United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 10

SEQ ID NO: 37908 - DNA, 276 bp, Glycine max
  Peptide Sequence Number=SeqID_154686
atgcagttccggtcaaaaatcaaaagtttagtaacaagagaacatacaatcaaatatgttagtctcggaaacaaaaggcagtgcaagcataattgttatgggatctacgccactgaagcaataggccataataataagcacaacgttcattcagaggcaaagatacctgcaacagttttgctggcccgacacagaacagtaggaggaaggaagtttagaatatgggttgcggctaaaggaggaatgcaaaccctagtgttgcaaattgagagttga

SEQ ID NO: 37909 - DNA, 538 bp, Glycine max
  Peptide Sequence Number=SeqID_154687
atgaaaacaacctaccggccagagtataagaggattggttgtcttagtagcgggagagtggtcaacatcaggttcagcttgcagaggaaaatgagtagaaaattgattttaggaaacaaagagaagaggtttggtagggactctttgggtggtgcttcttcagccaccgtagtttcatcgctgcttctgctcattgttcaaggggcgacgacagacgatgacatgcataaccccttggtgctggggttgggcagaggtcgagggacctcgcacgatgggttagagaatgctatggcgttgttaggtttctttcacgcttttgaatgccaagagacaccacagtgtgtggataagagcgtgagataccgtcggaggcaagctgaaggaggtgacacaatatggagaacgagatcattgcaatcacagctaaaagagaacatcaaagaccacctcaagagatgcaaccttttaagcacatcggaccgcaaatgggagagcgtatcgatggatttcatcactaccttgccaaggactccgg

SEQ ID NO: 37910 - DNA, 531 bp, Glycine max
  Peptide Sequence Number=SeqID_154688
atgcatgatgaaacttctgatacatctagcttaaacaagtggaggaggtgtagatgttctttccaagggaaccagagcgatgatgtcagaatatgctgcaccaaaactttgcacaagcttcaggatcattacaattggaagatggattggcaagggcaaaagataacagagcagttaatgcaactaataattgttgcatttgctgtgattgcatttgcaacaggatatcttatggcttctttccaaatgatgatccttatatatgttggtggtgtggttctcaccacattggatcctcatatatgttggtggtgtggtcttagttcagatggatttaacatttccatgggccttccaggagcatatactcagacattttgtcataagaagatgcttactgatttaggtattgccaagattagtgtagatgatactgctgcaactgctaaggcagtgctcttaaaggggagaaaagacattggagctattgcaggtcaagggcagcaaatatgtatggccttgacgttttag

SEQ ID NO: 37911 - DNA, 255 bp, Glycine max
  Peptide Sequence Number=SeqID_154689
atgatcagattcttccgtaagatctttaatggcagtccatcagcgtttaactcgaatccccttctagggatgcataatcgagctgccatttcctgtggttctggcttcgaacgacaaaacctggagtatactggaaagttctccccctcctcaagtattactagggtctttaggaatgagttcaaggtgtctgcatcgaatttcaccaaacgacctctcaccctcacctgcttaggtttatcctcggggtcatag

SEQ ID NO: 37912 - DNA, 387 bp, Glycine max
  Peptide Sequence Number=SeqID_154690
atggcttcctatggtgtggcgtctccattcatctttctccttctccattccgctgcaattagacctcaagaagcaaaggaatccattgataaagaagatccaaggcctacaagctccacatggagctacatcagaaggagaagacatacaattttgcctagaaaatggagaccgcatgcaatagctttaagagccctaaagaatcatgacaccatgtcctttgaagagctccttggaactcttaagttcatgaacaagaacttcagaaagatgaaagacttaagaaaaagaagtctctggctcttagcgtctagaagaccaagaaagcatcatcctccaaggattcatcttcaaaatcagcatctagaagctcgtccaaagctctaa

SEQ ID NO: 37913 - DNA, 606 bp, Glycine max
  Peptide Sequence Number=SeqID_154691
atggtcactacattaggcacattcttttccttagacgtagctttatgtgaggtcctcgttgatgacactggtgttagtgagatcaatgatgacctaattaacaatgttttcatccacaagctcagtagcagcttcaggctatgtgtcacaacctacccttcggcgggagggctaggcgagataaaaagtgcgtcttccaaaaaaggggagaacgcacgggagtcgccaccaacgtttattcgaggaaagtgggtcgacaagggtgttgcccttgctcctacgtatcctcaggcgagccagaagctagcctgggtgagccagggtccagaaaaagctaaaaatgacccttctgcccctcctcttggattgagaggaaatggaggtggacgctgcttggatgtagaggatggacgtcttcacgatggagataaaggagcatctagtgttgtttcactacttgatgatgaaggaggagagggaggagcccattccttttcaactatcttaggattagccttggttgctctgaacagggtgccataccctaatttcgtctggggactatcattcactgatgttttgattcttgctagccaaactgcgtag

SEQ ID NO: 37914 - DNA, 426 bp, Glycine max
  Peptide Sequence Number=SeqID_154692
atgaagaaaaaagtgaggagagaacacaacaacaatgagagaagtgctcacaaaagcgctttgatgcaatcctaccccgcaagggcattggatagaagactccaagtagaatgggccaaagatgcaagagaaggccctagggttcttatgagccttaggatttcaaagctcatttggagcacaaaatttcgtgctcttctctccctctcccttcattcatctccttcttcctccaagctcttatccatggcctcctatggtggggcgtctcctctctctcttccttctccattccgctgccattcatcttccaagaagcaaaggaatccattgatgaagaagatcctaggtctacaagctccaatggagcttacatcacgcttagtgggaggcaacccaggatttcttaccctatctctcttttag

SEQ ID NO: 37915 - DNA, 792 bp, Glycine max
  Peptide Sequence Number=SeqID_154693
atgaaggcgacaacagataaacaccgtcgagatcaagagttcgaagtgggtaattgggttttggtgaagctcaggccacatcggcaaacatcggtaacgggttcagcatattctaaattggcaaaacggtattatggtcccttccaaatcatagcacgtatgggcaaggtggcgtataaattgcttttatctgatcattcgcgtatccaacccatttttcatgtatctctccttaagccctatgtggcatcgacaaactcaagtgttgtcgcagaacttccaccaggggctatcgataaccaccctgttatcacgcctctagacatcttagcatccaaaatcattccttcagagacaggcccaaaacgtatggtattggtgcagtgggcaggactgacaccagaagatacatcatgggaggaatggtcagagttcaaatcccttcatcaccttgaggacaaggtgttgtctaatgggcaggggagtgttacgcagaacactgagggtgtgtccttagcaagaaagcagcaggagacaaatagcagcgagggtgtgccagtagcaagacccaagagaagaacggccatacccacttacttggatgattatgttcaaacgccattaagagttgttaggccgttaggatcaagagaaaaagctgcaaagttgaacgttgagaacaacaaaagagacatatgcagaatcgaagaaagcttctgcaaagcttgggacgaaggagggggtgatccagagggagataagatggttttgcaatgttcatacaaagcctga

SEQ ID NO: 37916 - DNA, 585 bp, Glycine max
  Peptide Sequence Number=SeqID_154694
atggcatatgcacgttcacacgcacttgctcagtcatcccaaagatgctcccctcttcccccatttcacacacgtccctcattggacccaatcaatgccacggagtcatcatctatggattggggtggtgatgattggggttctttatcatcatctaagaagagaaggaagaataaggtgtttgatgaagttcatggggagagtttggggaacgtggagaaggagaagctcttgggtgaagataaagatctcaaagaagagctggagaagttgttgggatcagagaaagagattaataataagcaattaggtgaaggacacgcttcggcggaacaagttctggctcgcttgatacacgctagagatcatgatgatgttcatcataggccttggaggctcgtgcttcagagtatacctgagcttgtaaggttgggaatgtgtgatttgtatattcgtcattctgcgagtaaaacctcaaaactagggaatcaagaagagaccaaatcaaagaagtttcgtgtactgtatcgttattcatctaaccatgacgcgaacagacctgtccagaagatatatattatctga

SEQ ID NO: 37917 - DNA, 408 bp, Glycine max
  Peptide Sequence Number=SeqID_154695
atgcaaaaactccaaaagattcagcaacaaatctatatgcagagctctattgctctaatcttggccaagctacgcattactgggcaatctgagaaaaagtcagattatcaaataagtgagctggaaccccttattcagggttggaccaagtgcaatacagatggagcagttaaaggtaatccagggaccgcaggttgtggtgacattttcaaaaatgagagaacatgtgtcttaggttgctttgttttgaatttgggaactcaaaactctttgtttgtggagctaacgagtgttatattagctattgggttgactgctaagaaaaattggaacaagctttggttggagtgtgattctgagttggtggcaaagcattcagaaacccctctctggttccttgaatgctga

SEQ ID NO: 37918 - DNA, 246 bp, Glycine max
  Peptide Sequence Number=SeqID_154696
atgaaaagtgagaaaaggggacttacagagaggcaggaggaagaggaagaggaagaggaagaggtggggcatggcgcagaaaagggaaagcagcattcaaggagagaacgaaaagcggtttgcaggtttcctgtgttttattttggcgccaactgtgtgatgtggcagttggtagatggcgtcattaataggatttggtataattcaaagcatatcgaccttgatacacctttacctagagaataa

SEQ ID NO: 37919 - DNA, 1137 bp, Glycine max
  Peptide Sequence Number=SeqID_154697
atgtacacgaaggcaaggatactctcttattcgtgttttggtgtaggtgcacttgaatcccttagcagtaatcatcgtcagggtcctgtacgactggatagccgtgtaggttctatgttcatcaaaccctcacctcttggttctccgcaaccctttcttcctctcgcaccttcacctttggctccattcactaataccactatcccaaagttatcaggactttgcactttgaactttactactgctgaaagtttgataagtgtgacagcaattgattgctgggaagtttttgcaccatttctggctaatgtaatatgttgtccccaattggaagccactctcacaattcttattggtcaatccagtaaacttaccaatgtacttgccttaaacgggaccgttgctaaacattgccttgcagatgtggaacaaattttgatgggccagggtgccactaataatctgaagcaggtatgttcaattcgttcttcaaatctcactgaggcatcttgcccagtaaaaaatgtgaatgatttttatgacacggtggatactactaagctccttactgcatgtgagaaaattgatcctgtgaaagaatgctgctaccaaatctgtcagaatgctatattagaagcagctaaagcaattgcatcaaaaggctctgatattttggccatagatgcaccacatgttcaacctgagcactcaaatcgggtcaatgattgtagaaatgttgtcctccggtggttagctagtaagcttgaaccttctcatgccaagaaagttcttagaggactgtctaattgcaacgtgaacaaagcttgtccactggttttccccaacacaaagcaagttgccaagggttgtgtggatgagataagtaacaaaacagcatgctgtaatgctatggaaagctacgtgtctcacttgcaaaaacagagcttcatcacgaacttgcaagctttggattgtgcagaggctttggcaatgaaattgaaaagatcgaatattactgcagatgtttatggtctctgtcacataagccttaaagacttttccctccaaggttctgttttctcttttcttgttagtatgctaagctcacactcaatacccataatattttgtacctga

SEQ ID NO: 37920 - DNA, 405 bp, Glycine max
  Peptide Sequence Number=SeqID_154698
atgacaggtacgaaaagaaaagccgtctttcctgtcaaactgatactaagagaatgcccacaacaattaactaagctctttgcgtcgcagcccgcaatccttggccccaactgcccaggactctataattcggcctcagcatgctttgtgagactcaaagagcgctactccaattctcgaattgacgaatcattaagggtcctcgtttacagaaacgaaatagatgtaaaaagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 37921 - DNA, 417 bp, Glycine max
  Peptide Sequence Number=SeqID_154699
atgtgcaagtttgagtttttccgtgacatcgtccacggcgaggccgtgacacacgcgcttctgcaccaagcaactctgggccacgtcccagtttcgctggtcggtgacgtagtgctgcagccagggcgagaaatcccctactccataccccaccgacggccccgcccgatccggcgcgttgtttctggtgacgaagagcgctacaatggtgaacgacgagaaggcgaggatgacgaagaacgttgcgaggaggtagaggtagagggcggcgttgacgcggcacagcacgccgacgaggccgagggtggagatgacgaatatgaagaggccgccgaagaggagcgggtactggagcaccttctggcagtcgccgtggacgcggatgtaggcggagtcgcccatggcggcgatacttag

SEQ ID NO: 37922 - DNA, 255 bp, Glycine max
  Peptide Sequence Number=SeqID_154700
atgagaaagcgcatgtatggcttcaatggtcaaattactgtggaggttggagtactccaaccgattgttcctgatggcgtagcagcccaagacatagatggtggtgacgagcacgagcacgcatgtattgaatatggtgagatgtctccactggcttctgatgttggccagcactcctcctttgcacgaatcgcagttgaaacacagtttgtcttgtctgttgctccatgtcctgcaatcagtgtcattcgctaa

SEQ ID NO: 37923 - DNA, 393 bp, Glycine max
  Peptide Sequence Number=SeqID_154701
atggagaagaagcccacgaggatgaggagatggccgatttgcttgacttcttgggagggagtggagatacgtgactgggagatccccagattcatgttgtctttccaaaaaggaagagaaggaaaattcccaatcaaagagtgggagaaagcaaaaagaaaagaaaggaaattcccaatcaaagagtgggagcaagcaaaaagaaaagaaaggaaattcccaatcaaagaatgggagaaagaaaaaaaaagaaaagaagggaagaaagctcctgatcaaggatcgaaagaaaacagaagaaatgtgcagagaggtctttggaccggacaatatctgaacaatacagaattgtcaccaaatgaacaaaaagaaggaaaggaatccacgacctaa

SEQ ID NO: 37924 - DNA, 477 bp, Glycine max
  Peptide Sequence Number=SeqID_154702
atgggaaaaccgaaaatgaagtttcgcaaaacgcagccaataatgcaagttcgcaaccctaacgcgaagctcgtcgtcgccgcgattccgctctccgatgagtctgcgcaggttgaagaatcgcgaggccagctgccggtgaagaatcgcgcgatttgtctggaagtcgcgattcatccccgatacagagattcaaccacgattcaggaacaaaaacgagacaacctcctattcgtatcggtagcagctggaatcgtatcgaatcgttcaatgttctatctcagtaaaatcgaacacgaattgcccctgcctccttctcgtcttgttcttcctattcgagaagctatacacatggagcttgagaagcttttcttagataaggttatagcaaacttgggcctctgcattagtgtctatgatatcagatcgattgatggtgggtttatcttccctggtgatggggctccaacctatacg

SEQ ID NO: 37925 - DNA, 426 bp, Glycine max
  Peptide Sequence Number=SeqID_154703
atggattctagaaaatccatatctggatattgtttcttcataggcaaatctttagtgtcatggcgtgctaaaaagcaagcaactgtgtccagatcatcttcagaagcagagtacagggctctgtcttcagctgcttatttgagagttcagcttaccagaactccaactctttactgtgacaaccaaagcgcagtccacattgcctcaaatccggtttttcacgaacgcacaaaacacttggaaattgattgccatcttgtgcgagagaagcttttgaagggcactctaaagctactaccagtttcaacaagtgatcaagtggcagattttctcaccaaagcattggcaccacccaaatttcatgattttgtctccaagcttagcatgatcaacatctaccatgataagcttgagggagggtgttga

SEQ ID NO: 37926 - DNA, 390 bp, Glycine max
  Peptide Sequence Number=SeqID_154704
atgattaagggattcctgatgagctctccagtgagaccaagaggattaaccattggattctatgatgatatttatattcctgcaagtcgtttgcccgacccaaaccactttgttgagactgaaccgaaaaaaagggtatcctctggccaagagtcaacggctaatccctcaagcaagaaaggcatgtggtattgggattatgatgaacaagaatatcctattactgatgtgatcaaattccgagttactaatgtgagttatccccaaattccagttgaacaaccaaaagaatcaaagccatttgcccctatgttggtctctggagcgatagatgatgatggtctaggccctatttcttggtggtttggagatgaggatgaggacgagtaa

SEQ ID NO: 37927 - DNA, 231 bp, Glycine max
  Peptide Sequence Number=SeqID_154705
atgaaggaatcgcacacctttgttataactcatatgcaacgcatttcacttgcttgccgtactcgccacactttattcaatgttattacatattttattcttgtaattcaaaagctcggggaacctctgtgggaagcacgtgcctcgtggatggaaaatcacgtggaaatggtgacccatgtggagcttcggctttgtcaaccaatagtgataaagtcttgtgtagcttga

SEQ ID NO: 37928 - DNA, 2267 bp, Glycine max
  Peptide Sequence Number=SeqID_154706
gcacgtgagccgttcgcgtgcgacccaaaaaatggcggcacgaagaagatggcgttttgcaaggtttcgctggcgatagcggagagggtgaaggatctgattggaaggttgacgctggaagagaaggtaaggcttctagtgaacaatgccgcggcagttccgaggcttgggatgaaagggtacgagtggtggtctgaggcactccatggtgtttcaaatctgggtcccgccgttaagtttaacgcacagtttcctgccgctactagcttccctcaagtcatcaccaccgctgcttccttcaatgcttctctctgggaggcaatcggacagccttgcgctcacagtcacagttatggaacaccgtgcaatgtgcacggcgaggcagccatgcatttaattgtgctgcttgacttttcttgctcacgggctagggtagtgtcggatgaggccagggccatgtacaacggtggaacagcagggctcacgtattggagcccaaacgttaacattttcagggaccctaggtggggccgtggacaggaaactcccggtgaggaccctgtgttggccggtacttatgctgctacttatgtcagggggctacagggaacccacgctaaccggttgaaggttgctgcttgttgcaaacatttcactgcttatgatcttgataattggaacggcatggatcgattccactttaatgcacaggacatagaggatacattcgacgtgccattcaagatgtgtgtgagcgaaggcaaagtagccagtgtcatgtgttcttataatcaagtcaatggggtccctacctgtgctgaccccaacctcctcaagaaaactgttcgtggcctgtggcaacttgacgggtacattgtatcagactgtgattctgttggggtgttttatgataaccaacattacacaccaacgccagaagaagctgctgccgatgccattaaagcaggctacgaagctgatgtcaatggtgctttggtgaatacactgacggtccaaatgaggttagggatgtttgatggagagcccacggcccatccatatggtcacttgggcccaaaagatgtgtgcaaaccggcccaccaagaactggctcttgaagctgccagacaaggaattgtacttcttaagaacactggtcctgttttgccactctcctcacagcttcatcgcaccgtggctgtcatcgggcccaattctaaagctactattacaatgattggaaattatgctggtgttgcttgtggatacaccaaccccttacaagggataggaagatatgcacggactgttcatcagttgggttgtcaaaatgtagcctgtaaaaatgacaagctgtttggacctgctataaatgcggcccgtcaagcagatgcaacggttttggttatgggcttggaccagtccattgaagctgaaacggtggacaggacaggcttgcttttgcctggtcgtcaaccagaccttgtttcaaaggtggcagctgcctcaaagggaccaactattttggtcttaatgtctggtggtcccgtggatataacttttgcaaagaataaccctcgaattgtgggtattctgtgggctggttatccgggccaagctggtggtgctgccattgcagatatcttgtttggaacagctaacccagggggaaagctgccagtaacatggtacccagaagagtacctaacaaagttaccaatgacaaacatggcaatgcgagcgaccaaatcagcagggtatccaggaagaacgtatcggttctacaatggtccagtggtgtatccatttggacacgggttgacatacacacactttgttcatacactagcaagtgctcccacagtggtgtcagttcccttgaatggtcatcgccgtgccaatgtcaccaatatttcaaacagggcaattagagtgacacatgcgcggtgtgacaagctctccatcaccctccaggtagacattaaaaatgtagggtccagagatggcacgcacacgttgttagttttctctgctccccctgcaggttttggtcattgggcactagagaagcaactagtggcctttgagaaggtccatgttcctgccaagggtcaacatagagttggagttaatattcatgtgtgcaagctcctaagtgtagtggataggtctgggattaggagaatcccgttgggggaacacagttttaacattggtgatgttaaacactccgtgtcacttcaagctgcagcacttgggattatcaa

SEQ ID NO: 37929 - DNA, 954 bp, Glycine max
  Peptide Sequence Number=SeqID_154707
atgatggaatcccagaaccagaacctactacgccaacccttgataaactcaacgcatcatcatcatcactctgctgattcccgtctcgaagaggtcctctctgaccccaccctaccctggtccaagcgcatcctctccgccacatggatcgaactcaacctcctcttccccctcgccgctcccgccatcctcgtttacgtcttcaacaacctcatgtccaacgttactcgcgccttcgccggccacctcggaaacctcgaactcgccgctgccaacctcggcaacagtggcattcagctcttcgcctatggcctaatgttgggtatgggaagtgcggtggagactttatgtggacaagcgtacggagcgaacaaatatgaaatgctagggatatacatgcagagagcaattatcgtgctaaccataacagggattcccttaacggtggtgtacattttctgcaaaccaattcttctcttgctgggggagccaccggaggtggcatcagtggccgcgatgttcgtgtacggtctgatcccgcagatcttcgcttacgcagtgaacttccccatacagaagtttctgcaggcgcagagcgtggtggcgccgagcacatacatctccgctgccacgctggtgctgcacgtggcgctgagctgggtggtggtgtacaagttagggtttgggatcatgggttcgtcgttgatgctgagtttgtcttggtggatcattgttggggcacagtttttgtatgttgttagtgcttcaaagtttaaggatacgtggagtgggtttagtgttgaggcattctctggactctgggattttgttaagctatcggctgcgtccgcggtgatgctgtgtttggagacttggtattttcaggtgctcgtgctcattactggcttgcttgataaccctcaactctctcttgattctatctcagtttggtaa

SEQ ID NO: 37930 - DNA, 272 bp, Glycine max
  Peptide Sequence Number=SeqID_154708
atggagcaacttaaaggatttgctaaggacaataaaaggtatgatgagttcatgatgatgatgggattcttgagaattggtgctggttcaaggaaggaaaacattaagaaactcaaattcgagtttgtttatgagtttgaaatgaaggagcttaagattgttgagaggtttagaatgcacatgtctaaacctgtggcaactcccttgggaaagcttgatttggatcatggtgtaagtgtgaggacatcaagcaggctctgtggcttagaggg

SEQ ID NO: 37931 - DNA, 306 bp, Glycine max
  Peptide Sequence Number=SeqID_154709
atggtttttacaggattaggatgtgatactagcgctgtcatcaaattacttgctgatccagatgctacacagcgtgcctatacccaagaggcatacaaaaaacatattccagggaccttgttgaaagagctttctggcaagttgaagactggagttctgctctggatgcatgaccctgccgaacgtgatgcaataatccttaaggagtctctatgtggggccaaaaatcttgacgcagctactgaagtcatgatgttggcaatcttcatcccagctgcaaggtttaaggcagatgtaccattttaa

SEQ ID NO: 37932 - DNA, 456 bp, Glycine max
  Peptide Sequence Number=SeqID_154710
atggaggagaaagattggaatgatgacagcctcaccatgaccaccgtttctcatcactgtttcagcgatgattctaaagcaccaagtttctccatctccatcatcgagaacatgaaggacgaatatggcctattcctatggccctgcaacgtagttctcgtcgagtatgtttggcagcacaatcatcgattttcaggagccaacgttgttgagggaagtttgccattgataagtgattacattgggcatgtggtgttgggattgacatggggagtttgggattcatccatattcagtttacaatcaacaattattctaggggctgatgtgctgtatgattcaaatgcctttgataacctctttgccactgtgactttcctgttccgaaattctcctgggtcaacttatataacctcatatcataacagaagagatagctcttatctcaaaagataa

SEQ ID NO: 37933 - DNA, 192 bp, Glycine max
  Peptide Sequence Number=SeqID_154711
atggcacaatgggaacgagtacgtcggagagtggaagaacggtgccatctcggtaatagtaataataagagtgtgagttttcccagaatttgtatttgggagcttgatggtgaagctggggatatcacttgtgatattgtggaggcttctatgatttatggtggaggaggagtgtgtggaagtgatgtatag

SEQ ID NO: 37934 - DNA, 261 bp, Glycine max
  Peptide Sequence Number=SeqID_154712
gcagtaaagaatgaaacatcaggaaattatgctcatgcacttctgacaatagttcaatgtgcagagaatcctgcaaagtatttcgcaaaggtcttacgcaaggcaatgagggtgatagtaacaagggctgagattgatttacagtatatcaaagctgaatatttaaacaattacaagaagccgcttgacggtgcagttcactcagtaacatccggccactacagggctttccttctcgcactcttaggtcccgaccagtag

SEQ ID NO: 37935 - DNA, 1748 bp, Glycine max
  Peptide Sequence Number=SeqID_154713
ctttgtatagagctgagccgtggaagaggctgcgtccagggcacttgtttggcgtccgggttgggaaagattcggattggcctggcaagaaacaaccttttccatgtgttcagttcattggaggggatggaggagatgttggattttacatgtttagatcagagaatgatgctaagaaaatgacagggtctagagagaccattcatgttccaaatgttgagcttctgagggtcacatatgaagtggagtctttgatgttcccttctaaccggaagatgatcaagtctttgtcattggaagcatcaggctcagatcggtttccagttattgatgttgcacgatgcacgccatctggtgatcttcgatttagaaatccaaaccttgaagagcttagatttgtctatgcattcatgaaggccatttccctggtgcactccttacttcaggttgacagggaaagtggtccaaagtattcaacagtggtgtgttttgaaccttttatagagactgttgatgttcagtggcctccagaagtagccaagggaggttatgaccttgttgctgttactgtttcccacccacccggtcaggcatatgatgaaaaatctaatagtgcgagtgctggctcgacccccaccaagtatgtagaaccacctagggaggacatattcaatgacacaaaagcatactcaagtactggcttgagacagtgtgcaatatgtgagaaagaagtgaatggagaacagtctctttgttgtggccggtgtagagcagttgtttattgcagttcaatctgccagaaacaacactggaatgacacacataaaagcatgtgtggactttacaaggccatgatggagagggaagaagagctggctataatgattttcatgttcccatgttctgctgaccagccttgtaagtggcttgaatcattaggtgtccaccagaagggtatgtggaggagaaagtgcagttgctattcacactgcccttttggtctccttcctgtgaaaggtgggctgcaggaactatggggtggaattgatgaatttgaataccctcatgattctccatttaataaccatttcatctcaagcccatttcttctctctggttggtctgagtactacaaccttcgctcacttccattgtcaagtcctgtagccgacattctttcacatccattgaccgtgtatcacattcttaccacccttaatataagttcaaagaaccttatactgaaagggaaagaggtgattgtccactaccttggacctgaaggagagttagattggatgccagcattcgcagaagtaggacacttgcttaatggattaggcaatgtacaaatagtgatggtgggaccagaagttccaacaaatttgtcaggtacaacctcaggaattggtagcagagttagagtgaatcttgtaaggggtgtttatcaggtggaagcctcctacctacctactccacatgtcgtcattgctctgaattctagattagcaatctattctagttggggtggagctcttgatgtaatcaaatcaattggggtgcctgccttcttcactgatcaatccgaagtttcgtgtgtaaatgctaaacaagttcttcggaatgctggactgcacatcacacatccagtaactccaaatcctttccggtcacctgtgaaaaatctcacagcttctagcaatcttccttcatacagcaatggttttgtctttggggtgaatacttga

SEQ ID NO: 37936 - DNA, 951 bp, Glycine max
  Peptide Sequence Number=SeqID_154714
atggctcaagcggttgaagaatggtataagcagatgcctgtcatcacgcgctcttatctcaccgctgctgttgtcaccaccatcggatgttcccttgatataatttctccgtatcatttgtacttgaaccctagattggtggtgaagcaatatcagttttggcgtctggttactaatttcttgtactttcgtaaaatgggtaaaatttctgccgttcaccatttagtgaattgttattcatcagatacggagggagcactagtgaagaaaggctattgctatagatgggtgtggtatgcaatccagattgcaacctatcctcttagaagtaaaataagagggagactgaagtttgcagtgatgaaaattgtgcatcttctaaatttgacatggtattttcttattgaatgggcagacttggatttcctgtttcatatgttttttcttgcccgttactgcaagcttcttgaggagaactcgttcagggggaggactgctgatttcttttacatgctcttatttggtgccactgtattgactggaattgttcttcttgggggcatgataccttatttatcagagtcgtttgcaaaaataatattccttagcaactcattgacatttatgatggtttacgtgtggagcaaacaaaatcccttcattcacatgagcttcctgggtctctttactttcactgctgcctaccttccatgggttctcttggggttctctgtactcgttggtgctagtgcttgggtggatctactggggatgattgctggtcatgcatattattttcttgaagatgtttatcctcggatgacgggtcgtaggccgctaaaaacaccatcattcatcaaagcactatttgcagatgacccagttgttgtggcacggcctgctaatgtcagatttgctcccccacctgctgaagaacttcaccaagattga

SEQ ID NO: 37937 - DNA, 373 bp, Glycine max
  Peptide Sequence Number=SeqID_154715
atgagtgatggattttgcggtactcatttgcagatcatggttaggaccagaggattaggtcgtgccttaggtcaggtcgatgagccagtcatccctgacccagatgttcaggatgacccgatggaggcaccagctgctgtggaggacattcctctggacattcctgcggacgcaggtgcagaggcagttgaggatcaaaatcagggatttccgggtggtccgagcgacccatccgtgttgacagcgtatgcgaatcatgttgcttgcaacatatggacaggacaggagcgtcctaaattgaagctatcctctcatgggaggaaggtccacagtttaggcaggtctgtccctgccattgagggacttattactg

SEQ ID NO: 37938 - DNA, 117 bp, Glycine max
  Peptide Sequence Number=SeqID_154716
atgattcagattgagtcccctgacagatcacttcatgaccatataattgaagcccttggcaagctcactgttgaacaaggaattccttatgttaccaaaaaagtcatgagaaattaa

SEQ ID NO: 37939 - DNA, 120 bp, Glycine max
  Peptide Sequence Number=SeqID_154717
atgaagatttgctacaaggaagctaagccttgccacaacaattctacaaagctaaagaccttggagttgaaaggaactcacccaacgaattatgcttttgctgtagtgaaaatcatctga

SEQ ID NO: 37940 - DNA, 480 bp, Glycine max
  Peptide Sequence Number=SeqID_154718
atggtctggcctactaccatgcctgaacattcgacgcgccaaacctctctggagcgtttggaagaggcggtgaacaagctcacccagcaccaagccacattagcccaaaatcaccaaacacttacccaagccaatgcagacctcaactccaaactcgattcaatccttgaccgactagccaccctcacaaccacaagggtcttcgatgccgaacgcctcactgtggcctctttctacatggaaggtcccgcgttgtgttggtatcaatggatatccaggaacggtttcctgacatcctggcaggctatgctccaggccctggagtcgagattcgctccgtcatactacgacgacccttatggggcacttttcaaactccaacagcgcgacaccgttaatgaatacctctccgagttcgagctcctcactaatcgcatcgccggcctcgctcctcctcttctgttgagttatttcatctga

SEQ ID NO: 37941 - DNA, 393 bp, Glycine max
  misc_feature (35)..(35): n is a, c, g, or t
  misc_feature (187)..(187): n is a, c, g, or t
  misc_feature (201)..(201): n is a, c, g, or t
  Peptide Sequence Number=SeqID_154719
ggagaagctcgccggagtggtgccggagccggtancggcgatgatggagggttccgcctggcggaggagccactcgatggtctggccgtcggacttgtggccgagctcgcgcgtgagctggaagacgcgggcggcgcagatgatcggcatgcgaatgcggcgcccgcggccgtcgaccttgctgtgncggtccttggaagncggtttcttgacggcgagggcggcggcggcggcggtggtggtggtggttcgctgctgtacttaaatacgctgaggcgaagaaggtggaactgggctgtggtgggtggcacgatggctgcgacgacgatcgctaagcttgtccttctagagtttagcgagagccatggcttgcggccagcacatcggttgtaa

SEQ ID NO: 37942 - DNA, 1359 bp, Glycine max
  Peptide Sequence Number=SeqID_154720
atggataatactagcatgcttcaaatggtttcaagcttggttctgattctaagtgtttcatcattggcttcggcatctctgaaagtgggtttctacagctccacgtgcccatctgccgaggaaatagtgagaagcacagtaaacaaagcaatttcagacaaggccggcatagctgcgggtctcataagaatgcatttccatgattgctttgtcaggggttgcgatggttccgtgttactagcatctaccccaggtaacccagtagccgagagagacaattttgccaacaatccaagcttacgtggcttcgaggtgattgaggaggccaagacccaattagaggctgcatgccctcaaacggtatcgtgtgcagacattttggcattcgcagcaagagacagtgctctcaaagttggtggcataaactacgacgtaccatctggacgccgagacggacgcatctccattgctgatgaagtgccacggaatctgcctgcgccaacctccactgccgatgaacttgttagtaatttttctcgaaagggcttgtcagcagatgaaatggtgacactttctggagcgcattcaattggtgtgtcgcattgttctgccttctccaagcgcttgtactctttcaatgacacagtcacacaagatccctctatggactcttcatatgctgaaacgttgaaaagcatttgtcctgcacctccttccaccacagattctacagtgtctcttgatccttccacacccattcgtttggacaacaaatactatgagggattgatcaaccaccgtggcctcttgacatcagatcagacgttgcacaccagtcaaaccacaagggaaatggttcaaagcaatgccaacaatggtgcaagttgggctgagaagtttgccaaggcaatggtgcaaatgggttccatcgaagtgcttacgggatccgatgagcgggaatttttccctttggcggctgccatgagtaacctatgtgaatccggaacccctatttccaatgttcaaaccctgagttttgcaccagaacctactgctattctgtatggtgtgaagcttaatggtgcaaattatcccctttggtcccaagttgtcgagatgtttgttgctggtcgtggcaaattgggttatttaactggaaaaactcaagacccctctacgaatgatgcttcatatgagagatggactgtggaaaatgctattgttaaaggttggctcatcggtgccatggaaaccgatgtaatgaatctgtttgtttgtcttcgcacgacaaagagtatttggactgatgtctctcaaacctactatgaaggagctgatagatcagttatatatctatga

SEQ ID NO: 37943 - DNA, 222 bp, Glycine max
  Peptide Sequence Number=SeqID_154721
atgagggaaggtacaacactagaggaacatcttgatgagctaaactttgttcttatagagctatgtgatattgatgtcaacatggaagacaaagatctggcaatgattttgttagccactcttcctccctcctataagaaatttgtgagttttgttagtgtaggcaaggattacattacacttgaagaagtcaagtacaatctctattctagagagctttga

SEQ ID NO: 37944 - DNA, 228 bp, Glycine max
  Peptide Sequence Number=SeqID_154722
atgtcgcggaacttcacggattgcctaacgatgggtgtcaagtaccgaagtggtcaagcaagggtcgcaccccaacaaatagatggtccccaaacgaaattagggtgcggaatgagcataatttgtctctgcgtgccatcggacacgattgtctctgaacgacgaaaaggtgtgcggaatgaccataatttgtctctgcatgtcatcgggctcgccgcctctggatga

SEQ ID NO: 37945 - DNA, 273 bp, Glycine max
  Peptide Sequence Number=SeqID_154723
atgcaaaacccgtgggtgtttgcgtttttgaatgagggaggggagttttgggtggagagaaactccccctcccctcgtttttatgtttccaggtgcaggggtgctcgcccaagcgagctcagctcgccctggcgagctaaccctgtatttttttttagggaagacacaggttgcctcccagctgcgcttcccgcttgtccggagctgggcatgggccgacgatccatcgatcatgggcctagcctctactcgcgtccgtccctaagtacctga

SEQ ID NO: 37946 - DNA, 600 bp, Glycine max
  Peptide Sequence Number=SeqID_154724
aggactacacttcctccccttctgagggttgtatgcccttgccttcaaaggactacacgtcctccttttcagagggctacgcgcccttaccttcaatgggctacacgccccccctttagaggactacacggcctcacctttaaagggctacatgccctcgccatcagaggactacatgccctcgccatcagaggactacacatccttgccttcagaggactacacgacctccccttcagaggactacacgtccacctcttcagagggctacacgccctcgccttcaaaggactacacattttcacctttagaggactacaagtcctcatcttcagagggctacacgccatcaccttcagatggctacacgccctcacctttagaggactacacgtcctcgcctacatagggctacacatcctcgcctttagagggctacacgtcctcgccttcagaggacttcacgtccctgccttcagaggactacatgccctctccttcagaggactacacgccctcgcctttgtagggctgcacgccctctccttcataggacttcatatctgtgccttcagagaactcaaggtcctccgcccttaa

SEQ ID NO: 37947 - DNA, 811 bp, Glycine max
  Peptide Sequence Number=SeqID_154725
atggacagcattcgtttattttataccttcaattcgaatgtaattccggtcatcaataaaacagaaaaatatttaggatatatcatgtgtgaagatgtctttcaggatttatcacgctatcctttgttttctgaatcaggagctatacttactgtagaagctcccgcaagaaaatattccatgacagaaattgccaatattgtggaaagcaacaattctaaattctacggtggatttatcagctttatgtcggaagaagtggttagggtaaccataaagatcagcaatgaaaatcttgcatctattgatgccacgttcgaccgcaaattcgtttcagagcttgagagcaggggcgtaaaatctgttttatacgatgaaatggctgaagcccttcagttttcaaaaattttcgaaacctttaataataaacaggatcttgtagagaaagaagttgatctttttttcacattcggaggagacggaacgatagtcaactctttaacctttattgaagatctcgaaattcctattgtcggagtaaatacaggaaggttgggttttttagccagctttaccaaggaagaagcattcaaagaacttgacgcaattctgaaaggagatgtaaaaaccagccgacgctctgtgatcgaagtggtttccccaagatctgaagaattttttccatacgctttgaatgacgtcaccgtttcaagaaaagaaacaacgtccatgatcaccgtagattcatttatcaatgatgaatttctgaatgtattctggggagatggtgttattgtctccactcctacag

SEQ ID NO: 37948 - DNA, 600 bp, Glycine max
  Peptide Sequence Number=SeqID_154726
atgaaaaatttacttgtattcgggatgctaacctctgcttttatactatcaaaagctcagaatacatattatccacaggccttctttgataaaaaactggctcaaaacatgatcggttttggaaattctaccattgaaggagtggcgtctaccaaacaaaaaaacaactggggaatcaaacctttactgggggaaaaacattatgcaccaaaaggaacagttgttatgctttttcctgtaaccccttattttgaagagttttataagatgaggaaaaagtatgagaataagaaaacaaccgtctacatgtctgatgaagcttttaaatacagaatagaagctctgactgatgatcatggcagatttaaatttgaaaaattaaaaccgggtaattattatctcgagacgattgtgaattttactgcaacggcaagttatcagcagcaaacaggacagtcggatgcttataatgcttacggaggatacctttattcaacacctatataccagacttttttctataactattcgtcggcaaatcgcgaaagtaaatttgtagaaatcaagcaagatggcgaactaaaagaaatcaacctctaa

SEQ ID NO: 37949 - DNA, 936 bp, Glycine max
  Peptide Sequence Number=SeqID_154727
atggagtgtgaactcactaaggctttgattggaaagggtgtcatgaatttctccgaagtggagcatatcatcctcaaatataaccgttccctaaaagaagttttcaagctgttcgacctaatccacattctcaccactgatcacaacactgttacaagaattaccagagaagttattgaggattttgcatcagagaatgttgtctatctggagttgaggaccactccaaagaaaaatgattctgtgggaatgagcaaacactcttatgttgaagctgtactgaaaggtctaagatcaatcacttcagttgatgtggatttcattccacattgtgaagattcaaagactctttttactcctgcaccggttattaatggacatgtgagaaaaaaaatctttgttaggcttctcttgagcattgacagaagggagacaacagaagctgcaatggaaactgtcaagcttgcattggaaatgaggccttatggggtagttggaattgacctctctggaaatccaagtattggtgattggaccacatatttgccagcattgaaatttgctcgagaacaaggtctttatgtaacacttcattgtggcgaggttgaaatttgcttgacatcaaacgttaggacaatgactgttccatctatagatgttcaccactttgctcatttgtacaacgcaaaacatcctttagccctgtgtactgatgactcgggagtcttctctacctgtctctccaaggaatacaaaattgctgctgattcatttgggctgggaaggagggaaatgtttgagctatcaaggaatgctgttgagcatatattcgcagatagcaaagtaaaggaggatttaagaaaaattttcaattcagtggcaaaaaaatatggaagtgtaaccacagtttcatctttagagaatatctgcatttag

SEQ ID NO: 37950 - DNA, 573 bp, Glycine max
  Peptide Sequence Number=SeqID_154728
atgaaaatagctgagggagcagctagaggacttgaatatttgcataacagtgcagaaccagctattatataccgtgattttaaatcatctaatatactattagatgaaaattttaatccaaagctctctgattttggacttgctaagattggtccaaaagatggtcaggaccatgtgtcaactagggtgatggggacttttggttattgtgcaccagagtatgctgcttcgggtaggagggtatttgacgcttcaagagctacagaagagcaaaacttgattgagtgggcacaacctttgtttaaggacagaacgaagttcactctaatggctgaccctttgcttaaaggtcagttccctgtgaagggtctatttcaagcccttgcagtggcagcaatgtgtctccaagaggaagctgacacacgaccttacatggatgatgttgtgacggctcttgcacatctagcagtgcaaagagttgaagaaaaagacacagctggtgaatctgtaaaatgtgccgggcatgttgaatattttaaagctataagttcagctggatctgagagggcgtag

SEQ ID NO: 37951 - DNA, 318 bp, Glycine max
  Peptide Sequence Number=SeqID_154729
atgtatgaagccacgtgtcgtagaggtcggcgacaacctccttgcagcgttgggcgccagtctcctcaggtttttcctccaagacatctttcttgcggatttggttgtgcatgtcctacttgttcttggcagcgagcttcttctactcgtgacggtccatgccggtgtggaacccgtggccaaagagaagctgggccttgtgggggttatagtaaagggagtttcgccaatcgggcacgttcgcgggtcggaggaaatcctccctctccaactcatccaatccctcttgatgtaactaattgtgttctccggttgtga

SEQ ID NO: 37952 - DNA, 381 bp, Glycine max
  Peptide Sequence Number=SeqID_154730
atgagtgagatagaagagatacatgaacagatgaaggccgacatgaaggccatgaaaaaacaaatgaccataattatggaagccatgataagtatgagaaaaatgatggaggtcaacacggctacaatcattgccgcaaggaggcaaagcgttgggaagtacgggtgtcccccatttttttgtaggttcaaaactagcattccttcccaccatgtggattgcctcccaactatacactacccaacattgtacacgctctcgatgataatgtcgacaactccacacccatacccattgggagccaacaaccccaatctgatcatgaacatgtctctcaacctatggggaagacacatgaagtaccccaaggccacactttag

SEQ ID NO: 37953 - DNA, 316 bp, Glycine max
  Peptide Sequence Number=SeqID_154731
ggtacatcctttgtggtgcaagtggagggtacatctacttgggttgttggctgagaacaagagagggtacatctcttgtggatcagttctagtggagggtacatccactaggttcaaagagaacaagggaggtttttctttgaataaggctaagcgcaactattgcactaagcccttgttgtgtgttgaggaggttgaggctaagcgcgccctatgcgctaagcttgagtgtcattctgatgaggctgagctaagcgcggcatgctgcgctaagcttaaactctcttctgttttgaaaattgtagactcaggctaa

SEQ ID NO: 37954 - DNA, 144 bp, Glycine max
  Peptide Sequence Number=SeqID_154732
atggagcttgacttgatggggcgagttcttgttaactccaaggtcttcctctttgtagaatcatcatggcgaggctcagctaatcaaggggcctattttgttgcggcaaaaacacatctcatggtggcgagatcatctttgtag

SEQ ID NO: 37955 - DNA, 166 bp, Glycine max
  Peptide Sequence Number=SeqID_154733
gaacctaatggaaaggatccaaaagtccacttctagtaacaactcccaagtgtggtttcatgcaacttcattggcttctagagatatcatcctcttaggtaacaacattgtggcagtaggaactaccaacgacaatgcctcaccaaacgaggaaaactctaggtga

SEQ ID NO: 37956 - DNA, 441 bp, Glycine max
  Peptide Sequence Number=SeqID_154734
atggcccaggcgagcgggatgctaacctgggcaagctggggtctagagaaattgagaaaaagacccttttgcccccttccttggtatccttttgtattcttgatcaaaacactgcgcgatcatttgctttgtgcgatgataacaaaagatgatgacaaaggtgatgacaaaaagctcaaaggtcaatcaaagaatgagttcaagatgttcaagatagaatcaataacacttcaagattcaagaggaaggttgaattcaagaatcaagaatcaagattcaagactcaagattcaagaatcaagaaaaggcttaatcaagataagtatgaaaaggttttttcaaaaactgagtagcacatggatttttctcaaaacatgtttaccaaagagtttttactctctggtaatcgattaccagattattgtaatcgattaccagtag

SEQ ID NO: 37957 - DNA, 471 bp, Glycine max
  Peptide Sequence Number=SeqID_154735
atggagaacgagaagaagaagtgtggttgttgggctgtcctcaaacgcggcattagagggttcaaggaaatttggaaaaagccatgcacaccagttgtctctgaaaaagccatgcaaggaaatttggaaaaagccaggccattctggcttttgggtggaagagtgtccttcacctttcagatcgcactgttacaaggtaccgaagccaaggaagaagagggtccttgccacatgggtgcttacatggacaaagacttgtcacatagacatatgactaacagtggaaattggattttaacggtaaagacttatttgcataacggatgtaaagatagagactattttttacatttcaataagatagagactaatttgaaaaatggctacaaagacaaggaccaaaatgcctattcactcttctattttatcaaaatattaaatgctttccctcaaacagtggtggttgattga

SEQ ID NO: 37958 - DNA, 567 bp, Glycine max
  Peptide Sequence Number=SeqID_154736
atgaaagatgatgagaaaagaaacgtgcaagatgatcaaaaagctaaaaatattttaacttctggtttatcttctgatgaatttttctgtactgcaagaagatatagaaaagaaaggaaagggattgcactcaaggctagttcctcaaaggaagaccacaaagaaggctctattgatgatgaagatgcagagaatttgaatttgattgtcaagaagattggcaaattcctcaaaaggtcgaaagacaaaaaaatctctaaaccttcaaagaaggtggaaaccaacaacaacaccttcaaatgcttcgaatgcaggaagcaaggtgatgcaagctccattggagcttgtaggcctaggatcttcttcatcaatggattcctttgcttcttggaagatgaatggcagcggaatggagaaaggaagagagagaggaggtgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 37959 - DNA, 228 bp, Glycine max
  Peptide Sequence Number=SeqID_154737
atgatgctccaaactctagatccactagctaatgtagctccatgtagagcttgtaggccttggatcttcttcatcaatggagtcatttgcttcttgaagatcaatgacaatggaatggagaaggaggaaagagataaattaggtgcaatagatggaccaatctgcatatttgcaagatcatccttaagatttgatagctttctatcgaacgtaaagtccatgtattga

SEQ ID NO: 37960 - DNA, 795 bp, Glycine max
  Peptide Sequence Number=SeqID_154738
atgaccataaattggagaactatacaggctttggaaaatgatttctatacaaaagatgatatagaagaagaagttggcttcattgcctatgtggaagttttttctagggaagagcataagaaaaagttggatgaagatgcaaggttgggtgccttggtaggaaaggtttctaaagaaattccaaaagttgttattttagagtctttgaagaccttgtctattgaggaggttcataagaaagcggcaaacaaggccatcatggttgatggtgagctagtgtttgaggaacatggagctaaattgatttttgcagatgttgttgcaaggcaagtagaagttgaaatggatatcattcttgaagacttggacccagaaaagaaaaaagctcttgaagaagctatggtctggtctattatagaagcttccctcaatgaaattgaggatagcatcattgagacaaaccttggtgttgcacctgttagacccataccattgtctaaaactgatgaaaggaagaagtacaagctagatcaacaacatgccattaagtggttacttccctcaagatctttacctccaccatcacctctaagagttgttcctattgagcctgatgtgaatgtcagatactacccttgctttaaaggatataaagtgttggagtggcacacttgcaacagagtttggaaagaaaatgtggatattgggactcactcttcatccagagatgcaacaattggagttagaaaaactcaatctcaccaagctctggaagacaggttttctatgtattaa

SEQ ID NO: 37961 - DNA, 714 bp, Glycine max
  Peptide Sequence Number=SeqID_154739
atggtagaacatggcagaaggccgaaattctgccatattaacatgtcattgtgcgttatggtgccaccgtggtgggcctcccttcacaaattgcctatggcagttggcaaaaaatccgccacagcattctgccatggcggcgccatgctacaacttagatcatgctggaagtatgccaactgggattatgtttttcccatgaatgtaaaggtggaagatctcatgaaagcaggagcaaatttaagagcaaaacttggattacgtccacgaacgcagaataaaaagaagttcctaacaagttggtctgacttgccggatcatcaattgggttggagcattggagaaaaagctgtcagtgagcaaggactgcaactggtggaattaaagtttgatatgaactacatcaaagattttctgttacagatgaaaaacaagaagtcatcatatattgaggaggacaattctgtgaataaaaatgagaaaccagtggaagaattggaggagattggagaatccaaggaagaaaaaaattttcctcttcgttcttgggtcaagaaggttgaattacctgcttttgaaggtaatgacccacttggatggttggcgagacaggaaaaattctttgaagtacagaagatcgagccttcagataagctaaaattggcgtcatcaacatggagggtaactgatagaagggggaaaggtgtatgttag

SEQ ID NO: 37962 - DNA, 597 bp, Glycine max
  Peptide Sequence Number=SeqID_154740
atggtgttgccgttaagccttccgaagtcaaggcaaaatgtcaaaaagaatgttgaataccgagcaatccggacacatcgaaaatccataaaactattgacaaaaaaaaaagtctctgtcgagtatggattgtgcgaaatgatgaacagcaaggctatccgtcccaatgttgcccccaaagatggaaacatggggtttgatgtagcagtttgtgaagccatgctcccagctgagatagtggataaaaatgttgaaaggatgtgtaaagagttgccccagtgggaagaatcagttctgcaagcaggggcaagatatcagcagttaattaaggaccttgcagataaataccctactgagaacttgctgcttgttacacatggggaaggagtcaaggtagctgtttcttcattcaaaaaggatgctgaggtaaatgaagtcgattactgtggatatgtggaacttagacgtcccatgttcatgaaagatcacacatttgccgctggagagttcgatttacttacaactagtggtcaaactggcgtaagctatttcctaccacgtcctttgggaagtgacaccaaccaaactttaccatga

SEQ ID NO: 37963 - DNA, 342 bp, Glycine max
  Peptide Sequence Number=SeqID_154741
atggtcattctgtgccttttttcatccagaggcggcgagcccaatgacatgcggagacaaattatggtcatccacacaccttttcgccatccggagacgatcaagtctgatggcatgcagagaaaaattatggtcattctgtgccttttgtcatccagaggcggcgagcccgatgacatgcggagacaaattatgagactaacgttgtcttctgcaccttttgtcatccaggggcagcgagtcgggtggtgggcggagataccttatggtcatctgcgcatttcgtcgaccgtgaggaacgaattcggcagtgttaggatgatgttggtcgttcggtgctga

SEQ ID NO: 37964 - DNA, 1200 bp, Glycine max
  Peptide Sequence Number=SeqID_154742
atgggtgacttcccttggatgccacttgtgaagcaagtcgaacctactggcgggactgtgccatcatccactatcgctcctgttgctagggaagggggtcaacctactgttgaggttggccttgttattggtgctgctgaggttgcccctagttctccttcctctattttggctaagatgatgcgagatgacggcgctagggtgtcgggccgtaagaagtcgagggcccctttgagccttcgtgccctaaggcaagccacagggttaacacctccgacatcaaccgaagtttatgctcatgttgttgctacaatcgtttttcttgttgctattattattgttactctttctcctccatctcctcatgttgtgcctattcaagtggtcactcctgctgctaaagttcgtatgttggttgcttcggctggttttgttgtggcgccttcgtctatcattgttgcacccttgctgagtgtcggtgtgatgaccatgagtgctcatgtgatgccacctccttcttctttggcttcaccgactctgcccttttctgtgttggtggcagtgtcgccttcctcatcttcttgtccctatctctttggatcacctaacgctgcgaattctaccaaggttttcctcaagagaagtttggcaattctgaaggagaatgcacagcgacaccaagaggctctacgcaaggtggcatccttggaggcaaaggtcaccaaatggatggctactgctcgcatggtttggagacaagagcgccctaaggtagctagggccaccattgccttcattgaagttgtgaagtcaaaccaccaactgtcttccaaggagcaaaaggacttggatagccaagtggaaggcattatggcaaagcaggatgagcttgccaaattggtggtggaccttgaggctcgactgaaagagtcaaagtctgagctgcgggtggctaaggagagggagaccaagaagaagcttgaagcgaaggtgataatgtacaagaaggaggctgtggagaagcatgaaaaaggattcaacaaggctatcaggcaagccaggttcttcaccaaggaccttgacttgggtctttttgaccctttcaaggatgtaaagaacggtgttctactggacaaggaagatattgccactgaagaggaggctattgaagagcaagatgctgatgatgccaatgtttag

SEQ ID NO: 37965 - DNA, 138 bp, Glycine max
  Peptide Sequence Number=SeqID_154743
atggagcttgcatcagctacttcgataaataggcatctggttcctgatgctaaaaaggatgttctctatttagcaatgctcatgcattcctatgttgtctccgggactgctagaccccgattcctcatgatagcctag

SEQ ID NO: 37966 - DNA, 708 bp, Glycine max
  Peptide Sequence Number=SeqID_154744
atgctttctattttctcgatctacttccctttcatcgatgaatcttctgataaccaaccccgttgttttttggtccagatgggctcgcaaaacccaaggtccacccttggtgagttctactggtcatttctccaaagggctcgcaaaacccaaggtccacccttagtgagtcctacaggttgtttctccaaagggcttgcaaaatgcaaggtctgcccttctacaagagcacctctccaatatgtgtcactccaagaagtaacacatatgcaagagcacagttcgtgcactacacacaccatgctcgtcaaactcaaggtccttccttgtgaatcgtatgcaagagcacgacgtgtgcgctgcacacaccaggctcggaaaacccaagttcctcccttggtgagtcttacaggttggctttccaaaggctcgttaaacctaaggaactcatggtacacaaggtcttccctcgttaaacccaaggtctacccttggccagcttactcctcaagaaccatgatgaaaacaatcaaaggtccaggttccataagacgaactataactagattgattgacaagaccttcaaccaggggaaaattacactaactcctcatgaacatcagaggagaagctccacaaagcgaaaaggaagcaccattgcaggagtgacaagacctttaatcaagttgaaatcaaacatgagatga

SEQ ID NO: 37967 - DNA, 378 bp, Glycine max
  Peptide Sequence Number=SeqID_154745
atgactgggatggagatagtgttgtcaaatgaggtgaaagacaattttcagccatttaaggaattggctcttaatactgtgaacataaagagacctctaactaatctggaattcaatctaaaggcatcaaattgttggatgagcttgggacagatattggatgagtatatgtgtttgaaagagcaaaaggcgatgctggatgaacaagtcgaggtaacgcaagaaaaaaccggattcacatgcttaggcaaggcatacaaaaggctatggatgtttacaatacttttcagaagccaccctcacccaaggtcacagcgaaataagccgtttctaattaatgataggtgttgttggatcgagtggcctcagaataattaa

SEQ ID NO: 37968 - DNA, 1734 bp, Glycine max
  Peptide Sequence Number=SeqID_154746
atgcatgagacattgggttttagtagtccaggagacatcatagagcacaaaaacattgttagcgggccaggaagtgctaagcgccaatctcttacgggttttgaattcttggaaaaagcgctaagcgcagcctgctgcgctaagtcccagatgcttacgggactttacaacttcaagttgggggtgaagacccctgtggttctatctggaattcgtgatgaatgcactaagtgtgcttatgcgcttagcctattcatcgcaactgttaaaattttggatttccagatgaacgcgctaagcggaccatgttgcgcgctaagcctgacctgtacggctaagcgccactttgcttgtgtaagttttcctttgaataaggctaagcgtgctaagcgcaccctgtgcactaagcctgaatgttattcaattgaggctagggagaggtatacagacatcgtggtacctcaaaagctactaccaaagagaaatgtggtagtttattacactgagttcgacgagttcaaggaggaacttgaaagaagacattgggatgagaagctgactgattttgctgacagtatcatagacattgctattgtgaaggaattttatgccaacctctatgaccctgaggataaatcacctaagcaggtgaaggtgagaggtcacttagtgaagtttgatgaggatactttaaacacatttttgaagaccccagtaattttggaggagggggagaacttgtgtacttattccagatttgcactcctgaggcctgatcctcaggagttggctgctaagctttgtatcccagggaagggattcaagcttaatgctgatgggcagcctttgaagatgctgaggaagaacatgaccactctagctcagacatggagtgttctttccttttctaacctcattcctacctcccacacatttgatgtcaccttggacagagccaagttgatttatggtattattataaagatggatatgaatttggggtacctcatctcccaccagatctctttgattgcacagcatgatacatccagacttggattccctgccttgatcacaactctatgcaaggccagaggagtccccactacttcagcaccacctgagacaccagctccttcttcttccacagctccagtaccttcctcagctccagtggcctggctaggagcccagccttctccttctggaggggttggggcctccacagcccaagagcctactcttgaggagccagaagcagtagcagagggggaggatgagctcacccctcctaagccattttattttgatgcagatgcacgcatggctcagaaggaggggacttccacagatcagatacatgagccatctcctacacctattcctgatgatgccataccatctgcaccagcatctgagttagagcatcctatctctcaggattcaccagctgctcagccattagaagagaacgagcatgtgattggaagcatgactgaaaatgttagtcagtttgtcagattgattgtgaaggaatgcattaaccgtatcctgtgggctaagcgtgcatccaccgctaagcatagcttcagcatgcttagcacgacagaagactctggcagagcatcaatatcaaagtcgcgcgctaagcgcgagatcagtgcgctaagcgcaaaagttgtcttcaaccagggtggtgctaagcgcagcgacacggattcagagcctatttaa

SEQ ID NO: 37969 - DNA, 657 bp, Glycine max
  Peptide Sequence Number=SeqID_154747
atgaaggatggcatgcaagttgcaatgaaaattcagtatactggtgtggcagatagcatcgatagtggcattgagaacgtgaagcttcttttaaactacacaaatttaatgcctaaaggactctatcttgacagagctataaagggaacattacctggaggtcaagatgtggtagtaaaaaggatttcaggtatttccactcaaggcttacatgaattcaagaatgaggttattttgatagcaaaacttcaacatctaaaccttgttagactcaggggctattgcataaaaggagataaagatatcaaactttggccatgtagagtatacaacaatctaggtgaagatttcttagatttgaatagttttaaaaagggtgtcattatacaatatgtgaaggagttagatgaacttagaactcaacttgtagcaaccagagcaactgctgatgcaagtgttgtatcagctcaatcagtgcagctccaatgtttacaacttctcaagaccaaggaattagctcaagaatggttgcatgcggaagaatggttacaactcaagctcaagaccaaggaatttgaagcaaatttctaccacaagaacatagatattaagatcatatcaaaccatatcagcaatgttattcttctagcagtataa

SEQ ID NO: 37970 - DNA, 243 bp, Glycine max
  Peptide Sequence Number=SeqID_154748
atgaaaagagttgagaaagacgcaatagggattaacctcattgatcaacgaatcaaaaaagagggaggaagcctcgttgcggaaggtagagtgcgtttgagaaaaattgttgtcgttaaggtactggttaacaatcaggacaacatgaacagggctgatcttacccattccaaacgactttgccgtattggcaaccaagaagaagaagaagaaggaggaggaggaggaggaggaggagtctga

SEQ ID NO: 37971 - DNA, 216 bp, Glycine max
  Peptide Sequence Number=SeqID_154749
atgcccttacggacactattcctacttccccatcaggctctgataccagaggtcagcggaataggatcaaacggacagataggaagtaagaatgcaatatcaaggtcacaccggagaccggcttacaaaacccaggttttcataaacaaagaaaccgaagcggcggcagagccgcacaggatcggtgaagggagaagagagaaagatgaaaaatag

SEQ ID NO: 37972 - DNA, 936 bp, Glycine max
  Peptide Sequence Number=SeqID_154750
atgcgtatctctgctagtatccgtggttcaattctggaatgttataaggtcaatgatttcatgaaagccatagatgaacagtttgaaaggtctaagaaggccttggctagcaacctaatgtctaagttgtcacctatgaggctcattgagtcgcaagaagaagggagacttgctcaagagattagtgaaggtgctcttaccatgactctagataagggggagaaagaaaggaaggaaaagaaccgtatacctcctattgccaaaattaaggaatgcctaaaggggtatagattttaccgtccaactcataacactagaattgttgagtcaagaaatgcaaagtttatagaaaatgatgtggctagtgggagtgatttaactcaaggcattggtcttgagaaaaatcaatgtgaggaaacagttgctacatcaagttataagctagtggttttttgcgacactcgccaaaatcgagtaacacaagctccacatcaagttgaccctattctagaagatcaagttgagcaacatcaaacacaaaatgttgagcaacctattgagcaacatcaaacacaagatgttaagcaacctactaaacaacaaccaaaaggtgtggatgtaacattgggaagatcaactagaataaagaaacctacaattcctagttattatcaagtgtatttacaagagtcagaatatgactttggagttgaaaatgatcccgagtcatttttgcaagtgattaacagttgtaattgtaagctatggtgtgatgctatgaaagatgaattggaatctatggcaaatgataaagtttgggatcttgttgagttgttaaatgggataaagcctattagatgtaaatgggttttcaaaaccaagaaggattcattaggtaacattaagagacacaaggcccgattggttaccaaatga

SEQ ID NO: 37973 - DNA, 228 bp, Glycine max
  Peptide Sequence Number=SeqID_154751
atggcttcatctgaaaagaggaagagaacaatttgcaagagggcagtggtaaaggttgatcctcaaggcaagtgtggtggagttcttatctatgatttgcaagtgataatactaaatgctactcagataaacctttcaggttgtggattggcagtgtatggagaaagtaatgaggggcttctttgggaattttgcaatccccataaaggaggaggtttgggtctatga

SEQ ID NO: 37974 - DNA, 147 bp, Glycine max
  Peptide Sequence Number=SeqID_154752
atggcatccggggcttccgtaaaatttctgaaaaccttggaaatatcgagtcgaaatgtttccgtaacgctttcaagacattttcgtgagcaaatctgtgaagattttccgccattcttcatccgttcttcgttcttcaaccggtaa

SEQ ID NO: 37975 - DNA, 165 bp, Glycine max
  Peptide Sequence Number=SeqID_154753
atgaacagggagcagatatgtgctcgaaaatttatttcctctcccttcgatgaggtcgagatctttgtcgcgtttacaatgtctcgtgccacaacgattatggtgccttgcgtcattaccgtgtggccaaggtggtcatggtggcaacgggagaagtcaacatag

SEQ ID NO: 37976 - DNA, 177 bp, Glycine max
  Peptide Sequence Number=SeqID_154754
atgacagaaattcctctggctactgccgcattcaatgatgttaagtgcatcctccaccaccggctgaaaaagctatttttgacggctaacactcttcacaaattgcattttgcatttttgagtcaggattcaccgtcaagaatacagatatcagaagtggtttttgatgatttttag

SEQ ID NO: 37977 - DNA, 270 bp, Glycine max
  Peptide Sequence Number=SeqID_154755
atgtcaactgctgccagatcaatccagtcaatcatgctagggaaaaataccacttcattcctattcacctccttctctctgagttcagtcacgggaattcccaacacttcggataatctaggtatggacggagagtgtcccgaagggaagaaaggcttagttcctcccagagggcatccaagaatcttttcaaagtcctcaagcatgagtactagctggaaatctttgaaagcacttccatcatggataagtcagacgtcgaaactttaa

SEQ ID NO: 37978 - DNA, 1031 bp, Glycine max
  Peptide Sequence Number=SeqID_154756
atttccagctagtactcatgcttgaggactttgaaaagattcttggatgccctctgggaggaactaagcctttcttcccttcgggacactctccgtccatacctagattatccgaagtgttgggaattcccgtgactgaactcagagagaaggaggtgaataggaatgaagtggtatttttccctagcatgattgactggattgatctggcagcagttgacatgttcctagcctattattatcgacgagaaagtcctatggtttctatccttgctgatgtgtactgtactctggactcgagctgggaaaagaaaagcactagagtcatctgttgttttcccgcactctatgtatggatggtgtctcattttgtgatgcacaatggtatgcctacttgtccattagaagatttttgcatggtgccagataagagaaagattaattgggaggagcttttggctagcacgacagaagtcaagctgcctaagaagacaaatggtgagagggtcgagatagatgtacctattgagcagaggaggaaagaatgcaatagactaagggatgtcaacatgtcaaaaactgaagcattggagcgagaaatgagaagggctaaaggggaagagacgaacagaagaaggtaccaaggagctttgtcaggcaatagtaacgaactcaagttgagaagtgcagagagggaccaaacaatagcggaaaatgtgacactgagagatgagttgaaggattgttgggaatcaaaggaaagcttgaaggagcgactaggcatgatggaaaagagtatgctagtaattgtcgatcaatatgaggtaaagatggtgagggagaggcaagttctggctactatacatggacaagcggaagtgctagccttacagggtgaaagagaagcaggggaggaagtgatagagctactacatcaagaaaagcccttgaaactgctagctagagccaaggcgagggctgatatatactctgctctcgacgaaattcatagtctcttcgataactactag

SEQ ID NO: 37979 - DNA, 258 bp, Glycine max
  Peptide Sequence Number=SeqID_154757
atggcgagttcgctgcggattggacacgtggaacgcaaaccgccaacggtgctggcgacttcactgaacgtggcatatcgccacttccactggcgacacagccagtggacagcagcaggggtgcaggctacgggggtgcaggacgtgcaggtgcaggctgcagcctttgacttcttgggcttaggggagttgccactagctttggcgagttacgctaaaggggactcgccagtagctttggcgatttgggcaaaataa

SEQ ID NO: 37980 - DNA, 2154 bp, Glycine max
  Peptide Sequence Number=SeqID_154758
atgaagaaccatgcatttggcgccctctttctctctacccttgttcttcttgtctctactgcaaagggtaagtgtccaccctcctttgtttgtgggaacctcggcaccatgcacttcccttacactgacacaaaacaccctcactgtggcctgttggtgatctatggctgcgatgaccgcgacaatgataccattaaaaccattaagaacaacggagcatggttttacatcacacgcgatcagaacaacggtaccattttgttcagagatgacaaactccgcacactcttgctaaccagacgatgtggagtcttcagcaacaactacaccagtttggacaccacttctcctttcctttcacttcacttcatgaatctcaatctattcatatgcaacagcactctcaatgtcacccctccttcttcagtcttttccaaatctaccatatgcaaggatgaggacatcttctatcgcccgactaatatggatgattattatgattatcattatccttattttgaagcatgttcgagggttatacttccaatcagagattcagagattgtacctgacaatggaaacctctttgactatctatcagctgatattcctgtccacgcagaggtgtttcacgattgttcttcttgttactatcttagaggaggccggtgtcaacttgacacccaagggaagttcttttgtgctgaagctacttcagttgctggaggactgggaattttgatggtcttggcttgcatcttacgaagatactattttcacaagaagaatcctacttacctaatgattgagaactttctgaagcaacatggacacctttcagccaaaaggtacagttatttggaggtaaagaaaatgactaactccttcaaaaacaaattaggccaaggagggtatggcagtgtatataaagggaggttacaaaatggaagccttgtggcagtgaagattttaagcaagttaaaaggtgatggagatgaattcatcaatgaagtggctagtattagcatgacttctcatgttaacattgtcagtttactgggattttgcctggagggctccaaaagagttctcatatacgagtatatgccaaatggatctcttgaaaagttcatatatgaagagaaagatcctttaaagcataaactcacattgaattgcagaactatgtacaatatcgtcattggtgttgctcgaggattggagtacttgcacaagggttgtaacaccaaaatcttgcattttgacataaaacctcacaacatactgcttgatgagttgttttgcccaaaaatatcagattttgggcttgctaaaatatgtcctagagaaaaaagtattgtatcaatgatggttgcaaggggaactgtagggtatattgctcctgaattgttctgcagaaattttggtggagtgtcccataaatcagatgtctacagttatggaatgatggtcttggaaatgcttgcgattttgagttctattcaagaaatgggtttggccaagtatgaggttgaaaaatttacagggcaaaatgattttgggctatggcgattgaagatgagagctcttcttgttcagcagggcctggtggaagcacttgatggagaagcacacagtgcaattatcctcagtctcggagacaatgtgctgaggcaagtctcaaaggaaacaactgctgctggggtttggtcaaaacttgaagatcttgaaaatatcgatgtcactattgatgatgaggatcaagctttgttattgatgtgctctttgcctaagagttactctcatttcaaagagattttattgtttggaagagactctgtttctcttgatgaagtgcaggctgctctaaattcaaaggaattgaatgaaagaaaggaaaagatgtcctttagaagtggtgaagggctgacagagggtcatacaaggaaagtttgtcctgaaaggcaaaaaaatggtggcagtaacaataggaagaaggactcagggaatgctgcaattgttcaagatgatggctatgaatctgtagaggcactgatggtgtctgaaaagaatccagaaactaaatggataatggattcagggtgttcatggcaaccaaaagagttttatcaaaaactgagttatggcacatga

SEQ ID NO: 37981 - DNA, 318 bp, Glycine max
  Peptide Sequence Number=SeqID_154759
atggatggtggggggtttttaagttcaactacatcaaaaattgccaatcctaatattcaattaccaggaacaagttcagcaaattccagtgcttcttcatctgcacttggtcaaaagaaattgtatgcagaatcccagaccggaaagtccacttttcaaaagcttttggagccaatgcttcctcaacttcctggaattgctccttatagaattgtcctggggaatgttaaggataaggtattgcttctaatttatagaattgtcctggggaatgttaaggataagtacttcctggaatgctggcttgttcatggttaa

SEQ ID NO: 37982 - DNA, 129 bp, Glycine max
  Peptide Sequence Number=SeqID_154760
atggaatactacgttcttctggagcagggctgcgaatataaagaaagctcgaggatcttatttttcggaggagtattggaagctaatggtccgaaaaatccaaggaatttgtttcaggaatacgagtga

SEQ ID NO: 37983 - DNA, 498 bp, Glycine max
  Peptide Sequence Number=SeqID_154761
atggaagatttgtgcctagtacccgacgtggtcattcctccgaagttcaaggtaccggacttcaataaatacaaggggactacctgccccaagaatcacctaaaggtgtactataggaaaatgggagcatatgtgaaagatgaaaaattgctgatgcatttcttccaagaaagtcttactggggcagccatcacctggtacactaatctggaaccttcccgagtccattcatggaaggacctaatgattaccttcattaggaagtatcagtacaattttgatatggctccagattggatgcaactacagaacatgtgcaaaatagtgcacgaatctttcaaaggattcgcccaaaggtggagggatatggcatctcaagtagcgcccctaatgacggagaaagagatgatatcctatgctaacttgctcccatatctactcgataattcaatggtagccataaccccaaccaaggttcctcaacctccatttttctga

SEQ ID NO: 37984 - DNA, 1149 bp, Glycine max
  Peptide Sequence Number=SeqID_154762
atgcgcgaaggcgacgtcgcgccggcgctggcgtctccgtcgccgccggtggtggttgccggccggagccggtcgcagggcttcacgacccggcgagtgacgcctgcaacggcggtggacggatcctccgccgtggagcgtgttctccccaacggcgacttctacgccgggagattctccggcaacgtcccgcacggatccggaaaatacctctggaccgacggatgcatgtacgagggcgagtggaagcgcggaaaagcctcgggaaaaggaaaattctcgtggccttcaggcgcgacctacgagggcgagttcaaatcgggacgcatggaagggttcggaaccttcgtcggatccgacggcgacacctaccgcgggtcgtggagctccgaccgaaaacacgggttcgggcaaaagcgttacgcgaacggtgacttatacgaaggctggtggaagcgcaacgtgcaagacggtcacggccgttacgtctggaagaacgggaacgagtacgtcggggagtggaagaacggcgtgattaacggcaagggagccctactctgggccaacggaaaccgttacgaggggttgtgggagaacggggtccccaaggggcacggcgttatgaagattcatcaccgtttgctctggggtgagaattttaacgtgaagcggttttcggttgacggaagagggagcgttaataacgataagagtttccccaggatttgtatttgggagtcggagggtgaagctggtgacatcacgtgcgatattatcgataatgtggaagcgtcgatgttttaccgcgacggaacgacgtcggattgtgaagagaaagagacgaggaggaacccttgtttctctagcgaggtgaagagacccggggaaaccgtttcaaaagggcataagaattatgagttgatgcttaatttgcaattggggataaggtacactgttgggaaggaggcttcgacgttgcgagagctcaagcagagtgattttgatccgaaggagaagttctggactaggtttccggctgaggggtcgaagcttacgccgccacatcagtccgcggagtttcgatggaaggattactgtcctgtggtgttcaggcatttgaggaagctatttcagggtggatcctgctga

SEQ ID NO: 37985 - DNA, 2091 bp, Glycine max
  Peptide Sequence Number=SeqID_154763
atggcagtgatatgtccgccaagccagggacaaacttggcttccccatggccccaattctaattaccacttcttctcaagaggaggagttggaaggcgcagtcgttcttattgtactttcagctcaccaaagaccaaaacgaatgcgtttacggtcagaggctgcggccaggactcggtggaagaccatcactttgtgaaggctctgagggaatcccaaccttacatttccgttcataggggcagactattcgttctgctcatatctgctcaacttgttgccggtccttacttcaatcccattctcaagtttgtgagtgatctctgccaccaagcccgcactgtgtctgtgttggatcttcaacttgaatggcacgtgcggcccgtgacggcggcccatttgggtaaccgaaagaagcttaatgcgttgagcgaagatggagagagcagctaccatgggtcgatggaggataagcaattcgtgcgttcgtttcgcgaggcctggccttacttgtgggcctatcgtggtagcacctttgttgtcattatttccggtgaaattgtttctggccctttcttggatgatatagctttccttaatcacctaggaatccgctttgttcttgttccggggacacatgtgcagatagacaagcttctgaatgagagagggtgccagcctatgtatgttggtagatataggataactgatgatgaatctctggaagctgccatggaagcagctgggggcataagattgatgatagaagcaaaactttctcctggaccttccatatgcaacattcgccgtcatggtgacaatagtcgatggcacgaagttggtgtcagtgttgccagtggtaactttcttgcagccaagagaagaggggtggtcaatggaattgattttgggtcaactggggaagttaaaaaagtagacgtaactcgcatgcgtgagagacttgatggtggctgtgtagttgtattaaccaacttgggctattccagctctggagaagtattaaattgcaagggcaaatacagagaacttaatggtacagacttttcagcggagtatgtgaatcagaataccactagtgttaccaatggcacctatgaagttgccactgcttgtgccttggctataggggcagacaagctaatatgcataatagatggtccaatacttgatgagagtggacacctaattcgtttcttgcctcttcaagaagcagacatgctaattcgtaaacgggctaagcaaagtgatgcagctgctaactatgtgaaagctgttgacgaagaaggtttcaactctcttgagtgtaacaattttaatggaacagtcaaatcaccacctattggatgttttacagaatggcataatgcaaccttccataatggtgttggttttgagaatggaaatggcttagggtccggtgagcaaggttttgctattggaggtcaagagcggctaagtcgaatgaatggctacctgtcagaattggccgctgcagctttcgtttgcagagtgagtccatgttttacctttatttttcatgacaaggaaggaaaaaacttgagggcgagccctggtgcagcggtaaagttgtgccttggtgacctgttggtcatgggttcgaatccggaaacagtctctttgcatatgcaaggagttcacttgctggatggaactattagtggagttttgttgttggaattgtttaaaagagatgggatgggaacaatggtggctagtgacctttacgaaggcactcggacagcagaggtaaaagatatttctggaataaaacaacttattcatcctttggaggcatctggcatattggttaagcggactgatgaagagctgttaaaaacattggattcattcgttgttgtggaaagagaaggtcacataattgcttgtgctgccatttttcctcactttgaggagaagtgtggagaggttgcttgtattgcagtatctcctgattgtcgtggccaaggacagggtgacaaattgcttgttttcgatgtttatgcagactcattcgatgttaaaacaactgtaaacctaatgagttggtag

SEQ ID NO: 37986 - DNA, 222 bp, Glycine max
  Peptide Sequence Number=SeqID_154764
atggctcaggccctccgtgctgatgaatacctacatcgcgtgatagacagcaatgattgctatgagtgcagtcctacatgtccccctatgcccgcacccgatcgacacttcgcgaactcaaacgatgttcctcgaaaaagaggatcatcaaagacggtatttcttgaagaagaagatcatcggcatgaggaaagaattgagagttcgagaacgaaattttga

SEQ ID NO: 37987 - DNA, 618 bp, Glycine max
  Peptide Sequence Number=SeqID_154765
atgactctgcaccaaacatggcaaagatacactgaaaatatgattcactattcagtgacctatgtagatattccaattgctgttacaaataattggttggataatcttatattggagtccattatcaagttgaaggagccaaggggttctgacaaggcagcaattgctgcatatatagaggatcaatactgttctacaccgaccctcagaaagttactgtcaacaaaactgaagcacatggtggcctgtggaaaattaatgaaggtcaagcacaagtacaggattgcaacaaatttaacaatatctgagaaaagaagatgctcttccttggtactcctggaagggaggcccaaagattctccaaaagcagagaagactggtgtccacatcctttcaaaatccgaaattgatgcagagctatcaaaaatgaagggtgtgacacctcaagaggcggcagcggcagctgcgaaagcagttgcagaggcagaagctgccattgccgaggctgaggcagcagctagggaggcagatgctgcagaagctgaggcagaggctgcacgagtgtttgcgaaagcagcaatgaaggcactaaaatgcaagacacttcgtgtttggtaa

SEQ ID NO: 37988 - DNA, 669 bp, Glycine max
  Peptide Sequence Number=SeqID_154766
atgcacccattcagaaacccaaagccatgcctttcactgttccaccatcttttcagattcagaatcacacccaccaccaattccccctatccaacaatcccatcgaatcacttctcaaccgattcttccacagcatacccgacaacaacaacaacaacaacaacaacaaaaacgacaacctctgtttccatcgatgcagggtcttctaaccgcaaacccattagtctatggccggggatgttccattcccctgccatatacgctctctgggaagccagatcttccgttttcgaaaaccccgttctctccaatggcccctctgttcccaaaacaccctcacggagcaggacttgcatcttctacaacttctcagaagatcacatgattcgtgagcagtataggaatccatggaatcacatcaggatgggcaagctcgtcgaggattttgatgctttagctggtaccgttgcattcaagcactgttctaatgaagatggcacagcaaggccacttctattggtcactgcttccgttgacaagatggttcttaagaaggcaatccatattgatgctgacttaaccatagttggtgctgttacctgggttggtcggtcgtccatggagattcaactggaattgactcagtctgaacaaggtgctgcaggatga

SEQ ID NO: 37989 - DNA, 2643 bp, Glycine max
  Peptide Sequence Number=SeqID_154767
atgtgtgcaaccttcaacattcttgttctcttgttatcacttttactcacttcttcttcttcttttttacagcctcgccgtgttctccatcaaccactttttccgacaatctctgttccgccagcagaagctccaagttatttacctcctgagcctcaaccaaagcaacaacaccaacccaagattccattttcttctatttcatcatcttcaccacctccgccgcagaaacctttcttcccttcttaccattctccgccattgccaccttctcccgccgtcgtcgccacttttccggccaacatctcctccctcctcctcccccaccccgtctcccgccaccaccgctccgccgccgccctcgccgtctctctctctctctgctccctcgccctcctcgcagccgtcgtcgccttcctcctccaccaccaccgccgtacacactcctcctccgatgacaacgacgacgacaaagcctcgagatcggatagcctccgcctgttcccgccgaacaccgacgcctccgacggcgccgaccgcaaaccccacgataaagccagccccacatcggagcttctttacctcggcacggtggcgaactcggtcatcaccaccaccaccaccacaacaacaacaaccatagactcaagctccagccaccacgaaattttccggccagcgtatcagaaattcggcgactcgccggagctcaacccgctgccgccactgccacgtcacaaattcaaaccatggactactgaagaacagaacaatgataaagatgtaacagaaaaagaaaaagaagaagaagaagaagaagagtttttttctccaacaggttcttctggtgggaacattaacaaacaacaacagagtcctccttctccttctgcacttgcttctgcttcaagctcacgcgttttccacgtggataaattcggttccagaagcttcacttctcgaaccccttctcacccacgttcaaattcactctctttttctcgttccccttctctgaatttcagccccgcaagtgttaaatcattgccaccgaacaccaaccttgcttccccttctttctcttcatcctcttcttctcccagggaagaatggaatgttccttctcatgggaaaaattctccggcgaccaccactttacctactcctcctccgccgccgcctcctcctccaccgccgccgcagttttgggaaactccggttgataaaagtgttacttttaggaatgagagtgaggagactccaaagccaaagttaaaagctttgcattgggataaagttaaggccagctcggacagggtcatggtttgggatcgcctgagaccaagttcttttcagttgaacgaggacatgattgaaacacttttcatggtaaataatcataataatttcaaggagggttttggtgttgcgattagagataataataatcctcggcgtcaaatggttcattctgcttctccaatgcccttggaaaatagggtgcttgaccctaagaagtctcagaacattgccattttgcttagggcgctgaatgtgaccattgatgaagtttgtgatgctctcagggaaggcaattgtgatacgttggggacggaacttcttgaaagtttattgaagatggctccaactaaagatgaagaatctaagctaaaggagtttcaagatgaatcttccttcaagcttggcccggctgagaaatttctgaaagccgtgcttgatattccttttgcatttaagagagtggatgctatgctctacattgctaactttgactcagagttagaataccttaagaagtcctttgaaactctggaggtggcctgcgaggaattaaggagcagccgaatgtttctgaagattctcgaagcagtgctgagaacaggaaatcgaatgaatgttggcaccaatcgtggtgatgctcatgccttcaaactggacacgctcttgaagttagttgatattaaaggaaccgacggaaagactactctcttacatttcgttgtacaggaaattgtcagaaccgagggttctcatatttctggttctaatcatccccatgcctctgacaatggccaccaatatactctccaagatgaggttgacttcaagaagcttggtctgcaagttgtttcaggcttgagtggtgagctcaccaatgttaaaaaagcagctgctatggattcggacgtgctcagtagtgatgttgctaaactttccagaggaatcgaaaaagttgtgcaagttgtaaaattgaacgaggagttgcctttgaaagaaactaacaaaaaattttcggacgcaatgaaaggtttcttggagaggggagagcaagagctttcaacaatccaggcccaagagaaaaatgccctctcttcagttaaggagataactcagtatttccatggaaattcagcaaaggaagaagctcacccatttagaattttcatggttgtgagggatttcctttcaatactagatggtgtttgcaaggaagttggtaaagtaaatgagaggactttggttggttcccgtcagtctgtaatgcctgcaaattctataatgcaaacctttttccctgagattattggtaagcaaccatctgattcctctgaatctgattaa

SEQ ID NO: 37990 - DNA, 204 bp, Glycine max
  Peptide Sequence Number=SeqID_154768
atgaccaatgacggggcaagagctgcacccgacaacttcgaccgcgccgccgcccacctcgccgtggcacagctctgcgacgctgcgaggttccatggcgccaccgccttggctctcaacgccttcgctgacgtcgtcgtccactacctcctcgacctgggtcgaaccgccgagttccacgccaaccgtgtcgaccgcacgtag

SEQ ID NO: 37991 - DNA, 381 bp, Glycine max
  Peptide Sequence Number=SeqID_154769
atgattgttgctgctaccaccatgatcacagttgcagccatcaccataagcataactgctaccaccactcgccaatgtcgtcgtgaatgtagtcattttcgatatcactatgatgatgatcatcatcatcaatcgccaccgttacagtcaccatcgtcatcaactgtcaccacctccgttaccacagtggttgtcgttgttgctaccgccaccaatggtgttacaaccactaacacgacgacatcagtagtggcagtaactacagtcgtggtggcgaaggacaattatgatggtgattgcagtagtgtccatgacagttgtgacaaaaacgatcatgatggtggtgacggtcatggtgatgataggtgtgagatattttag

SEQ ID NO: 37992 - DNA, 1164 bp, Glycine max
  Peptide Sequence Number=SeqID_154770
atgggtggtgaggaattgtgtttgatggagaactcagggaaagggaagaggctgtggaagaaggtgaagtaccagctggtggagtaccactccttgcccggttatttgagagacaacgagtacattctcggtcactatcgatccgaatggcccatcaggcaggttttgttgagcgcattcaccatccacaacgaaactctcaacgtttggacgaagcttatgcacatggctctcaccattcttagccttgtgaggagaaaggcagtttctgcaatcagaacccatgatcaacggcatttgatcgggttcttcatatttctggcattgaccatatacactgccatgaatcttaattcgctacagcagtttcctgacatgctcaagaaggccgacctgcacaaattacaatcagaaatcttgacgtgtctcccttccatgcctgatttgcacatactcagggagggaatctcaagttggcatattaaagaatatctgtacaattgtttgccacatagtgtaaaagatgacttggcgaacataatagcaccactcatgattagaccaattacaaggtggccttttttcgcatttttagggggtgccatgttttgcttgctagctagcagtatttgccatctcctctcttgtcactctgcacgcatggcatacattatgctcaggctcgactatgctggaattgcagccctgatatctacctctttctatcctccagtatattactcttttatgtgttacccatttttctgcaacctttacttgggatttatcactgtattgggcatctccaccatcttgttttctctactcccagtgttccaaaatccagaattccgcaccatccgagcatctctcttctttggaatgggtttatctggcgcagcacctattctgcacaagctttatctattttggggccagcctgaagtgtttcacacgaccggttacgagattctgatgggtgttctctatggaatcggagcactggtttatgccactaggattccagaacgatggatgcctgggaaatttgacattgccggacacagtcaccaattgtttcatatattggtggtggctggggcatacgctcattatcgggcagggttagtttatctcaggtggcgtgaccttcaaggttgttga

SEQ ID NO: 37993 - DNA, 546 bp, Glycine max
  Peptide Sequence Number=SeqID_154771
atggcgatggcgggcactcacgctcggcaatctgcttggattcttcgcctgctctgtttgtgggcttctgcagttctcgtattcgctgatgaacactccttatgtcttactcaaaatgccacactgcagctatcccgtggcttgcccgtgggaaattctcctggttccaagcctggtgctactgtgattgtcgaaagagttcatatacatggactgtcaaggtttagaaacttggggaaatttgcacattccattaaagtgaaggtgttgccactgcctacaaactcaaatgttcgcctgccaaacatagagaatttaaagaatgatcactgcaattggtttaatacgtttctatatgctctgttcaggaatgtgtctcttgtagctgggatgtgtcgacatgggcagtgggagaaagttaccaaaggttcttgggctcgatcgatgtctctttttgaccacaagatcttagatgtaaggactgctggttccacactggaaaattttgaggtttctgttgaagaaggtaacatttttgttccttaa

SEQ ID NO: 37994 - DNA, 237 bp, Glycine max
  Peptide Sequence Number=SeqID_154772
atggagtctgaagaatttatctacaatccttcaagcttctcaatctcttccttccctattcgattttggaacatgaagaagataatgcagaggaagaaatgggtacaatggtccaaaattcaaggaagtggaccaacctgcgtaaatgacgaaggaatctcaacctatgcattttcttcaataaggagacaaatgatccacataataatgccaatgttcccaacagaggatccatag

SEQ ID NO: 37995 - DNA, 474 bp, Glycine max
  Peptide Sequence Number=SeqID_154773
atggaaaaaacaattgaaggatataaaagaaatttccaagtaaagggcattacccgcaatatacaattaaacagtaaaaaggtgtgtccgatagttgatggtgctcataatcatttgactgggcgggcagcttatggtgttgtggtccgtaatgacagtgatgccatgatttttgctttctcctctaatatcggtaattgcaattttctgcgggcagaactttgggggattttgaaaggtctaactattgctcgtgacagaggctttaactatattgttgttgagtctgattctaagatagcaattaagcttataacatacggttgcccaactattcattcaaactataacttggttcaacaaattaaggagatagtggattcaagattggaagttaccttttctcatatttttagagaagctaaccaaacaactgatgctcttgctaaggcatgggatgctaagtgcttttga

SEQ ID NO: 37996 - DNA, 207 bp, Glycine max
  Peptide Sequence Number=SeqID_154774
atgcagatgcaaaaaggagctgaaagaaaacgagcttacgacgtcgtaggacgacgagcacagttctcaacatgtgaaggaaatgcgagaggtagaaaacataggaccagaagaaaacacgaccacagggacacatcccaagggggaaacatagcagccactggagcggggtcttgtagcgccgctagagccaccgcgtctctttga

SEQ ID NO: 37997 - DNA, 1350 bp, Glycine max
  Peptide Sequence Number=SeqID_154775
atgccgatgtttcagccttgtcggaaggacttggttgccgggtacgagggtggtggcgacggccagattctagatctggacaccgccgtgaaagacggcgttttgggcggcgtggagggcggcgtcctgggaggtggggttggtgagaaggtggatctggggaagatgattgaggagcttgagttatgtgaagtgccgagtgtgttcatttgcccaatctcattggaaccaatgcaagaccctgttaccctctgcacaggccaaacctacgagaggtccaacattcttaaatggttcaacttgggacacttcacctgccccaccacgatgcaggagctctgggatgattccgtcactccaaacaccaccctttacaggctcatacacatgtggttctcgcagaagtacttgctcatgaagaagaggtcagaggatgttcaaggaagggcttctgaacttcttgagacactgaagaaggtgaagagtcaggctcgggttcaggccctcaaggagcttcaccaattagtggcttcccatgccactgcacgcaagactgtcattgatgaaggtggagtttctgttgtatcttctttgcttggtccttttacttcccatgctgttggctctgaggttattggtattcttgtgactttgacacttgattcggaatctaggaagaatctcttgcagcctgccaaggtttccttaatggtggacatcttgaatgagggttccattgagacgaagatcaattgcacgcggttgattgaatcgttgattgaggagaaggattttcgatccgaggttatcttgagccatagcctcttggttgggttgatgaggcttgttaaggataagaggcacaacaatggagtgtgtcctgggctgagtctcctcagaacaatttgtttgcataaggaagttaggaatttgcttgtgagcattggggctgtttctcagttggttgaattgttgtctggcatggagcctgattgtttggaattggccctttgtgttttggatgcgttggcttcggtccctgaaggtagagtggctttgaaggattgctctaacaccatacccatcatggtgaaactgttgatgaggatctcagaaaactgcactcagtatgctttgtcaattctatggtctgtgtgtaagctttcacctgaagagtgctcgtcgattgcggttgatgcagggcttgctgcgaaactcctactcgtgattcagagtggttgcaatcctatattgaaacagcagtctgctgagcttttgaagctgtgtagtttaaattattcagatactatctttctttccaagtgcaagcttaccagaaccatccaatga

SEQ ID NO: 37998 - DNA, 435 bp, Glycine max
  Peptide Sequence Number=SeqID_154776
atgattagagcaattcatcaaggctttgacctcaagaatatcacccataagtattaccctgacccgggaccaaagaaaaaagaaaatctcaacaaagagcttaaaaaatctagcactatcaatattcacaaacaaaaagaaatcaaacgagaaagagagttagggaagtcggagaaaagcaacataagatctgatgtaagctccgttggagcatgtaggcctaggatcttcttcatcaatagattcctttgcttcctggaagatgaatggcagtggaatggagaaaggaagagagagaggagatgccacttcaaggagaagatgagtctagaagaagctcaccaccataggaggccatggataagagcttggaggaagaaggagatgaatgaagggagagggagagaagaacacgaaattttgtgctctaaataa

SEQ ID NO: 37999 - DNA, 339 bp, Glycine max
  Peptide Sequence Number=SeqID_154777
atgaaggtgtgtaagaagcctggtgaagagggagcaagggatatttatactggagaggatgttttgtcactatttgaactctgttaccagtatggtttctgggtgggttggtttaagatgttatctttgtctagatcattcacagttgctgacaacagtggcatgaaaagccgaaccggtggattgagtgtctcacttgctggtcctgatggttgggtgataggtggtggtgttgttggacttttaactgttgttggttggccccatccatcatcaatatttaacccttatgagaattacatattgtccaagaatccaaaaatcaaggaaaacttttaa

SEQ ID NO: 38000 - DNA, 318 bp, Glycine max
  Peptide Sequence Number=SeqID_154778
atgactttgtcacaccattcgaagttgatcgatcaggatgcttgccagggaaattggggaggtgtgatccactactcttcaagggaatctagaaatggcgtggacacgagagaatatggtgccatgcgtggaagtggggatgtgcagttttggatgagcaagaattgtaggtactcaggtaagtttaaattaggatgggcagtcatggttagtggtattgctgcatgcaaggggactgtatgggatcattatggagaagttattcgttcttactccttcaagttgggtagatgctctattattccaagtgtgctttaa

SEQ ID NO: 38001 - DNA, 219 bp, Glycine max
  Peptide Sequence Number=SeqID_154779
atggggatgcacttatcaaattgggggggagagggggctgagtttaaggggttcaacattttttgcactaagttttcacttgaaattagtgaggagaagaagaaagaaggagaaaatccaagtcgaggtgctgtcgtgatgcttccgagacgtttctgtgatcgattcttcgccgttcttcgttcgttcttcgtcgttcttcgatcttcaaccggttag

SEQ ID NO: 38002 - DNA, 105 bp, Glycine max
  Peptide Sequence Number=SeqID_154780
atgggtgttaagcgtctcaaagtgaccaaccaaggtgcattgtttactgaggttcatgggcaagtggcgattgtagcgatggttggtttgacattaacgatggag

SEQ ID NO: 38003 - DNA, 364 bp, Glycine max
  Peptide Sequence Number=SeqID_154781
atgaagtataagggcaaaggaaacattagggagtacgctatggaaatgtccaatcttgcatcaaaattcaagtcacttaagttagagcttgatgaagacatgcttgcgcacttggttttgatctcacttcatgcacaatttggccaattcaaagaagaaaggctacaaagagataggatcgagactgctcacttgactccaacctataagaataagaataggaagaagactaaggatgttgtggaagagtcttctcagcaaaggaaacaaagaaaggttcacgaacttacctgctgtttttgcaagaagtcgacgcacatgaagaaagaatgtctaaagtatgccacttggcatgtaaagaaag

SEQ ID NO: 38004 - DNA, 235 bp, Glycine max
  Peptide Sequence Number=SeqID_154782
atgggtgccaagcacctcacgaggaccaaagaatggtcgcacgtcatcgagcaaaggtccccggacgaaattaggcctcatgaattgattgtcgttcatgcatcctccaccaatgagtctggagccacgcgaagtgattgcctagtgcaattctccattctccacttttattcggagccccatgaattgactgtcattcatgcatcctccaccaatgagtctggagccacgcgaa

SEQ ID NO: 38005 - DNA, 247 bp, Glycine max
  Peptide Sequence Number=SeqID_154783
atggcatgcagcgtgtttgcttcgtgcccctattttagggacctacatgggagggagctaaaagggcttttagtgataattcccaaggtggtcatatgtctcttgatggtatctagaggtatcatccccttcgaagaacatattgcggcaggagacgcggggctcacgggtgcgtcttccaagggaggaaaatgcgcggagtcgccaccaacgtttattcgaggaaaacgtcggaaaaaccggaaag

SEQ ID NO: 38006 - DNA, 462 bp, Glycine max
  Peptide Sequence Number=SeqID_154784
atggcaaataatgtctttgaagtgaatgaggagggtcctgtaaaaggaactggaactgatggagctggtaagggagctgcaatagaagaagatggaacaatagtggaaggagctgtagaacgaggaatatcagaagatggaggagtcgaagtggatggtgttgttgaattcttctttatatatgccaagttaatggcagggctaaggctctccaaagatctggaatctgatgtgactcctctagctttacacaaagttgtgattaaggttggaaatccaagcctagaggagtcatgctgggcaatgatagaaacctggtgggagatgagggaccaagttggagtaagaaagaacactccaagtctaagcatgtgtggtcatgttcttcctgaggatcttcagaggctgaccatcagcattaagctcaaatcccctccttgggatgcagagcttagcagctaa

SEQ ID NO: 38007 - DNA, 1083 bp, Glycine max
  Peptide Sequence Number=SeqID_154785
atgttgttgcaaaaatgtgtgaagaagcttcactttggaagctgggaagagaaagaggtggcagcaaaggtgattgaagaagggttagctaaacaagatgttaaggtgagagagatggcaagtgagcttggggtggtgagagtgttggtttctatggcggtttccgaggtggcgagtcgccgccgagtaggactcagggccctgatccacctatccaatggaggaaatcacagaaacaaggttttgatattggaggcaggaatatcgtccaaactgcctaagaaaattgaccttgaagatgaatcaataagtgaatttgcacacttgctctcttcattgtcatctctaggaaacatccaatttcgtcattcttcgttgcactttctccaattcctcatagatattctcaagtcatgctcaagttttgataccaaacaatcatgcttggtggccttgtgcaacatttcatctttgttagagaatgcagggcctttggtttcaaatggggttgtacctattctcttggaaatgtccttgatgaaaggaagaacttcagagaaagcacttaccatccttggaaacttgggggtgactttgataggaaagaaggcaatagaaaatagttcaatggtgccaaaatgcttgattgagatcttaacttgggaagataaacctaaatgtcaagaattttcatcttatattttggttattctagctcataaaagctcaacacagagagagaaaatgttgcagtcagggattgtccctgtacttcttgaggtggctttagtggggagttctttagctcagaagagcgcactgaaattattgcaatgttttaaggatgaaaggaaaataaagatgggaccacattcaggcccacagacttcaagaactgcaaaggaatcaattgtaaagcaaagggatacaaaagaagggaagagaatgatgaaaaaaattgtggtagaaagtttgcacaagaatatggaaataataactaaaagagcacatggagctgaagatgattctaataagctgaagtctcttgttatcaacacaagttccaaaagtttgccctactaa

SEQ ID NO: 38008 - DNA, 282 bp, Glycine max
  Peptide Sequence Number=SeqID_154786
gacattgttgccccaaacagcattgtcattgtggaagacgaagaagcaccaaacgacgtcgttgcggcaccgaaaattgaagaattggtggcgccggatgcaggtgcgggagaggaagagaaggccaaggaaaatttcttgcatccttcatttgtgtttctctacaaactccaaattctccttgaatatctgctggtgcctgtcagcatatacacgaccgtgcatggccttcccctctttatgctgtgtgccaatggaagaaggctcagagagtgtgcgtga

SEQ ID NO: 38009 - DNA, 498 bp, Glycine max
  Peptide Sequence Number=SeqID_154787
atgctaggatgttttgctggaaaatgctctggaagcatcagatccatagtcaggcaccctgagcgacctgtaatagcttcttatggacggagtataaccctgatcagtacctgtgggaaaaggaattcacccttacaggtcgaacataccaaaggcaggatttggaggcaaattatctattttccgattgtgcagctcaaggacaccaggggctataccttgaagtggagtcattatcttccttctcctttccctgaagatacttctcttccttgtgttatatattgccatggaaacaaatgtagggcagatgccaatgaagctgctgtaattcttcttccttcaaatattactgtttttacccttgacttctcggggtcaggcttatttgatggagactatgttagtcttggttggcatgaaaaagatgatctcaagatggaggtgtcatatttgaggagcaacaaacaaatatctcgtataggtctttggggatga

SEQ ID NO: 38010 - DNA, 1155 bp, Glycine max
  Peptide Sequence Number=SeqID_154788
atggaattccccaagaagcgcaaaacccaagagaacggcgacaccaccaccgactctccgccgccgcaatccaccgaagaagcccccctcgccgccgcaaccccggcccccgcctcccccctcgcatctgaagacatccgcaagatcctgcaaccgttctcccaggaacagctcctcgacctactccagtcggcgtcgctccgccaccccgacgtcctcgacgccgtgcgcgccgtcgcggactgcgactcgaccctccggaagctcttcgttcgcggactcgccggcgagaccacgacggagacgctccgcagcgtgttctcggggttcggcgaattggacgaggctatcgtgatcatggacaaggccaccggaaggtccaagggctacggcttcgtcgtgttccgccatgtggacggcgcaattctcgccctcaaggaccccagcaagaagatcgacggccgcatgacagtcacgcagctcgccgccgccggtggtcccggcggcggtgacgtgtcgctccgcaaggtcttcgtcgggaacgtccccttcgagatttcctcggagaggctcctcgacgagttcctcaagttcggagaagtcgaggaagggcctctagggtttgacaaatcgagtggcaaaagcagaggctttgccttcttcgtttacaagaccgaggaaggtgcaagggcttcgttggttgaacctttgaaaactattgaagggcaccaagtgatttgcaaattggctgtggataacaaaaagacgaaaccttttggaacggatcagcatcaacatcagcagcaacatccgcagcaacagatgcagcagcaagtttctatgatggtgcctcagtatggtggatatggtggtaatggttatgggatgcagcagcagcagcatcaggtgccaccgtataataaccaagttccggttgccggtggtggtgggtatggccatcgatatggcaattcgcagatggctgggccggtatctggtgactatggtgcgagggtgcctcccaattctggtgggggttaccctgatggctcgcagtatggcttccctccttcgtcggggcatccgccgcagccgcgggttccgatggcgagacctcctggtggaatgtaccaaggcgcaccaccctattattga

SEQ ID NO: 38011 - DNA, 366 bp, Glycine max
  Peptide Sequence Number=SeqID_154789
atggataaagccactttactggctgaagtgattagccaagtgaaggagttgaagaaaaatgcagcggaagtaagcaagggttttctgattccaaaggatgctgatgaagtgaaagttgaaccatataatgatcatgaaggaggagaaggatccatgtcttacagtgcaactatctgctgtgatttcagacctgaaatactatctgacctaagacagacccttgattcccttccactgcatctagtcaaggcagaaatttcaactttggcaggcactatgttctgtgatggaaaaggcttctgcctcactggatttctcaccaagaacatcacatgcaagcaagaggagaagactatgctttattga

SEQ ID NO: 38012 - DNA, 228 bp, Glycine max
  Peptide Sequence Number=SeqID_154790
atgtttcttgtattcaacactgctttgaaaggacttgatgatactccacaacctaaatccaatgctggtgctaggtggattgttgttaagtataatagacaaaaaggaagcactgtgtgcggctattacatcatgcactggatatccacgataatcttaagaacttacaggaataattgggaaacggttaaattttgggtttttagtaaaaatgaagagagtatttaa

SEQ ID NO: 38013 - DNA, 324 bp, Glycine max
  Peptide Sequence Number=SeqID_154791
atgtctcaacaacttctaaaggaggtggcaagaccacctgtgatcgtaggcattgatgctaatggacaagcatttaggttttactcaggaggagttttcactggggagaactgtggaactaacctaaaccatgcagttactgcaattgggtataatgaggacgcaaatggcaagtactggttgataaggaattcatggggccaacattggggtgagggtggttacatgaagattaagagggacactggtgaccctgcagtgcgacaatgtagcatctatgagaccatgatcttagctcagttcatatatgtctctcacatttaa

SEQ ID NO: 38014 - DNA, 1509 bp, Glycine max
  Peptide Sequence Number=SeqID_154792
atgtctggggaagtttttgatggacaagatgcaggctatgtgcctgagaaccctgagtttccacaaaaccattctgatgaacacgatggaggaaatgtgattgatgactctgggttcccgcagctgcagcctgatgaacatgatgctggagggtttccgcagctgcagctgcagcctgatgaacacgaaggcggcaatttggctgaggatgccaatcatcctgaacataattttgacgggaatgatgttgaaggtttgcctggacctgattttcctcctcaagagcatgcagaggaacaacatgttggaggagacgtgactgagaattttgcctctgaggaaaagcaggaacctgaggaggatttgaaaggaggtgaagtaaagaagtggccagggtggcctggagagaatgtttttaggatgttggttcccgtgcaaaaggttggcagcattattggacgaaaaggagagtttattaggaaaattactgaagagactaaggctcgtataaaaattcttgatggtcctcctgggactgcagaaagagctgtaatggtttctgcgaaagaagagccagattgcagcataccgcctgctgttgatggtttgttaagggttcataaacaagttgtcaacgtggaccctcatcctgccgatagtgcatcaggtgcaggacgcccagttgttacaaggcttctagtggcagatactcaagcaggaagcttgattgggaagcaggggtccactataaaatcctttcaagatgccacagggtgcaatatacgcattcttggttcagaacacctgccagtttttgctctgcgagatgatagtgttgttgaaatacaaggggaatcttctggggttcacaaggcggttgaacttgttgcaattcatctacgtaaattcttggttgatcgcagcatagttgtagtatttgaaacacaaatgcaaaggccagatgttcgagtaaaccagaatgtgccaccaggcccaccacaccaaccttggggtcctcctcaaggttttcaagctcctggacctggtagtggtggtggacctgcttttccacccaatcctcagtatatgccgccttcacataactatgataattactacccacctgctgacctgcctcctatggacaagcatcttcatcagggtccagcacctgcctatgtaagggatgcttctatgggaattcattcatccagtgcacagccacaacaatctgttgtgactaaggtcacgcagcacatgcaaattcctttgtcctatgcagatgctgttattggagcatcaggggcaaacatcagctacatccgtcgagctagtggagcaagtattacaattcaggagaccaggggtgtgccaggagagatgactgttgagataagtggtactgcttcacaaatacaggctgcccaacagctagtacaggtatttcattttaaagggcttttgcattcgtctaatctacacgttagctatcttatagttattgtttga

SEQ ID NO: 38015 - DNA, 447 bp, Glycine max
  Peptide Sequence Number=SeqID_154793
atgctggatgccccaagcaattccccaacaacttccatgctcactttgagcttaggcccaaggtggtggtggcaccaaaaggtgcctcctcctctgaaagaagcacttgttgttgcttcttttcttgctttttttggttcttccgggttcttgcttcctcttcttcgtcagggacactgcgagccaagcgccaagcttcttcttcttctctgcgaacaaggcttcgaggatagtaaccttagggtagaagacgccggaaaaaatggggaaagggggcttacggcagcggcttccagaagatccgttaggggttcttccggaagtctcccggaacacctcttccgaaaagtttccggaataagtagttcttccggaagaattccggaagaagggttcttctggatgacctttgagatttctggaagaactttccggaagaaatgttga

SEQ ID NO: 38016 - DNA, 870 bp, Glycine max
  Peptide Sequence Number=SeqID_154794
atgagtacagcatgttcgccgcttcaagtcattttgctccaaacctgcatcatgctttctcagtacccttatgactaccttctcaacccaaacgcccaactttataattcgacacccagtaatcaagtattttatgatcctcgttttatcagtcagtactacgttcctcccagcttcgggttttatcctaattttccgtttcacgcgccaattacctatgatcagaatgtgaaaacggataaagcgtgggccagcgttagaggaaggaagcttccagctgagagtaatgctagggctcttcgtaatcgagctcaagctgttccgtttccaaacaccattcaagaagctgagacttattccatcaccaccgtcatgattcgcaatatccctaaccaattcaagtttgaagacttgctgctcatactggacgagcattgctttcaacagaacaagagcgctgaggataccaaggcttggtccaagtttgattttgtttatttgcccatggattataggaaacacgcgatagagaaaaggatgtcgaatttgggatacgcgtttgtgaacttcaccactcctactgcagcgttcaagttctacagcgagttccaaggtttcgagtgggatgtcaccaaaaacaagaagatatgtgaaatcaacgtggctcagcatcagggcaaagctaatctgaagaggattttccaggcaaaggttttcaagtgcgagagccgagattttttgcctgtgctatactcacgaggccgtgatggcttgaaccgtcgaatcaagagaaattatgtgggaaaacatgtatggggtcttccacgaagaaccctaggaacctcttcttttaacccaaatgacgtgtga

SEQ ID NO: 38017 - DNA, 279 bp, Glycine max
  Peptide Sequence Number=SeqID_154795
atgaaacagaacaactcagggacggaacaaagcaaggaagcaaacatgtcacgattggccaggaatggtgacaggttcaccagaaaatgcccgcgaaggtctcatgaattatcgaaaactatggagagccaagggtgcaaagttgggggtcaccaactgtcacagctggcaagaaaatgttgggaaatgctggaaatgttgcatggaaggatgggtgtatgtcgaaaaggagaacagttggccctacttcataacagactaacagaggcacacaagtga

SEQ ID NO: 38018 - DNA, 1431 bp, Glycine max
  Peptide Sequence Number=SeqID_154796
atggcctcagaagagcccactgtcgcggtggaacccgctcccgaacctgccaccgccgagcctcccccggaggagaaggaggagcccaaacctgaagccaaggctaagaaaaccaaggaacccaaacctaaaaaggtttccagaccacgcaaccctcccactcatccttcctacgaggagatgattaaagacgcaattacctcgctgaaggagaaaaccggttcgagccaacacgcgattgcgaagttcatcgaggagaagcacaagcagcttccaccgaacttcaggaagcttcttctctaccatttgaagaaacttgtagccgctggaaaactcgtcaaagtcaaaggctccttcaagctcccacctacccgaccttctgcatcttcttcttcttcgccggcgaagaagaagaagcccgcacctgctaagccccaacccaagcccaagcctaagcctaagcccaagcccgctgctaaagccaaggacactaaggcaactaagtcaaaggcaccagctaagcccaaggcagctgctaagcctaaagccaaagttccagccaagcccaagcccgcccctaaaccaaaggctgctgctgctgctgcttccaagcccaagcctgctgccgccaagcccaaagggactaagccagctgccaagcccaagcccaagcccgctgctaaaacaaaggctgctgctgccaagcccgcggcaaagcccaaagcgaagcccgccaaggcttcaaggacgtcgacacggacttcaccagggaagaaagcagctcctgctgcgaagccggcagcgaagaaagtagcgcctgctaagaaagcgccagtgaagagtgtgaaaccaaagagtgtaaagtctccagcgaaaaaggctacggctaagagaggggcatactacgacaacaatggtggtggtccaccctgtgacatgtcaggtggcagtgtgtatcaccttgtggatgtgcatgtttgtggtggcgcttgcaaccatgatatttcagagaatggtgtaccctttgctgttgctacacgtctgagtccacggggcacatttcttgctgtccaatgttacacttggtttgttggcccagatgcaggggtgatgttcgatccatttgatcaacagttgcatagaagtcaactgtgtggacgagggcttgtgacactagttggctggacagttcacagcccctctagcgctaaactaagaggctcgagtgataatgctgggttcgaggccagcacctccagaaataaggggggagaagaacagagaaaagcagaaaggagaggaactttgctattttcattcatgcctgatttgctatcgggaacaattccaaatcaagctatatacgatattggtggtgctgcatatgctgaacatgaaatccccgagctgccctcaagcatagtctcgaag

SEQ ID NO: 38019 - DNA, 282 bp, Glycine max
  Peptide Sequence Number=SeqID_154797
atgcaaatctggtggctccaaaacagaggagaatgggagagaatgtcaagacccaaaacaaagctgggaaaaaacaccactacagatgcaaatttggttgcaccaaaacagaggagaatgagagaacgtcaagactcaaaacacagctgggaaaacaccatcacagatctggttgtgcgacacaaattgtgccctaggaatgtaaactcaaacgattttatgagttggctcgcaattttgataaccatgcaatcaacagaagatctaacagtgaatctctaa

SEQ ID NO: 38020 - DNA, 336 bp, Glycine max
  Peptide Sequence Number=SeqID_154798
atggagagtgggttccaactcttgatgcagagtggatggcgatcacgatggacattgcctctgtgtggttgtgtctggggagagacgaaagtgagtatgacagagagggagagagtgttgttccctgtgtttgtcaatccagaagccacaacacaagacttggtgaggaaagagaagatgagaatgttccacaaaatgggttatggggcaacagtggtagacgagtgcacgtgcatggcgaagatcaaagacatggatctatgcttggaattcatcgacacctatgtctacaccacaaccatgacgttatcggtcaaaaactttaaccgctactaa

SEQ ID NO: 38021 - DNA, 1380 bp, Glycine max
  Peptide Sequence Number=SeqID_154799
atggaaatatgttaccatgcccacatcgatcgcgagattgaatcgctcctagaaagaatacatcctcccagggtctgtatcgataatgattcttgccgagactgcactgtggtgaaggttgatagtgcaaacaggaagggcatattattggagatggtccaagtgttgacagatcttgacctcatcatttccaaatcatacatttcctctgatggtggatggtgtatggacgtgttccacgtgaccgatgaagctggcaagaagctcacagacgaaaccctcatgctccacatccaacaggaactgtgcgccactagaagtaaaggggagatttcaagggatacagaattggctagtcagaaaggagcacaggcacagcaacaaaacgtggcaatggagaacacggcattggagatgagtgtgacggaccgagcgggcctactatcagagctatcagcagtgcttgttgagttgggctacagcgtcacctctgcaacggcctggacccacaacgacagggtggcctgcattatattcctggaagacgcatcctcacctgggcccataagcgacccaaaacggttgggcctggtggaggagcagctggagaatgtagtggcggcccacggagaaacgggccagaagaacagcgtgagggtgacgacgctgggcaccgggcgcacccacacggaacggcggctccaccagctaatgtacgccgacagggactacgagagctgccgcgcctgtgataggacccacgtctctgttggtcgatgcgaggacaaaggctacttggtggtcaacgtgaggagcagagaccgtcctaagctattgttcgacaccgtttgcgttctaacggacatgcagtatgtggtctttcatgctgccattagctccaaaagatccatggctgatcaggagtacttcataaggcactgcaagggtagtttagctctgcccagtgaaagcgagacggaagaactcaccttatgcttaatcgctgcaattgagcggagagtctcgcgtggattaatggtagatattcgaactgagaatagaatggggctactatcgaatgtgacccgggtgtttcgtgaaaatgggttatccatatcgaggtttgagattggaacagagggagaaaaagcggtaggatcattctttgttacagattcttcaggtgaacaagtgaacccaaacatcgtggaattggtaaggcaagcatccggtggatctgttgttacagatcacaagtcgcctcatagggtgcgtcaatctcaatcggatatagaagctaaacctaaattctctctgggaagcttgctatggtctcgattagaacgcctttccggtggttttgggcccattagatcgtga

SEQ ID NO: 38022 - DNA, 327 bp, Glycine max
  Peptide Sequence Number=SeqID_154800
atgtccgattcgaaggtcgaaaccatcgccagattagcccaatggaaaatcgacaacttcggaccctgctcctacaagaaatcagaccctttcaagctcggaatttggaactggttcatgtccatagagaggaacaggtacctctacatacacatctttccggagccttctcggcttactaaggaacagccacccgtggcacgcttcatcctgcgagtctccaacaactctggccctacccgcaaattttacatttcccctgttgatccatgtgtgtttgtgagtgaaaagatggaatttggggttgttgattgcaaggagatatga

SEQ ID NO: 38023 - DNA, 453 bp, Glycine max
  Peptide Sequence Number=SeqID_154801
atggggcgaggtggggatgggtatgcgattccccatccttgcttcctcaaacccatccctatctccgacgggaatgattttttttttccatacccgttcctgttggggatcggggagaggtacgagtacagggcgggtaggtttgtttgccatctctacctacgacaactctcctacttctccggtgatcggtctcttccttctcccgcgccacctcatttcacctacaccctctttttcgtggctcttcatacgccctccttcctttgcgcgttgacattcaagacaagttcctttcatctcttttgggttttagcgaggggttgggttctggtagggaaggttttcagttccagaacaaatattctggaacaggtagttcggaataggtgtccaagaatagttgttctgttagtgctattcaggaatactcgtgttgaagatattagataa

SEQ ID NO: 38024 - DNA, 360 bp, Glycine max
  Peptide Sequence Number=SeqID_154802
atgcaacacaaaggaggtctaggaacttggttgggattagaaaggtcttttggtgatatattccacaaaggagctaaaatgcatggaagcaccttaaaccttccagggctagacattgcctcaggattgataagagcaagtcatttctatgctagttattttcaaacagtggtgctgacacaggctccacacggtcacttggtccttagtgacatggtttactttgatgtgatcgtgggtaacaaacaagctatattgaatgcattgatatcggtattgacagcgaacatagttaaatcaagaaacttcattaagcctatgcttcgatggagagataaaaaacatttactttttgaataa

SEQ ID NO: 38025 - DNA, 609 bp, Glycine max
  Peptide Sequence Number=SeqID_154803
atgaccaccgccaccgagaagctctccgctctcaaatccgccgtcgccggattgaacgaaatcagtgagagtgagaagaacggattcatcagcctcgtcagccgctatctcagtggcgaagcgcagcatgtggaatggagcaagatccagacgcctacggacgaagtggttgtgccttacgacactttggcgccaactcctgatggttcttcggacgtgaagaatctattggacaagcttgtggtgttgaagctaaatggaggcttgggcacaactatgggttgcactggtcctaaatctgtaattgaagttcgtgatgggttgacatttctagatttaattgtgatccagattgagaatctcaattccaaatatggaagcaatgttcctttgcttttgatgaattcattcaacactcatgatgacactcaaaagattgttgaaaaataccaaaactccaatattgagattcatacttttaaccagagccagtatcctcgattggttgctgaggactttttgccattgccttccaaagggcatactgacaaggatggatggtatgacttcatctttgtatttttatactcgactatattattgttctga

SEQ ID NO: 38026 - DNA, 513 bp, Glycine max
  Peptide Sequence Number=SeqID_154804
atgctttctgctcttccttttcagggaaacccattcccggcgttggactacgctttcatgccgtgggatgggcttgactctttgggcttcaagcccaccagccccaatcccgtcacttcgagttccggctcaggctacccaaaccgaacccatgccgaagaaaaaccggcctcggacaagtcgaaccacgtcacgtccgtcatggaggagcggaaacgcaggagaatgatatcgaaccgggaatcggcccgaaggtcacgcattcgtaaacagagacatcttgagaacttacggaaccagatgaatctatttagggttgaaaatcgaaaactgaacaacgggttgcagtttctccttcaccactgtaaccgcctgagaaccgaaaacgagtggctcctgtccgaacgacccatgctccgtcaaaaactagccaacataaatcaaattttgcttttccgacatttgcaaccattttcctctgcatggccctgcaatattgtcttggcggaataa

SEQ ID NO: 38027 - DNA, 943 bp, Glycine max
  Peptide Sequence Number=SeqID_154805
tgcaaatatggaagccatcaaagaattgaagaatctgttgcaatccgagtttgaaatgaaggatttaggggttgcaaggagaatactgggaatggatattatcaggaaaagaaatgaaggtctgttatatctatctcagtcaagttatgtgcagaaactattgagaaggttcaatatgcttgattcaaaacctgtatcaacacctattgctggacattttaaattgtcaatcactcattctccacaaacagaagatgaaatcaaagatatgagtagaatcccctactcgaatgctacaggttcacttatgtacgctatggtctgtacaagaccagatttagcatactctgctagcattgtaagtagattcatggaaaatcctggaaaacaacactggagtgccataaagtggatcttaagatatctaaagggttcaaagtctgttggtctggtttatggaagaaattcagaaagaatcaatggtctgtcaggctatgttgatgctgattatgcaggtgacattgacaaaagaaggtccttaacaggatacttattcactttgtatggaagtgtcataagttggaaggctaatttgcaatcagttgtggctctatctaccactgaggcagagtatatagctctcactgaagctagaaaggaagccatatggcttaaaggtcttgttcatgagctcgaaggaaagactggtcctattgaagtatggtgtgatagtcaaagcgcaattgatctctctaaaaaccaagtttttcatgagaggacaaagcatattgacattaggatgcattacatccgagacatcatagcacaaggtgaagttgaagtgaggaaagtggctggagcaaacaatcctgcagacatgttgacaaaagaaggagagcttgctggtcctaatattgaagatccaaggtggagattgttatga

SEQ ID NO: 38028 - DNA, 1992 bp, Glycine max
  Peptide Sequence Number=SeqID_154806
atggccaattccatgagctttttcctgcttctttctttactagcttttgctcccttgtgcctctgtcactataaccaagagggttacctctaccctcagttttatgactattcatgcccacaagttcagcatattgtcaagtctgtccttgccaagtatgttgcagagcaacctcgattggcggcttcaattctcaggcttcatttccatgattgttttgtcaagggttgtgatgcttcattgttgttagatagcagtgtaaacatcatcagtgagaagggatcaaatcccaaccgtaattcagctagaggatttgaagtcgttgatgcaattaaagccgaattagagagaaaatgcccttctactgtgtcttgtgctgacatcttgactctagctgcaagagattcagttgttcttactggtggaccaagctgggaagtacccttaggcagaagggactcactaggtgcaagcataagtggctccaacaacaacatcccagccccaaacaacacattccagaccattctaactaaattcaaccttcaggggcttgatcttgttgatctagttgctctatcagggggacacactataggaaatgccaggtgcaccaccttcaagcaaagactctataaccaaagtggcaatggcgagccagattctactcttgaccaatactatgctgctacattgcgtaataggtgtccaagctctgggggtgaccagaatctgttcttcctagactatgccaccccatacaaatttgacaacagctacttcacgaaccttttggcttacaagggtctcttgagttctgatcaagtcctcttcacaatgaaccaagaatcagctgaactaggtgtaggtgttgatggaggtggtgttggtgatgtcagtcctagtggaggcaacaataatgtcaatatcgataacggtgttaagaatgatgatggtagtgattgtaatgtcgatgacagtgataatagtggtggtggtgatgatattgatgacggcaattttaatggtggtggtaatgatagggatagtgttaattacaatgatggggctgacgctgctgaaagtgatggacatggtggaggtgatgcgcgagaaggtggcggcggaggcactgtcggggtagcagaggtgaaggcggcggagaagacggcgttcgatgtgaagctcgagggttttgatgtggcggcgaagatcaaggtgatcaaggaggtgaggatgtttacgagcttggggttgaaggaggccaaggatttggtggagaaggtccctgcggtgttgaagaaaggggtcacaaaagaagaggttgaaagtatcattgccaagatgaaggaggttggtgctaagggttcggagaaggtggcggcgatcgtggacgagttgatggggctgacgctgctggaagtgatggatctggtggaggtgatgcgcgagaagcgcggcgtcaacgagcttccgatcgcgatgctcatggtgcccggaatgggcgtgccgaggggtgttccgaatggtggcggcggaggcgctgccggggtagcggaggtgaaggcggtggagaagacggtgttcgatgtgaagctcgagggtttcgatgcggcgacgaagatcaaggtgatcaaggaggtgaggacgtttacgagcttggggttgaaggaggccaaggatttggtggaaaaggtccctgcgatgttgaagaaaggggtcacaaaagaagaggctgagagtatcattgccaagatgaaggaggttttaaatatcggtcgttgtcttgttgcggattcatcgcaattgttaatactgtggagtaatgcggccgcccaaatcatggtttcagacctttttaaaacctccaatggtttagaattgctgtccgcaactgctgttttggacgttctcagttctcacatcattatggaggccacattttcctataattgtgtgattttggtcatggctgctcgtactggatgttag

SEQ ID NO: 38029 - DNA, 534 bp, Glycine max
  Peptide Sequence Number=SeqID_154807
atggatgaagattcactccacgtgagtgatggaaaggacttagattttaatcatgggttaaggagttgtacaacagatggagatatattatacttagtgaaggatgctttggaaaatgagaatgagataaacgtttattttcatcatgaagtagatccaattccagaagaagtcccactgatgttggacttgaaatgtcatccaattccagaagctagtaatgaggatgatttagatgatgtacctgttgttgaccatgaggaagtcaccattgatgcaaatgttggtggtggagagaaaggtattaatgtggatgttggtggtggtgaagagaaagatgtccttgcacctattgttgatgttccaccaatagcaaggtataagctaaacatgagaagacctaaacaaaagaacattccagacactttaatagtagacgtgcctgttgtggatgacccaccatcaacatccttacttttcatgccaacaccaaggttcactagaaggaaggctgctgataaagatccagtataa

SEQ ID NO: 38030 - DNA, 759 bp, Glycine max
  Peptide Sequence Number=SeqID_154808
atgaccatgatggatttaaacattgcccaacaaattggtgggagttcttggagattcttgggaatagaaacacccttaccttgttgcctccacgagtatgacaccagtgttgttgctgtgaaggcttcaaagaaatcatcaagaatatgcaaatactggatagatggcaactgtgcatacggtgatcagtgctggaatagacattcgtttgttaatgttatcaagaaagatagtccaagacccaaaaggttggtttggtggacagcacctcctataatgtttgtgaagataaattgcgatggggcttttacccgctgtggaaataaagctgctgccggagggattgtgagggattggaaagcgaattttgtctatgctttctctagtagattgggtaagtgctgcacggcgctagaggctgagttatgggcaattaagattggagtagaaaccgcagtatccagggtatacggtaatttgattgtggagagtgattcgtatgcaagtatccaactcattaacatgggagttccacaaggtcacattttttatgatcttgtctcttccatacttgagattggtaacaaggccaatcatatagtttggaatcatgtcttcagagaaactaattcgacagctgatggtctcgccaaacatggattgtcattgtctagtggggtagaactttttgagtttcctccaccgttcatttgggcccctttgtgtgcagatgaaatgggagtaatatactctcggtga

SEQ ID NO: 38031 - DNA, 525 bp, Glycine max
  Peptide Sequence Number=SeqID_154809
atgagggaggaaggatttagtgcactttacaaagggattgttcctgatgcatttaggaccataatgagggaagaaggatttagtgcactttacagagggattgttcctggtctatttctggtctctcatggtgctattcagttcacagcatatgaggagctacgcaaggttattgttgattttaagagtaagggaagtacagtgcataatcaaaaccctgataaattgctgaattctgttgattatgccgttcttggagcaacatcaaaactggctgcagtacttctaacctatccatttcaggttatacgggctcgattgcagcaaagacccagtggtgatggggttccaagatatatggacacgttgcatgttgtgaaagaaactgcacgatttgaaggtatccgaggtttttacaaaggaattaccgcaaacctcttgaagaatgctcccgcttcttcaataacatttattgtttatgaaaatgtcctaaaattgcttaaaccagcaagaaggaatgactga

SEQ ID NO: 38032 - DNA, 600 bp, Glycine max
  Peptide Sequence Number=SeqID_154810
atgaagaccaatgtgacgctaactggagatgcgtcacacgtcgtgcgtgtgaacttcccgcgccagggccctatatggggtcgtgtgcggtggtattttgagttggttgcacatgtggacagtgtggtggtcttcggcgagcgacagtggttgaagagcattgaagttccaatgagatcatcgtcaccaccatcgtgtagatcagtggacgataatgctgatgatgagatcttgagaacatctccttcttccgatttcattttcacccaaaagcttctcgctttcaacatcaccctcaccaaaacccctcttcaacgagccctactcttcttctttctccatcccaatcgaatggccgagggtgcacgaaccgcgcatgcacccgccccgcacccgatccaacccaaacccgacgataaaaccccgaatccggtgaaggagactccgccgccgccggagaaaccggagcccggcgattgctgcggcagcggatgcgtccgggacgtttactacgacgaactcgaagatacaataagctatacaaacaagacgatcccagccccaaagcttcttcatagtcttcatcatcgcatgggttag

SEQ ID NO: 38033 - DNA, 1782 bp, Glycine max
  Peptide Sequence Number=SeqID_154811
atgaagcctatagaaaatggcaataccgttaacatcaactatcaaaatagctggttaggcttctccctctccccacaaatgatcaatataggtgttccttcacaccttcatcagacacagccttcacccgcagctgttgaaactgttccaccaagcttttatcatcatacacctctccatagctatggctcttactatggactggaaggtgaacacgttggattgagttcatccttgcctatcatgccccttaaatccaatgtctctctctctggaatagaagctctgagtagatcacaagcacaagcaacgataactacttcagcaatgcatccaaggttaaataatatgctttacaaccagctcttatgccatggactaaacaatccaaacaacttaaatcacattcaagagaatatcagccagcaacaattctcgtattactctaccttaagaaaccatgatatgattttagaaggttccaagcaccagctcccatgtatagctgaagatgaaaatccgggtttgaagagttggttctcaagggacttccctgctagacatggagaagaatcaaggatgattgttcctttggaggacaataatggaggcgaatctggatccattggatcaataacatatggggatttgcattcattgaatttgtctgtgagtcctacctcaggatcaagctgtgttacaagttcacctgctatcactaatactgttgccactgataccaagaaaagggggcttcaaatggtggaccagaatcagaagcaaataggtcataggaaatccatagatacctttgggcaaagaacatctcaatatagaggtgtaacaaggaatgtttgttcatcaggcataggtggactggtagatacgaagctcatctatgggacaacagctgcaagaaagagggccaaggaaggaaaggaaggcaagttggaaaattatcaaaacgaacttgaggaaatgaagaacatgacgagacaagaatatgtagctcatttacgaaggaaaagcagcggattctcaagaggggcctccatgtacagaggagtaacaaggtctcacaggctagcatttacacagcaccaccaacacggaaggtggcaagctcgaattggaagagtggctggaaacaaagatctatatcttggaaccttcagtacccaagaggaagcagctgaagcctatgacattgctgctattaaattcagaggagttaatgctgttacaaactttgatataacaagatatgacgtggaaagaattatggagagcaataaccttcttagtagtgaacaagctaagcggaaaagagagatggatgatggaactagaagcgaggctacagttaaccaaaaaccttgtactactcaagaaaccgttctgatgcagaaaagatgcagaagccaatcagaatggaagatggttcagtatccatcctcccaacagcttgatcagaatccacaaagaattgagtgtagtagaactgagtccttgtcaactgctttagataacatgtttcatcaccaagttgaggaatcgagtaacatgggaacacacttgtcaaatccttcttctctggtgacaagtttgagtagctcaagagaagagagcccagataagacaagcttgccaatgctctttggaatgccttcaacagtgtccaaattattggctgacgtggattctttggatctatcttccaatctcaggccttcgctttctattcctcagatgccaatttttgctgcttggaccgatgcataa

SEQ ID NO: 38034 - DNA, 937 bp, Glycine max
  Peptide Sequence Number=SeqID_154812
atgcagaatttcggcaccgcctgggcggtgaagcgcgccattgtcgatggcgaaccgatttcggaacgcgtggtgacgctgaccggcgaggccatttcccggccacgtaatgtctggggccgtctcggtaccccggtaagccatctgttgcaacaggtcggtttcacgccgggtgcgcgccagatggtgatcatgggcgggccgctgatgggctttaccctgccgtccctcaacgtgccggtggtgaagatcaccaactgtattctggcaccgtcggccagcgagatggggcaaccacaggaagaacagtcctgcatccgttgcagcgcctgcgctgacgcctgcccggcaaaactgctgccgcagcagctgtactggtacagtcagggtggcgatcatgacaaagcgcgcgcccatcacattgatgactgcattgagtgcggtgcctgtgcgtatgtctgtcccagcaatattccgctggtgcagtattaccgtcaggaaaaagccgaactgcgcgccatcgatctggaggccaaacgcaccgccgaagccaaagcacgctttgaagcgcgtcaggcacgccttgagcgggaaaaactggcgcgggaagcgcgccacgagcaggccaaacagcgggttgcgcgcagcgataaagccgagctggaagcggcaaccgggcgcgtgaaagcgcgtcaggcgaagacgccggaacaggaagccgccgaacgcgaagcgcgccatgcgcaggcgctggcgcagcaggccgagaagcaggctgaaaccgaaccgctaagccgccaggccattgacccgcgcaaggccgccgtggaagcagccattgcgcgtgctaaagcgaaaaaagtggccgcgccggcacggccagccgctgacaccacgaccgcagaaagcgatccgcgcaaagcggcggtcgaggcgg

SEQ ID NO: 38035 - DNA, 495 bp, Glycine max
  Peptide Sequence Number=SeqID_154813
atgaccaccttgacccagatgtggatgacattgttgctcagcaacgtcctgcccagcgatcataactctgacctccctctgccgaagtgtcagctggtgtatgtcatcctgacacggatgagcgtccatgtggctcagttgatcgttgacgccatttatttattttcaggtatgccacctaccaggcaccctctagaccaagataagtctaacagggccatggggtttccagcgttgatcacgggtctctgccagacattcggggttcccgtcacacctagagaggcgcagggtgatgcaccgcaggccgcagacacaccgccagaacctcatcaggccgatccagctgggtcatttgacatggagcgggttgagtttgcatggcccggagattggcctgaggcccaggcaggggaggtgcccgtagaggctctcgacgatgccgaggaggcccgcatggatgaggagatgacagatttactcggtttcttgtga

SEQ ID NO: 38036 - DNA, 740 bp, Glycine max
  Peptide Sequence Number=SeqID_154814
ttcaagaggaaaaaaagagaaaaacagaagaagaagaagaagaagaagaagaagaagaagaagaagaagaagaagaagaagaagaagaagtgagaagtgagagaaaggggaatgaaatgggaatgagaaaagaagagatggaaaaaaccgggcaggacacgtggagaatgagaaaggttggacgaagtgagaatggggatgggttagagtttatttattgctcttctgttggtgtctatctcaaatctgatctacacctcatgaagagcggtgatatagactgggtttctggtggggccattctgaatggcccaagaacagtcttcattgaggctaaaacaaaaggtgaacgaatggagactaaagcgggaatgaaggataacttaaagggagattgggaagatttgagagttttagagaaagaaatgcaggaaaacattagaaaaaggaaatcttatcaaagtagagaaggtcgaaggggttcaacttctctggcacagcatagcggaactgactataacaagtatgtccgtttcacatggtacatgactctcagccctgatagtataggactgtggagaacaacatcccttagacggggtaaacgagaggcaagatccaaagatcctgctgctgtggttgtggatcattcaggatatgcagtgtctgctactgaaggagatcatacattgattgctagtgatgattttatcaagtctgacgtcatatttgctaaataa

SEQ ID NO: 38037 - DNA, 108 bp, Glycine max
  Peptide Sequence Number=SeqID_154815
atgggtgcaaaggagatgtcattcattcacaaggatagtaaaaatcctgtcactggtcttgcggtgggtcctgatccatggcctcatcatctgtcaaatgcagcatag

SEQ ID NO: 38038 - DNA, 216 bp, Glycine max
  Peptide Sequence Number=SeqID_154816
atgaaatccaaatctaatatgttcaaagataagtggacccaatcttggcccatgagctcaaaaatctatcctaaggttcatgagaaccctagggccttcttcagcagctctagcccaatcctcttggagtctcttgctcatggctctggtgactggtcccttcctagggaggattgcatcatcccctccccctttaaagaggatttgatcttgtaa

SEQ ID NO: 38039 - DNA, 477 bp, Glycine max
  Peptide Sequence Number=SeqID_154817
atggaacatgatatgcatcaaagatgggaaggcaaggtttcagcgaagctgagaaacaccactaaggaacaagcatggcctctcgtaaaggacttcttcaacctccacaaacggttcccctccctcgccacgtgctacggggttcacggatctaatggtgagcctggctgcatacgattctgtgccggatcctccattccatcatccaacggctcagggagcgtgagctggtcaaaggaaaggcttgtagccgttcatgatgttgacttgagtttgaagtatgagatggtcgacaacaatatcggattcagatcgtacgagtcaaccatgagggtcctaagtgatgatgactccaatggatgcttgttggaatggtcctttgccgttgaccctgtcaaagggttggtgcttgaggatctggttaggaagtaccacgtggggcttcagcttatggccctgaaaatggaggacgaaatt

SEQ ID NO: 38040 - DNA, 606 bp, Glycine max
  Peptide Sequence Number=SeqID_154818
atgaagaaggacatttacaaggtggagaagattcctctcttcttcaaaggattttggacaggttcgatggtcttcaaacctttgttggtgaaaggttttatgctctggagttacaagtggacatgcgatttgatgagatggattcaagaattatcaagggttgtcatcatcaaaaaaggggagattgtagaagcaagcttcatgatgatgaatcaagttgattcaagtagttttgatgataacaaagatgatgacaaaaagcccaagagaatgatttcaagaacaagattcaagaatcaagagaagtttgatttcaagattcaagaaaagatgaattcaagattcaagaaaagaaatcaagaaggcttcacaagggaaggtacatcctttgtggtacaagtagagggtacatctacttgggttgttgtaactgagaacaagagagggtacatctcttgtggatcagttcaagtggagggtacatctacttggttgttcaaagagaataagggagggtacatcccttgtggatctttgcttgtaaaggtttttacaaggttgaaaagaaatctcaaggaccgcaggtcgcttggggactggatgtag

SEQ ID NO: 38041 - DNA, 414 bp, Glycine max
  Peptide Sequence Number=SeqID_154819
atgttactttatgcagacctgtcactgctagacctcctcatcaccgagccggccctgaacctggttaagtgctgcaatgagctcaacattgggtacgccaggggagtcggcgtgtgcgtggtgacgttcaccgtcaatgccctgttcaatggtcgttatgttgtacttgttgcctatatgagtgttacatctttgcttgagaatccagttcttcaagattatcttcaacctgttgttacatctgttgattcagaagcaaagcttcatggtgaatcaaaggtgattcaaagtgtttcgatgataacaaaagatgacgacaaaggtgatgacaaaaagctcaaagatcaatcaagaacaattcaagagttcaagataagaatcaagaagaattcaagactcaagaagaaagtctag

SEQ ID NO: 38042 - DNA, 741 bp, Glycine max
  Peptide Sequence Number=SeqID_154820
atggaggtgactcccaaaacattggctgatgtaaagggtggcactttgatttcttacgaaggaaggcttttggaaattgcacaagtcccagatgaacatgtcaatgagttcaagtcaatagagaagttcaaaattttcaacacaaataatttgtgggtgaacttaaatgcagttaaaaggcttgttgaagctgatgctcttaagatggaaattattcccaatccaaaggaagttgatggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagatggatttgtcattcggaacaaagctagggcaaatcctgaaaacccttctattgaacttgggccagaatttaagaaggttagcaacttcttgggccgcttcaagtcaattcccagtattgttgagcttgacagtctaaaagtggctggcaatgtatggtttggagctggtgttatcctcaagggaaaaatcagtatcgtggccaatcctggtgttaagctggaagttcccgatggtgctgtcatttcggataagcatgaggttgtcattccaatttctaagcctagaggtttaattgtcatacgcaggaaattaatggcccagaggacctcctgtgaggaagcccgctga

SEQ ID NO: 38043 - DNA, 486 bp, Glycine max
  Peptide Sequence Number=SeqID_154821
atgactcctaaacctttcaactttcccgccaaacgcacaaccgcacttttcctcctaaccgccactgccgtctccgccgcacaaacttccagctccgccgtgccctctcctctccccgcactctcccctgaaaaaatcggaggcgaaatccacggtctcatccgcaccgcacgtgccgtctccacggttgcatccacggttgttgactacgaattctcgttgcgcggccttccaaaggactccgatcagtaccgtcaaacgatttctcaggttcatctacgctctgccaagaggtttctcaagctatgcgaagccaacaaaggattttatgtgaaggctggacagttcgtttcggcgcagaaagtgcttccgaaagaatactcgtccactttgtcttccttacaggatcaggttgctcctcttccttttaaagttattggggaagtgttaaaggataatctcggacctgatttctctgagatgtaa

SEQ ID NO: 38044 - DNA, 255 bp, Glycine max
  Peptide Sequence Number=SeqID_154822
atgtctggaatgatggttgatggtcattatttataccctcaatacaggcttgagtggttaccattagcgtttgccaagtccatgtcttcagaacttgattttgttcaagaggcaaggaattccgagatagcagccaaaactttcagaaatagcaaaatggtcagaattcctcatgtattctgggacttgactacaagacaaatcctaaccatgcagttttatacaggacacaagatcaaagatagcattgtgtga

SEQ ID NO: 38045 - DNA, 375 bp, Glycine max
  Peptide Sequence Number=SeqID_154823
atggtggtggtgacggaggcgttgcgggttttcgccattgatcaggttccatttttcaaacttttgttcccccattctgtgtatattagtgttagtatgtgtggtagtatgattgggcttcaggtgagacaacttccacaatatccaaggcaacaatttgctagatttccaagtatgtctcctagtgctgttgatttgttagagaagatgcttgtccttgatccaaataggcgcatcatagaggagaaaaaagaagaagaaataactacaacaagaggagaaaaaggaggaggttattcaacatttaacatcggtgcttacgtcaccaacgatgttaaaacacattttttacatcgttcacgaatacaacactaa

SEQ ID NO: 38046 - DNA, 771 bp, Glycine max
  Peptide Sequence Number=SeqID_154824
atggtagcaaaatcattgactgagctgtttgctgaaatgatatttgtacatggctacatacatggtgatccacaccctggtaatatattagtttctcctgaaggttgtaatggtttctctttggttcttctagatcatgcagtctacacggtattggatgaagaatttagaaaagatttttgtcaattatgggaagctttgattctcaaggattcaatgaaaataatgcggctcggtgagcgattttgtgctgggaagtattccagatatttacccatcattttcactggtacaaccattgaaagcaaaaatgccgttggcatatcaattgaagaaaaagagaccttgaaacatgaattgaaatctctgttgtttgaggacttatcttcattcatggagtctctgccccaagattttattgctataatgcgtatagatgcactgttaaggtatatcattagaaagatggatgtctcacgggtcacgaggttgctaacttacaccaaatatgctgtgtatggtcgtctctgtccaaagttggatggggaagattttgctgtcaaagctagctttttcagtttcatgtcaacgttaaaatatcttcgcatcctactaacggtccttacaggggccactgacgttatccctaggcggcagaagttgaaaagtgtacagaattacttgcatagcaagatcaattgtgacactttgggcctcttggtgcattccgtttttcttcttttatgtgtctgtcctaatgcattgttttaa

SEQ ID NO: 38047 - DNA, 138 bp, Glycine max
  Peptide Sequence Number=SeqID_154825
atggccactcctatgagcactgcttgctatctggataaagatgaatccggtcagtcaatagacataaagaaatatagagatgcaaaactgatagaaagagcactagtggaacatgtcattttattggttctgctctag

SEQ ID NO: 38048 - DNA, 307 bp, Glycine max
  Peptide Sequence Number=SeqID_154826
tgttagagtactgcctctgaacattagcctacgtgttcttgaatttgaagatgaagcttacaaccttaaggttatttctctgatatcgtcgtgtgccgtcagtgagatcgtggccgtgccaccccgccgaagtcagccgcacaatctcaaaggtggttcttgtgtcgcgcacacgccggcatgccctgccccgccggtgaagttggagataggcattatttcccctgttaggataggtaggaatgcttccaaccaacaaaactcccaggttgttgaagtagtcaacaagtttcaatggggtatctag

SEQ ID NO: 38049 - DNA, 288 bp, Glycine max
  Peptide Sequence Number=SeqID_154827
atgaggctaaaccacccattgttgggagctcagcaaccaaacacttttgagtatttgatgactatagaggttggggactttctcacaatggcagctaaatacacaagttcttttgaaggatgttatgtgaaaaggaggataggtgtggaaataatatatgatgaacatggggtggaagcttatatgcagtttaaaaggggcatgtgccagcatgcaaggctctcacactacaacacttcatgtggtggcacttcactcaacatccttgctggtcagaatcctccgtag

SEQ ID NO: 38050 - DNA, 573 bp, Glycine max
  Peptide Sequence Number=SeqID_154828
atggagtgtggaagtggaaccttaagtagtgaaggtcgcgttttgaatcgaaggaagatattgttgaagaacttaatgaaaagttgggatcattcaccttacataattctcaggatgcatggctttggatttgttgcaccaatggaaagtacacgaccaattctgcttattgggaaatatatgaaacctggaaatgcaaagttacacttcttgcaacattggggcatccataaatctattaaaggtggacaagtgtggatggctatttggtcattagtggtgtggaacatgataattgttatgcatactgatactgtaggaggttatgtagcttcatgtagagcttgtaggccttggaacttcttcatcaatggagtctcttgcttcttgaagattaatgacaacggaatggagaaggaggaaagggagagggagaaaggggaacgaaattttgaaagagaaaagagggagaatgaggaggcatggaagaggattaaagaactggagtattgtgctcagcatgacaatcttgctcagtgcgtcaggatcgctcagcccaagaagcttgcttag

SEQ ID NO: 38051 - DNA, 249 bp, Glycine max
  Peptide Sequence Number=SeqID_154829
atgggggaaaaatggtcactttggggacattttccagcccctgggcccattaggaaacttagaggtgaagtaaccagcccgcttggaagcaagcttcatgagatgaaccaagcaattttgatgatgccaaaagccaaagtgagtgattcaagattgattcaagacttcaagatcaagcatcaagaatccaatccaagattcaagatcaagagaagaaatcaagaagcaacaagtcaaaacttcctataa

SEQ ID NO: 38052 - DNA, 336 bp, Glycine max
  Peptide Sequence Number=SeqID_154830
atcccaacggtcacaatgcagacttatgtgctagagacttccagtaaaagtttcgcgtcgatccaacggttaacgaattggaacgaggagaatgttactgggcttggagagattgatggggacccggtgttgagaggaacgaggataagggctacgtgggagtacgtgagctcagtgaaggtgggcaactggggatgtggtacctggagatatgtcacgggggtcaggagaccttggggacgacaggcgagctcctggcagtcaaccgataaaagaacaaagaccacaaagcaagaaggcttgtgtggtggctggccagctgtgaatcttgagtga

SEQ ID NO: 38053 - DNA, 267 bp, Glycine max
  Peptide Sequence Number=SeqID_154831
atgacgtttttcctaagctacacgaaagcaaaggctgaaggtgttacagtgtgcactaagccagacaactcgtgcttaacccaatttctctttgtagaagcaagcttcatgctgatgaaccaagtaattttgatgatgccaaaagcccaagtgattgatccaagattaattcaagacttcaagatcaggcatcaagaatccaatccaagattcaagattcaagagaagaaatcaagaagcaacaagtcaagacttcatataggataa

SEQ ID NO: 38054 - DNA, 1347 bp, Glycine max
  Peptide Sequence Number=SeqID_154832
ttgttcgcgcgagatcacggtcaggctggccggtgtctgcagcacgctcaggcccagcgcagacccggcgctggcggtggaagacagttcaccgctgcgggtgtcgaccacgcgcacggtatccagcgtggtcggaggtggcgcatcggcggcaagggcgggcacggcgtacaacagggacatgcacagcgcaggcagtgtcgccctgcgcaggcgcgcggagttggggttggttttcatttgttcacggcatgcaaggccgccccgcagtggcagggcagctcagggaattcggagaacgcgcacgcagcagtgccaggccatgcctggcggctcgggaaaatcaatccaaaggcgcgcgcgcagggctcaggcggccatcaaggccggcggcccacgcgctcccaatgtgccgctgatgcgctgcggcaacgcctgcaccgcaccgcgcaacgcgcggcataccggcgccatcggcgccaacagcaacactgccgccaccagcagggtgatcagccgcgcggcgatcaggcagtagtcgcagtccacgcccatctcatgctcagcgtgtggatcggcaggcggcttcttttcggcctcgccgtgcgacatcccgtgatgctcgtggtgcccttccatcgcgtgctgcgcatgctctgcgtgcatcgcatgattcatggcagccaccggtgcggtggccgcaacatggccatgtaccagccagcggctcaccaacggggcgagcaacaccagcagcatggcaagccatgccagggcctggaaccggcggtggaggacagaacgacgcacgccgccattctacggggcgatggccaaccttggactgcgttcagggtttgccccctgcgacacggtgacgcagggtccagcgaaggttcgcagtggatgcttttcgctccccgcccatcaactcacgtactgggccacaccattaccaaacgaccagttttccttcttcacttccaccaggttgataaatacatcctcgcggcggatgcccaccgccgcgtgcaggccatcggcgatgccggcgtacagcgccttcgtctgctccagcgtgcgcccttcgttccaggtgatctggatgcagatgaaatcgtcggtgcggtccacacccagatagccggggtcgtagatcagcgtgccgggcgcgtgctgctggaagatctggaagcggtcgttttccggcacgcccaccgcgcgcatggcctggtagatggtttcgccgactcgttgcaggtagtcggcggatttacctttgcgaagatcgatgcgggcgagcggcatggtggcactccagcgtggatgggtacggcgacaggctga

SEQ ID NO: 38055 - DNA, 522 bp, Glycine max
  Peptide Sequence Number=SeqID_154833
atggtcgacggtgaattcggcgcgccggtccgcacccagcagccattgcgtgctggtgtagtacgcggtggcgtagtacgccttgtcgaacacgttgaacaaccgcgcggacagccgcgtgcgcggtgccgcctgccaggtcagcgccaggtcggtggtgctgtagccgggaagttccaacgcgttggcattgtcggcgtagcgcttgccgacatagcgaacacccgccgctgcgctccagtccggcaggaactgccagctcaaccatgcgttggccaagcgctcggccacgttcggcggcacgttgccatcgcgcgacaccagcaccgccggcgaaccggtggtttccaggaagtcctcgaactcggccttcagcaccgtcgcgttgacatcgagcgaccagtgcggcgcgaaggtccaattcaaggacgcttcaacaccgcgcgaggtctgcgcgcccacctgcacccggcgatccggcaccagcgggtcgcggctgagcagcccggtcttgcggatgcg

SEQ ID NO: 38056 - DNA, 618 bp, Glycine max
  Peptide Sequence Number=SeqID_154834
atgacgctgcgatccaccgccaggcgctggacctacctggtgcatcgctggctgggcattggtgggtgcctgttgatgctgctgtggttcgtgagtggcatggtgatgctgttcatcggctacccgaagctgacgccgggtgagcggctggcggcgttgccggtgctgggggatgcccgcggctggcaggggctgtcggcattgccggccgccgtgcaggccgagccggaggccgtggcactcacgacgctgcgcggcgagccagcgtatgtggtgcgaagcggcggcaacgtgggcgcctggtctgcgcgcaccggccaggttctgctgccggtgtcggcacagcgtgccgaagcatccgctgcgcagtttgctggcggccaggcgttcgtcggcgcgatgcgcgtggatgaggatcgctggacgcactcgcgcgcgctggacgcgcaccggccgctgtaccgggtggaggtagggggcgcgcagccgggtgacctgtatgtgtcctcccacaccggcgaagtggtgctggacgcaccgcatgtgcagcagcgttggaactatgtgggtgcctggctgcactggctgtacttcctgcgcatgcagtcggtggacccg

SEQ ID NO: 38057 - DNA, 201 bp, Glycine max
  Peptide Sequence Number=SeqID_154835
atgtgggatcaacacgagcttaaaggagcattcaaattgggtgtatttacccctaagacctacactctgaagagtctgttagggcctctccctcctgattcaggaaacctacactttccctttaacactgcgcatcaacacttttctcaagataaacactggtcgggttattgtataattcacagctcacaatacaagtaa

SEQ ID NO: 38058 - DNA, 1619 bp, Glycine max
  Peptide Sequence Number=SeqID_154836
aactcgaaacaacgccacattcactgtaggcccagctcatgacgtcaaagacggcgaagcagtagctggagaggaagagggagccggtgcgaaagtcggcggccacatcggcaagccaggtggcaaagaagcgaaaggcggtggaagtttcatggtggtgtgcgcctcatgtactatttcgagattcatgtcaaggatgccgacgtgggaggccaatagttgctgctatcacgacgatgatggtatgctctaccgtggacattgcaagggggaggcgtttggcccaacctatacttctgaagatgtagttggtgccgaaattaaaaatggccaaggttcattgcgccgttgcggcctggtgaacaacgatctcttccacttcaacctcggtgtggcttccgccgccggctcgatccagttgcatctcatcatcctggagcttctctacatgaacgaatttgtcgtcgcggtggacagggcgtcaacggcgctggatctattactggtggcgctggaactcctcttcgaggagtgcgtgcgctggtgcatggatttcctcaagccggtgtcatggacggatgaggaagagaagcaaatggtgagattaatctccttttgtagcaagaaagattcgaaggagctcatgtctagggtttggccttcgggagaggactcatgcgaagtgatgctgcaaggattgatttcctcgacgatgaacagttacgacaacactgcattcgagaaggctttcgtagggaagattcttcgggatctgttgtcaagggagacaatgaagagagtattggaaaaggtgttcaggatgagcttgaagatggtgaatgagtcgttggaggattattcgagtccagtgtttagaggggatcaaaacgagatggaggctattcaaaggctgaatctgcataaggcttcaacaaatgggaagcatcttctgtggctgttggagaggatgattgagcttagggttgttgatgtcacagtcagggaatggagcgagcaagctggcttcactactgatttgcagagggcgtttcgtgatgatgcctggaggaacattgtgtctggccttcctactgttattctcaggtgtacatttaggctcaccaatgctgtctctattggcgccattcttgcttctagacaggtgagaaagaagctcgtagaagattggctgtcgcgaatcatctccatattgcctatgttagatgctcaagaattagtgaagaaaatcatgtgctctagagaacttgttaaagttggtgatgacttgagtgaaattcaaatggatgggcataatgagcatggacttgattcgttacctcaagaggagtttctaagccttttaggtggtgcaaggactagcccaccagctcatcaatttctcgttaacactcttagagaagtgggtgttaagcttatttcaaatgttctctccggtgcaggcaaagaacttgaacgtattgtcttggaccacctccagcctgttgtagaagttattggatttagaataggagaactaagagggctttcaagatggtgtgcacggtatcaggacattggcttggatgagtcacttattaacaatgcaacagaaaaggctg

SEQ ID NO: 38059 - DNA, 426 bp, Glycine max
  misc_feature (413)..(413): n is a, c, g, or t
  Peptide Sequence Number=SeqID_154837
atgtcaaacggctccattatcgtccctccaaattgtcaagtgattgaatcaaacagaacatatactctgagggagtccccaaagagagttataaaaaatagaatgagaggactcaaggtcctcgccttcagaggactcaaattcctcgtctttagaggactcaaagttctagcctttagaggactcaaggtccttgcctttagaggactcaaagtcctagccttcagaggactcaaggtcctcgcctttagaggactcaaagtcctagcctttagaggactcaaggtcctcgcctataaaggactcaaagtcctagccttcaaaggactcaagatccttgcctttagaggactcaaagtcctagccttcaaaagactcaaagtcctcacctttagaggactcaaagttttagncgggatcctctag

SEQ ID NO: 38060 - DNA, 318 bp, Glycine max
  Peptide Sequence Number=SeqID_154838
atgggagtcatagttcttctcccatccttcttgatagttgtttcattcacaaaggcacttgatggccctggcaatcaaatcattgaatggttcctagaaccttggacacaatcactttgcgattgtctgaggatcgttgaagaagtgcctcactccacagaagagaagggtctcattgagtttgagaccaactttctcaagttgttggatgtcaaagaagtgttcaaggtttatagagggctaattgttagtatggatggtagtcatctctacgattggaataatctctatggctggaataatctcaacaacagatga

SEQ ID NO: 38061 - DNA, 345 bp, Glycine max
  Peptide Sequence Number=SeqID_154839
atggagaatcttccattttactttcctcacactatctacatcaacatcctgaggaatctgaagggcttaggtggtatggacgacatctattatgctgccataatcaacaaggtattttgggatcaaggtgtctatcgcatctttgacaagatggacgatgactctaagtacaccattatagccaaaggtgatgaggacatgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaag

SEQ ID NO: 38062 - DNA, 645 bp, Glycine max
  Peptide Sequence Number=SeqID_154840
atgtctgttgttcaagatggtgattatacgtgtgaagatatatctctaatatctgtttgcaacctgtcaaattatttaggaacagttttctgttttgttttggaagttagtttctctttgatagtttgttttcttgagtgctatataaacatagaacattggagtatttccttatgggcaagccgtagcaaatcaagggcagtacttagatactattgtgaaaagtacaaaaaacaagggactgatttgttggggaagacactagaagcaggggatcttgtggagaaatggcttgaagttgaggcccataactattacccaccaatctacaacttggttatgcatattttggttcacccattaaagggggagccatttgacccaaaagttattcaagagagtgaaaaaaagcttgggaaggtgcttgacatttatgaggagaggttatccaaggcaaagtacttggcaggggatttcttcagccttgctgaccttagccatctcccatttactcattattggataaatcaagtgaaaaaggagtatatgcttagagaaaggaagcatgtgagtgcttggtgggatgatattagcaacaggccatcttggaagaaggttctcctgctatacaaataccctatttag

SEQ ID NO: 38063 - DNA, 263 bp, Glycine max
  Peptide Sequence Number=SeqID_154841
atgaggataggaaaggagggaacatacaagtatgctaaagccagtgacatctgcaaaggaagtggccaatgcaatacctacaagggagagttcgccaagatgaccgaccagccatcatcaatgacaccacctgtagcaaaaactgtgacactgagaccacaaccattggttgggaaatgtccacgacgagcttgtggaggtcagggcagggtgaagggcgagaatgagatgtatggaggtcatggcaaggtgaagggtgaagg

SEQ ID NO: 38064 - DNA, 378 bp, Glycine max
  Peptide Sequence Number=SeqID_154842
atgatatccgcatcagggaatttgccagcttctcttcccattcttaatgggaagaattatgatcgatgtgttgatgcatatatcttggagaagatattaggtgtgaatactacaaaggaggcattagatattctcgcgaaatcctatgagggtgctgaaaagttgaagaagaactatggtgataagatagaagatgcaatgataatggacaagattttgagaaccttaaccccaaggttcaatcacattgttgttacaattgaacaaggaacaaaccttgaaggaatgaaagtagaagagctacaagggattcttgaagcacaagaaatgagactcaatgaaataaattcattgaaatcctcaaacaaagctttgtag

SEQ ID NO: 38065 - DNA, 402 bp, Glycine max
  Peptide Sequence Number=SeqID_154843
atgagtgacaatggtgaagaagctagagaaaatcgtccagttccccatttgaatgaaaggattctttcatcattgtcaaagagatcagtagctacccatccttggcatgatctagaaattggggtgtttctgcttgttcaatggctacaggttgtggagatcactaaaggaagcaaggttaagtatgaacttcacaaaaagactagattgattaaggttgatcgggttttgtattcatcagttgtttatccacataactatggttttatccctcgcacattgtgtgaagacaatgatccaattgatgttttggttctcatgcaggagccaattcttcctggatgtttcttgcgatcttgggccattggactgatgcccatgattgacggggtactgaattaa

SEQ ID NO: 38066 - DNA, 490 bp, Glycine max
  Peptide Sequence Number=SeqID_154844
atggacaatccagatgcaggaaatcttagtgcaacaaggatgtgcaaaagcattgaagggaaaggaaaatatgtcttcatgctttctcaaaaggagaagggtgatatgattgacaaggacaagagtgttataatcttgtgtcttggtaataagtcactaacaaaggttgcaagagagaagaccacgactgaaatatgggatgctattctatatggaaaggatcaaactatttccttggatgatgttcacaaatcagttcaaataaaagagcttcaaaagctacaagatttgaaaatcgaggataatggtgaaggcttgaatgaagattgtcatgagaaaaaggccaaggaatctaggaatttggttgattcattagatgttgtggttgctttggatggttgtgagagtgtgagggactactttgaaaccttggagctcaaagaaggtggaatggtacttctaggcaataacaaatcatgtgcggagcaag

SEQ ID NO: 38067 - DNA, 303 bp, Glycine max
  Peptide Sequence Number=SeqID_154845
atggggacttggaggaaactatctatatgcaacaatcagaagggtttgcaaaggacaagtccaaggatgcaccaatcgaagctggatagcacacctttgggtcaccacacaaagctttctatcacacaagctcctagcaccgatgaggaaaggagtaagatcggttctattccatatgctagtggagtaagaagaatcatgtatggtatggtttgtagtaaactagacttggctcttgtggttagcattattagtcattttatggaaaattcgggtcaagcgcattcagaggctttgaagtag

SEQ ID NO: 38068 - DNA, 564 bp, Glycine max
  Peptide Sequence Number=SeqID_154846
atgactcaccggcacattcagagttgtgcctattttaagtttgtaattattttagttaggagggcacacttaactaaagtgcaagttattggtataagaatgcatatgtcgaggcgagttaaggatttgttggcacaacaaggtctttcaaaggcgctatgcaacttgaagcttgagaagatggaggttttggattgggaggggttgcaagagagggttgtgacaaccatacacttatgttgggtagacgaggttctttatcacgtgatggagttgacgtcgttgggggagattatcaacgatctagcaaggttggacgtaaagattgaggatgaggataaggcatgtattttgctgtgttctttgcattcttcttacaaacatttggtgacaaccttaacgtataagaaaaactcaatgagtctggagtcaatacaagatgcactcatgtctcattctcaacggagacaaaatgcagtgaggagttcacaagatgatggtctgtatgtgaaggggaaacaagaatgtggaagaatacaaggaaagggttttggtggtaggtag

SEQ ID NO: 38069 - DNA, 294 bp, Glycine max
  Peptide Sequence Number=SeqID_154847
atggtggtgaaggtgtacggtccaacctatgcatcccccaagagagtgctggtgtgtctgattgagaaggagattgagtttgaaacagtgcatgttgatctcttcaagggagaggctaaggaacctgagttccttaagctgcagccatttggattgcttcctgttattcaagatggagattatactctctatgaatctcgtgcaataataagatactatgcagagaagtataaagaccaaggcacagacttgttgggaaagacaatagaggaaaggggtctagtggaacaatga

SEQ ID NO: 38070 - DNA, 354 bp, Glycine max
  Peptide Sequence Number=SeqID_154848
atggtcttctacaacacagaaaaccctaaattctccacctcgctctctctctcttcatacctccatcgctgtggagatccccataaagccggtgaagatatagaggcacaggtgttcgttgctcacgagattgagttggattcttcaccgtcggaagctatcctctttctcgtccgaacatggcatctacatccgccttatcaaaataacagggtcctacaactaatcacggtggatctttgtttggtaaagtttggtcttttgttctttaacaacaccttatcttgttattcaatccaaatccctttgtcggcactttgctttgatgttgataggccaagaagtaattcataa

SEQ ID NO: 38071 - DNA, 633 bp, Glycine max
  Peptide Sequence Number=SeqID_154849
atgcatgtagatgatgcaactgatgaggtccatgaacaacctcaagaagtagctgatgatgatgtagttcttgatgtcgagggttttccaagcggaccccatgatacatcagttctgattgactatgttcatcatgttgcagttgctggttggaatggagaggaatgtcctgagttgaagttatcttcacatggaaggaatgttgagaaatttggcaggcctgctccaaagattaaaggcttagtggttgccacgggattaagtcctctgatcgcatgttccttggacattggcgatcagggacttatatcggcttttgcggagagacaacataaggaaacgagtagtttccatcatctgcccatcacaggcgtcttccatagcttcaaggctcttcatatggacaaagttgtgttgttgttagttgaattgcttgaagttagtggagttgaagcaagagctaaaatagtacaatgtcatgggagtggaagctacacatggggagttgttgcccttgtccatatgtatgacaatttgaatgatgcatttaagagcagcgccagacaacttgcaggatatatcacacttttcaaaacatcatcacgggtagcaaacacctacaatgcaatctag

SEQ ID NO: 38072 - DNA, 909 bp, Glycine max
  Peptide Sequence Number=SeqID_154850
atggtggaggagattgagtctttgcagaagaatcagacatgggagctagttcagcttcctgcgggcaagagagccataggatgcaaatgggtgtacaagagaaaacctctagtttcagaaaatgaaggggaaaagtttaaggcttgcctagtagaaaagagacacatttctatcatggcagtgctagccttggtagccaattgtgacatgcacttggagcaaatggatgtgaagacaacatttcttcatgatgatctagaggagcaaatttacatggagcttccagaagggtctttgtatggattgaagcagtctccaaggcagtggtacaagcggtttgattcttacatgcttcggattgactacagacgatgtgagtatgactattgtgtttacgtgaggatccttgatgatgtcttttttatttttttgctactgtatgttgatgatatgctgattgttggcaaccatttgcatgatgtgaatgagttgaaatcactgttgaacaaagattttgacatgaaggacttctgtcctgccaagaagatgcttgggatggaaatcaagatgcttgtggctttcacaatagggctatttttagaagatcattgtttgaagacagatgttggggtggagtacatgtcaaaggttccttatgtcagtgcggttggttgctcaatgaaagcgacattaggaagcaatgaagtggatcttgaggtacctaaagggtacaatagatcatggtattatgtttggcactcaacgggtgatccttcagctgtgggatatgtggatttagatgacagaaagtctacaacagggtatgtctttacttttggaggtggcaaggaagctatgtggttagcagggctagtgaaggagctcggcattgagcaatgtggagtttag

SEQ ID NO: 38073 - DNA, 735 bp, Glycine max
  Peptide Sequence Number=SeqID_154851
atggttggatgtggcggttttataagggatttaagaggcagcaggagttgtggatttgctaaaagaattggttatgcaaattcctttttggctaagctatggggtttcgatgttgattctgaagttgttgtgaagtgcataattggaggtagggaaggttgtgctacagatgccttagctaatatagcatgtcatcttaaggatagttatgtgatgtacgaacaacctccgcctattattaggtcattgctcctagttgatgtcaatgggggtttcaacttcccgtctcattctgataatcaccaagaactcgctcaattaaaccatccgacgatcccacaaagaaaactaagccacacccacgttttagaatctcgcaaaccgcaagatcacaaggttatgatcatagggctcaacttcttgcttactctagacaactcagagaaaatgctcggtcccataaaaatgttcaagttcaatttccccaaaatcagtcaaaccctaaaggccaggcaaaagcggttattgttggctgaaccggttccagtatactcgcctttaacccaaatactatctagctctagtacccagtttggatgtgatgaatgtgttgaacataagggaagagaggtaacgaacaggtccaagaagagaatgggaaatggaaataagtgttgcaagaggaaactgaagagcatgttcaaaagattgccatgtaaagtaatcgagtggtaa

SEQ ID NO: 38074 - DNA, 1596 bp, Glycine max
  Peptide Sequence Number=SeqID_154852
atgtctattcgaacaaatcccatgaaagcagtgcctacgttgttgaagcggctggtgacagtagagaaacaactcaaacaagtgaatttgaatgatttgaagtctgagttgattaggataaaggacctgttttccttagtgaagaaaaatgaagaagaactccttgacacattaacagtcctggatggctatcttcgcaacaaaaacataaataagttgacagaagaggagggacacattcgcaagagaataagagaatcaactcaaaagttgctgcctgctggtgaaatccaaagtactaatatagaggattctcagtcatcaagaaaactcccttcgagcctacaacgtgaggagttggaaatgattgaggtaaattgtaacaaacttgatcatgttggaaaacgttgcttgttgtctctcttacatttccctgaaaatgctgttatgaagaaaagtaatataattctctggtgggttggagtgggtttaacagcaaatgaaaatggtgaggatgtgtttgacaagcttatggattataaaataattgtaccgcatcgtagtgacaagtatcccattgagaataaatttagaattaatccttgtgtccatcatatccataagtcagggaagttgttgttagaaaatgatgaaaagcagcctttacaaattataaccccatctcatcatagtgattcaggtacttatttagcacttgacaaacaaaaggttaaactaagtgatcagtttggttttaaatccaacaattgcagaagtgtttttaatgttggtgcaagttatcttaattttggaccccaatggatggccaaaatgaagcatttggaggtgcttcaactgggtcgttggctgcaaggttcaccaaaacatcatattgaagtggagagtgaagaattcttgaaggagttaagggatcaaaaggagttgaagtatcttagccttcgcgggatatcaagaatatctgaactgccactctccatttttcaactcgagagcctagaaactctcgatctgaaggcctgccacaatctagaaacattacctaatgatattgcatcattgagaaacctcagacatttggatttgtctcagtgttacttgttggacagaatgccaaaggggattgaaaagctggctaagcttgaagtactcaagggatttgtaataggtagttctatcaagactccctgcaatgtatcagatcttgcacatttgtcaaaactaaagcaactcagcatacatataggaagtggggccgtgatccaagataaagagtttgaaagcttggaaaagttgtctgaacttgagaaactcaaaatatcatggggtgtgtttgacacaaggtacagtgctattcaggtcactttgccttcaaatttgaaaaagttgcatcttgaagggtttcctggacaaaatataccagaatggttgaagcctgacaagataagtacgagtttgtgtgagctatctataacaggaggaagactcaaaagtatggatcttcaacaatatgctcacgtgtcttgctcattacagatcatacgtctcaagtacctaaaacatttgaagcttgattga

SEQ ID NO: 38075 - DNA, 288 bp, Glycine max
  Peptide Sequence Number=SeqID_154853
atgaattgtgaggccaaggtgttcaaccctaaggaaaccagtgtcgtagttctgactaagattaatgtacaacttatttcaacgatacttagaggcaggcaatcgaggatgctggccggtgtcattgttggtctcaatgttgctagaattattaaggaacccactgcggctgccattgcgtgtggattggacaagaaaggtggtgagaagcacaagaatagaaatgtgaaatacaaggacattgatgagattgatcttgttggtgggagcataaggatagggaagtag

SEQ ID NO: 38076 - DNA, 540 bp, Glycine max
  Peptide Sequence Number=SeqID_154854
atggatcatagttggatgaaagcatcacgcatcattgacgagtatgagaatggggttgaacaattgttgtcagcagtgttagctttggtgaacttgaaggcaagatttgggaggagtgacaaaagcttcactaaattgcttgtgttattgaagaagatgcttcctaaagaaaacacattgccgaaaaatcactacaaggtgaagaagattttatgtccggtgggaaaggagtacaagaaaatccatgcatgccctaatgattgcatattgtatagaaatcggtttgtagaaatgtgtaagtgccccacatgtggggtatcattgtacaaagtcaaggatgatgaattcagtgatgatgcaagcaaaaacaatagtcgtctagcaaagttgtacatcaagcgaaaatacattatcatatgtatgatgatagcaggtctaaggcagccgaggaatgatattgatgtgtatctcactcagttgattgaagacttgagaaaattgtgggaagatgaggttgatgtgtgggatgggaatctttag

SEQ ID NO: 38077 - DNA, 333 bp, Glycine max
  Peptide Sequence Number=SeqID_154855
atgaagcatttggaggtgcttcaacttggtcgttggctgcaagattcacaaaaacatcatattgaagtggagattgaagaattcctgaaggagttaaggggtcaaaagaatttgaggcatcttagccttcgtgggatatcaagagtatttgagcagccacctttcatttgtcaacttgagaacctacaaattctagttctcaaggcctgtcacaatctagaaacgttacctagtagttctagcaagactccctgtagaatatcagatcttgcaaagttggaatacctagagcaactctgtagaagcaagcttcatgatgatgaatcaagttga

SEQ ID NO: 38078 - DNA, 279 bp, Glycine max
  Peptide Sequence Number=SeqID_154856
atgtcagtggtatctgaattcaaggacaaagcttttgatgtcactaggcatggcaatggggcccgaacctacccgattttgatggggaaaacccgagttgactggggtcggggtcgggattttataagcatgtcaggggtagggcggagtagggaaaacctaatcccgtcgggggcagggatggaggtgtataaacacatgtactgtatgggatcaactgcaagtaaccttcatgatgatctcacattgtccttagtggacaacatgaatggttactga

SEQ ID NO: 38079 - DNA, 288 bp, Glycine max
  Peptide Sequence Number=SeqID_154857
atgttaacggttgtggatggctatattcgcaacaaaaacataagtaagttgatggaagaggaggaacacatttgcaagaaaataaggtattcaactccaaagtttatgctaggtgatgcaattcaaagtggtgatatagaagctgttggttcatcaggagaaacattcgaggatgtgaaggtcaagctgagggaagaagtgaatagaccattcccttggagcccacaactcgaggagttggaaatgattaaggtaggattagcgagggtttcctatgggatacagtag

SEQ ID NO: 38080 - DNA, 393 bp, Glycine max
  Peptide Sequence Number=SeqID_154858
atgacttactttggagtgattgaagaaatctgggagcttgattatagtgaattcagagtgcctgtttttaagtgtaactggcttaatggaaatataggtgtgaatgtagatgaaatgggatttactttggtagatcttcaaaaggtgggttacaaggacaagcaattcatcatggtagaacaagcatcacaagtgttttacgcccaagatctacatgactcaagatggttagtggttctacagggaagaacaaatagttttagtctccaaaatcatgattcaacacttgatatttgtgaggcgccttctttctcgagacaaatgccttccataattaaagaacaagtagtggatgacgtacttgtagattgtactgatcatgatgaagagtga

SEQ ID NO: 38081 - DNA, 912 bp, Glycine max
  Peptide Sequence Number=SeqID_154859
atggaggagggtcattgttggatcaagactaagagaaaatactctattaactctagtattgattcacctactaattacccctcctcctatgatgactactcatgggaagaacaagcctttgcaaaagatgcagcttggtctggttgcatatggccaccacgatcatattcttgtaggttttgcagaaaggaatttaggtcagcacaggctttaggtggccatatgaatgttcatagaagagatagagcaagactgaagcagccatatagccctgatcagaatgaaatcctcagtgatggtcttgagaaaaccactcaacagcagagttcagttcagatttcttttacttctttgggttacttatacccatcttctcttgatggattggctcctaacactagccctaattctgatccttattctcatgctcctgcttcaccttccaagtttttagcctcatcaatcaacaagagaggaagagagaaaccccagattccactttacaaaggatgtcttgagtcttctcctgatcttccttccaaatccatgtcaaatttaactgaagacttcagattttgttcacgtaggctcgatcctgaagctggtgttgagaaaatgttgaagggattggattctgggtgtaggagtactgagagagatgatgctaaaactgatgtggctgtgatcttaaacctgtttatgaatcaacctcacccacctgtgaagtttgagactaaggagaaatatacaagtttcaagaaggggaaagcagatgcttcatccattccattcttccccaaatcatgctcagctgataggcatcatatgcagtcacagatgtatgaatttagccctagttccatagaagaactagatctggagctaaggcttggttataggtccaaggtatag

SEQ ID NO: 38082 - DNA, 306 bp, Glycine max
  Peptide Sequence Number=SeqID_154860
atgaagacgatgatatacaaatccgtctttgaattgcagaaacattacttcaacaacattgctttggtgaacaccatcgtgactaagttgtgcaccttagctacgttaagactcgaacaagagtcaattgacccctttatcactcagttcgcatcgtcactcaactttcccttcctcagtcatcgtcactccttcgtcatcttctatcagctcaccccgacttacggtggtcatcgtgactcaggtcaccccttctgcggcggtgcacccctagcctctcatgactcaggcaagcaggagaaatga

SEQ ID NO: 38083 - DNA, 285 bp, Glycine max
  Peptide Sequence Number=SeqID_154861
atgccgaagaagtcgtggccattcaacaagagaatgcatagctatgagaagcttatgcaagaagctaagaacatgcagatggaagaactggctaaatataggaaccaagttcgagtcgaggctacgtcaaccaagaaggaggtcaacaagcccaactttaacaagactaaggaggaagaacgaagggatcagccaccccgagaaccttattacacctattacacctcccctcaagtgcaagcagatctcatatcttatatcaagccttggctattgaaatcctag

SEQ ID NO: 38084 - DNA, 180 bp, Glycine max
  Peptide Sequence Number=SeqID_154862
atggcatcaatacggctatccaaggagtcaaaacgctcaccgacgaagagtcatccctctgaggaggaggaggaggagaaggagagcgatcatctgctgcctatggctgagcgtccttcttcacccaagaaccatccctctctttgtggtatccaaaggaggaaaccacaccagcactga

SEQ ID NO: 38085 - DNA, 624 bp, Glycine max
  Peptide Sequence Number=SeqID_154863
atggactcgacaaatgaagataaaacttcttatatcatcgaatcggaaaactattgttacaaagttatgctatttggattaaaaattgtcaaagccatatatcaacgactaatggataaggtattcaatgcgcaactggggaaaaacctggaagtatatgtggatgacatagttgccaagtctgatgacttgtcgacgcacatcaagaatcttgagaaggtgttcgaaaacctatggaaacacaatatgaggctaaaccccaataaatatgtcttcggggtagaaggagggaagtttttaggatttatgttgacccaaagaggaatacaagaaaaccttgataaatgccaaaccattttagagatgaggagtcctgggaacataaaggaagcacaaaggttggctgatagaatagcctctttgtctaggttcaaccatgagctttttaacccaacgacctcgtatggagagtgcgaggcgaagccagaaaagacacccgagcaggaaagtttagtcccaactgggaaggcccattcagggtcacaacaagccaagacaacggagcgtacagacttgggaactagatggcaagacaattccaagaacatggatcatgacggataa

SEQ ID NO: 38086 - DNA, 309 bp, Glycine max
  Peptide Sequence Number=SeqID_154864
atggctataagatgcaatcccaaggactcgtaccgccttctgagcctgaggtcagaagttccatcagtcttcatccaattcaaaacaatggtagagttacaactcaataccaagatcaaagctctgcaaactgatggtgccaaggagtaccttgcgttgactaagtaccttgcagatcgtggaatacaacactgcatctcatgtcctcatacacatgagcagaatggtgccccagaaaggaaacatcgccatttgactgaaacgggtctcaccttgctagctgcttcctcccttccttcaaaattctag

SEQ ID NO: 38087 - DNA, 948 bp, Glycine max
  Peptide Sequence Number=SeqID_154865
atggcttcttcaagagccatcaaatggctacaaatatgtgatcatggtacgaattttaaaaacaaccaatttctcaacatctttctaagagtttttgttcaacacttgctttgtcaagaaaagttcattgggcaaaagcttgtgctattctattttcttcctctcctccattcttacaaaaagcttttcaagagaccgactcttggttgtaaaagtttcaagagacagtctacttggttgaatcactggacacaaaggagtaatgtcctttggggttcattgcaagaagtggaatttgcttcttcctataatcactggacacaaaggagtaacgtcctttggggttcattgcaagaggtgggattgcctcttggtgtaatcactgaacacaaaggaggaaggtcctttggggttcattgcaagaggtgggattgcctcttggaggttactcctgctattggagttgatgcgccagttacttcagctggttctgttgtggtgtcttcatccaccgttaccacatgcttgctaagcgttggtgtggccaccgctagcactcctgtgatgttgcctccttcttcttcagctccaccagttccaccctctactatgttggtgggggaagtcggcaaggagcttgaagatgagctgataatgaacaagaagaaggttatagagcaacatgaaaagggctttaacagggtcgttaggcaggccgggttcttcgctaaggaccttgacttgggtctttcttaccttttcaaggatatgaaggatgatgtttttcttgacgaggaaaatatcactactgatgaggaggtgcttgtagagccgcatcgaggcttaccaaggacggaccttgggttctatgagcttgtgaaactcaccaaggcagaccttgggtttggtgagcttttggagaatcaaccaaagatgcgtgcatcctag

SEQ ID NO: 38088 - DNA, 468 bp, Glycine max
  Peptide Sequence Number=SeqID_154866
atgaggtccacctcaggattctatgtttatctgggaaataatcttgtgtcttggcttgcgaagaagcaacaatcagtttcaaggtctagcactgaagcagaattccgaagcttagcagctctagttgccgaaattaaatggctcaagtcccttcttaccgaattgcatatcatccaaatgaagcctcatttattgtggtgtgataatcaaggtgttgtaatgataacagctaatccagtgttgcattcaaaatcaaaacattttgaattggacctctggtttgtctgtgaaaatttggctgcaaatagagaaatagttgtcaagcacataccctcacaatttcaagtagttgatcttctaaccaaggctccctcaagtagtacttttctgagccttcgacccaaactgaatgttcatcaattacccacaatcagtttgtggggggatgtaaaggataaagcaaaataa

SEQ ID NO: 38089 - DNA, 567 bp, Glycine max
  Peptide Sequence Number=SeqID_154867
atgcatcagctgaccttggttctcttcttcatgcaagtccttgccctagcctggttaaagtggctccatgctaacaatcaactctctaccagggaagattttcttcataattgcttcatatcgggtctccacactgtcattcgtgcgaagttggtcatctttcaaccaaactcgttagctcaggctgtgggtttagccctcttggtggaggagaaattcaaggattctcgatcttccttttcgtgtgattccaggacttcctatagtccaattgtgcattccaaaccttccattttaggaccacctccttcttccatgttcacaacatcaaccttacctataaaaagagtgaattcaaccgacgttcagaagcatgggagcaaagggctttgctacaattgtgaggacaagtggagtctaggccataggtgtcaacgtcctatttcggatactacttccattaattctccatcgaatggtgagcagtttcatttatcatttgccgcattctctggacctccaccaccacgtacaccgcgtggtcgacttaggctaaaaagcccataa

SEQ ID NO: 38090 - DNA, 375 bp, Glycine max
  Peptide Sequence Number=SeqID_154868
atgaggtccaactgtccagggaacgacaaatttttggactgtgtgcccctactgtcgaaaccttttcaactaggacaagagccgccttcacagcatccattctctgtggggacaaagaatttggtacaacttgaagatcatgaaaggagcattatatcttcactgccggtgaagatgagtgatgctaaggacgatgttgaatggttgcagtactcatctaaagatgaaaatcaatttaaatggcatattcagatcaaacagcggaaattaaatattacaagcgtacctccagccattgcaaatcaaacgcgaagcggtgcatacacgaacctgaaggcagttttgttcttccagacccttactcgctctgaatag

SEQ ID NO: 38091 - DNA, 240 bp, Glycine max
  Peptide Sequence Number=SeqID_154869
atgtgggcttccaacaatgcatacttggagatggttgttttaatgaatttagtattcagaatgagtgtttatccaaaggagaatgttggttcatgcttggttccgtttatgctccatgtttcagctgaagccatgaatgatgctgccgaaggcatgcaacatactattaggaaactgtcccaccatttgcaaataccatccgcaaatgaaggtgttagtaaatatttagattttaaatag

SEQ ID NO: 38092 - DNA, 150 bp, Glycine max
  Peptide Sequence Number=SeqID_154870
atggcaaagtgggattctagtgcctgtagaaatcccggccatgaggggcgcgagggtgtcaatagtggtggtggaggcataggcataggggaggggtggttgaggcagtcgaggagtaattcgaccttagttgccaggtcagagtgctga

SEQ ID NO: 38093 - DNA, 366 bp, Glycine max
  Peptide Sequence Number=SeqID_154871
atggatgctgtgaaggcggctgttaataggagtgaacaacaggatgatgggctattaccagagttcaagctgagagagcacatgtcaaggcagagttggatcttttcggtagatccatttgcatatgttttgtggcaacgtgagagtaacggttacggtcaagacaattcaaatgccagggcggaagatataggcagagaaggtactagtggtcaagttgacccggttaacaacaacctcagaacggggatgtcagaagttgggattcccctgcgtgcaacacgtggcgaaaacgccactgccactagcggaatagtcagtggtctcgctgcttgtgctggcgatatagccatgcatgggatgtag

SEQ ID NO: 38094 - DNA, 135 bp, Glycine max
  Peptide Sequence Number=SeqID_154872
atgggtaatggtagggtcgaacgtttactaggctggttgaagggtgaagtgatatacagtgggctattagacagggattgcaacggcccagtttggacagtaatgcgaagctccacgggtgagcctaagtggtga

SEQ ID NO: 38095 - DNA, 1177 bp, Glycine max
  Peptide Sequence Number=SeqID_154873
atggtggacaatggctctattttggaatgccaacaacgttgtgctgacattcccttgatccttcagggccattcgtttacagtcaccctccacctcttacccattagcgacactgacatagtcttgggtatagactggcttcaacagttagggccagtggttactaattacaccatgttatccatgaagtttcaccactttggctcactcgtggagcttcgcgttgatgtccaaaatgggccgttgcaatcctttgccaaacaattcaaaagaatgatccaaaccggatctacatcatccttatttcatctggcccttcaacccgttaccactcaccaccctgaacttgacacaccacaccccatccccgaaataaaattcctccttaccaagtatacccccatcttccttatcccttcaccctttcccccaccccgtctaatagcccatcgtatatcacttcacccttcaaccagcccaagggatggttgttggcggatatgcatggactactgcgcgttaaatgcggtgactgttcgcgatcacttctcaatgtcaaccatagatgaactcctggatgatcttagaaaagcatcatggttcaccaagctcaacctttgtcaaggatctatgccacccttgctgttccactcacggcgttactctgtagggacaaatttcaccgatgcctctggcacgaccatgggtgtcgttctaatgcaacatggtagactagttacattcttcaacaagcaatttacacccaaacttcaacatgcttcgaagtatgtgcgagaattgcacgccatgactaccgccatccgcaaatggcggcaatacctcctcggacacaaattcaccattttaatggatcatcgtagcttgaaggagttgatgacacaaattattcaaacaccagagcagcaatattatttggcaaagcttttggggtacaattatacgatccagtttaaaagtggccactctaacgtcattgcagactcactttctcgcatcgaagtaccctttgagccaacatttcttgttctctcggtcccacaaattgaattcatggaccagcttcgggcaacactgcaagcaagtccaattttccaacagaatttgtcttcaatttcctctaatcctaaagcttttccggttttccagatgcacagtg

SEQ ID NO: 38096 - DNA, 444 bp, Glycine max
  Peptide Sequence Number=SeqID_154874
atgaagggttgtcggttattggaaggggatggtgaaggtggtggggggttttgggaaaaaggattggggagagtgggttgtgttgatttgaagggccggcgccaatcctggattttgtctacctataatttggcaagtgttgtggcatggggcaacgatatgggttgcatggctaatacctctcggcgaatgtctggtgagagaccagagatgaagcaactaagaagaaatggaggtggcataagtaatgatgaggacatgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 38097 - DNA, 159 bp, Glycine max
  Peptide Sequence Number=SeqID_154875
atggtcaacaaccaccataatcaccgtataaccgtgggagttggacagattggtttggcaattcttaatgaattccttgacatcccgccggggatggtcccaggtgaaattagcttaaaggtggtggatagttttggaaactccaaggtgtccgcctag

SEQ ID NO: 38098 - DNA, 477 bp, Glycine max
  Peptide Sequence Number=SeqID_154876
atgaagggttgtcggttattggaaagggatggtgaaggtggtggggggttttgggaaaaaggattggggagagtgggttgtgttgatttgaagggccggcgccaatcctggattttgtctacctgtaatttggcaagtgttgtggcatggggcaacgatatgggttgcatggctaatacctctcggcgaatgtccggtgagagaccagagataaagcaactaagaagaaatggaggtgcgaaccttttggatcgtcgtaataggtcagggcaaagcgggattctagtgcctgcagaaatcccggccatgagggggcgcgagggtgtcaatagtggtggtggaggcgtaggcataggggaggggtggttgaggtggtcgaggagtaattcgaccttagtgaccaggctagctacgttcaataaggtcagcaatacatgcaccaaaactctactaacagactacgtgctccactactaa

SEQ ID NO: 38099 - DNA, 900 bp, Glycine max
  Peptide Sequence Number=SeqID_154877
atgatatgccttagccacattaccttctcctcaccggtcctattggtgaagaagaaggatggttgttggcggatgtgcatggactaccgcgcgttaaatgcctttactgttcgcgatcacttctcaatgccaaccatagatgaactcttggatgatcttagccaaggatcatggttcaccaagctcaaccttcgtcaagtattcttcgacgatatcctcgtctacaatgaatcactaccggagcatatcaaacacctggacttagtgctcagtgctttgttgcagggcaagttttatctcaagtgctccaaatgtttcttcgctcaacaacaattagaatacctcagccatatcatttccggtaagggtattgaaccagaggacaaacttcaccggccctcagaaactcaacaagcttttgatttgttgaagcacaccatgacccaagctttgatcctcataccccttgatgtttcacatccttttatagttgagacggatgcctctggcacgaccatgagtgccgttctaatgcaacagggtaaacccgttgcgttcttcaacaagcaatttacacctaaacttcaacgtgcttcgaagtatgtgcaagaattgcacgccatgactaccgccatccgcaaatggcgacaatacctcctcggacacaaattcaccattttaacggattatcgcaacttgaaggagttgatgacacaaattattctaacactagagcagcaatattatttggccaagcttttggggtacaattatacgatccagtttaaaagtggccactctaacgtcattgcagactcactttctcacatcgaagtaccctttgagccaacatttcttgttctcttggtcccacaatttgaattcatggaccagctttag

SEQ ID NO: 38100 - DNA, 744 bp, Glycine max
  Peptide Sequence Number=SeqID_154878
atggggtataaattatgttattttaagagggcgagccctggtgcagtggtaaagttgtgccttggtgacttgttggtcatgggttcgaatccggaaacagcctctttgcatatgcaaggggatattagatgtgcaaatatattggtggatgcaaacggatctgttaagtttgcagattttggattggcaaaggaacccaaattcaatgatgttaagtcctggaagggaacagcattcttctggatggcccctgaggtttgccttcaatctcctcctctaaagaaagctaaagaggagagcacacaaaagaactttgatgaaggcgaaactgcacaattagggttgtccaaggtggttgtcacaaagggggcaacaccaaaccaacatgaaatggcccctaacctcggaaatgtgcgtgcagaacctgtttggcacggagaaatagggcatgtgcggatgcgggagcgtggctcattaaaggttgctggaggatggcggcagttgctgaaaaatgagttagaaaagctaaaaatgttgctagaaatcaagcagctagtagaagggtccactggaatgtggaaagccaaggaaagaagtttgccggaaaagggtggtagttatagaggggaggtgtggaaggagagtagacctcttggtattctcattgcttttctcttttggcttaggcttcaggctgagagtttcttctctatggaacacttgctctgtgaggggaggctatag

SEQ ID NO: 38101 - DNA, 168 bp, Glycine max
  Peptide Sequence Number=SeqID_154879
atgaatggcattgttgctcctgatttgaggagcaatttggaggctctgcatatgattgtgactaagaaagagaagatcatgaaactcaacttagtgaccatgatggggaggaatcaaaagcagggtgatatcatgggtgacaataatgaagccaccgaagatgattga

SEQ ID NO: 38102 - DNA, 540 bp, Glycine max
  Peptide Sequence Number=SeqID_154880
atgaggtacctgaaaggctttagcggattccacaagttcacagaggacgtgggaatgagcgagaccgagttgaactactcgatggttctggcgaacaactcggagacggtgttgttgccgctgaatgagtcggtttacggaacgaaaaggaagagccagattgagacgtatttggaacacaacaaaggtgctggtgtgcaacaccttgcgcttgttactcacgacatcttcaccacactaagagagatgagaaagcgaagttttgttggtagatttgagttcatgccttctcctcctcccacctattacgccaacctccacaatcatgccactaatgtgttgaccgttgaccagattaagcactgtgaagagcttgggattcttgttgacagagatgatactagaacttgttttgcggtcaacatagtgattgttgtgcttggatttaatcaaaagatttgtcgtggatttcggcgatcagattcccaggttcaaaaatgtgatattgccttgaaattgtatcatatgatttatgcttga

SEQ ID NO: 38103 - DNA, 396 bp, Glycine max
  Peptide Sequence Number=SeqID_154881
atgaagatcattctaaacttttttttctgggtgagtgaggatgcatcaaatctgtatatctttattgagcttgtaaccaaaggttcccttcgaaacctctaccagagatataatcttcgagattctcaagtatctgcctatacaagacagattttgcatggtttaaagtatcttcatgaccgaaatattgttcacagggatattaaatgtgcaaatatattggtggatgcaaacggatctgttaagcttgcagattttggattggcaaaggcaaccaaattcaatgatgttaagtcctgcaagggaacagcattttggatggcccctgaggtttgccttcaatctcctcctctaaagaaagttattgaaaaatgggccaacatatgtattaattga

SEQ ID NO: 38104 - DNA, 165 bp, Glycine max
  Peptide Sequence Number=SeqID_154882
atgtcgttgcagttgaggttgtgggcaggtcgtccatggtgggcatgcacaaataaaaggggtgaaagaggcgttaggattaaggaagggaggtcacaagatgggaagtgtaggaaacaaatgtccattttcaagcagcatcccgatcaacgtttggctaactag

SEQ ID NO: 38105 - DNA, 306 bp, Glycine max
  Peptide Sequence Number=SeqID_154883
atggctcaaggcttcaacatcacttccaaccacgatcgtggtagagaatattttgcaccaaattgcatgatcgaactgtttagctggtcctttgggttcgatattcggactttcgagttcattgcattcgggacaggtcgagccataactaatgtttctccttaccaagttaagtctcatctgaatcttgttgatcatgaccctctatacaaaagttcttgctttgaagggtatcttaatgctccaaaaacatctaaaagcatcattatccatagcttgttgttcttgaagttgaagggaggatag

SEQ ID NO: 38106 - DNA, 348 bp, Glycine max
  Peptide Sequence Number=SeqID_154884
atgttgatgatgttgaaaatgcacggtgatgatgttatgttgtgtatgtacataggggctacaatgattttgttggatatccctagcgggggaaataaagtgtttctcatgaggaggaatacttgtagttgggggcatgtcactcggtttggaactcccttgagactcaggctgatcacggtgggggagggggttgcttgtgtacgacagggtgacctcgacacttactgcctagttttcctaagtgagagtgtcgtgtggacacgcttaggctatttacttggggatggtaccacattgcatttgagagttgaggtcaggtgcatgcatcatactgagcatgattga

SEQ ID NO: 38107 - DNA, 690 bp, Glycine max
  Peptide Sequence Number=SeqID_154885
atggcacagatatcaagacaacattcaccttcggatcatccttccagagaggaacgtggagctcgcccctgccatctcacacgccttccaaagaaaaggattgatgttgctctggtgcgcaaattctatgcaaatgcctatgacccagaggacagctcactaaagtattgtcgagtctgggggaaagtcattcgatttgatgtagagacattgaatgactttttggagaccctcgtcatcatcacagaaggggaggagtaccccatatatttccagtacctgtacacttatccagaccatgaggccatcatggccaagctatgcacatcgggtgatcagtttattctgaacaccggcggggccccgtggaagcaactccggaaggacctcaccacattggctcaaacatggagcgtcctgagctacttcaacctcgttcccacctctcacaccttttatctgaacatggacctagctcgcctcatctatgggctggtgtcgcaaatggatatggacttgggcaacatgattttaggacagattaggcagattgcccaatccagcaccttccaactcggatttgctaccttgatcacaacattatgtgatgttcaggggtttacttcaaacaccttgacctttgagtcactaagtcccatgattaacttaacatacataagtgtccaatga

SEQ ID NO: 38108 - DNA, 285 bp, Glycine max
  Peptide Sequence Number=SeqID_154886
atggcatcaaggagaggaatgttgatcttaactttcctaaaattccccatcgtctcactatctagcacaactctctttagaggagtaactcttgatggaaaagggaagggagctctatgtagagcttgtaggccttggatcttcttcatcaatggagtcctttgctttttgaagatcaatcgtggcagaatgaagaaggagaaaggtgaaatgagatgccactttaaggagaagatgagtcaagaacaaactcatcatcataggaagccatggataagagcttga

SEQ ID NO: 38109 - DNA, 489 bp, Glycine max
  Peptide Sequence Number=SeqID_154887
atgccacaaaagtgcaaagatcctagcacttttgttatcccatgcaccataggcaagtgcacatttgcagatgccatgctggatttaggtgtttccattaatatcatgcctacattaatttacagacccttgcagcttggtgatttgaggccaactaaagtggtcattcaattagcaaattggagcattgcacaaccacttggagttttggaggatcaatcatctttagaattgaagccttttccaacacacttgaagtatgcttatttagaggcaaatgatcagcttcatgtgatcatttcaaactctctccaagctggccaagaggaaaagttgctaaaagtcttgagagatcataaaagagccattgggtggactctagttgaccttcctaagattaatcttgccatctgcatgcataggattttattggaggatgagttcaaaccaatgagacagccacaaaggcgcctcaatcccattatctag

SEQ ID NO: 38110 - DNA, 1890 bp, Glycine max
  Peptide Sequence Number=SeqID_154888
atggaaagaagtgaacctgcattagttccagaatggttgagaagtgctggaagtgttgccggggctggaagttcagcccaacagtttgcctcctcgtctgctcatactgattctctttccgtaaggaataaatcttctaagaatggtagcgattttgatagcgctcgctctgtgtttcttgaacggacatcctcatcaaattcgcgaaggagttctatgaatggttctgccaagcatgcctacagtagtttcaacagaaatcatcgtgacaaggaccgtgacagagagaaagatagatccagttttggagatcactgggactgtgatggttctgacccattggctaacatctttcctggaaggatggagagggatacattacggcgttctcattcaatggtttccaggaaacagaatgaggttatacctcgtagagttgtagttgatactaaatctggtggcagccatcagaacaatagcaatggcatactttctgggagtaatgttagtaatagcattcagaaagctgtatttgacaaggattttccatcacttagtactgaagagaagcagggaatagctgatgtggttagggtttcatctcctgctttgggtgccgctgccagtcagagtctacctgttggtagttcagctttgattggaggggagggatggacatctgcactagcagaggtacctgctataattgggagtagcagtactggatctctatcagttcaacaaactgttaatacaacttctgggtctgtagcatcaagtacaacagccggccttaatatggctgaggcattggcacagactccatcccgagctcgctctgctccccaggtgctggtcaaaacccaaaggcttgaggaactggctatcaagcagtcaagacagttgattccagtaacaccctcaatgcctaaagcttcgaggatacttaaaattgattgtgttgactgtcaggttcataattctgagaaatcaaagcccaaaacagctatcagaaatgctgatatgaatgtagttaccaaaagtgtgccccagcaaccgcctgcattgcacattgcaaaccaatctgttcgtagtgtaaattccaaagttgatgctccaaagacatctggaaagtttactgatcttaaatcagtagtgtgggaaaatggcacttcccctacctctaaggatgtatcaaatccaacaaattattctaacagcaaaccaggaaatcaacatgctgttgctttaggagctgcctctgcaccattgaggaacccgaataacctaaaatcccccacggagcggaagccaacttctatggatttgaaattaggttccaatttggagaagaaacattccatctctcaagtgcagagccggaatgatttcttcaatctcattaagaagaaaacattgatgaactcctctgcagttcttccagactctggcccaatggtttcatctcctgccatggagaaatctggtgaagtaaataggggagtaatagttagcccttccgcaagtcctcagtctcatggaaatggtactgaactgactagcaatggcacccatgctcatgaagaggttcacagactttctgataatgaagagaaagaatcaaatcccagtgttacaatatatccagatgaggaagaagctgctttccttcggtctcttggctgggaggagaactcagatgaggatgaaggccttacagaggaggaaatcaatgctttctatcaggagtgcaagaaattggacccaactacattcaagctatgccagggtaagcagccaaagctgtccaagttgtttgaatcttatgcatctaacttgtgcgaatcttctgctgagttgagctcttctgatcccagatctgaagcttga

SEQ ID NO: 38111 - DNA, 435 bp, Glycine max
  Peptide Sequence Number=SeqID_154889
atggcagagttgtgcttggtacccgacgtagttattcctctaaagttcaaggagccagattttaataagtacaagggaaccacttgcccaaagattcacctgaaaatgtattgtaggaagatgggggcatatgcgagagataaaaatgtttgctggcgaaaggatcgaagtaggaaatttgattatgttactactatgagttctagtaatagaagacttgggatgagtgaagggaataagaaagaaggagaaacccatgttgtgaccgtcgttcctacatggccaaatttcccactagcccctttaaatcccatgtaccaatgtcctccccaacaatatcaatactcagccaatattagtccttcccattactcaccaccctaccaaccaagaacgcccaatcatccacaaaggccacccctaaataggccataa

SEQ ID NO: 38112 - DNA, 1099 bp, Glycine max
  Peptide Sequence Number=SeqID_154890
atggaaggcttggattttctcgatacattctcccccgtggccaagcttacactgtccgcggtttatatgaagctccctccaggactgattgtggataatcccaaccttgtttgtcgccttcagcgttccttatatgggctcaaacaggcaagtcgccaatggttcacacggctctcgtcatttcttctctcccaaggattccgtcaatcttcagctgatcactcgcttttcttatactctaataatgataatgatataacagctattcttgtttatgttgacgacatcatcttgacaggaaataacctcaagactataacacatattaccaagcttcttgatcaaactttcagcatcaaggatcttggtattctgaagttcttcctcggtctagaagttgctcgttccagccacggtatacaaggatcttgctcgtgccagcgcaaatatgttctggatatcttatcggattccggtatgcttggttcccgtcctacttctacccccatggattattctacatacattgctcacgctgttcaacaactcagccaatatatggctaatcccacttccacacactcacaagctgcttttcgggtcttacgttacctcaaaggatcccctggttctggcctcttctttgcggctcaaggtacactcactctcaaagccttcagcgactccgattgggcaggatgtcgtgacacacgacgctccatcactggcttctcagtctatctgggtgagtctctaatttcctggcggtccaagaagcaatctacggtctctcacagttcatctgaggcggagtataaagccttggcttctactacatgtgaacttcatggctcacctacctccttcacgattttcgggtccccttccttcaacctgcaactctctattgtgacaaatcaatctgccatccaaatagcctcaaacccagttttccacaaatgtactaaacacattgagatcgactgtcatatcgtgcgagacaaagttaacaaaggattgctaaagcttcttcccgtttcatcttcaatgcagcttgtcgacatcttcacgaagcctctctctcctgctctttttcaag

SEQ ID NO: 38113 - DNA, 618 bp, Glycine max
  Peptide Sequence Number=SeqID_154891
atgtctactcgaaagcaaatcgttcaggctattatccatcacaatgggaaaatgggtgattcggctaatgaggtggagttcaattccagaaaaacgtgtaatattacatgtgaacttgatgtcacatttaagaacattagcggggacacatactcaatatcaatgagagataaaaatactaaaagaacccacacttgtgtattgactatgtcacaagatcacgtaaagcttaggtacgacgtgatcggtacaagcatcatagcaatggcgatcgaacaagcatatggtaattggaagcaatcctatgaggatttacccaaattgctcttagcgtttcaaacatctgtgcctagaaccattgttgagaaagagttgaagctaacttataacgaacatcgagagctacttcctggttgtgcaacgtaccatcacattttttggacatttaaggtacttgttgatgggtttgcatactacaaaccaatagttgaggttgatgatacttttcattatgggacgtataaaggaacattattagtggtagttgcacaagatgagactaaccacatccttccgattgcctttgcccttgttgagggtaagactacggaagcctga

SEQ ID NO: 38114 - DNA, 765 bp, Glycine max
  Peptide Sequence Number=SeqID_154892
atgacgggtttcaaaacagaaccgccttcctattctttcttttataatactaaccctagcttcgcgccgcacctcaacttctctcttctacctcgcatatcaacaatcttcctcttctcctcaccttcaccttcgtttccccttcctcccctcgtcactcctctcattcttcctccttctcctccccaagcttccttcctccttcgcctctgctccgccgctccctttcctttcctctcctttcccttcaaacgaacatttcttcatgtcggactcggccaacaagttgcgattgcttgtcggataaggggaaggttggacttggaagagattatgaaccaaccggaggatgctggtgagaaaggggtaattaacgatgatgttgatgtcggcaggaataaagatgaactgggtaaaacaataggaagagaacaggaggaacctcccaagtctcaaattggtcgtgagagtgggtccaaattctctaattggctgaatggagagagaagtgagatggaatggttttggagaaagccacgagctgatctggaaaatgtgagattttccactttgaattcgaagtatactgacgagggatcttcaaatggctattcaactgaagcattatattctgaaacatggtgcgaatgtcatgtaagatgtctcaaggttgtcatgagatccaatgtaggattggaaggggggaagaaacacaaatggtggaattgtaaggtttatgtacctttttttgttttctacgaatga

SEQ ID NO: 38115 - DNA, 153 bp, Glycine max
  Peptide Sequence Number=SeqID_154893
atggagaagaagaagacgaagatgaatgatgaaaaagaagaagttgtggttctcattcacaaagagagaattgaggcttttagaaggctttgccgacataatctctctcggattacccactacacgaccctgcgctttcgacaacagaactaa

SEQ ID NO: 38116 - DNA, 177 bp, Glycine max
  Peptide Sequence Number=SeqID_154894
atggagctgctaattgagagagcaggtcaccctaaaattgatgatggaataacagtgttattggttgcatcttttaatcaatttatcataagttacatgtttatgatttatgaggttgaagagtatcttgtgggaagtgcaaatagcttgtgctcttgggcatactctagcctgtaa

SEQ ID NO: 38117 - DNA, 417 bp, Glycine max
  Peptide Sequence Number=SeqID_154895
atgagtaaaaaaagtttggacacttcacgttggaatgtccaaattaggagaaaagtcaagataagaacaaattcttttaagactaaagaaaagaaggggcttatgagcacatgggatgatttggatgacacctcatctaatgaagatgctgaagaagcaaatatatgcatgatggcaaacacatcgtctgaaggatttgaatcagaccaggacaatgaggtaaattgcaatgacccaaagtctcttggaaaagcttattatgaacttttatctaattcatcaattctctcaaaagcttatcaaaacctacgaaaagatttcaaaaatatatccaaagatcctttaaagcttgagaaaacccttcaagatcaagtagatggttcactagacgaatttgctcaagcatgtaaggcttga

SEQ ID NO: 38118 - DNA, 285 bp, Glycine max
  Peptide Sequence Number=SeqID_154896
atggaggtaccagtaggtactggagctaatggaggtgaaaaagatgaagcaaagggagatggagtacaattagaaaaaggattagctagagtagaggaggaaggagtagctgaatcaggtcccctagccctagacttgcgagtccctggaaaagtgattgatggatcatccagggctgagggactcaaaggtcagagaatcggatatgactcctctggctatgcacaaagttgtgatcagtacaggaaagtcaagtcgagaggagttggactgggccatttgtga

SEQ ID NO: 38119 - DNA, 480 bp, Glycine max
  Peptide Sequence Number=SeqID_154897
atgaccagttgggggtacatgggaatcaaagaggtcatagaagatgaacaagctccaaccgtgtatgactattttgggtatgggcaaccatcagggaagccaagtgagcagaatacatgttcaaacattgaggctacatacaagcataggtgggttgaatatgcagagaagactagatataatgcctcccaagttccagcagaatggcatggttggctccacttcataattgatctcacaggaggtgagcttcttttactgaaaccaaaaaggtatggtgctgaacacaaagaaaattggtcaggagaagttaaacaggatccacaggttgaaggagaaattgggctgatattcacgaagacaatgatattttgtagcaacggctacataatattgttagacaatgacaagaactactgtaaaatggagattgaactaaaggctcaaatgattgttagaattgaaatcatggaaatgtga

SEQ ID NO: 38120 - DNA, 237 bp, Glycine max
  Peptide Sequence Number=SeqID_154898
atggctcctcctgtgcgcgctcgtccaaatgtgaagaaagagtatcctgggctggctgagatgtctcctatgcagttgcaggccagggatccaaggccttcttcatcctcacagacctccaagactggtgtagtgactggtgaggttgaggctctggctgaggctcctgggctgcggaagcctcacctccccccaaaggagaaggatgaactcctggctaggccacctgagctatga

SEQ ID NO: 38121 - DNA, 135 bp, Glycine max
  Peptide Sequence Number=SeqID_154899
atgacaaaggaatatttgaaggctgttggatccgtttcacttcaaccatgcatggctatttatagaaaaacagccaaggagtgcaagaaattctctcaggcgagttgtagttcacacaggcgaattatggcttaa

SEQ ID NO: 38122 - DNA, 382 bp, Glycine max
  Peptide Sequence Number=SeqID_154900
atgaacactaacggtgacaagaagaagaagtgtcgtaggaagaggaagacgaacaagaagcatcgtaggaagtggatgatgaaccgccataggaagaggaagatgaagggccgtatgaacaggaagaggaagaaaaaggaccgtagaaacaggaagaggaagaagaagggccataggaataggaagaggaagaaggatgcgcgcaacagccgtaggaagaggaagaagaaggagcgcgcgacagccataggaagagaaagaagaaggagcgcgggacggcagtacggacgaaactgtagctttgtttatattattaaggtgaaggacatttttatcatttcacccttcgtgctgggtgtcctagcaatgttgggtgcaccaa

SEQ ID NO: 38123 - DNA, 924 bp, Glycine max
  Peptide Sequence Number=SeqID_154901
atggcagcatcatccaagaaacgcaagggttcatcttcctccaccaccattgcaggtcaacactgccacgatgcttccggtgactctccaacaccacccaatccttcactttcctcaccatgctcactaactctattttccttcgatgatcaacgtcagaggtattactcctccttttcaaatcgtgtcattcttgatcctaaatttctggattttgatttctttgagggagaaacctttgactgttatcaatcattattctattctctgaccaaattaagtagtcaaggtgtaccttttgagggaaccttagttgatgactggaaatccatttattctagtcatgatgctcgaaaaatggtatgtgttgaaaatgctgatatgactggtcgtttgcttgttggttcttttacctttgagtgtcacatcatgcattatattttatgccgagtcttgcttcctcgttccacaaatcttgctcaagcctctgaggaagatttaatcttgttatgggccctgcaaactgaccgtcaaattgactgggcccatcttgttcgctatcgtatgcataaggcattacgggcaaatgcaccacttctttatctccaccttgttactctaattctgcagcacttcaacattcctctggttaataaaccttttgtcaaggttaaacgttcctttgccattggagtcgctgtcgttgcatcctttgggtataggaaggatctagatggtcaatgggttcgtaaacaagacctctcgcctaatgctccccatgaacacactcgatctccaccaccaagggatccctcctcttcattgctgaatgatgttttagcgagcttcaggatgttcgtgcatttgtcagagactggtttgattctatggattcacgtattacgcgacttgaggatgatatga

SEQ ID NO: 38124 - DNA, 1500 bp, Glycine max
  Peptide Sequence Number=SeqID_154902
atgtcttctggtgtggactcagttcgtgaccctctcgataacgcatggaaaacgcttcgtttccccatcatcaaacccagagagcttctccttttgttcctcaaagcgggtatcgccgtttcaatgctcttaatcataaccctctttatcactctctacaatcaacctttttatcctaacaacaaccacacaaccatgaaatacatgctccaacagaaaacccctgaggaaaaagcctccaccaacatctcccacctcctgtttggcattggcggctcgtctgctacgtggcagacgcgtcgccaatactctgaactctggtggcgtcctggcgctaccagaggcttcgtctggttagaaagtcacccgccagacaacacgacttggccagagacctccccgccgtaccgagtctccggcgacacgtcggtgttcaagtacacgtgctcgtacgggtcgcgctccgcgattcgtatagcaaggattgtaaaggagagcttcgagttagggttggagaacgtgcggtggttcgtcatgggcgacgacgacaccgttttctttaccgacaacctcgtcacggtgttgtcgaaatacgatcacaacgaaatgtactacgttggagggaattcggagagcgtggagcaggatgttatacacttctacaccatggcgtttggtggtggcgggttcgccataagttaccctttggcgaaggaactggtgaggattttggacggctgcattgatcgttacgctgagttttatgggtccgatcagaaaattcagagctgcatcagtgagattggggttcaggtcaccaaagaaccgggttttcatcaggtagatatacatggtaacccatatggtttgttagcggcacacccggtggcaccgttagtatcgttgcaccacttggactacgtggaccccatattccccaacacgacccgcgttaacgccgttaaaaaattaataacggcgtacaaaatggatccgggtcggaccctacagaagagcttctgctacgacctccgtagaaactggtccgtttcggtgtcgtggggatacagcgtggagctctatccctctctgcgcacttccaaggagctcgaaacggcgttcgagacattccgcacgtggcggacctggcacgatggcccgttcacattcaatacccgacccgtcagtgtcgacacgtgcgagaggccgcacgtgtatgtgctggatggggttcgtaatgtggatggggacatgacccgatcttggtacagaaaaaccgtggacgcttcggggaaggagtgcgcgcgtgaggagtacgcgcgggctttggaagttcaatacgtcgacgtttatgcgtcgcgctttgtgccggacaagtggaaaaaggcgccacgaaggcaatgctgcgagataatggacggcgcagatggggtgaactctagtgtggttcgcgtcaagatcagagggtgtcgtcgatttgaaagcgtgactccttcgtag

SEQ ID NO: 38125 - DNA, 1254 bp, Glycine max
  misc_feature (57)..(57): n is a, c, g, or t
  Peptide Sequence Number=SeqID_154903
atggctcgttgtcccggggcggcggcgaacctctgctgcctcttcttccaccaacancacgagccgtccccgccgccggacaccctcggcatcctcgccttcgacgccgccaagaccatgtgccgcctcgtctccctctacaactcccatgaccaccaagaaatcctccacctccgccgccacgtcattaggtcaaaatccgtctctaaactcaactcccgtgatgagtgcttcctcctcaccctcgcctgtgccaagcgcctcgaggacctcaacctctccgccgccaccgtctcccgcctcgccacgcgctgctccgaccgcaacctcgcccgttgcttcgagtccgtcgacgcccggaagctcgagttcggaacaaaggacgtggagagcaaaattgagaacatggagaagctcgtttcgctttggaaccagacatttgacaaggttgtcgggctcatggcgagaatcgtttgcattgtttacaacagaatatgttcggttttcggaacctttgttacgggcgatgtcaaacgtagaaatctaaacaacaacaacaacaatggtgttgtaaaacgacatattgtcgaaaacagttgttgtaggattgagcatcgcgagttgtataggatgaatctttgcatgttcgaccaaaccgaggaggcgttgaagaagcgcgcgtgggggtgttgtaacgcgaggaagagagctcctaccggggttttccggtttcaccacgcgccgccgcgggagggcggcgaggtgtcaggtaacaaccatgtcatgaggctggcaccggagaatacggttggcggggcggggctttcgctgaggtatgccaacgttattttgttggcggaacagtgcatgcacgcggctgatgccgtgattgggaacgacgcgcgtgttgcgttgtatgatatgttgcccgggaggttgaaggtgaagttgagggggaagttgaagagtgagtggttggaatgggagaaattggagggcggagaagaggagcattcggcggcggcaacgcgacggcacgcggcggcggcggaggtgatggagatattgttgccagtggctcatgacatggtgaggtggcaggcggagaggaacttggagaagcaaaagtttgagacgaagcccacggtgttgttgttgcaaactttgcattactcggatttggagaaggtggaggaggtcattgtggaggtgttggttggattgagttatatgtattggaaccgaaatttatga

SEQ ID NO: 38126 - DNA, 2025 bp, Glycine max
  Peptide Sequence Number=SeqID_154904
atggctacccttttgaaaattttatctcttacggtgctccttttgatcccagtttcatgccaagttgaccagcttctctatgctggattcaaggatgttggtgctagcaacctaaccatgaatggggtggctaaaatagaacataatggaatactcaaattgacaaatgactccagcaggttaatgggtcatgctttttacccatcaccttttcaactaaagaactccacaagtggtaaagttctctccttttcttcctcttttgctctagctattgtccctgagtaccccaagctaggtggccatggcttagctttcacaatagcaacttctaaggatctcaaggctctacctagccagtaccttggcctccttaattcaagtgataatggtaacatctccaaccacatctttgctgttgagtttgacactgtgcaagactttgagtttggggacattaatgacaaccatgttggaatagacatcaatagcatgcagtccaatgcttctgccaatgttagtttggttggtctcactctcaaaagtgggaaaccgattctagcttgggttgattatgattctcaattgaatcttataagtgttgcactttctccaaattcatccaagcccaaaaccccactcttaacctttaatgtggatctttcacccgtttttcatgatattatgtatgttgggttctctgcatcaactggtttgcttgctagctctcattacatcttgggttggagctttaaaatcaatggtccagcaccaccccttgatctctcttctctcccacagcttcctcagccaaagaagaaacaaacatctttgataattggggtttctgtctcagtttttgttattgtgttattagccatctctattggcatttacttctacagaaaaatcaagaatgctgatgtgattgaagcatgggagcttgaaattgggccacataggtactcctaccaagagctcaagaaggccactagaggtttcaaggacaaagaacttcttgggcagggtggttttggcagagtttacaaaggaacattgccaaattccaagatccaagtagccgtgaaacgagtttcgcacgaatccaagcagggccttagggaattcgtgtcagaaatcgccagcataggccggcttcgccaccggaatttggttcaattgctcggctggtgtcgccgccggggcgacctcttgcttgtgtatgatttcatggccaatgggagcttggacaagtacttgtttgatgagccaaagattatcctaaattgggagcacaggttcaagatcataaagggtgtagcttcagctcttttgtatctacacgagggctatgagcaagtggtgatacatagagatgtgaaagctagcaatgtgctgctagattttgagcttaatggaagattaggtgattttggattagcaagattgtatgaacacggggctaacccaagcaccacaagagtggtgggtacattaggctacttggcacctgagttgcctagaacaggaaaggcaacaacaagctcagatgtttttgcatttggggcactattgcttgaggtggcttgcgggcgcaggccgatcgagcctaaggcattgccagaagagttggtgttggtggattgggtgtgggaaaagtacaaacaagggagaatacttgatttggtggacccaaaactaaatgtctattttgatgagaaggaggtgatagtggtgctgaaattggggttgatgtgctcaaatgatgtgcctgttactaggcctagcatgaggcaagtggtgaggtatttggatggggaagttgaggtgccagaggacttgaaaaagccaggggatataagtcaccatgaggggtttgatgagttcttgcactcacttgcatcttcatcctttgataagatgagttcaggctccaattttggaaatagagacatggagtctagttttctttcctttgctaattcacctcattcccttctccatggcagaggggaaactaggtga

SEQ ID NO: 38127 - DNA, 429 bp, Glycine max
  Peptide Sequence Number=SeqID_154905
atgaagttgcggagacattgcagtatatggtgtcaccacaagggcgtaacacatggacagtggatgatctcgtgtctttatgtggagaagctgacgattttatccgaagagcaagagaggatcactgagcctgtggcacatggtccagcatcagagcgtagctttccgccacaacagtttcacatgcttccgtccagtgtggaaactcgaggttttgacagacgaagggagattgttcaagcggaagatttttcccaacaaatggagcagcgtggccatggaatgtactactcgccaccaacattttctcagtatccttcgcagatgtatcagtatcctttcgaaggtcatgacactgatatgtctgcaagcgaacattcatttggtggtgttgcggaacacatcctcatttttcatggccgaccatga

SEQ ID NO: 38128 - DNA, 438 bp, Glycine max
  Peptide Sequence Number=SeqID_154906
atggacacaaagtgctttcttccggagttcagtactcaaatctaccggagagttacatccgacccgagtcggagcgacctcgtctttccgaggtttcggagtgcgaggatgttcctatcatcgacttgggttgtcaaaatagagcccagattgttcaccagatcggtgaagcctgcagaaactatggtgattaatcacggggtggctttagaagccgcaaaggaaatggcagaggtggcacatggattcttcaagttgccagtggaggagaagctgaaattgtactctgaagacccctcaaagacaatgagactgtccactagttttaatgttaaaaaagagacggtgcataattggagggattatcttagacttcactgctatcctttggacaaatatgctcctgaatggccttctaatccaccctctttcaagtaa

SEQ ID NO: 38129 - DNA, 243 bp, Glycine max
  Peptide Sequence Number=SeqID_154907
atgcatgcatgcagcacccaaaccgccagtgggactggcgggttcactgttggtgaaggactcaccactgtgaatggcgatatacacatgcaagctgaagaaatcgccagtgcgagtggcgatatacgtgccaatgggaaccgtcagtcaaactggcgagttccaggtggcaggttgcctttttcagaggacaggccaaaaggcaagttgcaactgtcattggcaagttgcaactgccattga

SEQ ID NO: 38130 - DNA, 789 bp, Glycine max
  Peptide Sequence Number=SeqID_154908
atggaacgatgcacgactttggctccaaagaggactcctcccgtgatagaaaataagtcactcggacacaggtggttgcgacgaagaaatcaacatattagcaatgatgatttgattatttttcgtcgcaagttgagtatcatgaaacgacatgagtttctgtgggaaccttacacagcaactgttatgtcgtcgttgcctccaatttgtttggttggtagtgtagcatggtgcgcagtgaatatccatgggctaacgctgaaaagcaaacaagatgaaaattggttccaactgttagccccaatgatcagtcagtggaataatcgaactgagtttagcgtcgacgtttatcctcgacaggagggcctattgagttttaactccgattacatggctgaagttgcggagacattacagtatatggtgtcaccgcaagggaggaacacatggacagttgatgatcttgtgccttatgtggagaagatcacgattttattagaagagcaagagagaatcactgagccgatgtatcagtatccgttcaaaggtcatcacactgatatgtctgcaagcgaacattcatttggtgctccgcattggaatgtacccggagcaatacctgatatgggtgacttattaggtgttgatttgagtcaagagttttttgctgaggctgaggaagtacaagcggggaggcatcgtggcagaagaaatcctgatcgtcaagcgcgaagatgggatcgaccatgtggcacatcctcacgtcaccacggacatgataatgaatga

SEQ ID NO: 38131 - DNA, 330 bp, Glycine max
  Peptide Sequence Number=SeqID_154909
atggcgtctaaaactctcattctcgttcttctggtatcattcccagcacaaggtctcgtaaaccctctgctgagactcgacaagcaccttgctgcaaaaggttgctttgtcaccttctccactacaaagcccaccggcgaacacatgcgcttcgccaccaacaacaatgccaccatcgatgaaacctcatccacacccatgggcgacggtttcttcgccttcaacttcttcgacgacagtttgggcgacggcgaccacccagagaggcataatctttcagacaccaaagcccatctcgagcgaattgaaagcaagtcagttcccagatga

SEQ ID NO: 38132 - DNA, 504 bp, Glycine max
  Peptide Sequence Number=SeqID_154910
atggcttccccatctattcctgcaactgttaatgaggtcaacacggtgaatgcacatgtagaaaataacatacaacatggtgaaaaagacaaaggtcaagtcaatgaaaatgtcatcaagaggaagaggcaaaaaacaccaacagtttggaatgattttgaggaaattgaacttcttggaggtttaaagaaagttgtttgcaaatattgcaaagagaagcttggtattggtgatgaagatttcttcatgagagaaatggcagctctaatgaagacaaagtttgacgaatattggggggagtgtaacttgcttatggctattgcaagtgttttagatccaagggttgccaaagagaatataaagaaggcgcgagagtcattggagaagttatatgatgagtatgtgactttgagtttggaagagtcatcctctatggaagtagataatggtggcaataatccagtgaatgacgaaggatatgaagagatcactttgaagatttga

SEQ ID NO: 38133 - DNA, 489 bp, Glycine max
  Peptide Sequence Number=SeqID_154911
atggttttacagggacaacctattataaggaatgcaaagtattctcaggaatacatggtgtggtatcaaagtaatactattatttttttaaatatgcaaccgccaagtggattgtcaatgaatttcgaaactggtcaatcatcaagggcaacaaacatcgcgcaaccagaatgtaatcttgcatatacaccaattccccccatcatagattacgttgcacccacgtacacaccaattccccccacccccatggcggattacgtttttcctagtgcttcgaatatggactacacttcaccgattgtccaaccagatgatttcctgagcaataacaaagtggaaccaagtttcaatttgatgtttagccaagacgttgaagagaataatccatcgctatatgatataccagatgagcgcccacgtcgaatccaagacataataggagacgccttccatgtggaaccggaccccattatggggattaagtag

SEQ ID NO: 38134 - DNA, 276 bp, Glycine max
  Peptide Sequence Number=SeqID_154912
atgacaaaagggagtgcaggaagcaatagccggcaatgctccttacatatatatatgtgtgctttgagtaatgggctttacaagagtgtgtggcatcgtgctgttgtcaatgttgagaaaccaaggctttctgtggcttcatttctttgtccaaatgacgaggcattgataagccctgcaaaaccactcacggaaggtggatccgaagcaatatacagaggatttacatatgcagaatactataagaagttttggagcaggaacttagaccaatga

SEQ ID NO: 38135 - DNA, 564 bp, Glycine max
  Peptide Sequence Number=SeqID_154913
gctggccctggtgttcacctttccccctccgacattgcttctcggctcccaacacacaaccctgatgcacccgttttgttggaccgcatattgcgcctcttggcttgctataatatcctctctttttctcttcgcactctccctcatggcaaggttgagagagagagactctatggtcttgcccctgttgctaagtacttggtcaggaacgaagatgctgtctccattgctgctctcaacctcatgaaccaggacaaagtcctcatggaaagctggtactatttgaaagatgcagtccttgacgggggcattccatttaacaaggcgtatggaatgacagccttcgaataccaaggaacagaatccaagagtcttaaatctctggttgatgttggtggtgggactggagctgtaatcaacatgattgtctcaaagtatcccactattaagggcattaattttgatttgtcccatgtcattgaagatgccccatcttatccagtggagcatgttggtggagatatgtttgtcagtgttccaaaagctgatgctatttttatgaag

SEQ ID NO: 38136 - DNA, 1773 bp, Glycine max
  Peptide Sequence Number=SeqID_154914
atgaaaaaatcaggtgaaaattcaaatggctatcaaacgcataccaaaattgtcaatcaggaaagaagttcagcaggttctccaaggaaattttcggtaacaaagtttgcacctgaatatttcaagtcaggtagtgctgtgaatgatggtccttttcaatctaagcctagctgtggttttggacttcattatctggatattaccaaaatgaaggaaaatactgtgccaccagccaagccaactgactgtgcatctggatcttctcagatggggcttcaacatgtagacttaaaggaatttattatttttcagaaacagcaagctttagtatgtacaggtgatgtagattctggatgcaatgtgaataattgctcggaatatagttcatcttgctctgctgaacatgtcccgccttcaccttcttcagtagtagatacaactactacacctgaaaattcagctaggaaagtatcaactgaaaaattaaatgtccaaatgctgcttgatacattgcaaaatttatcagaattgcttctttatcattgcttaaatgatgcctgtgaattgaaagagcgagattgtaatatccttaaaaacgtgatcagtaatcttaatacatgtgctttaaagaatgctgaacaaattgcccctgcacaagaatgttttttcaatcagccagaaacttctaagagtgctggagaatcacgtgagtttcaccagaatgcaagtttcaagaggccacaattaaccaagacagaaatgacaaaggcttgtaacatgactaaggatctaaagaggattcttagtgagaatttccatgatgatgatgaaggagcagagcctcagactgtattatataagaacctgtggcttgaggctgaagctgcactttgttccgtctattacaaggctcgctataatcaaataaagattgaaatggataaacattcataccaggaaaaagagatggagaagcaatctaaatctgaggttgttccgtctttgagccagagtcagagttttgcaactaaagtgcatcatccaaaccctgattcttctgctgcccttaaatttcgtgtcttggatgcaaccaatctggaggaactatcttgcttgaatatttccactgatatgaacaagcctaatgcaatgacacctgaaggaaaaggtggtcaaaacctggatagcttcatcaataattattttgttccctgctcagacgatgaggctgaaagaaatgatgagtcttctgttatggccagataccaagttctcaaagcccgggttgaccagtcatccattgataatctggaggaaccattagacatagcagacaagtcatcacctagagggagggataatcaaaaccaagttaatttatcccaagattctcctattcctgaaaaaaactgtactgattatgagacatctgttctggctaggtttcatattcttaaatcccggattgaaggttcaagttctacttcagaagggaagcaattagatggagatggatctgctggcaaagaaatggatgacacaacaaattcaacatatgtatctgagggtaaaagtttggacgtccatgtaaatcctgctgtggtgcatctcaattcctacactgccgtggacaagtcaatcccaaaagagtttcatctggattcggaggacaatcaagaaactcagcctagtggaacctgtgagtttcagcctcctacttactactccgatggctttgcatcagattgggaacatgtggagaaaagcttgtag

SEQ ID NO: 38137 - DNA, 657 bp, Glycine max
  Peptide Sequence Number=SeqID_154915
atgtctccgggtcccgttcttgacgccggcgccgaccaacaaatccccttcgtcgacgacgcatccctcaagaagaaacctcaccccctggaagatgacgctcctattgtcgaagacgtcaaggacgatgacaaagacgaaaccgaagacgaggacgaggacgacgatgacaaggaagatgacgcccaaggtgctgctgagggtgggaagcagagcagaagtgagaagaagagccgaaaagcaatgctgaagttgggactgaaacctgttactggtgttagtagggtcacaatcaagaggacaaagaatattctttttttcatctcaaaacctgatgtcttcaagagtccaaattctgagacctatgtcatatttggggaggcaaaaatagaggacttgagctctcagttgcagacacaggctgctcaacagttcaggatgccagatgtggaatctgtactggcaaaacaagatcaagatgctgcagctgcagcagcacagcctgaagaagaggaggaggttgatgaaactggtgtcgagccccacgacattgatttggtgatgacacaggcaggagtatcaagaagcaaggctgtcaaggccctcaagactcacaacggggacattgttggtgccatcatggagctcactacttag

SEQ ID NO: 38138 - DNA, 525 bp, Glycine max
  Peptide Sequence Number=SeqID_154916
atgtttagtgttggagctctgaaatcggaatttcttgggaggcaaccggacagggagagaaaggaaagaagcaagaaaatggaagaagaaaagggaaaaagttcagaccttgtaattctatctaccaaagaggagacttcagttccagccctagtctgtctgagaaaagaggacattaaacgtttcgaggaaaccgaggaatgcttcgtcttagacttcgatccatttcactcgctcgacttctccaagctttccttggaccatcaagatgtctccattcttgctgaaaagggcgaggtagcttgcagggattacccgcatccaaggcatttgtgtgtcaaatttccgtttactgcaacacctcacgggagctattgtgaaatgtgttactgttatgtatgtgattcagctgcaccatgtaagtattggaacccatctacactctcacactgtgatgcagatagcgatgatgactggaaggaagaaaggaatcggaagaaatttcaaagtattctcgctagttag

SEQ ID NO: 38139 - DNA, 429 bp, Glycine max
  Peptide Sequence Number=SeqID_154917
atgaaaacacaaaggttttatacaggttcatcccaactcttgggctacatccagttctccttcaaacctggaagggtttctactaatcaaatctttgattacaaccaggatagagtaactattccattgcttttgaattacgagccaagtgcaaaagcacttgtcttctcagggctagactccaatgtgacttggatgcagccagactcaactcctctatcttggaggtccaatgggaacctccctcgatgggttggactaaatgtaattctgatggcacaaatcgaggcaaacccggtgaggcaagttgtggtagcatctttagggattatcatggctcttcaaaaggatactttggtgttctgggcatctcaacagcgctggaagcaaaattattgggtgccattacagctatggaaacgaccctga

SEQ ID NO: 38140 - DNA, 951 bp, Glycine max
  Peptide Sequence Number=SeqID_154918
atgaagccaaataagcttaaatgtataactacattttttatcctatatttgttcaatcaaaatgctcattctgagctgcaggttgggtattacagctattcatgtagcatggctgagttcattgtgaaggatgaagtcagaaaaggtgttactaataatcctggaattgcagctgggctagggtgtgatgcatcagtgcttcttgattccactcccttaaacactgcagagaaagactctcccgcaaataaaccaagtctccgaggatatgaagtcattgataatgccaaggctaaactagaagcagtatgcccaggaattgtttcatgcgctgacattgttgcatttgcagcaagggacagtgtggagtttgctcgagggcttggttatgatgttccagcaggaagaagagatggcagaatctcactagcttcagatacaagaacagagttacctcctccaactttcaatgtaaaccaactcactcaactctttgcaagaaagggattaacacaagatgaaatggtcaccctttcaggagcacacaccatcggtcgctctcattgctcggctttcagcagcagattatacaacttcagtaccacttcaagccaggatccaagtttagatccctcatatgcagcacttctgaagcggcaatgtccacaaggcagcacaaaccaaaacttggtggttccaatggacccttcaagtcctggaattgctgatgtggggtactatgttgatatattagcaaaccgaggcctcttcacatctgaccaaactctcttaactaatgctgaaacagccagccaggtgaaacaaaatgccagggatccctatttatgggcaagtcaatttgcagatgcaatggtgaagatgggtcaaatcattgtcttaaaaggtaatgctggagagattagaacaaattgcagggtggtcaatagttag

SEQ ID NO: 38141 - DNA, 501 bp, Glycine max
  Peptide Sequence Number=SeqID_154919
atgtgttgtgaaagagaagaagaaattaagatgaaaacacccaccaccaaagtggcgaagacactttcgaaacgtacacgaccacaatatgacatcgacattgactcccccatcagggccatagcttgtctcaaaaaaatcgacgacatgcgccgcttcgaggaaaccgaggattgcttcatcctaggttttgacccttcctccgccgccgttcccctcttggttgattcttctgccgatgatgtctccgtcattgctgaaaagggccaggttgcttgcagagattacccgcactcaagacatttgtgcctcaaattcccattcacgaccacgcctcatgagagctattgtgaaatgtgctattgttatgtttgtgatacggctgccccgtgtaaggactggaagggctggcattgcaatgcagagagtggtatttactggaagaataaaaggagtttgaagaaaattcaaccagtgcgtctctataattctcaaccatga

SEQ ID NO: 38142 - DNA, 1102 bp, Glycine max
  Peptide Sequence Number=SeqID_154920
caagttcgtcaaccacaaaaagctcgtcgccggcgacaccgtcgtcttcgtcaaggactccgacggcagggtctccgtcggaatccgccgcgcggctcggtttgccgccgcgatcgagactccgcagccgccacctgcggaacgggaggggttttcgcggtccgcgacggggagagtgaccgcggaggccgtggcggccgctgcggagtccgcggcgcgaaacgctccgttcgaggtggtgtattatccgaggaccggttttgcggattttgtggtgagtgctgaggttgtggaggaatcgatgaagtgcgcgtgggttggtggaatgagagtgaagattgcaatggagactgaggattcttctagaatgacgtggtttcaagggacggtttcttctgcatgtgcttctgagaatggaccttggcgcatgcttcaggttaattgggatgaacctgaagtcttgcagaatgcaaagcgagtcagtccttggcaggttgaacttgtttcccttccatttgcacttcatacagtatactcccctaacaaaaggcttagatctgaccagggttctgggctgttaagtaatagggagggagaccccttctttcctatgacagggttccctaactcgacaatggaacacatgacagggttccctaactcgacagtgggacacatggataaatcattgttgagttatgatacttttcctgctggcatgcagggagccaggcatgatctattttctccatcaagtttttccaactttttaaatgataagtcctatctgtatatgggtagtggttcatttgggaacaatccagtgcaaagtttgggaactgtgacaacagagctaaacatgagcagttctcaatcggatgacttgtcaccacatagccagagtagttttcattcctttgccagagagtttgctgggacccggaactgtgacaccaaagttgcttctggttcaattctgctatttggtaagatcatacagcctgctgaaagtgatttgcatgatggtgattgcatggaacgtgatggcagcaggggcagcaataaacttaagacagttgaggcatgctatttttcaaagtag

SEQ ID NO: 38143 - DNA, 369 bp, Glycine max
  Peptide Sequence Number=SeqID_154921
atggagaagcctactactaaaagtaaggatgttgatgtgatgcaatcacatagcattgaggagccgatcactaacattgatgttagtaacaagaatgtggagaagccaaccacttctttaatttctttgactcctccaattcacaaccaagatggttttaagaaagctcttctccaacttgctttattcgctcctaaaatggatttgaacaaatttgatgtgctgaatgatgtaaaggatggggagttggtaagaaaatctcaaatggagagttctaaagagccatttgatagtgaaatgacctctaaggtaggtgatgctaaggcgaccttaaactctattctgacttctaatcctccaacaacatag

SEQ ID NO: 38144 - DNA, 315 bp, Glycine max
  Peptide Sequence Number=SeqID_154922
atggcagactcggcatgggtgattggctttgttgcatcgacacggggcatggaggtgcagttagcctggaaagtggaggcggcggtggtgactacacgaaggaagaagatagcggagttgagctgcaagaagttaggccatggcgacctcgaggcggtccacacaagcggtagaaagttcgacgtccgtcattcgaggcaagccctggcgcaacagttaagttgtgccttgatgaccagtttggtcatgggttcaaattcggaaacaacttttatgcatatgcaaggcagcaaagatgagagccttaaattgtga

SEQ ID NO: 38145 - DNA, 858 bp, Glycine max
  Peptide Sequence Number=SeqID_154923
atgtgtttgctcaactattttgaagagtacgaactcaagcacatctttagagaaaacaatgacagagaaaatgtgttatcaaagttagcgagttctaaaaagtcaaggcaacacaaaacattcatacaagaaacacttgttacaccgagcatagaaaattttgatatctttgcaagacagattggttgtgacttttggatgaacctgatatggaattatctagtgaatgaccaattacctatagatgaaattgagctctatatgccacgaatgaaattcacagaggaatgtgcagcatggaattgggaggaaggaacatggcaacttgatttctccgagctggttattattagccaacaatgcatactactatgcataatttcaaaaaggtgcaaagaatgcgaggagttcaacaaacttcatcatgcaccatcagagaaattacatagcattcgttcaccatggccatttgtattatggggtatggacattcttggtccttttcctattgtaaaaggccaagtgaagttcttactggtgaccattgactacttcgccaaatggattgaggtagaaccacttgccaaaattattgctcaaaagcattctatggacataccattgcacttcataatccacaccaaaggaatctcctttcagattgactatggaactaacgccatgattccaattgaggtcaatgaacccttaacaagaagagcccaatttgaagaagcatttaacgatgaaaatctagctttggaactaaacatggttacaagggagttttgggttggcgatcttgtatggagaatgaaaggagaagcaaggaccatactgaaggaaaacttgctctga

SEQ ID NO: 38146 - DNA, 561 bp, Glycine max
  Peptide Sequence Number=SeqID_154924
atgcaaccaagtcccgcatcattaccggctccgcttcccatgccaattgcgccttcatgtcctacactcgtgcaaccattccctgcacccttgccggctccacttcctatgcgtgctgcctccttccccgatctccgccacactcgcgccactgtttcatgcaacaagctcttcagtactgttgctcagtatggccgtgcaacagctcctaatgacaaggctctcgaagggagaaacatgacgttgtttgagatggaaactgaatactatggacctaccatggttgcatgcaagtgccaactaactgtgtttgcattatggacggctgctgacccagaggagcctcgctggaacagaccttgggatcctggaggacctggacggactcgtaacaccttgaggacaaggttttgcttgatgggctcgagaatgatacaattgatactagggggtctacaagaagcaagggctacaaggcccacaaggaagagtgtaccaccaactttatgtgcaaaatggctaggaggagcaaaacgtgctaataagatagtaggttgttaa

SEQ ID NO: 38147 - DNA, 345 bp, Glycine max
  Peptide Sequence Number=SeqID_154925
atggctaaaaatcatcacaaattcaaggcccagacgaagcatacaacagccgaagtcgctcgccgatgtaaagttgatgtcttgttggagatggtgtcgttgtcgatgtctatttgggaatacacagtgctcctccttctacggcccctcctcgccgtaacgttcgttctcttcttaatatccctcggttggtttgtggcgtggaaactggtgctggtgcacgtgcctctggtgcaagaggttttcggcctcaagaagaaagctgttcgagtgaagcccccaactggtcgcttctccaaaatttacggcacccttcatgccaaaaactcaccctccacttcataa

SEQ ID NO: 38148 - DNA, 243 bp, Glycine max
  Peptide Sequence Number=SeqID_154926
cgtacatctacttgggttatgatactgagaacaagagagggtacatctcttgttgatgaggacaaggcaaggaataagggcaaggaacctttagaaggacttggaagacctatggcaagggctagaacaaagaaggccaaggaagctcttcaacaagtgttaaccatgctatttgaatttaggcccaagttacaagtggagaatcttcagattgttaattgcaccatgttccaagaagagtag

SEQ ID NO: 38149 - DNA, 559 bp, Glycine max
  Peptide Sequence Number=SeqID_154927
atgaagggtgtgggaggatatcacgattggccctattactcttcgccggcttcaaatttatcagcttttgcggcgccgtttagtgtgaatccctacacttccagtgaggcttcgtctcagttcatggattcagccgaatccgcagaaactgtgcccccaattcactttcagccctacgggtacgatttcttttcgagccccgttagacaattggattccagtgcgcaattccctcatctgggtttgccttcttatcccgcaaggtcaagccttgttgaagcccaaccctactatgcgtcttctgcaattcacgatcactcttctaattcggcggcgccttatcattggtcttctgaggctccctcttcgggttggccttcgcttagggtagctaataagtcacctgaattagggttttctggtcaaggtggtgtttcctgggaccagtttccggagttcaatagccgcagtaaagagaaactgatcgaagttgggagaagtctctcctcaaaggaaacaaatgtggctggttcggttggtgaacaaaagaggaaccaag

SEQ ID NO: 38150 - DNA, 273 bp, Glycine max
  Peptide Sequence Number=SeqID_154928
atgcaaagaagatcaaagagagaggatggtttcgcatgtgaacatcttgttgtatggcatgggggtgacaacatccacgacgatagagcacaggtgcaggtagcgatgcttgaaacgacaggtggaagcaacacgaagaagatcaaaatgaagatttggaagacgacaacatttgtagcggtgacgttcgcagcgaaagtgtacttttgcgactatgaggggaggcaaagtgcgaggattgaaggaagtggaaggaagttaggaatgtgttga

SEQ ID NO: 38151 - DNA, 120 bp, Glycine max
  Peptide Sequence Number=SeqID_154929
atggcagaaccatcgaaaaagcgaaaaggcgtttcgacttcatccatagtcaccaaaactcaaagtcatggatcatccaaggcgcagactgtaacgacccgcctcgtcgctacgaagtga

SEQ ID NO: 38152 - DNA, 312 bp, Glycine max
  Peptide Sequence Number=SeqID_154930
atgcaaaggtgtgagcacatactctatgacaccttcctattctccaccaacacaagcgacagtgcgaggttcacctccgttgtcgctaattgcgaacaagaaccgacaacaaaggcatggctgttgacaatggcgatggtcgacatagggagagacatgagcaccatgtggggaggacagagggagggaggtgctttagggtttgagagtggggtgaggtgcctgggtgcaggaagaaaaattaggtacaggaagcaatggcccaatcatagaagacaaaacaacaatgagacaaatgcccaatcatcttag

SEQ ID NO: 38153 - DNA, 1158 bp, Glycine max
  Peptide Sequence Number=SeqID_154931
atgtctctcaaggttgtaacagtggtgtttttgctggcaacaatagtagtagccagtgatgacaccagtttcacctataatggattccaatcttcttatttgtaccttgatggaagtgctgagttcaccaccaatggcatgcttaagctcaccaatcacaccaagcaacaaaagggtcatgctttcttcccaagtccaatagtcttcaagaacaccacaagtggaagtgtgttttctttctccaccacttttgtgtttgccataaggtctgagtttcccaatttgagtggtcatgggattgtgttcgtggtttctccaacaaaaggggttccacattctcttccaagccagtaccttggcctctttgatgacaccaacaacggcaacaatagcaaccatatttttggggtggagcttgatacaattctgaacaccgagtttggtgatatcaatgacaaccatgttggagttgatgttaatgaattgaagtcggttaaatcagctgctgcagggtattacagtgatgaggggtttaagaatttgagtctcatcagtggctacccaatgcaggtgtgggtggaatatgatggcctaaagaagcagattgatgttactttagctccaatcaatgtcggtaaaccggaaggccctttattatcattgagcaaagacctttctccaattctgaacagtagcatgtatgttggattctcatcctcaactgggtcaattctaagttctcattatgttttgggttggagctttaaggtgaatggcaaggctcaacagcttgcaatctctgaactccctatgctacctagactaggtggtaaagaagagtcaaaggttcttattgtagggttgcctctgatattactcagtttgattctcatggtggctctagcagtggttcatgtcatcaagaggaagaagttcacggagctgcttgaagattgggagcaagactatggtcctcataggttcaagtacaaagatcttagcctggcaacaaaggggttcagggagaaggagctgttggggagtggtggatttggtagagtctacaaaggggtgatgccaatttccaaaattgaggtggcagtgaagaaggtgtcccgtgaatcaaggcaagggatgagggaatttgtggcagaaatc

SEQ ID NO: 38154 - DNA, 870 bp, Glycine max
  Peptide Sequence Number=SeqID_154932
atgagggaatttgtggcagaaatcgttagcattggctgtctcaggcaccggaaggtggttccccttctggggtactgcaggcgcaaaggagagttgctattggtctatgactacatgccaaatggaagccttgacaagtatctctacaacaaaccaagagtgaccttaaattggagccagaggtttaaaatcacaaaaggggttgcttcaggtctgttttatctacatgaggaatgggagcaagttgtggtccacagagacattaaggctagcaatgtgctacttgatgctgaattgaatggtagattaggggactttggtctttcaaggttgtatgaacatggaactgatcctcacactactcatgtggttggaactcttggttatcttgcacctgagcacactagaacgggtaaggcaactacaagctctgatgtgtttgcttttggtgcatttatgctagaggttgtgtgtggaaggaggccaatagagaaaggaggggaatccgggagcgaaattctggtcgattgggtgtataattgttggaaaaagggtgagattcttgagtcaatggatccaaacttgggcgcaaattataggccagatgaggtggaattggtgttgaaactcgccttgttgtgctcacattctgagcctttggctaggccaagcatgcgccaggttgtgcaatacttggagaaagatgtgcctctgcctgatttgtgtatgcttagcttatcttcaaatggcttaacttttggtttgcatgaagattttcaggactgtccaatgtcttatccttcatctatgaataggccaatatctcatacttcttcaattgttgaatcacttctctctgggggtcgttga

SEQ ID NO: 38155 - DNA, 339 bp, Glycine max
  Peptide Sequence Number=SeqID_154933
atgatcttggaggaagggtataaacgaggccttgatggttgtaaaaataatctccatggtagattatttctctctaaaggggacaatcctcctaaaatccatgacctacgtactcaacttacgaagcagtggcaacccccttggtcaatggcggatgataccttttggaaaaagtttggggtggtagcatctaattctagggaaggtaaggagcaaaaaaaacacagcttacctaaagaagggaagaagacttctgtcaaatatgtacctaaggataaaggtgttgttgatggtaaagcctatgctaaggcaagaggatctcctaaacctttcagatga

SEQ ID NO: 38156 - DNA, 363 bp, Glycine max
  Peptide Sequence Number=SeqID_154934
atggcccaagtggcacctctggacatggagttagagcaactggatgttaaaatttcctttctccaaggatggctagaggaagacattctgatgcaacaacctaaaggttttaaggtgaaagaaaatgaaaattttgtctgtagattgaagaggtctctttatgagttgaagcaatcaccaagcaaggtggaggatggttccaacatctatctattactttatgtggatggcatgcttataacatttcaaaatttgttggcaattcagaagctgaagtcattacttagtagtgaatttgagattcaggacatgagagctgttgaaaagattttgggcatggaaatcaagagggatcgagtctag

SEQ ID NO: 38157 - DNA, 789 bp, Glycine max
  Peptide Sequence Number=SeqID_154935
atggagctacgcgacagtggtgtcaagatggaagatgaagatttggtgtctgggaatggtgataaagcttatgcattcggattatcggtgactgattctgccaaagggacatatgcaattactgcaaaaaaaccgggtcattgggagcgagattgtccaaagaaagtaaagaactattatattgctgcccttgttcagaatgactccttatcgaaaagggatttggttatggagaagtttggtggtaatgtccttatgggtaacaatactcctcgtaagtatgttggtataggttctgtacaaatcaatatgcatgatggtgttgttaaaaccttaactaaagtttgtcgcgttccaaagcttaagaaaaatcttgtatctgtgggtgccattgatttgataggttttttttgttgggttaaaggtggagttatccatatcagagggaaatggaagtatgtggtaatgcagggaaccaagcaaataaatttttacatgcttcaagggtccactacggcaggctctgtctctactatttcacaatctggaagccatgcgtctaataattctctatggcatctgcgtttaggccacatgtgtgaaaaaggtttggatattctgagcaagcaaggcttacttgcaaatcacaaggtgaaaccttttcagttttgtgagcaccgcatctatgggaagaagcatcagacaaagttcccaaaggatgagcatgcaataaatgacatgttggactacgaccattttgactattggggaccttcgagagttccataa

SEQ ID NO: 38158 - DNA, 134 bp, Glycine max
  Peptide Sequence Number=SeqID_154936
atgtcgatgttacaccacgacggtggcacaagatgtttgatgacaggatggttttcgaagacacctacgacagtcgatgagtcacggagaccaggacgtgagctgagtgacgggggggggggggggaatgtaac

SEQ ID NO: 38159 - DNA, 402 bp, Glycine max
  Peptide Sequence Number=SeqID_154937
atggacattggtactagctttagggttgattttgctcaagatgggcttatcccccaacatggtgataaagaccaagcaatggtcacgaaagatatcactttcacccttattgatttcatgccccgatgtatcttttttcctgtcaagaagcttaatctacaatggagttgctcgaccatctatgcttctccaacccttactttgcatattgatctatgggatcatctcaaaattttatttgatgttattcttgatccctggcttctaatgggggacttcaataaaatcattcactcatcagagatccaaagagcttggctaggtcacccagattatggtgacattgtcaataaggctttgcaggttactaaggagatgtacttactaaacttcaagaggtga

SEQ ID NO: 38160 - DNA, 726 bp, Glycine max
  Peptide Sequence Number=SeqID_154938
atgtctcagcccacaacttcgatttttgctttctctgcaggtcctacgaatggtctagactttgatgaagatccacctgatggtagaggaacaacatcacaaccactatcctttaagatatgtgtctcaagaagtatgcccagaagtcttgcaatgatagagtatgaagatgaaaatcctttgaagccaaaggtccatatttcaaaatcagtgtcaaaagcctatgcgcaccttggaatgaggcactggtggtcaagcttcgacatccttgacataggtaatgagtatttcatggtcagttttgacatggacgttgatcgcatgaaagtcatcgaagatgggactccaatcaaagtcgacatcaatacaaagtatgtgaaaagaggtagattcacaagagtttgtatcgaggttgatttaacaaaacccgttatggggcgtgtttggatgaaagtttattggtaccaagtccaatacgtaggcctgcatcaaatttgtggcatatgtagctgttatgggtatctcacgattgagacgaaaattgtcgagacaccacctgctcatgctaacttgagcaacgaccaaactccccccacaattacggtggaggcaaacacaatggagaaagaagtgtcgcaatatgaggagggacacaataatggtagtaataatatcccaattaatgtggaggaaacaaatatgggaaacaatatctcttttgattaa

SEQ ID NO: 38161 - DNA, 777 bp, Glycine max
  Peptide Sequence Number=SeqID_154939
atggatgagtggagttcaaccttgggtcatggttcggtgtatggattccttgagcctcattccatacacaattcaaaggacagacatgttgaatgtcaacattacattgaaacattggttaaggaatcccaacaagaggatgttgtcatttggttatgttcgttgcataagaagcctgatattcatttgaaagttgcagttaacaacaatacaatgaagacattaaagagtagtttggatggtcatattgataaagttgcaacgcagtggattgaaataaaggctagtcatataatgaatgtttatttccaactactgatgtttggtcattgtgtagctgaggatgtcgatagtgttgatcatagcccaattgacatcaacaaatataaggtttcacaactacattcatcttacttaaatttccctactggaaggtacaaagtattcttaggacataaacaatactttgtatctttgaatgttggtgttggaaagatgcaatggtatggatttcaccaagaacctgctggtggtgctgatatcctcaatgaaaaagaggcaattcttcgacaagacatatatgacaggacgccaacatttacatggggaaagggccatgtcaccttgcttggtgattttatcgatgccatgcagcaaaatatgggccaaggaggatgcatggctattgagaaaactaaagatgggtttcactggggagttggtaacaagcgtcttctccaaaaaatcattctcatgggtctcatgaaaacaaagtga

SEQ ID NO: 38162 - DNA, 771 bp, Glycine max
  Peptide Sequence Number=SeqID_154940
atggttaatagactacaacctcacttggatactatcattgttcccttacaaaattttgagaaagcctatgatagggtaaattgggacttcttgaagcttactttaattaagtttggcttcttgaaaaagattactgagctgattatgaactgtgtttctgctactagtctctctcttgagtggaacaatgaaaatctccctagcttcaccccaaggagaggcctaaagcaaggagaccttctttctccttatcttttcatgttgtttatagaaaagttagccatcctcattaatgagctcgtgcatgaaaacaagtggcaatcactttcaattaaaaacaatggtcctagagtgagccattttttctttgttgatgattgcctcttgttcagcaaagcctgtgcatcccaagttgagttggtcaaggaggtgcttgagagattctgtgtggcctcaggtttaaaagtaagtgttgataaatccagattttatgcgtccaagaacgtgtccaatacaaagaggtgtcatttttccaacattattaatttccaatacacctctaatccaggcaaatacctagggttccctatcttcacaagttgtgtcactaagagggaattcaacttcattttggatcacattcaaggaaaattgcgcggatggaagtccaagcttctcaacagggctggtagaatgaccttatcccaatcagtgttggcatccatcccctcatatgtcatgaacaactatcttcttcctaggtacttgtga

SEQ ID NO: 38163 - DNA, 558 bp, Glycine max
  Peptide Sequence Number=SeqID_154941
atgaaaaagaaaccacgagaacacgatttctgcagcaactcgaccccaaaatccctaaaacttcataactcgatttctccctcaattctcaaccaaatcacgtcccacaaagcccaaaattcatcatttctcattctctttcatctccaccgattaaaacttccaaaaacacctccaaatggcataatcatcgaagaagcgaaagggggttgcgatttcatctgcagttaccggaactcgaaaccacggaacacccaaagcacagacatctcaaattcctccctccatatcatctcctacattgttttcctcggaagaacaacgtatccgtttatctccatgaaacttcctttttaccctgaattggttaaagccttctattctaacttggaaattcaagaagattccttgatttccgaagtttatgggattaagatggtcatagaccagtcccttttctttgaactcactcaattatccagtgacggtgtaccatttgagggtacacttgatgatgagtggaagtttgatttttctgtggctgatgcccgccagatg

SEQ ID NO: 38164 - DNA, 1172 bp, Glycine max
  Peptide Sequence Number=SeqID_154942
accgcggttggggaatgcagcagttaaagaccgaccagcacgatttacatcagcgtctggatgcgatgcaggcggaattaaacctattccgtattccattaaataaatggacggttcccactgcggtattaggtggcgtgatactgattggcatgttaatcctcggtatgaattataacttcccctatagcgaagtcgggaagcaggtttatcgcacggtgcccattgtttcgcaaacccgcggtcgagtcaccagcgtgccggtgaaaccaaatcagatgctgcatgaaggcgacatcttgttcaccatcgacccaaccccgttccaggcgaaggtggacgacctgaccgcacaagtgaaagcggccagccaggaggcgttgtcgctggatgcggggttaaccagcgcgcaggctgatttaagcaaagcggtcgccgagcgcgaccgggcccagcgtgaatacgcccgcttccaggcaggtcatgataaaggggccttttccgatcagatggtcgatacccgtcgccagaactggaaagcgacgcaggcggcggttgacgccgcccgggcaaaggtcgcacaggcgcgtaacgatctcaattcggtggtgcacggcgagaacaccaaagtcgcttcgctgctggcgcagttgcgtgaggcgcaatttaagctcgataacacggtggtacgcgcgccgtctgacggctatgtcagtaccgtcggcttgcgcccggggaccatgtccaccgcgttggggctgaagccggtaatgacgtttgtgccaacggataatgcgaattcacgtgaatacgtcgccgcattccgtcagaacgcgctgcagcgtttgcaaaaaggtgaacaggctgaattactgttcccctctattccgggaaccgtatttaaagcgcaggtcgcggaagtgctgccggcgattggcgaaagccagtttcagggtcaggggacgttgctgacggccaccgatctggcggcgcgcggccgagcgctggtggtattaaaagtgaccgacgatcgtctggcaaattatcagctgccgcagggcgcggatgtcgaagccgccgtctattcggaacattttgagcacctgtcgctgataagaaagatcctcatccgtatgaaaagctgggaaagctatctctatctcgatcactaa

SEQ ID NO: 38165 - DNA, 1029 bp, Glycine max
  Peptide Sequence Number=SeqID_154943
atggcacagaagaagagtactccaatcacttctaccacatccagacggagcaaagttgcaatcccttccaagaagaggaaagaaatttcctcatctgactctgatgatgatgtcgaactagatgtctcgacatcaaagaaggccaagaaatcagggaaaaaggtgcctggaaatgttcctgatgctccattggacaacatttctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacataacaaacagaaaaagtgatgattatcagaaagtatttgtcagaggaaagtgtgttagattctcccctgttgtgatcaacaaatacctggacagaccaacagatggagtgatggatattgctgtctctgagcatcaaattgccaaggaaatcactgccaaacgagtccagcattggccaaagaaagggaagctttctgcagggaagctgagtgtgaagtatgcaattctgcataggattggcgctgcaaactggagagaatctcctctatccctgcactacaaactgttcgaggggacacatgtcccagacattgtctcgacatcagggaaagctgctgcttcaggtgctgtgtccaaggatgccttgattgctgaactcaaggacacatgcaaggtactagaagcaaccatcaaagccaccacagagaagaagatggagctagaacggctgatcaaaaggctctcagaaagtggcgttgatgatggtgaagcagccgaggaagaagaagcagctgagcaagaagaagaagaagctgagcaagaagaagaagaagccgatgaggaagatgcagcagaggatacagaatccaatgacgatgattctgaagccaccccatga

SEQ ID NO: 38166 - DNA, 390 bp, Glycine max
  Peptide Sequence Number=SeqID_154944
atggcaccagaggacatgaaaaagatgaccttcgtcaccctgtgggggacgttctgctacaaagtgatgtccttcgggcttaagaacgctggggtaacctatcaacgggctatggtagcattattccatgacatgatgcacaaagaaattgaagtctacatggatgatatgattaccaagtctaaaaccgaggaggaacatctcgtcaacttatggaggttgttcgaaaggttgcgtaagtaccgattaagattgaatcccgccaagtgcactttcggggtcaagttgggaaaattgcttggttttatcgtaagccagaaaggggtagaggtagacccggacaaggtgaaagccatccttgaaatgcctgagctacgcaccgaaaagtag

SEQ ID NO: 38167 - DNA, 162 bp, Glycine max
  Peptide Sequence Number=SeqID_154945
atgaaccctccagtgcctgtgccaccggtgcttggaaggccccttatcctatacatgattgtgttggatgagtcgatggggtgtatgctagggcaacatgacaagtccgaaaagaggaaacgggccgtttattacttaagcaaaaagcagcccaccgtctaa

SEQ ID NO: 38168 - DNA, 528 bp, Glycine max
  Peptide Sequence Number=SeqID_154946
atgggggagacatatgaaatacctcaccacaacctagccgacttcgagcctcgcctcggatacgccactctggggcaagcagttggtggtgtacccctgccaaatactttggaggaccctcaattttgcctgcaaccacaaccctttcattttgcggtagggagagtccctcctgctatggtagaaaagggaaaatttgatcatatagaggaaaggctcagggccattgaaggaggtggagattatgctttcgttgacatggcagaattgtgcctagtgcctaacatcgtcatccctctgaagttcaaagtgtcggacttcaataagtacaaggggactacttgccccaagaatcacctaaaaatgtactatcagaagatgagggcgtacgcgaaagatgaaaaattgctgatgcatttcttccaagaaagccttattggggcagtcatcacctggtatactaacttggaaccctcccgagtccattcttggaaggacctaatggttgtctttgttaggcagtattag

SEQ ID NO: 38169 - DNA, 300 bp, Glycine max
  Peptide Sequence Number=SeqID_154947
atggatactggagagagatgttgtttgatcactgataaagtttcaaaagtgccgctttattatccgtgtttgtatatatcaactgagttaagaaagaagaacgaatcaatttcaactattgagctacattcagcgagtatagctcttttttatagatttctgaatctcaagaacatagacatagaagcaaggatcagaacagcagagtttcttcatcttcaagagattgatggactaaaagaatttataactaagagaatgaaaaaagagaaggttgcaaatcttgatagcgggtgcagg

SEQ ID NO: 38170 - DNA, 189 bp, Glycine max
  Peptide Sequence Number=SeqID_154948
atgccttttaaaggcttaaaagacaaagaaatgaactgcgttttctatgttttttcaggaaaacgcaatgaactcgctaagtcagcatgcgacgaactcgctaagtgcgcatatcgcactaagctagttcatcttgtgaggatgaacactcatcctcctattgagatacttatggctaagcgaggctga

SEQ ID NO: 38171 - DNA, 462 bp, Glycine max
  Peptide Sequence Number=SeqID_154949
gctcaagagaaaagccctataaaagagcatgagtcaagagaaaaagatgaggaacaagcacaacaacaatgggagaagtactcaatagtagaaaaccaacaagaaaatattctccaaatcaataaccttcctcatcaactgattttcaagaaaggaaggcaaggagagcatgaggaaaccttaagtgccattctttctttaatcactaacacctttcttgaaatgatttggaatgtacttccagactatatgaagttcatggattttctagctaaaagttttttcgctaagcgcaggcctcgcgctaagcgcatatttgttcatgcgctaagccgggagtctcaagcacttagcgcccaacccttgcatctgaggctgatttggtccactaagctagacaaggctgagctaagccaacatcaattcgatctgaattcggctaagctacagcctgatcgctaa

SEQ ID NO: 38172 - DNA, 282 bp, Glycine max
  Peptide Sequence Number=SeqID_154950
atggcacgcaaaccgaggcaggattttagcgtttcaaagcccaaatttcagacagctcttttctccctctccctcacgttgccattctttcctccttcattctccattgaagctccaaacaaagctccaacctttggccatcatttctgctccaaatcgcgaaaggagggcattttcggagtcgtgaagtgtgtgtctacgagtgggacttcgaaatttcagggtttttatgatgatgcttgtgatgttcatgtgctgaaattgcttatggaaaactgttag

SEQ ID NO: 38173 - DNA, 210 bp, Glycine max
  Peptide Sequence Number=SeqID_154951
atgactggtacactcttccttttgaaacagcaaaatagtttagagattatgagtgtcattattttggggacgccacatggaggccatgaaagagcaaatgaccacattaatggaagccatgatgagtataagaaggatgatggaggtcaatgcagctacagttgttgccacaagtatcaccatagaagtggacccgactcacccacctag

SEQ ID NO: 38174 - DNA, 534 bp, Glycine max
  Peptide Sequence Number=SeqID_154952
atggacttgggaaggttccagattagtatactaggtgacggttgccccagtaagactttcctggaagaaatgcatcaacaatttatcatttttcgagtatgccctcattttcctgctgtacatcttcagcaagaggaactcttcccaccacaaaatgctagggttgtggttgtgggcgatactgagggccccccaaagtgtttggcatgggtacgtcgcaaaatgtctgcccctcagcggcatattcgaggcgaggctcaaagttggctagattgtggtctcggggtgcttcatgtgtgtcccccaggggtagagagatatgtgcatgatcatattggggttgttggctctcaatgggtatgggcgcggagttgtcaacattctcatcgggagtttgtgcaacattgggtggcaagccatatggtgggaaggaatgcttgttctaaacttgcacaaaatgggggccgcccacacttcccaactctttgcttccttgacctaccatatctgaggctggatgttttacttgattga

SEQ ID NO: 38175 - DNA, 144 bp, Glycine max
  Peptide Sequence Number=SeqID_154953
atggcagctcatccaggcgatagtaccaaagggcttaatcttatgagaaagcaagagattgactctttgagaaggcctctcatcctaaacgcaaaagataggatattagatttgggaattagacacatgcaacctttatcttga

SEQ ID NO: 38176 - DNA, 492 bp, Glycine max
  Peptide Sequence Number=SeqID_154954
atgtcctttttcttgatttttttgaaccccaactcacacaggctagcatctggctcgcgtgggccacccaataacttcatcgtgaagaaactagctcacttcggcgagctcattacttcagggttaagtttcagctcgcctgggcgagttgcaactaccccaaagttccaaggctcagaagtggagagaaataagaggagagagaaagaagaagaagaaagaagaggaaacgatgttgaggcactgtcgaatcacgactgtgaccaatccctacatcgttccttgtttggtgttctttgtgcgaccgttgcagaatggagaaggaagagagagaggagactccacttcaaggagaagatgagtctagaagaagctcaccaccataggaggccatggataatagcttggaggaagaaggagatgaatgaagggagagggagagaagagcatgaaattttgtgctctaagagagctctgaaatctgaagtttaa

SEQ ID NO: 38177 - DNA, 279 bp, Glycine max
  Peptide Sequence Number=SeqID_154955
atgccacctagcagttcagacttcaggttctcagcaaaaggatgcaaaagcaataaaattgaggtttcctaccaggaagttgttgctctaaagagacaagaagagctcattcgtgaagaagaagcagcatggctggctgaatgtgagcagaaagcaaaacgtggaaatgagagggaaaagaagtcaaagaagaaacagacaagaaagttggaggttctaataaagaatggttcaaggtatttttctttgttttggaaattagaattgaggataggctag

SEQ ID NO: 38178 - DNA, 984 bp, Glycine max
  Peptide Sequence Number=SeqID_154956
atgtcctcgccttcagaggactacatgccctcaccttcaaaggactacacaggactacacgccctcaccttcagaggactacacgtcctcaccttcagagggctacatgccctcgccttcagaacactacacttcctcgccttcagagggctacacgccctcacctttagaggacaacacgtcctcccctttagagggctacacgtcctcaccttcacaggactccacgtcctcaacttcagaggactacacttcctcgccttcagagggctacacgtcgtcgccttcagagggctacatgtcctaattttagaaggactacacgtccatgccttagaggactacacgttctctccttcaaagggagggctacccgggcacaccttcagaggactacacgccctccccttcagatgcctacacgccctcgccttcgtagggctgcacgccctcaccttcagaggactacacgtcctcgccttcagaggactacacgtcctcctcttcagagggctagacgccctcatagtcagaggactacacgtcctcgccttcaaagggctacacgccctcgccttcagaggactacacgtccgccccttaagtgggctacaccccttcgccttcagagggctacatgtcctcattttcaaaggactacacgtccatgccttagaggactacatgtcgtctctttcaaagggaggactacacgtcctaaccatcagagggctacacgtcgtcgccttaagaggactacgcgtcctccccttcagagggctgcacgccctcgccttgagaggacaacatgtcctcgccttcaaaggactacaggttctcaccttcagaagactacacgtcctcaccttgagagggctacacgccctagccatcagaggactacatgtcctcggctttagagtgctacacgccctcacctttagaggactacacgtcatccccttcagaggactacacgttctc

SEQ ID NO: 38179 - DNA, 165 bp, Glycine max
  Peptide Sequence Number=SeqID_154957
atgactgtgaggctaagtcatgaagtgctaaaagtgtcagttgagcttagctcatcagttaggctaagtgcgcatccaccgctaagcgcagctttagcgcgacagaagaatctgacagagcatcaatatcagggtcgcgcgctaagtgtgagatcagtgcgctaa

SEQ ID NO: 38180 - DNA, 465 bp, Glycine max
  Peptide Sequence Number=SeqID_154958
atgaaggcccaagtggagaaggatgaaggcccagaggcagagacactatcaagactattaattgttgctgaaggcccaagtaatccttgtggcgtctaccctgacttatcttccttcactggaagtggcgtctacccagacttatcttccttcattggaagtggcgtctaccctgacttatcttccttcaccggaagtggcgtctaccctaacttatcttccttcaccagaagtggcgtcatccaaaccttcgtagcctgtatcaaacgatccgctcctactcaggttcacatcacgaatgttcgattgagtcctgtaatatatcgagccgcacggaataaaaaacagaacatccgagaaaattcaaatggcagtaaaatgtttctcggatgtcggattaaatcccataatatgtcgagacgctcgaaattaaaagcagatgattcgagcaaattcaaacggtaa

SEQ ID NO: 38181 - DNA, 276 bp, Glycine max
  Peptide Sequence Number=SeqID_154959
atgtcaaagtgttcaaaaagaacaaaggtttctgcttttggaaattactcgtcgtcttctaacccagagacacgcgttgaagtcgaagaatatgatatgtcattgccaatgtcttgcccaattggacaaaaagcagcaaaaaggaaaagcaaaggaaaagaatctcctaacactctcaatttatctggcatagaaaatgtaatgaaggacaaaaatatgaacatatcaaaacttattcagttaaaggaggcacaggaaaggcatctacaagaatag

SEQ ID NO: 38182 - DNA, 390 bp, Glycine max
  Peptide Sequence Number=SeqID_154960
atggcatcaaagaagagaaaggcacctgccacaccttcccaggtgaaggtcagaggtcatctagtgaagtttgaccaagacaccctcaacacattcttgaagacccctatgatcattggggagggggaaacactatctgcttattctaggttcacactcctgaggcctgatcctcgggaattggcagccaagctctgtatcccagggaggggatttgagcttaatgctgatggcttgacattgaagatcctcagaaagaacctgactaccattgctcagacttggagcatgctttcattctcaaacttggtccctacctcacacacatcagatatcactctggatagggccaagttgatttatggaataattcagaggatggacatgaat

SEQ ID NO: 38183 - DNA, 1223 bp, Glycine max
  Peptide Sequence Number=SeqID_154961
cacaacattttattggagacccatctttatggaaagataggtctgtagaattattatcaaatcttaagtgtagaaccttagcagattttagatggtacagggatactttcttgactagggtctataccagagaagatagtcaacaacctttctggaaagaaaaatttctagctggtcttccaagatctttaggagataaggttagagataaaatccgtagccaatacaatggagatattccatacgaaagtttaagttacggtcaattaatttcttatgtccaaaaggtagccttaaaaatttgtcaagatgaaaaaattcaaagacaattagctaaagagaaagcccaaacaaagagagatttaggatctttctgtgaacaacttggcttgccagcctgtccaaaacagaagaagaagacctctagaaaagaaacccatgaaaataaggtagttaccaaaaagagatttccaaggaggagatactcgcacaagccttcaactagtaaagaaatagaaaacccaaaacaaaaattaaaatctaaagtaacatgctataactgtggaaaacaaggtcacattagcaaatattgtaggttaaaaagaaaattaagaaatcttaatctagaaccagcagttgaagaacacattaataattttctcatggaatgttcggaggaagaagaaacagaaacttcattctcctctgatgaaaatctcaatctaattcgacaagatgatccattgtcatctacagaggatgaaagacaaatcaatactttaacaagagaacaagacctcctgtttgaagcaattaattctatacctgacccccaggaaaagaaaaattttctagaaaagctcaagaaaacattggaagtaaaacttagacaaaaagatattattatcaataacaaatttgatgtttgtaacattcttagaaggttagaaaatacttcagctaaaccaacaacaatccaagacctccaaacagaaatcaataatcttaagaaagaagtaaaagaacttcgtcagcaacaagaaattcaccagaatatcctttctcaactcgaagaagaaagtgattctgaaagcatcgctaacagtgacacaaaccacatagaaaatccagaagataatatgtttatgggtttaatcaataagatcaaaatccaaaagttttacataaatattaagatcattattaatgattttatgctataa

SEQ ID NO: 38184 - DNA, 261 bp, Glycine max
  Peptide Sequence Number=SeqID_154962
atgggtgataactggaagtccccaaaggtgaagcacctcaacggccgaagcccgagaaattgtccccttcttagatacaacattcgggcagcatggcgcccgacgtatgcatttaagaaggcgacacggaccctccatcggtttgacaaggtgaggggatcaagacgtaatccgtgcttgatgcagatgcgaaaggcacaacacggggatgcacatagtacaacaatttccacaaataattataagcaaaggcgtacatga

SEQ ID NO: 38185 - DNA, 510 bp, Glycine max
  Peptide Sequence Number=SeqID_154963
atggaaactgatcctaacatgaacaatcctcctatccctatcataaaaaaagaaacacccatcaaagtcataattaatcaacctagaattgaagaaccaacaacatcaaatcaagaaattcacccacttggattagtgtttgctatttcaatggccttacatcaatctacaacacccccaactgttgacaatgaaattccttcaacagatatagatcccaagaagtcgatgagctttgtgaggaaatggaattattccccaatgtcttcaacaatgcttttgagggccaccaactttgaccaacatgctactaacattactaaaattgaatcttcaacagagcatgatgggactaaactcattcaagctcaagaaggatttccaaaagccaaagagaatattatgtcaatacaaggaccaatggaaaaaattgaaaaatctgaagaagacttggtcaaacaaaaggaagagctcttggcaaagcttagaccaatccaagatgaactttga

SEQ ID NO: 38186 - DNA, 981 bp, Glycine max
  Peptide Sequence Number=SeqID_154964
atgattaccggagaccaaaaacaaattaaactggaagagctgccactgtttgaattcgaaaagctatcaactgctacaaacaactttcacttggccaatatgcttggcaagggaggttttggtccggtatacaaggggcaattggataacggacaagaaattgccgtgaaaagactttcaaaagcatctggacaaggattggaagaatttatgaatgaagttgttgtgatttctaaacttcaacatcgcaatctagtgagacttcttggttgttgtatagaacgagatgaacaaatgttggtatatgagtttatgccaaataaaagtttggattcatttctatttgatccactccaaaggaaaatactagattggaaaaaacgcttcaacataattgaaggaatagctagaggaatactttatcttcatagagactcaagactaaggattatacacagagatcttaaagcaagcaacatcttactagatgatgagatgcatcccaaaatatcagactttggtttagctagaattgttagaagtggtgatgatgatgaagctaacacgaaaagggttgttggaacttatggttatatgccgcctgaatatgcaatggagggaattttctcagaaaaatcagatgtctatagctttggagtgttgttgctagagattgcatggaaactatggaatgaaggcaacatcaagtctataatagatctagagatacaggatccaatgttcgaaaagagtatattgaggtgcatacatataggacttctatgtgtgcaagaacttacaaaagaaagaccaactatctccactgtggttttgatgctcataagtgagattacacatcttcctcctccaaggcaagttgcatttgttcagaaacaaaattgtcaaagttcagagtcttctcaaaaaagtcaatttaattcaaacaacaatgtaactataagtgaaattcaaggtagataa

SEQ ID NO: 38187 - DNA, 1503 bp, Glycine max
  Peptide Sequence Number=SeqID_154965
atgggtgtaatctctgtgaatgataccatcacatcaaccagattcatcagggaccctgagactataatctcaagcaacggtgacttcaagctaggattcttcagccctgaaaaatccacacatcgctatgtagctatctggtatctcgctgaaacctacatcatatggatagccaatagagaccaaccacttagtgatttatctgggcctggggtgttcaaaattcacaaggatgggaatctttgtttcacacaccctgctgatgctgcagtgccatcgatgaagattgctgccaacaggctcacaggtaagaaaatcgagtatgtgtcatggaaaagcagttcagatccttcttctgggtacttcacagggagccttgaacggttggatgctccagaagtctatttttggtacaacaaaacaaagccatattggagaactggtccatggaatggaagggtcttccttgggtcaccaaggatgtcaactgagtacctatatggctggcgttttgagcctaatgatagtggaacagcttatctaacctacaactttgaaaacccttctatgtttggagtcctgaccataagtccacatggaacacttaaattggtagagtttttgaacaaaaagatatttctggagcttgaggtggatcaaaataagtgtgacctttatgggacatgtgggccttttggaagctgtgataactcaacattaccaatttgcagctgttttgaggggtttgagcccagaaatccagaggaatggaacagggaaaattggactagtggatgtgtgaggaatgtgcaactgaattgtggcaagttgaataatacgagtgatgttcaacaagatcggtttcgggtgtaccaaaatatgaaagtgcctgactttgcaaagagattattaggtagtgaccaagacagatgcggaacaagttgcttaggaaattgctcttgcttggcatatgcatatgatccttacattggttgcatgtattggaatagtgacttgattgatttgcagaaatttccaaatggaggggttgatctcttcattcgtgtgccagcaaatcttctagttgcagcagcgggtggtaaaaagagaagagaaaacatgggattactcattggcattactggggcaattggagcattaatcatagctgtcggtgcttatcttttgtggcggaagtttactcctaagcatacagtaaaagttgcaacacatgcgagggtcctaacacggggaacttctagcacgtgtgaggggttctgggcatcgcgagggagagcaacaaggtggggtttcaaagaatcgttgcggtggagaagggaagggctggatggcaacacagccaaacacacgaaaagtgagaaggtagccaattatgaccataagatcgctcaggtagttttgggttttgcccatgaagccgagtctgttgatagggtcattgatgctagagagatcgtcggaagggaatggaagagagagtaa

SEQ ID NO: 38188 - DNA, 372 bp, Glycine max
  Peptide Sequence Number=SeqID_154966
atgttggggcacggatatgagcctagaatgggtttgggccgaaacgggaatggcatagcaagtctggtggaattcatggagaattacggaagatccaacaatgagtcctatgaaagtagtgataccgaggacccgaatgttgatattgagaaactaataaatcaagccgagaatagggaagatgaggattgggggcttcctccagagttgaaaagaatggtcgagcaagaagaaagggaagtgaagccacaccaagaggaaacaaaagttgtaaacttaggtgttggtgaagaaagaaaggaagtcaaggttggcattggtatgtctgcaaatatccgagatgaagtggtagctctgttgcgagactactaa

SEQ ID NO: 38189 - DNA, 709 bp, Glycine max
  Peptide Sequence Number=SeqID_154967
atgccaccgaggaagctctccgcaaagagatctaggagggatgctgcggccgaaggaaccagcgccgctcctgagtttgacagccatcgtttcaggagcacagagcaccagcagcgtttcgaggccatcaaaggatggtcgtttcaccgagagagacgcatccagctcagggacgatgagtacacagattttcaggaagagatagctcgccggtgttggacgtcgctggtcactcccatggctaagtttgacccagatatagtcctagagttttacactaatgcttggcccacggaggagggcgtgtgggacatgcgatcatgggtaaggggccagtggattccttttgatgcagacgccctcagccagttcttgggtgacccgctagtgttagaggagggccaggagtgcgagtttagtcagagaaggaaccgagccgatggatttgacgaggaggccattacccaactgttattcataccgggtcaggattttgcccggaccgttgccgtgaggcgggtgcggatcatgctcaccagcatgactaccttgacccagatgtggatgacgttgctgctcagcaacgtcctgcccagcgatcataactccgacctccctctgctgaagtgtcagctggtgtatgccatcctgacacggatgagcgtccatgtggctcagttgatcgctgacgccatttatttatttgcag

SEQ ID NO: 38190 - DNA, 520 bp, Glycine max
  Peptide Sequence Number=SeqID_154968
atggctagtagttgtttctccatgacaacaccaatcttcaaaattcgcttcttcttattcttatgctttattgggataagttcatctcaattgtcctctgacttttactccacaacttgtcctaatgcgctttcaaccattaagagtgcagtggattctgctggatgtgatgcatcagtgctattgaatgatacatcaagtttcacaggtgaacagacggcagctggcaacgttaattccataaggggttttggtgtaatagacaacatcaagtctcaagttgagagcttatgtcctggtgttgtttcttgtgctgatattctcactgtagctgcaagggactctgttgttgctcttggtggacctagttggacagtgcaattgggcagaagagactcaaccactgcaagtttaagttctgcaaactcagacttgccccgttttgatttaagtctgcaacaactcagcgataatttccaaaacaaaggtctcaccaccgcagaaatggttgctctctcag

SEQ ID NO: 38191 - DNA, 168 bp, Glycine max
  Peptide Sequence Number=SeqID_154969
cttttctttcagtatgctgtaagagataaaatcatccatcctgtcaaagccgagatttttgacccgtcgttgaacggttttattttctacgacgttggatataacgacggtcgtccaccgtcgttgtatcctgctttccaccgtcttagaatcgcgtttttgcagtag

SEQ ID NO: 38192 - DNA, 780 bp, Glycine max
  Peptide Sequence Number=SeqID_154970
atggtcattgaccaatccctattctatgatttaacccaattatccagtgaaggtgtaccatttgaaggtacactgattgatgattggaaatatgaattctctgtgcatgatgcccgtcggttggtttgcaccaaccaagcggatatgaccggaaggcttcttgccagttcattggcttttgaaatgaggggtagtaggttcaggcataaagttagaaagaaatttgttgtttcagaagcggctgacctgtctttcttgtgtttggtttcccactcctctaatcccactcaaactacttattcaccatatttgtctgatgttccttctcctgattggatgctaataaacggaaaaggaccatatatgaacaatctttgtcaatcatatgagaccttcaatgttacacaaggcaagacatatttgcttaggatatcaaacgtagggacagcctggagcttcaatttcaggattcaaaatcatcaactggttttggttgaaactgaaggccaatcctacttagttcttgtcacaacaaaccaaaatgctgctgattactacatagtagcctctcctaaactgagtaatgccacaaataataacactcttgttggtgttgttgtgcttcattatgacaactctaccacaccggctaatgggtctcttccaagtggtccagatccatttgatctgcaattctccatcaaccaagcaaaatccattaggtctttgattgctatgatcatcactgctatatgtttgttctatattgatctccattaa

SEQ ID NO: 38193 - DNA, 561 bp, Glycine max
  Peptide Sequence Number=SeqID_154971
atgtgggttttcttaaccagtcgtcaaatcgactgggcccatcttgtgagatatcgcatgcataaggcattgcgatcaaatgctccactcccatatccccatctgatcaccttgtttctacaacattttaaagtccctcttgactctgagccctttgtcaaagtcaagagatccttctctatcggtgcgaatgtagtctcctcttttggataccgcaaagagagggatggctcttgggtgaagaaggatgctccaagagatgactcttcatctcttatgcacaacattcttgacaggttggatggactccacaccttcgtcggtgaacgctttgactcgttggatagccgtattgatgccatggatgtacgatttgcagggatggacacacattgtcatcatcaaaaagggggagattgtggaagcaatgtcttccaagattattttgatgatgccaaagaatcaagagtcaaacaagtttcaagaataatcaagatcaagattcaagattcaagtaaagaatcaagactcaagaatcaagagaagattcaatcaagataa

SEQ ID NO: 38194 - DNA, 312 bp, Glycine max
  Peptide Sequence Number=SeqID_154972
atgtctaccagtttgtgctggggacatcacaaattcgtctgcagaatccttggaagcagcatctttgtacgagcaggcaacaattatttccttgtttattgtgccatgcacaatgtcaacaactttaacataaaagagatgaagaggcttacaggcataagtgtccctcacctgagaagtgcttcacaggcaaatgctcttccagtcattggagtcaatcttgtagaaagcataatactcctcctttgtgatctcctaaggctctgtcatccaaatggccttatgcttgttcaccaacgagcattcatgtga

SEQ ID NO: 38195 - DNA, 110 bp, Glycine max
  Peptide Sequence Number=SeqID_154973
tgggtacaaggtgaatggagttggaagttactttggaggagagagtgatttgtatgggaaatggagagccttactagagatcacggatggattcagaaacataaagaagg

SEQ ID NO: 38196 - DNA, 333 bp, Glycine max
  Peptide Sequence Number=SeqID_154974
atggttaaggaggagcgtaaggaggtaagtgtctcctccaagatgttagctaagaaggaaagtcattttgcaataaagacaaatattaaagaaacttcccctcttagacaacctccacatcttctactttgtaaaaagaaacttgttagcactgccagacctcttgggtttgatattattcctcaagtaaaggagttgttggatgagggtttggttcataagagcttaaatccttgtgctttgttggtgcccaaaaaaggaataatcatcatgaaaataaagaaaaaggtgttgaggaaagaatcccggagtttcaagaacctttatatttga

SEQ ID NO: 38197 - DNA, 465 bp, Glycine max
  Peptide Sequence Number=SeqID_154975
atgccaaacatccttcaacacctaaccacaaggcgggctcttcccatgactagtagcaaggtcatccaatcatatggtgtcacgtggcggatgaatattcgtagtaccagccagtcaacgccttcccgtgttgtgctctatatacagatgatagctgcacgaatgataagatacatgtcagttactgattcatggtcgtaccttacatgtcgatcggacgggaaccgctgttccagattcagaatcaggattcacacggtcaggtcggactggtccaaccgggatctggtggctaattgtcctagtttggctgggtcctccagtgtcaattgtatgatcgatccaatagtggaactggttcggctagaccaccgggtctcagttggattggtccgaatagctgagccaaactggatttcacaactgtgcttgcaacgattgaaaaatgagaaagatgaagattaa

SEQ ID NO: 38198 - DNA, 582 bp, Glycine max
  Peptide Sequence Number=SeqID_154976
atgacgcctgacggtcggagcctatggcggggcaggcaacaaagggggcaaaggcgtcatacgagggggaaccaaaggggctggcggtggagctaccaacggtggggtcgcggccgcggtggaggcagacgaaggtctgatagcttctgctcctggatcttcgcaaggccggcggcctggtccacagtcataggctggtggacttggactgtgcggcagatcttcaatgtcaaactcgagatgaagcaaggcaacaggaagggggccgacaagccgataattctattagtcaagtcttcgaactccttcaggaacagaggtggagtggcgagggactggtgtggggttgggcgtggtggaggaaggcacaagagcaaggtggttgagaagcttgtccatgttgagggtcatagagtgcatggtattgtcaagacgaacaagggcctcgtcgaggttgcaggaggccatgaggacaaacgagagcaccaattgttacgaactaaacataaatgcaggaaattaagagttggctttgaggcacctgaacctccagaggaagaagaagagcagagatgggagtaa

SEQ ID NO: 38199 - DNA, 897 bp, Glycine max
  Peptide Sequence Number=SeqID_154977
atgggcgggggcggaccaatttatttggtccgtgtaagaagcggggcgaactggcccgctccgcttccaatgcgggcgggccttacacggggtggggtggcccgcctacccacccctaccgcatacccattgggtcctaatatagagcaacctaacccgaagctagccacacccgtatccgaaggacctgacccaaaacccacacctgactcggacccaaaccccacacccgacccggaactggcccaaattagttcgaactccttatcgggtgatttagcaccgagaattttgcacctcgtcggccttctctccgacaatcgtgtggtcctccttgttgatgggggaagtaaccacaacttcctccagcctcaactagctatctctctgggcttaccttgccggaccgctccaacaccattacgcgtgatgttctttcatcacgggcgcttcgtggaatttctgggtgagaacgccaccactccgggtcttcttccccaacaccagttctgtcacctctgtcggcacaacgagggtgtttcgcacttccatattgctaggtttcctgaagctcctcctgactcactacccattgacacacctagtgcagttcgtcagaataaaccttgggatcccggtattgtttttggatgccatagtttgaaaaaccaacaccatgaggacatgtttttgatggggcagggagtgataaggaagcgtgataacatagcagacaaagggatgtattcaaaagaaatagatgcgaatcaagacatagcaactataggggtgtctacagcaaagaagggtgtaaatcaagcagaaaaggaggtgcaagcagcagtcaataccaaaagaaagatctcaaagcctgcttaccttaaggactacgtgtga

SEQ ID NO: 38200 - DNA, 273 bp, Glycine max
  Peptide Sequence Number=SeqID_154978
atggtgtttaatcttcttattcagaccaaatggaagcgtgtggcagtcaagtattactcagatgactggccaacaaacaatgcaaagttagcttttgagaagtttgtatttaccaagactgttaagacaaatgctcgtagaagagacaaagaagctccaaaattaactgaaagtggtttccagtttttgtgctcttcatcatccaatttgatgcaggatagaggtgttgatgcagctgacttatctcattcatgctggaatcagttttcatga

SEQ ID NO: 38201 - DNA, 1312 bp, Glycine max
  Peptide Sequence Number=SeqID_154979
atggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggcttctgctggtactaccacagacaatagctgtgagtctgtggtaatgagtggtcaaaaccaacagcaaaacccaacacctcagcatcccaaccgggatgctaacaacccagctggtcttctcgccatagctgaggagaccctggcagagttcctttccaaggctactggaactgctgtcgactgggtccagatgattgggatgaagcctggtccggattccattggaatcgtagctgtttcccgcaactgtagtggcgtggcagcacgagcctgcggccttgtgagcctggagcccactaaggttgctgaaattctcaaagatcgacagtcgtggtatcgtgactgtcgatgcgtggatgtgttgagtatagtccccactggaaatgggggcaccatagagctcatgtacatgcagacatatgcgcccacaactttggcagcagcacgggacttttggacactgagatacacgacaagtttggaagatggaagtcttgtgatatgtgagagatccttgacatcctcaactggtggcccagcagggcctccttctactacttttgtaagagctgaaatgcttcccagtggttttctaattagaccatgtgagggtggtggatccattattcatattgttgatcatattgatttagatgtctggagtgtacctgaagtactgaggccgctgtatgaatcatcaaaaatcttggctcagaagttgacaattgctgccttgcaacatataagacagatagcactagaatcaagtggagaaattcagtatggtggtggacgccagcctgctgttttaagaacatttagccagagactttgcaggggctttaatgatgctgtgaatgggtttgttgatgatggctggtcactgatgggtactgatggagtggaagatgtgactatagccataaactcatctccaaacaaatttttgggctccaattacaacgcatcaatgtttccagcatttggag

SEQ ID NO: 38202 - DNA, 777 bp, Glycine max
  Peptide Sequence Number=SeqID_154980
atgggtctccacgcccgccgccgcgactcctctcccggcaccgtccctccgctctccccaaccatctccatcccccctccccagctcctccaccaccaccatgttccctcctctaacaacatcttcaagtcccaccatgaccgcagccacaaccgccgcgaatctctccccggtccctccttccttcccctctcgccgcctccagccaccattcattcccgccgcgactcctaccccggccccttcccttcccccacattcgctgaatctgattcaggcctccttccttcaacctcatcacactattatcatcctgagctttatcatcataccagcaaacgcaggttgtgtctctacgacaaggacagcgacctcgcctggccgtttcgcgaccttgaaggtctcgaccatgatgacataagggaaactgcctatgaaatcttcttcaccgcgtgccggtcctcgccggggttcggtggccgaagcccgatcacattttattctaagcatgatgggagtggtgaggggaggagtacgccggtgtcccagacaagtagggtgaagcaagcgcttgggctgaggatgctgagaagctccttgtctcagaggataatggtgtcggcaccggcgtcgccggtgactgagcggagtcctcggtctcgggctgtgccacggaggacggtgacgatggcagaagtcatgaggctgcagatgggggtgtcggagcagagtgatagccggctgaggaaaacacttgtgaggacacttgttggccaa

SEQ ID NO: 38203 - DNA, 1536 bp, Glycine max
  Peptide Sequence Number=SeqID_154981
atgtcttctctaagacccaccatgtcaaatgctcattctaaattaacctttgatgagctccaatgggtgattaacatccgaaaaacccttgaagaagagcttgaggaagatggtgatcaatttgctgtgtccatcttcagcgtgccaaagctccttatggctagtgatccagactcttatgtccctcaacaggttgcacttggcccttaccattattggcgtccagagctatatgagatgcaaaggtacaagattgcagcagcaaaaagattccagaaacaccatcaaagctgcaagttagagaatctcgttgatcaattgaccaagttggagcaaagggttcgagcatgctaccacaagttcttggatttcaacggggaaacgttggtgtggatgatgacggttgatgcctcattcttgcttgagtttcttcaagttttttccatgcaagaaggggccaaggtacaaagggtttcttctagcatgtctcatttggtggattatgctgggaagaaatcagctcataatgcaattttgagggacatagtaatgcttgagaatcaaatcccattgtttgtgttgagaaagatgcttgacctcaaattctcatcacttgaagctgcagatgacatgctgagcttgatgttcatagggcttttcaaagagatttctcctttcaagatgatggaggagtatccaaacattcaagtctcggaaaatgtgcatttgctagatttcttgtataatgtgatagtgcccaaattagaacaacagtcagacacaattgaagttgagtttcaacaagaacaaaaggaaggaaatgatgaagaagcaacctcagactccagtcatgttaagcaattcttcagcgaagtatggaagctgctttcaaaactaaacaaagggccaatgaagatggtcaaaaaggtaattgtatctaaacctctcaaagtctttgttcagttgccttggaaaatcgtgtccaaccttccaggacttaaggttatgaagcaacctcttgaacatttcttattctctcaagaaaaaggagatgaaaataagggagaaagtgcgagttcaagatccaatagtctcatgaacaagccaccctcagtggaggaaatcactattccttccgttacagaactcttgaattgtggcattcgtttcgtacctaccaagggaagcatatcaagcatcagttttgatgtgaaaacatgcacgttttaccttcccacaataggtttggacgttaacactgaagttttcctgagaaatttggttgcatatgaagcatcagttgcattggggccattggttataacccgttacactgagttgatgaacgggattatagactcggaggaagatgcaaaggttctcagagaaaaagggatcattctgaaccacttgaagagtgataaagaagtggctaacttgtggaatgggatgagcaagtccttgagattatcaagggtgtcattattggataaggtcattgaagatgttaacaagtattacaatggtagaatgaag

SEQ ID NO: 38204 - DNA, 2553 bp, Glycine max
  Peptide Sequence Number=SeqID_154982
atgcctggtgtgatgacaaatacttggggagagacggcaatggagtccctattttcacttggccggcaagcagaaactatcattctccctttggaactccttcgccacctaaagccttcggagttcaatgattcccatgagtaccatttgtggcaaaagaggcagctcaagttccttgaagtaggtctcctctttcacccttcaattcccatagaaaagaccaacacctttgccatgaaccttaaggaaattatacgtagcgccgaattcaaacctttagacactggcaaaaactcagacaccatgagaagcttcagcaactctgtgatttccttatcgatgagaagccctgatgacactcccaccaatgtttgccactgggctaatggctaccctgtgaacattcatctctacatttccctccttcagtccatttttgatctaagggatgagacatcagtgcttgatgaggtggatgagcaacttgatctgataaagaaaacatggtcaacactggggatcaataggccaatccacaatgtgtgtttcacatgggtgatgtttcaacaatatgtagaaaccgggcagatagaacctgaccttctttgtgcctcatataccatattgaatgaggtggcaaatgatgctaagaaagaaagggattccttgtatgttgagatattgaaatcggtcctcggttcactgcaggagtgggcagataagaggtttcttaactaccatgtgtattttcagggaggagatattggacaaattgaaaaccttcttcctgtggtgttgttagcatccaggattttgggagatgttacaaattctgaagaagggcaagaaaaaggagataaaactagagtgagttcttctgagggccgggttgattactatatctgttcttccgtgaaaaatgcttttgaaaagatgatggaagcagcaaatgccaaatctgccgagtctgaaacagagaaaaaaatcggtgaagttatacttcaattagctcaggagactgaatatttggcattgaaggagagacaaaattatagtccaatattgaagaaatggaacacaatagctgcagcagtagcagcattgacactgaacaattgctatggacatgtgctaaagcagtatttaagtgaaatgaccacatcaataacagttgaggtagttttagtactgcagagggcaaaaattctagaagatgttttggttcaaatggtagttgaagactctgctgattgtgaggatggtggcaaaacagtagtgagagagatggttccttttgaagttgagtcaaccataatgatccgtattagaaaatggatagatgaatcactgcacaaaggaaaagagtgtttggagagagcaaaagaatctgaagcatggaatccaaagtctaaatcggagccgtatgcaaaatcggtggtagagctgatgaacttggccaagaagattgtgcaagaattctttcaaattccaatatcaataactgaagttttagttcaagaacttgctgatggattacaaaaaatcttccgggagtacacaatgtttattgctgcatgcggattgaaagagaactacattccctctcttcccccactgaccaggtgcaacaggaattcaaagttccacaagttgtggaagatagctagcccctgcagtgttagttgtgaagatccacacatatatggaatatttgaagctaatcatcctcactcatgcactagccgtggaacacagcgtctctacattcgtctcaacaccttatcctacctactttctcatatcccctctcttgacaaatcactcgccctgacaccaggagttgttccttcaaatcgccacagtttcacaaacagccacaagactcaaagtaacagaacttcatacttcgaaacaaccaacacctccatcctagcagcctgccagcatgtctcagaagttgcttcctaccgtctcacgttctttgacacaaaccctttcttctatgacagcctctatgttggcgatgtagccaacgctaggattagcaatttattgacaattctcaagcataacgtaaaactaatgacagcaattctgacagaaagagctcaagcgctggctgtgaaggaagttatgaaggcctccttcgatgcattcctcacggttttgcttgctggtggaaccaccagggtgttcaatgaatctgatcaccaaagtatacaagaggattttgacagtttgaagcagctattctgcagttttgaagaattgatagcagaaaatgtggtggagaaagaggctgaggtagtggagggagtgatagcactaatgggcatgagtactgaacaattgatggaaaacttaagtaccttatcaaatgagacaagtggaataggagtcattggtaatggtcagaagttgccaatgccaccaactacaggaaagtggaatagatctgaccccaacacaatattgagggtattgtgctatagaaacgatcgaactgcaagtaatttcttaaaaaggacattccaaatagcaaagaggagataa

SEQ ID NO: 38205 - DNA, 432 bp, Glycine max
  Peptide Sequence Number=SeqID_154983
atgaaatttgtggcgagtgtttacctcacactgtgcctagcctcttcttttatcatgatgatggccacagtacaaagggcaaggttgttgtttgcgacaaatgaatactatgttcgagtgatcaatggtttcagtgacaattcctctgtgcctttggtgatttggtgtgcttcggaggagatggatcttggagggcgtgctctgcaggagcacgatgatttcagctgggtgatgaggccgaatttctggagcagcaaccgcatgaagtgcacgatgaaatgggacaacacgaggaagagcttcgaggcgtttaaggcttccagggacactgatcgctgtgggattcataggatgtgttcttggatggtgactcaagatgggttctatttcagcaatgatgaggttaattggaggaaggatttcttgtggtga

SEQ ID NO: 38206 - DNA, 810 bp, Glycine max
  Peptide Sequence Number=SeqID_154984
atgaaggagaatttcaaagaattagatgttgtggtgactgagtggttggaagagcacaagaggaaaaaggatttgaacggtgggaatagtggtgacttaattgatgtgatgttgtcgatgatcggtggaaccaccattcatggctttgatgctgataccgtcatcaaagcaacggcaatggcaatgattttgggaggaacagacactagctctgctaccaatatttggacactgtgtttgctattgaacaatcctcatacattggaaaaagtgaaggaagaaattgacacacacattgggaaagagagaattgtaaccgaggaagatataagcaagttggtgtacctacaagctgttcttaaggagtcgctgaggctatatccagctactcctctttcaggacctcgtgaattcagagaagattgcaaggttggagagtaccatgtgaagaaaggaactagactaatcacaaacttgtggaagatccaaacagaccctagcatttggccagagcccttggagttcaagccagaaaggtttctcactacccacaaagacattgatgttaagggaaggcattttgagctcataccttttggaagtggtaggaggatatgtcctggaatatcatttggccttagaacatctcttttgactttggcaaactttcttcactgctttgaagtctcaaagacatcaagtgaacctatagatatgactgctgcggtagaaattaccaatgtcaaggttactccacttgaagttctcatcaaacctcgtttgtctcctagtctttatgaaagcatgtga

SEQ ID NO: 38207 - DNA, 1257 bp, Glycine max
  Peptide Sequence Number=SeqID_154985
atgaagcatcatcataggtcaccacaccaccaacagctcttctgggcaagggtggtcatgcgcaagtggcttaacatggggagctatgagtctgattacagtgctgaccctgttgatgatgatgatgattctgaaagtggttcagacaatgaagagtggggaagacggtcgcggtttgcaaatgaagatgaagcttcatctgaatcaacagaatttcttccaaagttaaggaggcagaagtcatcaacttatagatctcagtatataaacaaaaaggagctgagggtatgtgttgggacgtggaatgttggaggaaagcttccacctgacgatcttgatattgatgattggctcggtgtcaatgaaccagctgacatctatgtcctcggtcttcaagagattgtacccttaaaccctggtaacatatttggtgctgaagatacccgtcctgttccaaaatgggagaatattattcgagaaacactgaatagagtccgacctgaaatgccaaagataaaatcctttagtgaccctccatctccatcaaaatttaagccatcagatgacatccctgatatagaagaagaaatattacttgaaagtgatagtgacattggtgaggaagtccatcctttggatgaagaaaacaatatttgtgatggaacattcatgggtgaaactgtgaatacaaatttattagcttctgatgctgctgatattgcaaactccggcttgccagttaaaactgatttacagaggcagttttcttttccaaagatgtttgataagcaacacagtttttcagaaaacatggtcacgccatttgcccaccaggccactaaactaactcgaatgcttagtgggtctgaaaggatgggtttgagctggccagagcctccactgcatctgctatctcagcgagttttggacagaccaacttcttttaaatcactcaaatcctttaaatcatctaagtcgttcaaaacattcaactctttcaagtcaattatggatgaaatgccggggattgtaggtcttcctgaaattgaccttgaagctttgataaagagaaaaagaagatcaccatatgtaaggattgtgagcaagcaaatggttgggattttcatcaccgtttgggttcgtcggagcttgcgtaaacaaattcagaatttaaaggtttcaactgttggagttggtgttatgggctatattggtaacaagagtgaccatctgaccgatattgcattggattattaa

SEQ ID NO: 38208 - DNA, 300 bp, Glycine max
  Peptide Sequence Number=SeqID_154986
atgatgacggccaacattgctcatcatcatatcactgttatcgcccccaccatccacagctatgttggtgacgatcataccaaagtgattcataggttcaaatgcacaagcaagacagcggccaagattcttgaagagacctgttttgcatggaagcaaactcagaactcgttgaagaaggataatacatgtttcttccttcaacacggagacatctcatttcaacaaaaaaagttgaagttgagttgtattcattgctcggagagcaatcgtcttccggtgtgtccaaggatgttctga

SEQ ID NO: 38209 - DNA, 180 bp, Glycine max
  Peptide Sequence Number=SeqID_154987
atgagattattgagttacaaaagggcagagctcaaactctccgatcacagacctgtgaccgccacatatatggttgaagttgagatattctctcctaggaagctacagagagccctaactttcactgatgcagagattgaaaatgaacaaggatacatcatgagttgtaaaggagattaa

SEQ ID NO: 38210 - DNA, 318 bp, Glycine max
  Peptide Sequence Number=SeqID_154988
atggtacaattgttgatcaagaaaaaggacatcaatcttgagtatgaaaaagaggagaaacaacccatgcaagcagtatcgactttgcagttgggtgtgttggtaacaaagtcacaacaagacaatgatttaggaaaagctcttgaagtttctgccaatgggagaattgaacccaccaagggggaagagcttggtattgaagacaaagactcaaaaatcattgaggctaagggggttgaggaaatcatggtggaagaagctaagaatctgcagcagaaaatgcaggaacaaaaagccatggaaattggaattatatag

SEQ ID NO: 38211 - DNA, 1740 bp, Glycine max
  Peptide Sequence Number=SeqID_154989
gccttgaggccaggcatgcaggtccatgccacgttactcattagcggaacaaacatgaacatcttgtctcttcattcaaagcttgttggaatgtatgcaagttgtgctgacctgaaatcagcaaaactcttgtttaaaaaaattgaacacccaaatgtttttgcattcaactggatggttttggggttggcttacaatggccactttgatgatgcattgttgtactttcgttggatgcgcgaggttggccacactggcaacaatttcaccttttccattgttcttaaagcatgtgttggcttgatggatgtgaacatggggagacaggttcatgccatggtttgtgagatgggttttcaaaatgatgtgtccgttgccaatgctctcatagatatgtatggcaaatgcgggagcatttcttatgctcgtcgtttgtttgatggaatgcgtgagagagatgttgcctcgtggacatcaatgatttgtgggttttgtaatgtgggggaaattgagcaagcgctgatgttgtttgagaggatgaggctggaaggactggagccaaatgatttcacatggaatgcgattattgcagcatatgctcggtcgagtgatagcaggaaagcctttggtttctttgagaggatgaaaagggaaggtgttgttcctgatgtggttgcatggaatgcattgatttctgggtttgtacagaatcatcaagtaagggaagcgtttaaaatgttctgggagatgatactttcaaggattcagccaaatcaagtgactgttgttgcactgcttcctgcatgtggatcagcaggttttgttaaatggggaagagagattcatggatttatatgccggaaggggtttgatgggaatgttttcattgctagtgcccttattgacatgtattcaaagtgtgggagtgtgaaagatgctcgaaatgtatttgacaagattccatgtaagaatgttgcatcatggaatgcaatgattgattgctatgggaagtgtggcatggttgattccgccttggcactgttcaataaaatgcaggaagaaggactgaggccgaatgaagttacttttacatgtgttctttcagcttgcagccatagtggttcagtgcatagaggtttagagatcttctcatcaatgaaacaatgttatgggatcgaggcaagcatgcagcattatgcttgtgttgttgatatcttgtgccgttcaggaaggacggaagaagcatatgaatttttcaaaggcttgccaatacaagtcacagagtcaatggctggggcttttctacatgggtgcaaagtccatggaagaagagatctggctaaaatgatggcagatgaaataatgagaatgaagttaaaaggacctggtagctttgttacactgtcaaatatctatgctgctgatggtgactgggaagaggttgggaatgtaaggaatgtgatgaaagaaagaaatgtccataagcagtctggttttagttggattgaaaagccaggtgggattcttgaaggggagaaagagaaagaagggaacaatatggccagtgaattggatattgtttcagtaattgttggcacaggggagggacactccagattgagcacagcacaaacaattgcaatcaatatagcagcctgcaatactgcagctgcagggaccaaaagcttaccatcaccaccccctccagaagttgatctttgggacagtgatgctacttga

SEQ ID NO: 38212 - DNA, 1128 bp, Glycine max
  Peptide Sequence Number=SeqID_154990
atggcgggagcaacaggcagaaccctcttcaccctctccctctcttcctcctcttccctcacgcgcctctctctcatccccaagcgcgtcccactccccaaacccctccccctcttccgccgcttccgccctctctgctccgtctccgccgccgcgccggaagctgccgacgcgaagcactcaatactcctcgagaggctccggtcccgacacctccgtgacgccgcgaaggccgcccccgaaccgaggaagaaggagaaggtcgccgccgcagccgcagccgccgccgccgccgccgaagcgaaggagaagaagaaggcggttgcgagcttcgaggagctgggactgagtgaggaggtcatgggggctgttagggaaatgggaattgaagttcccactgagatacagagcattggcatccctgccgttttggaagagaagagcgtcgttttggggtcgcacactggctctggcaaaaccctcgcttacttgcttccccttgctcagttgttaagacgggacgaacaattgaatggaatactgttgaagcccaggcgtccacgagctgttgtgctgtgtcctacgagggagttatccgagcaggtttttcgagttgcaaaatcgataagccatcatgcacgattcaggtgtaccatggtaagtggtggtggccggcttaggcctcaggaggattcacttaataaccccattgatgtggtagttggtacccctggcagggttcttcaacatattgaggagggaaatatggtatatggtgacatcaaatacttggttttggatgaggcggacacaatgtttgatcggggctttggtcctgatatacgcaaatttataggcccattaaaaaatcgtgcttcaaaacctgatggcctaggttttcagactatcttggtaactgcaaccatgacaaaggctgtgcaaaatctgattgatgaggagtttctaggcattgttcatctgcgcacgtcaacattgcataaaaagatttcttctgctcgtcatgattttattaaacttgcaggttctgagaacaagcttgaagcattacttcaggttgtgttaagatgtgtagatctagtggcactaagtctctttggaattgtttga

SEQ ID NO: 38213 - DNA, 1076 bp, Glycine max
  Peptide Sequence Number=SeqID_154991
atggatgactttgagtggcatcctttagtgaaacaggttggactcgttgatactgacgtgttcccttcctcagtcaatttcaatgaaccctttagagggggggggggcatttttgatgctgtcgatgctacaccttgtgtgcctccttccatgactggcaagaggaaacgtagtgatgaggttggaggaaccgaaatacataagaagaagagggctcccttcagtcttcaagcccttaagactcccaacccacgaagtccaacttcgatccactcggccgctcagattgctactcctatgaccagcgtttatgatcctcttgctcctccaccttcatctgccttggtggtttttatatctccttcatctgcactggccactttcacttctggccatgccgcatttgctcccatttcttctattgcactgcatcttcttagtgcaaggctgacaatggcaggtgttgtaacaagcatgcctcctcctccttctgttgtgccacctttgactcccactatcccaaattctaggatgtctgcttcctcttctcgtccaagtgtttggagcttgcctattttggaagagagtgggagcaagcatggggaggctataaacaagattgattccttggaggaggttgccaagtggaaggccactgccaagacagtatggcaagtggactgccccatggtggcaaatgctatcatttcctttgttgaggctatgaagttgaatcaccaactgttgtccaaggtcgacaatgtttttgccaagttaatgagtacgagactagatgacgacgaaatatttgggttctataaatatgtattgaaagagaaggatgacttggcaagtaagaatatccgtgaaggacgacgagtcttaggtgtaaagaggctcaccaaggacagaccttggattttgccagcctttggagatttgattagggcagaccttgggtttgatgatcctttggagattcaaccaggagcaagggtggaccttgggtttggtgagactcaccaagggcagaccttggctcaatcatttgagtacaagttccctccttgcctcag

SEQ ID NO: 38214 - DNA, 519 bp, Glycine max
  Peptide Sequence Number=SeqID_154992
atgttcggttccgcacgaatcctctccgacgtcactctccgcctccgtcaaaacctttcggttcacggtgtgcgcgtgcagaacataaacatcggaggcggtgtgggaggcgagatcccggacaacaagcgtctggtgtacgctcttcagaacctccacggaataggccgttccaaggcgcaacacatcgtcgccgagctcggcgtcgagaacaaattcgtcaaggaccttagcaagagagaactctattccattcgtgaattgctctccaaaaaaagtgtgttgagagagatgtgggaaggttggtgggcattcagtgctaccgagggattagacatgttgatagcttgccatgccgcggacagaggactcatacaaatgcacgcaccaggaggagccggaaaactttctccggatccagatagatggtgcgattacaattgtggtcccaatgccagtcatggacatcccgaaaaccttaatgttagggctgcaattgcagttgcacactgtttataa

SEQ ID NO: 38215 - DNA, 1320 bp, Glycine max
  Peptide Sequence Number=SeqID_154993
atggagggacaacaaatttgttcacaaagtcaagcccagtacttggagacagagttgaccaagatgctgccaaatgtggttctacaaatgtctgaagtcaatgagcaatgcatttataaagtaccacagaaatttcgtgaaggtaatccaaaagcttatactcctcaagttgtttccattggtccgtttcacaaaccgcgtgactctaatggagagaacaacactttggtgcgaatggaagaactcaaactggaatatcttcggagatttctaaatcgaagcaagcagttaagtatgaagcatttatttcaaagacttattgagaaggaaaagcgaattcggagttgttatggggagcctattaattgcaacagcaatgatttcttaactatgattctagttgatgcttgttttattattgagcattttctaagattctatacaggcttggcttccattgatatagatcctttatcaaaatcatggttggtcaatgatgtttttcatgacttgacactacttgaaaaccaacttcctttctccgttcttgaagacatattcaactctgctaagccggacttcattggccctataagagatgtcgagtctctctcatttcttagcattacttttcactattttcgaaaatacaactatattggcataagagaaaacacaattgatagtccaaaacacttcactgatcttctgagaacttttatgcaaccatcaaaaattcatcatgaaagtctgaaagtaggttatatggttaatcatttaccaagtgcaagccaactatcagaggtgggtatggtattcaaggctagttcttgcaaatgtttgtttgaattgaaatatcatcatcgtaagggtgtaatggaaatgccatgcttaactattgaagataggacagagacactgttcaggaatatattggcattagagcaatgtcactacatactttcacccaatgttactcagttcttattcttactaaatttccttatcaacactgaaaaagatgtgaacatactagttgataagaaaattatagtcaattggatgggtgatgctaatgctgtagttaaaatgtttaacagtctttgctcaaatgttatagtgtcatacatgagtgaagagtattgtactctctaccatgatttgattaaattccatgaaaaccctcgcaacaagtacaaggctatcttttatcatgagtacttcaacactccatggaaaaaagcatctacaactgctgcagttctactacttttgtttactttaattcaagctatatgttcagtcatctcattgttttaa

SEQ ID NO: 38216 - DNA, 1094 bp, Glycine max
  Peptide Sequence Number=SeqID_154994
atggcagcggaatggagaaggaagaaagagagaagatgccacttcaaggagaagatgagtctagaaaaagctcaccaccataggaggtcatggataagagcttggaacaagaaggagatgaatgaagggaaaggaagagaagagcacgaaattttgtgctctaaaagagctctgaaatctaaagaccacttctttaaggccaaggcaacgaatatcagctctgacgggttgtcattgatgtatgaggagaatggggtggacaaggctatcttggaacaattgctagccttgcttgatgcactagccatcctatccttgccttcggcaagcaaccctcttcttatcttggatgggagttcgactgaagccagggtcgacctgccccatgcctcagacactatcgagactgatgttgaggctacacctgacatgcatcctcctccagctatgaagaggaagcacagtgaaaaggctggagggatcggacaacataagaaatcgagggcttcttttagtcttcgggctctaaagcaggcaatgggattggcatctggttcaagccgtccctcttcccttcttcctaggactaccaacccccaaggtcactcaggctgttgccgctataaccaacattttttatatccgactcctccatctccatctactcaagcgatctttgaaccttcttcctcaacatctgccacgtccattcctacctctgccgcacttgatcttgtttcttctattgcacctccactgcttagtgaaggggtgaaaacagcaagtgttttaacgaacatgccttctccttcctcggctttgccaccctcggctcccactgtcctgactcttattatgccttcatccttttcatgcccaagcgtttcattggaccaaaatttgactaacactttcaaagtcttcctccaaaatagcgtagctatcttagaagaaaatgggaataggcgtaaggaggctatgaacaagattgctttcttggggcggagtctgccaagtggagggccactgccaggaaaatatggcgagtggagtgtcctaaggtggcaaatgctattcttgcatttgctgaagcc

SEQ ID NO: 38217 - DNA, 973 bp, Glycine max
  Peptide Sequence Number=SeqID_154995
taggcgccaaggcggtggtgaaggactgaagggcgaaggagaagaaaagaaagttcaagaattcaggaaaggaaatccattcatctcagccgtttatttcggatgctttaaccatccaacggtgcacattccgaaaagcgaatttcgtagccgcgtcgaagacaaacgagtaacaaacaaacagcacaagcgtcacttttctgcgaaatcgccgatgctagaatcggagctccacgatttatccgacgacgccgattacgccgcgtctcaacaacaaggatctgctagcgtgatgctgcgtagtgacagtgccaaacagagctcccctcgggaaggtgctgaaattgtatttttgaaggacaatgtcgcaattcatccgactcagtttgcgtctgaaagaatcagtggaagactgaaattgattaagcaaagctcgtccttgtctatgacttggataccttacaaagtgcatagttcagaggccaggctgtctgataaagacagaaacctttatatcataagggcggtgcccttcacagacatcaggtccatccggaggcataatcctgcttttgggtggcaatatgtcattgttgttctatcatcagacccaggtgtgcagcgtcgtggcgttgcggcgagtttgtggttttgtgcggcgagttgcaaacccaagtggcaggtgcacggcgaccaacgagttgcagaccaggtgcggtggcgagctgcggcgacgagttcgagcgtgaagaatgaagatgaagagaaggggtctttggctgcagcggcgagatttttagggatagtgccaattgccaaacactcagtctcaaacgcactgaaagcccagtccgggtttgtaaaaccagccgggtcgccgggttccctcaaaaccggccaggtcatcctgggccacatgcatgaacggtccaatagcaaaatcggtttggttaggtcaccggattgctgttga

SEQ ID NO: 38218 - DNA, 522 bp, Glycine max
  Peptide Sequence Number=SeqID_154996
atgtattatgtgcaagacttgaccattcttagttttgagcaagttatcagatctgaagaagatgccaacgtattccttgtgaatgattttcagaatacactgcagaggactttgtcttccttggagatgcccagagctgttccccttacatgtggaccttcaaatacgtcagttgatgaatccattttgattgagaaccaagaaagggctgataatggtgccaatgatggaagatttagtgttaatcagttccacgggaagccaagacataaagtagatcctgctcgagacctctctattcaagttttagagaagttttctcttgtcacaagatttgcccgtgaaacaacttcacaactttttggagaaaaccagagtaatggatttagtcccattgacaggaggacccatatccagactaaccttgatcaccctaagaagtcttccaatgttgaggaaaatacctctgatgaaagtcctgttgccttggattctcaggaggcgcaaaattattttgattag

SEQ ID NO: 38219 - DNA, 183 bp, Glycine max
  Peptide Sequence Number=SeqID_154997
atgatggtggagctggaggaagaaggcagtgatataagagagaaagagaaggatagaagatatgaagtgaggatagaagtgatggagaagcagagaatgtatatactggtaggttttgcctcgggatgggaaggtgaagaaggtgagtggaatgatgtcaagggggagcaacacttactttag

SEQ ID NO: 38220 - DNA, 213 bp, Glycine max
  Peptide Sequence Number=SeqID_154998
atgttgaggagaattctgccgtcgctggcgaggactggctctgttggtgaagaaaacgacgttcgagaaggagaagacactgtcaaggttcgcctcagagatcaacaggtttacgccaccttcctccattatcatgccagacccttttctctcctctcctcttccaattccaaaccattttatgggtcgatccttgagtttgtagcaggttaa

SEQ ID NO: 38221 - DNA, 409 bp, Glycine max
  Peptide Sequence Number=SeqID_154999
aaccactcattgagttggtgagaaaccatgttccttcatgggaagatgcccaggaaatgggtgttgagggaaggagcccagagtatgaagaacctcgggatttgaggtcaaatcctttccaaggtggagggaatgatgtaatcctatcccgcaagggcattgagacaacattcacaagcatgagctccaccacagatgacacaccctgcaacctagcatcttgcaatgtgagttcaagcagacttttcttggtcggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgtgatctacgaactttttagtgaaag

SEQ ID NO: 38222 - DNA, 255 bp, Glycine max
  Peptide Sequence Number=SeqID_155000
atgatttacatctgtcgcaacctacccttcgacgggagggcgacgcgagactcacgtgtgcatctttcaaggaaggaaaacgcacggagtcgccaccaacgtttattcgaggaaaacgtcggaaaaaccgaaaaaaggcgtggtctacaaactttaagtgtgaaaggttcgagagttgtatttacgcacggagaagggtgtttcccttgctcctacgtattccccaattgtgataagaaaatcaaacctacgtag

SEQ ID NO: 38223 - DNA, 253 bp, Glycine max
  Peptide Sequence Number=SeqID_155001
gcagaggtatgttcatgatgccatcgacaaatgggtgcaagtgaatgacatcattgtggatattaaggaacctaggtctggagtggactggggtttcctactaattactgtagaaggagagttgagtataattttcctggtttctcgtttcggcatgggtgggtgctttaaaggatggagagtattgtgggggtggtggaggtggatgatggatggcaagccttgctctgaggttcacattctcctcctttaa

SEQ ID NO: 38224 - DNA, 1197 bp, Glycine max
  Peptide Sequence Number=SeqID_155002
atggccgataccttgttccaccagggccttacgaggcttcctaggctagttgggattctaccggaggcagcttttgacaaactcaaagaagctatctgccatgctccggttctcgggttgtcggatttttctctgcctttcgtcgtagagactgatgcctcagggctcgccgccataacttcgacagtaaagatgtggagccagtatttactgggacatcaattcacaatcctaacagatcataggagtttgaaggaattgatgtcacaagttgtgcagacccccgaacaacagctttacttggcaaggttgttgggctatgattatcgaattcaatatcgttccgggaaagccaatacagccgcagatgctctgtctcgacgaatctggcttccaaagcacttttgcttcatcaagattctcctcgaagaatttcactccactccagctggcggacatatgggtattaccaaaactctggctcgaatgagtgacaactttacttgctcgggaatcaagaacgatgtttgtaactttgtccttgcctgtgttgattgtcaacaaacaaagtataatcatcgcaaatcatctgggttattatgcccccttccggtaccagcgtggacatggaaggatttatctttagatttcattgggggattaccggcctttaggggtcatacgatggtgctagttgtggttgatcgtttttcaaagggaatacatctcgggtccttgccgcctcactatacggccatcaatgtcgttcatattttcatggaaatcgtgggcaagtttcatgggatgccccacaatctcgtatttgattgcgaccctttattcgtaagtcatttttggcaggaactgttcaagttgagtggcacgaaaattcgcatgagtttggcctatcacccacagttcgacgggcagactgaagtcctgaacaaaattgttgaacagtacttgatgtgggctgaatggtcctataatacattagtacattcaggaacccagatgactctatatgagattatgttcggaaaaatacctccgatcatccctcagtacatcgtaggaacatctagtgttaatgttgtggatgattttctgattaatcgagaggagttatttgctagcttacgcaagaagcttcttaaagcacaacaaacaatgaagcactttgcggataataaatga

SEQ ID NO: 38225 - DNA, 732 bp, Glycine max
  Peptide Sequence Number=SeqID_155003
atgagtgcggtaatagcagcttcaaattgtatgactttaccttcggtcaagcaacaacaacataaaaatgccataacttcctatgccagtgaaattgtagtacctacaacgaataagtataggtttgtgttgaattctccaaattctcttcagtcttcacctacacaggtggcagagcaagtaaaggagttgagtgcgccaaatctaactatccctgctataggattgactacagtggtggccaagccactggaagattcaccaatggaagggctattggtgatttcatatctgcaaaacttggaatcacatcaccaccagcttatctgtgagtgtctcagaatgttgataccttactcaaagattcagagattatcttttgacgatcacataaacaatttcaagaaaaccaaagaagtaatttcggcaaacataggagaggcagctgccaacaagcatttcaatgaagccacgtatttcattgggattgtactacggattaaaggaagagctagttcaaaccacaagttgaacattatgggaaacaaatttggttgttatctgctttcaatggtttgcaagatggagagtgattgtattgaggacatggacattgaagtcctctcttcaatgtggtctgaagatgttggcactgatgttggaaaacagttcaatatagaaaagcttggaatagaccagtacattttggaggaagtcaatatcatagagtag

SEQ ID NO: 38226 - DNA, 237 bp, Glycine max
  Peptide Sequence Number=SeqID_155004
atgcaattgtcttttgatgattctggcatgatgaagaagggtgaggaagaaagattagatgctttgaagtcaacgaaagataaatatgaattatcatcattggttaaatcaattaagatgaaatcaaagcaagttcagttaccctctgatgataagacaatgaaagatggaaaatctcacattaaagaaacccagcaggggaaaaaggatcttagcagaattatgaaagaagtgtag

SEQ ID NO: 38227 - DNA, 303 bp, Glycine max
  Peptide Sequence Number=SeqID_155005
atgtacaattcaaaagtcaaagcaaagcggcattcatctcaatcacctgattctaatatcccctttgattattgttatgacataagtataagccagacaattgaagttccctttttgaatctaacaatgaaaggtggagatgattattatgtcatggatcctataatacaagtttctagtgaggaggaaggagatcttctttgtttgggaatccagaaaagtgacagcgtgaatatcattggacgtcgacctagcagtggagagttagaacagcatgtacaaggtcataaatttaaaccttaa

SEQ ID NO: 38228 - DNA, 201 bp, Glycine max
  Peptide Sequence Number=SeqID_155006
atggctataagtggcaaaaggaccaccacaaatgtaaaggtaggtttgatcatgaatgatcgattaggtgggttaattgatggattcgatctagccacgggattcacagcaatagcaggagaaacagcaggagagtgcgatggtgtgttaattggggatgtatttgagagcacatcatcagaacctgacaggaccatatga

SEQ ID NO: 38229 - DNA, 986 bp, Glycine max
  Peptide Sequence Number=SeqID_155007
atgaccccagatgatatccgattggtagttaacgaaattcttcctcaataccaagcatcccaatggcagatctacctgatcgctttatgtattggggggctgattgcctctattgggatttactggggggctaatttaaaaaaacgcggtgagataaatgccagtgaggctctattcgataaaatcagtgagcagcttagacagaacactaaggatgttgaaacaataaagactgcgttgtctgggcagcactgggtaagccaacagacatgggttaacaaagaaaaatattatactggcttaatcacataccttcatgactttatccacgccatcgatggtcaattagactgtgttagaagttcaatttctgttcatgatgaagctattagcgatcctgagttttatgaagaaatgcaggatctaggcaccaaagcttccgaaggactgaatgacttaaggggaccctcattagtgttcctctccgaaaaaaccaatttggccctcgaccaaatgttggcagagctatggaacttgcgagaacactcgacagggcccagatcggaattcctaaagggggaggtggagtatgacaatgcaggagaaagcaaccttcgcggcctacctctcttcggggttcctggtgctggtcggcaaggtatcgccatcggtatcgcaaccttcgccgccaacatctactttcagaatcgccagacgcgcgccattgagcgggcctctcgcgccggcgccacgattatcaatccgggactaattattgggttagcccttagccaggcaaatgacttcacgtcggcaaacggaaatgctctacgtttttccaaagctgcgatggaagtgatggggaatgcggaaggctgccaccgcgaaccgtatctatgccccgccaaaatcatcacacaagggatcggccatacagggaaaggtgttgctgccgttagtcaggccagcgatcagcagatcgcgaa

SEQ ID NO: 38230 - DNA, 1824 bp, Glycine max
  Peptide Sequence Number=SeqID_155008
cataatgggatccaaaaatgcaaacgggaagaaccacaaggacaaaaggaagaagtttaaggataatttgaattcaaatcattcatccactggtgatgccaaggttatcattatcagtgatcctcgatattcaaaggctcacacggatcctcggtttcgtgaggctccaaagcgtgaaacgaaggtggccattgactctcgcttcaaccgcatgttcactcacaagagttttttgccctcttctgctcttattgacaagagaggcaagcccaagaacaacccaacctctcagcttggttctctgcgccattactacaaagttgatgaaaaggaagttgagcagagtagtgatgaggaagaagataatgaagaggaattggtgaaagccaatcgaatgaaaccggagagtgacaaaggaactgaattagaagagaccagtgaatctgagtcagaagaaaccagtgaatcagagtctgatgtggacacagatacagatgaaggtgcagatgaggaagtttacgaggaagaagcctctgatgtccatgaagacatagcaacgattgacaaagaaactcatagggttgcggttgttaacatggactggagatatgttaaggctgttgatttgtatgtattgttaagctcatttgtcccacctaatggactgatcaaatcggtaacggtctatccatctgagtttggtcttcaacgtatgaaagaggaggaagttcatggacctattggtctatttgatgatgaagatgaaaaaaatgatgaagatagcagcaatgatgacattgacaatgagaaactgcgtgcatatgagaagagcaggatgcggtactattttgctgtggtggaatgtgactcaagtgccacagcaaattacatttacaaagaatgtgatggtcttgagttaaaacagtcatcaaatgcacttgatttaaggtttattccagacaacatggaattcaaacacccgcctcgggatgttgctactgaggtacctgcaaattatgagtgtaaagatttctattctcgagcacttcagcacagtgaggttaatcttacttgggatgatgatgaacctcttcgtgcaaagacattgaaacagaaattcactgatgatcagctagctcagatggaagtgaaggaattcttaacatctgatgagagtgaaagtgatgatagcaaggataataatgagacagatgatcagcctgataaaagggcaaaaaaacgagctaagtaccgtgctttgctccaggccggtgatgattcagatggaggcaatgaacatgataatgtccagaatatggaggtcaccttcaatacaggtttggaagatttaagcaaacatattatggaaaagaaggataaaaaatcagaaacagtttgggatgcacatttgaggaaaaaatgtgagaaaaagaaaaccaggaaaaacaaaagaaagtattcatcagatgatgatgatagcgatgatactgatcaagaggcaactgaagaagcagatgacttcttcattgaggagcctgctgttaagaagaggaagaagcttgaaaataaagacgaagaacctaaagagatgaatgggctagacgaagcaagcaaagaggagcttgaactgctgcttgctgatgataaggggacagatactggtctcaagggatataatctaaaatttaaaaaaggcaagggcaaaaggacggagaatagtattgatgaggagaagataccaagtaatgcatacgatgatccacgtttttcagcgcttttctcacctgactatgcaattgaccctaccaatccacaatttaaaag

SEQ ID NO: 38231 - DNA, 282 bp, Glycine max
  Peptide Sequence Number=SeqID_155009
atgaatcagcccgcaaacgagaaaggcggccaaacggaagtgttgctggtgaacagtgcgctggtggactgcgtgggcgtcgccccgatgaagtgcatgcaggtgcgccgctccgcgcagcagccgtgggagttgttctataccggcatcgaaggtttcaccttcgaaccgggctatcagtatcggctgaaagtgcgcgttactccggtagagaacgtgccggccgatgcctcatcgctgcgttacacgctgattgagcagttggaaaagaacaaggcgtga

SEQ ID NO: 38232 - DNA, 585 bp, Glycine max
  Peptide Sequence Number=SeqID_155010
atgaatgagtttgtttataatacaagtaaccttaaatggttaaatttgagcgaatcaattaaattaaatcgtgaacgtaagttgaaaagtgaggaaggatggggcccagaggcagagtggcatgtgatggttgttactgaggagcaggctttggattacttgtccgagttgggtttaatcagaatttcaggcacccaaaaaagggggcattctgctccgaattgcagaatcgaattggaagggaatgtggataatgagatagcagaggacaggttgccacaaatggaatttcttttgcgatacaaacaaggccatgcaataccatcactctttgctggaattgacatgtgtcgccattcccaccagcgccttcccttttgtctacgaggcgttgaagacgccaacactaatggcaagttgctcatggagccagtcaaacgcaaggccctagggttgcagtgttgcagagtgcagcaggtcagggttgcagcgatgcaggggcagcaggtcaggggtgagggacgcgtcattgggtattgcgagtttcataaaggaggcgccattccctccagcaatttgctttaa

SEQ ID NO: 38233 - DNA, 216 bp, Glycine max
  Peptide Sequence Number=SeqID_155011
atgtggctaagggaaaaacacaagaaggctttgcttgaggctttggaaaaggtcaaagctgagttgatggttcttggtttcctttcactgcttctgacttttaggcagagttacattgttagaatacgcattcctgtcggtgtggcagacaaattttttccaatattgggaatttactatgcctgcaaatccttcaagattccggcttacacatga

SEQ ID NO: 38234 - DNA, 321 bp, Glycine max
  Peptide Sequence Number=SeqID_155012
atgaatgtggatgacaagagtagcaggacaacactatatcagagagtgtatatagattcaaatgctgttgaagattttctaggttatattggagttgaagttcagataacaacttcccatcagtattttttggggcacctttggaagattatcatagggaaacagcgtttcaaactagatagagaagtgaagtcagcaaaaagggccactttctggttcctaaagcattctgatgatggcaaagcttggttaattaacatcatatacaggaaccctacagtcaaggaaatttctgtagcacacatggcgtcctttgactag

SEQ ID NO: 38235 - DNA, 525 bp, Glycine max
  Peptide Sequence Number=SeqID_155013
atgagaactgttaggctgctaagacgggatggagggttgcttggttcgaattcaaagtatccacaagccatcgtgctttgtgctacagaggagaaaagtgagcagtgctttaatgctgcaaaatatatcatccataatgcagaattgaagtctgcaaaggatagtgcttcaccagataacgggcagtcaaaggcctcaattggcctcatgattgggactcctagtgagattcttgaatacattgaagaggggagtgttgttcctgctgaaataagatacttgaggctcttaggttaccagttcttgggagctcctagcattgatctcactagtctttctcatgtttcttgcgttttgggtgaacaatcctccgttgtaaagcatcttgagtgcgatcatgcaggaaatatttctgcaatgtctctagaaatggaacaaacagaagtatttcatttcacagagtctcttgacgctcttaggaaaaaagtggcagaggccatggattcccttttgaaacaacagtga

SEQ ID NO: 38236 - DNA, 336 bp, Glycine max
  Peptide Sequence Number=SeqID_155014
atggtactcaacgagatggaagccgtgaaccaggacgacgatcagggctattggttaccttttcaacttctaattaccttttcatccaaacatagccatagccatagagatgagatgagtataattagcaagatagtttggggaaaaaatgaaaaaggttgtgaaactagcagaaacctagaaaattgggtgacgatgaaggaagaggaagggaggttgtggaagaagatgccattgtcgtcgtcgaattcaccatgggcaatgtgcaagcttatgcagcaaaagtgcacacaggagtgtgtgtttgtgccatactttttatcagacaacccgtag

SEQ ID NO: 38237 - DNA, 582 bp, Glycine max
  Peptide Sequence Number=SeqID_155015
atggccaaaagaacaagtgcaatgaatttagcattcattttaatattattgtgtgccccaattagcatgtttatatgtatgggagaatgggagccaacttggagcacaagagctgcagaagaagctgaggctgtggcagccataccatgttcaggacatggaagagcctacttagatggtcttattcttaaagggcatgaacatgtacatgtttgtgagtgcaattcatgcaatggtggatctgattgcttcaagtttttatcagattgtattgccaacgcttcaagtggggacccatattttttggagccattttggatgcgacatgcagcaagtagcgcaattttagtatcagggtggcacagaatgagctattcttatagtgatggatcatacatttcagaagtattggttaagtacatccaaaaagttcatagcatcgttggaaatgcaatcactaaaggaaggtacttcatatttggaagtggctcaacgcaactattcaatgctgctgtttatgccttgtctctcaactcttcagtgtctccagcaaaagtggtagccacgaccccatattaccca

SEQ ID NO: 38238 - DNA, 1194 bp, Glycine max
  Peptide Sequence Number=SeqID_155016
gagacacgtccttgtggaaaaacaacacagatagcaactctagatttattgagtttgtgacttcaccgaacaatccagatggaaagttgactaagagagttcttgaaggtcctaatgtaaaaaccatttatgatcgagcctattattggccacatttcactgctattccttcaccagctgatgaagatcttatgctgtttacaatttccaagctcacaggccatgctgggagtagatttggatgggcaataataaaggacgaggcagtatatcaaaagatgttgatatatctgcaattgaacaccattggagtttcccgtgacgttcagctgagagcattaaaacttttggacgtgattgttgaaggagatggaaaagaaatattccaatttgcatattcaaccatgagagatcgttggataaggttgaaacaagtcatatctgaatcaaagcggttttctctacagaaactgtctccccaatactgtacctttttcaagagggtcagagatccttcaccagcttacgcttggttaaagtgtgagagacaagaagagagtaattgctatgaaatccttgaagctgctggcatcattggccgtgaaggaaacagcttcagcacacagcagagactcccttcgcatccaatgtctacgctcttcatcgccctccaatgctgccaatgctccaccatgcaggcactctctctctctctctctctctctctcatattctgtgtgcattctaatccaattgattgcaactatgttcaggtgaagcagaagaagaagagcagcaacaaatggaattgcgcggtctgcaaccagaagcaatcggtttgcagagtcttcgcccagggattcatggccaaggagcttcgcaagttcgtccaggacttcaacatgtcccgcaagtccttcgacgacggagaatatccccttgccggaaccctaaatccgccgcttcccgccacggaacacggagacgccgagctcaacctcaaaaagaagcggaacgattggtccgcgtacctccaccaggaacaacaaccagatcatgatgcagatgatgattttgagccactggttgtgactgagttgcaaaaaggtatgttcaagaaacgcagagtggtggaggattctactgcaggaagtgacaggcttttcaaaaagtcccttttccataactctcaag

SEQ ID NO: 38239 - DNA, 318 bp, Glycine max
  Peptide Sequence Number=SeqID_155017
atgtcatttatgtggattcacattgatgcagaggagctaaggatagatcaaccaagagttacatcattgactgaaagcaatccaaagagaaataattacgtaacaccaactaatcagaggactcaaaaatgcaaaccaactagcagcagggcagcctccaaatggaacaattacttaactgaggacaatgaaaatttagagcttggatggaagaaaagctttaactttgaggaccattcaggtccaaggaacaacaccgtcttagagaccatgactagtgaaatagtagaagatgatattcacccagattttatgtga

SEQ ID NO: 38240 - DNA, 237 bp, Glycine max
  Peptide Sequence Number=SeqID_155018
atgtgtttgaaaatttcagttattcatgaccataatcactttctagctaggtcacgcatcattgtgcaaattttgttcccttcatcaattcaacgaagagttagtattggcctcatccacattgaattcgtttatgttgaaagccaacgaggaggacgactatggatgctcttgctaattacagaaagaattttagtcttggagctatttggatatctggacttgcatcaccactag

SEQ ID NO: 38241 - DNA, 297 bp, Glycine max
  Peptide Sequence Number=SeqID_155019
atggatagatgttcatcaataccttcaccattggtactatgggtaatgagagaattaccacccaaagaagctgctagcatatccgaagaatcaagtacaatagcttttgttgttgatagttcaattgcaatccatcatcctcaacgctggactacagcaacaagcatccagatccctacagcaacaagtgtgagaaaagtgaggccaaaagttactatcgctaaatttcaattcaatccaaagacttgtcacatgggtttgcttatatggacaaagacttgtcacatagacatatga

SEQ ID NO: 38242 - DNA, 375 bp, Glycine max
  Peptide Sequence Number=SeqID_155020
atgggattggataacagtgggcttatgggacaaactggatactggaaaaacttcccatggaaacctgcagaatcttctcaatcaccctgtgatcctggggtcgtgaaaataaatgtcgatgcagcaatattcagtgatgctaacactcttgaagcagacatggtgttgcgggatcataatggaatgtttcttcaagcaaaaacagtcagaggcagaagtttgagctttgttgtaggccaaacactggagtattcagcagtggaggaggattgtaaagcttttgatggtttacagaccaatattataggagtttctgagttttataatctgcttgcaacatgtcaatctcttctcagttattatccaaactcaaat

SEQ ID NO: 38243 - DNA, 309 bp, Glycine max
  Peptide Sequence Number=SeqID_155021
atggccaaattcgagaaatacatggagatgctacaagggagaaagatgaaccacctattgaaaaactcacataggacgtactacatcaacaccatggaaagtggtaaacgtgacaataaagaggaggagcaacaagttcgaatcattctaggaagatccttcatgaggatcgctcatgtaaccatcaatgttcgtaaaggaacctacacacttagagaaggcaagaaacaaatgttctactacattcaacgcattgaagattttcccaatgaatcggctcaccaacaacaccatcatacaataccttga

SEQ ID NO: 38244 - DNA, 459 bp, Glycine max
  Peptide Sequence Number=SeqID_155022
atgttgcatcttaactccagccaagggtttggatacatgggaaatggtcaaaatggcatggatccgtcagtagttccccatggtatagtggctccaatgatgccattgccctttgatggttcaggaatttccgcagctcctacttataatcagcatcctggtggttcattgtccaacacatttgcctcagctctggcttctgctaccccagaaaatcagcacctgatgctagctgaacatctatatccacttgtggacgaaattactaaaaatcatcatcagactgaaaaggtgacaggaatgttgttggaaatggatcagtcggaggtcatccatctgactgagtctcccgaggacttgaaaataaaggtgtttgaggcaatgcaggcccttggtgaagccgcaccagattctgaagaagttggtgatcaacttggctcagtctcattgaaggaatga

SEQ ID NO: 38245 - DNA, 936 bp, Glycine max
  Peptide Sequence Number=SeqID_155023
atggagcatctgaatttcactcctctgaatggaaaatccattcgtgttatgttttctaaccgagatcctagcattcgaaaaagtggatatgcaaatgtgtttatcaagaaccttgacatatcaatagataacaagacattgcatgacacttttgctgcctttggatttgtactctctagtaaggtagccgttgatagcattggtcagtcgaaagggtatggatttgtgcaatttgacaatgaagagtctgcgcaaaatgctatcaaagagttgaatggcatgttgataaatgataaaaaagtctatgttggactctttgttaatcgccaggaaagggctcaggtagatggatcaccaaagttcaccaatgtgtatgtgaaaaacttttccgaaacatatactgatgaagatcttgagcagctctttagcacctatggtacaataactagtgctgtggtcatgaaagacacagatggaaaatctagatgttttggttttgtgaatttcgaaagtccagattcagcggttgctgcggttgaaaggttaaacggaaccacagtcaatgatgataaggttttatatgtagggagagctcaaagaaaagcagaaagagaggcggagttgaaagccagatttgagttggaaagaataaggaaatatgaaaaataccatggtactaatttgtacgtgaaaaaccttgactataatatcaatgatgacaaattgaaggagctgttttctgagtttggaacaataacatcttgcaaggtgatgcttgaaccgaatgggcgtagcaagggttatggttttgttgccttttctgctcctcggaatgcaaatagagccttgcatgaaatgaatggaaagatgattggacggaggcccctatatgtagctgtgggccaacgcaaagaagagaggaaggctcttttggag

SEQ ID NO: 38246 - DNA, 1623 bp, Glycine max
  Peptide Sequence Number=SeqID_155024
atggctgctattctgttatctgcactttatgccgacgtacttgatccttcacaagtttacaaaggcttcagcaaattagttgactcagcagatgacttgattgtagatataccagacacagttgaagttctagctcttttcatagctcgagctgtggttgatgacatacttcctcctgcatttttgaagaagcacatggcctacttacccaaagattcaaaaggggttgaggtcttgaaaaaaactgagaaaagctatctagctgcccctctgcatgcggaaatcatagagcgatgctggggtggaagtaagaataccacagttgatgatgttaaagccaagataaacaattttttgaaggagtatgttggaagtggtgacaagaaagaagccttcagatgcatcaaagatttgaaagttccttttttccatcacgaaatagtgaagcgggcacttataatggcaatggagagacgtcaagcagaatccccactgttagacctgttgagggcagcagctgaagaaggtttcattaactccagccaaatgtctaaaggtttcggtcggttgattgacactgttgacgacttatcacttgacataccagatgcacgtggaatactacagaaactgatgtctaaagcagcatctgagggttggttatgtgtgtcatctttgaaatcactttcagtggagcctgaaaagaacaccatagaagatagtgctgccaaaagtttcaaggtaaagactcagtctatcattcaagagtacttcttatcgggtgatatattggaggtaaatagctgtctagaacaagaaaacagcaagaactgtgctgcactcaatgcaatctttgttaaaaaactgataactctggcaatggataggaagaatagagagaaggaaatggcttctgtgttgctgtcgtctttgtgcttcccagccgatgatgtagtgagtggttttgtaatgttgatagagtcagcagatgatactgctctcgacaatcctgttgttgtcgaggatcttgctatgtttctagctagagcagtggtggatgaagtcctagccccacaacaccttgaagagattggagcacagagtttgggaccaggttcaattgggagcaaagtgcttcaaatgacaaagtcattgctaaaggcaagacttgccggggagcgaatcttaagatgttggggtggtggagggagtagcaggcctggatgggcatttgaggatgtcaaggacatgattgggaagctgttggaggagtatgagtctggaggcgagataagggaggcatgtcgctgcatgaaagagttaggaatgccatttttccatcatgaggttgttaagaaggctttggtgacaaccattgaaaagaagaatgagaggttgtggggtttactcaaggagtgctttgaatcaggactaataaccatgaatcaaatggtgaagggttttggaagggttgctgaatctcttgatgacttggccttggatgtccctgatgctaaaaatcagtttgcatgctattttgaaagagcaaaggccaatggatggttggacaattcattttgtttcagcaaacaggaacatgcaacagagaatggcactcactaa

SEQ ID NO: 38247 - DNA, 789 bp, Glycine max
  Peptide Sequence Number=SeqID_155025
ggagcgatcggagaggacgagggagagtgtggggacgacattggtggggagaatgaagggttcatgagaacgactatcatggttgcttctgcaactacaatgaaggggattctctacttggtgcaccaggctcctatcatgttcagtagcacgcaattcgggctatatccttcctccttcaactctctccccttaagttgcaaacagattgactctctcccgttcgtgctccactgctccgccgtcatttctgtcttcgtcaaaaaccagctccacgaagtgaatcttcgcttagagacgctggtcgaagagagggagtacgaggttgccgttctccaccgtgaggtcagcgaccctgccacgggtctggagaacaaagcgagtgctctcgccgaagagcagagaagttctcaagagtcgcttactgttattgtcattgaaacgttgatcaaggaggcgattgaagtggtgagcagtgagaagagtgagattcaaagccgaaaccgtgctctagagaagaaaatcggttctctggaaactgagttgaataacattggaggagtcatcaaaaattgtgtttggccagaacctgagagtcaaggttctaggttcacgggagagaattggaggaggaagaacacacactctgggatggatactccggactggttgaagaagttaaatttctctggtgtgaacttccctccatggatcttggcttgtgtggttattgtcttcacccgcacgaggaagagaactagagattttctgaagaagcgtggttggtga

SEQ ID NO: 38248 - DNA, 309 bp, Glycine max
  Peptide Sequence Number=SeqID_155026
atgaaggaattgttgtactttatgggattattaaatctcagattgcaaatccatttttttttatcattgggaaataaaagacaacaaggaaggaaaggggaaactactcccgaacaaagggagagcctaaagcatcagccaacaaaagatgttgcaactgggaaggacaactctgaaaagtcaacaactgggaggatgaagaagctccactttccgctaaccaatgagcacaatattgattgccatgtctcagaacatgcacaaaggagaggttccaagggagtggaaggaacctttgaatcttcctga

SEQ ID NO: 38249 - DNA, 951 bp, Glycine max
  Peptide Sequence Number=SeqID_155027
atggataagagcttgaaggtaggggaagatgagtggagggagagggagagaaagagcatgaaattttatgcctcgaatgagtttccaaagttgttcttggcattatgtgcgaagaggcaaaggggaaaggcacactccttccccacttcttcatctgctatgccacacttagcttccccccacccccctaaccctcattgtatgaaactagaagtgcctcattttaatggtttcgacccatcgggttggatccttaagatcactcaattctttgaataccactctactcctgaccacgagtgcctaaccattgcttccttctacatggagggccccgctttggcttggtttcagtggattacccacaatggtcagcttgcttctttgcttggttttcttcagcctttggaagcgcgcttttccctatcccagtacaatgatcctactggagctttgttcaaactcacacaatgtggctccgtcaccaattatctctctgagtttgagactcttgccaattgcatcattggcagcaggtttagccagactctaggaggagaagttcagcgactttcgttgttctcctcgtggcaaacccatctctcactccatcttggccctgcactattctctcacctcgactcaaagtacttcttcacctatgttaccatcccctcccaaaccaccgcgattcccttcaaacgtctatctcccgaggagttagtgacacgtcgcgagaaggacctatgttttaattgcaatgagaagttccataaaggtcacaagtgtgtctccaaggttttcttgctgatagcagaggaagatgatgactcgcaggaggcccatggccttatggatccgctgcttgactctcaggaagcactagcctcatctcaagcccaaatcagtttacacactctttcaggtcacttagctccaaaaacattatga

SEQ ID NO: 38250 - DNA, 687 bp, Glycine max
  Peptide Sequence Number=SeqID_155028
atggattttgctaatcccaatgtcactaaaggaaaacagcagatggacatggaaggacaaacattaaatatatgtgtcaatcgggatggagacagctcgagcaaacatcttgttcgactttcggatcctcaataccactcttgtgatagagctggaggtttcgagacttgtcctgacaatcaagctagcctttcttgccatacttcaatagcatatatggaacttattactaagacaccatcttttgagggtggggactatcagggagttaattctttttctttggaagatgaggaagatatgacttggtaccaaacaaattattccctccttagtcttcttcaggatgaggagcagtcccttgaatcccccattgatatgaaggaaattcatgatgcttcgttctcaatggaaccctggaaagctccaggtccaaatggctaccttgctagggctcctttctttgctccccaacgaggtccaaggtgtttgggtccctatgaaagttgggagaattggccttttagtgtccatctcatgttcgtagatgatttgcttctttttggccaagcatatgagagtaccacaaaggctatcaagaaagctatggatttattctatggcatatcgaggcagcttattagtaatgacaagaccaacatcttttcgaaaaatgtcaacccgtag

SEQ ID NO: 38251 - DNA, 456 bp, Glycine max
  Peptide Sequence Number=SeqID_155029
atgaagaataagttttccaatccaagaccttcaatgttggaggacacagatgatggtcaacttgaggacattgatgttattccaaatgaagagatgatattggcacttagtgaaaaaggttatgtgaaacggatgaagccaaacacttttaacctacaaaatcgtggaacaattggaaaatctgtaggaaaattaaaagtgaatgattcgatgtctgattttctcgtttttcgtgcacatgatcatgtcctatatttcagtgataagggaacagtatactcagctcgtgcctacaaaattcctgaatgtagccgcactgctgctggtacaccacttgttcaggttcatggtgatgagctgaaatgggtccgtctttgctcaaatgatgactttgtggccatggcttctcacaatggaatggtcatgctaagccaatgcagtaaggcaagttgctga

SEQ ID NO: 38252 - DNA, 660 bp, Glycine max
  Peptide Sequence Number=SeqID_155030
atggatgacggaacaagaggcaacaatgaatctttatggtggcaggacctaaaggtagtgttccaccaatcgcaacagggcaatgtctttcaaaatggaatagcttggagggtagggtgtagagataagatcaaattatgggaggatagttggactattgacgatgttccactaataacaaaatatcctaggctgtatcacatttcctgccagcaaaaacagttcattcagcaaatgggaagtcacacagatgcaggttgggagtggaatttcatttggaggagatccttgattgacaatgaaatcgacatggctgatagcttcttgggggatatagtaggtagcctaatacaaccacataaaagagataactgggtgtggaaagcatatccaaatggccaatactcagcacaaaaccaactgccaacaaaattaaacctgcgaaggagacatatagagatcaatgatttactatgcccattctgtaggaacaaggaggaggacgtagctcatctatttttcaactgcagtaaaatcctccctatatggtgggagtctttgtcttcggtcaacatctcaggtgctttcccgcaaaatccgagacaacatttccttcatcatgcaaatgggttggatgctggaataagggctaacagatga

SEQ ID NO: 38253 - DNA, 131 bp, Glycine max
  Peptide Sequence Number=SeqID_155031
atggagcagttactcgatcctcaagaaatgaaaacaattactctgaagatatactgcagaaagtgtttgtggtctcctctctatgtgcatagtagcgacctcgagtcaaacgccaaagctattagacaacg

SEQ ID NO: 38254 - DNA, 156 bp, Glycine max
  Peptide Sequence Number=SeqID_155032
atgtccaaagctaagcaaagaaaaggaaagaatgcacaaagatttttatattgctatcatgatgtgataacaaacaaaatcattgtgaggttccattatgaggttctcattttgaagaacctcattgatgaacattatgaagaaccatcagaatag

SEQ ID NO: 38255 - DNA, 351 bp, Glycine max
  Peptide Sequence Number=SeqID_155033
atggatcaaacttggatgaatgcaagttgcatgagccctgtgtatgaggaaggcattggagagttcttgcaattttcctctaaaagaagtcgaccagatgaggatggaaaatatttttgtccttgtataaactatttgaatgggagacgacaagtactagatgatatacaagaacatcttattgattcgaagaagcctttatatcggggatgcaagaaatctttgaccctgttatcagtgatgctaagtctgattaatgtcaaggccatatattggtggagtgacaaaaacttcacttcactacttcaggtggtgcaggatatgcttccagatgaaaacacgttgccataa

SEQ ID NO: 38256 - DNA, 522 bp, Glycine max
  Peptide Sequence Number=SeqID_155034
atgcgagcgaattggagacaacataaggacgtcacttctttctacttcaccaggttccctgaagatgcaatagtagaagacttgtggtatcacttcaagcagtcaggagaaatgcgagaggttttcataccctggaaacgaaacagacatggaaggagatatgggtttgtgaggttcaaaggggtgcgagacatgcatcaggaaaccaggaacgaatgtgggagtccagcaagggcgtatgcagaggtggtcactcagactattccaagaacagaacagaggagagcatcggccaaagacgattatactcgttacaactcaacatctgcagttaaccttgacataccgctgacaggccagcattggctcaaggaggcatgggtggacagactgaaaaacctagccttgtttgatagcatagaggatgatatgaggtgggatagtggacaaaacatatcaccaaagtaccttggtgatgatatggttttgctccttggtctcacagaagaaaaagctgcatga

SEQ ID NO: 38257 - DNA, 303 bp, Glycine max
  Peptide Sequence Number=SeqID_155035
atggggtttatgtgctttgcatactttacagttattgatgcacagcagaaagagtcactgcctgagcatgagacccaactatccagcatccgttggcatctatctgaaggtgggttgaaggactataacttgctagagcggcttggtgatggcaacaagccaacagcaattattggtgatgttgctgatgaccttaatttggatttggtagttattagcatggaagcaattcatacgaagcatatagatgcaaatttgcttgctgagttcattccctgtcctgtcatgcttttgccattgtag

SEQ ID NO: 38258 - DNA, 276 bp, Glycine max
  Peptide Sequence Number=SeqID_155036
atgcctcttcaaaacattatggaggttgaggtttttgattgttgggattacgtgtctaaatgggtggaagttgtggctactccaaggaatgatgctaagattgtgcggaaggcaaaggagaagaggagaggggaggcaccatccactagggaatacgccaaggaagaaggagcttcaccaccaagaattgccttggataagaagcttgaagaggatgctttaatggaggaaaagaaagagagaaggggggagcacgaaattgaaggaataaaatag

SEQ ID NO: 38259 - DNA, 435 bp, Glycine max
  Peptide Sequence Number=SeqID_155037
atggggataatagacatggatagagggtttcctctatttgcgatactcaggcttaggatgtattcattagagagctctaagtctctgtatcttgatgtcttgcatgttgtttttcaaaattccaaaattaatgctccaaccaatcagcaaccaaaaccgtcatccatcattggcaatcatgatgatataattgagggtgacaaagctaatcatgagcttgtaggtgaaaaaatgaaggtgaatcatgctgactaccttgatcgaaacaatagaagggaatcccaaaaccttcttataacatgtgcaattgatacaaccttcccatggtgcacttttggagatttcaatgatctactatccaatgaagaaaatattggactcgtggatcaccccactcagctcttgaatggatttcgtgaaggctttattgattga

SEQ ID NO: 38260 - DNA, 345 bp, Glycine max
  Peptide Sequence Number=SeqID_155038
atggatttgtgtctcgttgtttgtttcaaggtttatctccaaacctatgtcatcttcaaaaaggttctaattctcaatgtttggtgtagccacaagaaatggaaggttacgataaggtgttttgatgataacaatgatgatgacaaaggtgatgacaaaaagctcaaagatcaatcaaagaacaactcaagtgaatcaagaataattcaagagtttaagataagaatcaagaagaattcaagaactcaagaagaaagtctagagacaagaatcaagattcaaggttcaagatctcaagaatcaagatcaagattcaagaataaagagaagactcaatcaagataa

SEQ ID NO: 38261 - DNA, 633 bp, Glycine max
  Peptide Sequence Number=SeqID_155039
atgggcggtggaaaatccttgtctttttctgcagtattcatggtccccaattccactcaacacttcgcttctaacattgcattattcacttcaaagttcaattctttctctgtcgtcgctctttcttcaacttcaagcttaattcctcatgtctttcagaggcctcagccggttttggatgaaaaggcttctgatccagatgcgtttgaattgcagccaaatgccacatcaggcatgggtgttgctgatcacagcaaaaacaccttcatggaattgaagcagaagaaggttcatcgttatgtgatctttaaggtcgatgagaagaaaagggaggttgtggttgagaagactggtggcccggctgagagctatgacgattttgctgcatctttgccggagaatgattgcagatatgctgtctttgactatgatttcgtcacttctgagaactgtcaaaagagcaaaatcttcttcattgcatggtccccttcaacatctcggatccgtgccaagatgctctatgccactactaaagacaggtttagacgtgagctagatggtgtccattatgaaatccaggctactgaccccacagaaatggatcttgaagtgctgagagaccgtgcacattga

SEQ ID NO: 38262 - DNA, 468 bp, Glycine max
  Peptide Sequence Number=SeqID_155040
atgacaaatagacgtcacaaaatgcatatggaaatcagagacaaaggaaagagaagctctagaaaggaatctcgatcccatatgcatcaagcgccccccaacagaagtaactcgacttggactccatctacagacctttgcatgaaatgcaatgtagatgcaacagtgttcaaagacacaatcaattttagtgttttagcttgtatgaaggactctggagggaggtttattgctgcaagacctcaagtctatcaaggagatccgacacctcaagaagcaaaagtagtggctagtctaacagctctcaagtggatatcaaattcgcaattggcaaatgttattgtggagttagcttgcaaagcaaacatggaggcaataaacataaagaattttgcgaataacaaagctagagatagactaagacaatgccttgacaacaagaactctttaatcaattatcagacataa

SEQ ID NO: 38263 - DNA, 342 bp, Glycine max
  Peptide Sequence Number=SeqID_155041
atgagacttctagtgaaaatcaaagtcttgagggacaatgaggttatcactagtgagttggcttatattagctcatctaatatctctagtgacaatgatagtggatatggtaccaaccctgtagatgatgaattgatgatgtgtaggaggttgttgggtatccaatgggtagttgcattaatgaggccaacacaagctaatcaggaaaagtcttttgttttgatgcctaaagaagaattgttcatcaaggatgggcaaggctatctggagaagaggtttgtctttcatccaggaggatggatcgatattaaagagctgaatttgaggtcgaattctctttaa

SEQ ID NO: 38264 - DNA, 123 bp, Glycine max
  Peptide Sequence Number=SeqID_155042
atgttgagactgagagggcgagaccgttacgtttggagaggaccgagaaatggggtaaaagcggtggggaagcggatcctctcctgcagtcagcgtctccagccctctcctgcacccttttaa

SEQ ID NO: 38265 - DNA, 174 bp, Glycine max
  Peptide Sequence Number=SeqID_155043
atggagaagatgaatgtgcatgaaacaacaaggggggcccctaaggttgtagctcacccaggcgagctgaaacttagtgctgaagcaatgggcttgcccaagcgagttggagctcactcaggtgttcaacaccataattcgactatcaaggctcaaaagatcaaggaacgatag

SEQ ID NO: 38266 - DNA, 2718 bp, Glycine max
  Peptide Sequence Number=SeqID_155044
atggcgactcctataactcctgattccgcaacacttgcttcgagagatccatggaagcgtcttaaacaacctgccttcgatgataattccattcagcgcaaagataaggctgcgctttatcggtctgtgcctgtcatttcagttctacttgttgattattataggtttaatggatggtcttcgtgccttgaaactagtagcaaatggattagtagaaagctattggctttcaagtatgagcaagttaaggcttcgattgattcatctgagtttatgcataagcatgattcggccatgaatttatctgcattaattgaagcaaggaaacgggaagaaagcttgaagatggcaataggaatcaatgaagcgtgcatagctagtcttgagaaggccttgcatgagatgcgtactgaatgtgctgaaacaaaggtttcagctgagagtaaagtttctgaagcacaccaattgatagatgaagcgcagaaaaaatctactgaggctgaggcaaagctgcgtgctgcggaatcctttcaggcagaagcttgtggatattatagtgttgcagacaggaagcttcgggatgttgaagctcgtgaagatgaactcaggcggcaaatcaaatctttcaaatcagagtatgtgtttaaatatttctttggagaataccgtgcattgctttatacacggaatgctaaagatgaggaattagatagtcttcaaaaagagttggaggacacaaaaacaaatactaataaggaacacggagccctttgtgatgagaaaaccaatttgaagttgatggaggccaccctaacaataagagaggaggcactaagtaaacgggaatctgagctgaacaagaaagaacaggaattgcttgatttgcaagtgaaacttgctagtcgagaatctgatgaaactcagaaagttaaagctgttcaggaagctgaacttggagcaagaaagactaattttgaagctgaactacaaattcagctcaaattggttgagaatgaaattgagatgaagagatgggcttgggaattgaaggaagtagatcttacacaacgagaggagaaactccaggaaagggagcatgagttggaaattctgtcaaggacactgggtgagaaggagaaggatttggtggatatgtcaagtgcgcttaaagaaaaagatcaaagcctgagagcttctgaaaaggaattagagttaaataaagttcttttgcaaaaggataaagaagagataaacaaaacaaagttagatgtacagatgtctttggtttcattggaaaataatttaaggcaatttgacaatgcgaaggagagacacgaagccttgaaaagtgaaacaaatgacttgtcagttttggaagtgaaactaaaggaagaaattgatgttgtacgatctcaaaagttggagatagtagcggaggcagataagctggaagcagagaaagcaaagtttgaagctcagtgggagcttcttgatgaaaagaaagaagagctgcggaaagaagcagaatacatagcagaggaaaaaaaggcagtttcggctttcattaagaaggagcgtgacaagctaagacaagagaaagagaatatgcgtgatcagtacaaacgagacttggagtcgctaacctgtgaacgagaagagttcatgaacaagatggcacatgaacatgatgactggtttggcaagatgcagcaagagcgtgcaaatttcttgagggacgttgagatgcagaacaggaatatgaatatccttattgacaagaggcgtgaagaaatagaaagttatttgaaggaaagagaaaaatcttttgaagaagaaaagaacaatcaactagaatatattaatgctcttaaggaaaaagtagcaaaagagtacaaacagtgcattgaggaactcaaggttcaaagggataagctccaaaatcagagagaactgttgcatgctgatagaattgaaattcatgctcagactgaagaattgaaaaaagtgaaggatcttaaaattgtctctgatgatattgctctgaccgaattgcttaattctgatatggagtctaaccaacaaaaaatctctatgaagaaaaaattgaaccagcggactcttaagcatgatgatcatttaaattccccccaaaaaatagatgctaataagattagcaatgggtttgattcttcatttgtgcaaaactcatctgttgttcttccttctagccctgttcgattctcatggatcaaacgatgcacaaaactagtttttaggcgttcccctgagaagtcactcgttcatgatgatgacaaagaaccgaaagtaatacttgaagtaccatctccagccgaagatattaacagattaagtgattttgaatctgaaaataagaaagatgtgaatagacctgttcccttggtttcgaatggatcactagggaacactgaaggtactggtgtagtgatggtagacaaggttatgcatgtctcagaggtgacttctgagaggactgatgctatcagtctccccaatctagaatcagcggatcatttgtgtgatcctacaattgttgtagataaaggcgatcttcatgggaacaaaattgatcaatcaaattctcaaattatcgagatagatataccttgtggatccgacgttttcgcaaaatcggaagaaatatgggaggaaaatagtggacaagttcctgatcgatga

SEQ ID NO: 38267 - DNA, 627 bp, Glycine max
  Peptide Sequence Number=SeqID_155045
atggttatggatgcaagtgatgggaatcttctgctgtctaccacatatctggaataccgccacccttctgtcaaatgggctcagacgtctgatgtactctacttaacagttgagctgcctgatgctcaggatgttaagctcaaactggagccagaaggaaaattttacttctctgcaactgctggtgcagagaagattccttatgaagttgacattgatctgtttgacaagattgatgtaaataatagcaaagccagtgttggttcaagacacatctgctacttggtgaaaaaggctgagaacaagtggtgggacagattgttgaagcagggagggaaatctccagtctttctgaaagttgattgggataaatgggttgatgaagatgaggagcaagataataaacctgcagcatctgatatggactttggtgacattgatttttctaagatgagcatgggagggggtgagggattggattttgatgctgcaggcaatgatgatgatgatgagagtgacacagaagaggagtttgcagcagaagcatctgctagtaaagaacaagattcgaaagatgctgtaagcagctatccaattccaaaggatgcacctgatactaaagcataa

SEQ ID NO: 38268 - DNA, 396 bp, Glycine max
  Peptide Sequence Number=SeqID_155046
atggaagacgcatccatgagcccctgcgtcgccctcccgccgaagggtagtgttgatgagaagaaaggaggtgttattgtctctgataggaagtgcaaaatctttagagataaaatttgtgataatgacgatggacttagggtggtacttagtggtgtttgtatgagggtcatggaaaaccttttcttcataagcttgagagaaggctttaggatcagcttgacatggttttgcagcaaatggaaattgcttggttccagagatcaaggactaaatggctttatgatggaaatgcttcattccatgaacaagatgagaggtaaagaagatttctttgttgtcaaggtggatcttgctaaatcttacgatcatatgagttggaaatttgtcaattaa

SEQ ID NO: 38269 - DNA, 1824 bp, Glycine max
  Peptide Sequence Number=SeqID_155047
atggggtacgaatgtaattctgcattggataaatatgaaagaattcctcatgaaaagatccatgaaatacttaaagtaagctatgatggtttggaagaaaatgagaagcaaattttccttgacattgcttgtttcttcaatacttgtggtgtgggctacgtcacatcagtgctacgtgctcatggttttcatgtaaaagatggtttgagagtgttggttgacagatctctcttaaagattgatgcttctggttgtgtgagaatgcatgatctaattcgagacacaggcagagaaattgtaaggcaagaatcaacagttgagcctggcagacgtagtaggttatggtttgaagaggacattgttcatgttttggaagaaaatacgggaactgataaaatagaattcataaagcttgaagggtacaacaacatacaagtgcaatggaatggaaaagccttgaaggagatgaagaacctgaggattttgattattgaaaatacaaccttttctacaggccccgagcatctgccaaatagtttgagagtgctagattggagttgctacccttcaccatctttgcctgctgatttcaatcctaaacgagttgagctactccttatgcctgaaagttgccttcaaatcttccaaccatacaatatgtttgaatcattgtctgtgttaagcattgaagattgccagttcttaacagatctaccaagcctacgagaagtaccacttttagcatatttgtgtattgataattgcaccaatttggttaaaattgatggttcaattggctttcttgataagctccaactcttgagtgctaaacggtgtagcaagctaaaaattctagcaccctgcgtcatgttgccatctcttgaaattttggaccttcgggggtgcacatgtcttgatagcttcccggaagtattgggaaagatggagaacataaaagaaatatatttagacgagacagccatagagacactgccatgttcaattggaaattttgttgggcttcaacttttgtccctgaggaaatgcggaaggcttcatcagctaccaggtagtatatgtatattgccgaaagttaaagtgattttcggttttgggcatgtggtatatcgattttgggaagagaaccaatatgaacaagagttgagcttagaagtgtctccaaggtccatggttgttgttgatggtgacctggattttacatatattgacatgtattatccacacataagtccaaataatgtcatccaagtatgcagtcctaatctgctcttgcatcatgatttcattttgttgttcaaaaagcttgcaagcaaggatgggagcagatgcaggaaatcgtcaatgcatttctcgtttcgaaacaaattccccaagattgcggtatgttgttctgtattgcctagtttgaaaattaccatgatattgattttgaagttgggcgtactcatcaacggcactaagatatttagttcatcatgtaactacttatttacacaaacatggaacccaaaactttggtgtgatctagaaagcaaagcagaggggatgttttcagagcaagaatggaatgaagctgagattttgtttgagttgggataccccacaccatgtgctggattaacaatgtcgctccacaactttgctgagggacgtctaaattggaccctatttggtgtctacgaggagggaaataataaggaggatattaaatttaaagatcccatgtcaaccttttcattctgtaacatgctcatggaacctccctcttcattacctagttgtttgtactatgttgttaaatga

SEQ ID NO: 38270 - DNA, 309 bp, Glycine max
  Peptide Sequence Number=SeqID_155048
atgacgttgtcgaagaagtactttcagaaaatgaatggaacagcaattgaaagtgtgaaagcattgatatcatgttggacatggcatttcttagaatggctcaaatactttgaaaatagtggcctttggatggtcatctgcaagttccaagttttaagaggactaagtctgaacatgataagaatctgcaaaataagcgaagttcaaatttttacacctcacaataatgacattgcaaccctgatgttactcaaccaaagaaatggggaagaagttgcacaacagggaacgaagagtcttgagtcttaa

SEQ ID NO: 38271 - DNA, 324 bp, Glycine max
  Peptide Sequence Number=SeqID_155049
atgaaggaaaaagaaaaagagatagcagttatagcatgtgtaattggcgtgtgggtgaagaaagaggatctgaaggtgcaggtggaggagaataagatcctgcagataagcggggagagggtgaaggagaaggaggaccagaacgacaagtggcaccgcgtcgagaggcagtgcggaagcttcctccgccgcttccggctgccggaggatgccaaccccaaccagatcagctgcacgctcgaaaacggggtgctgaacgtcaccgtgcccaaggtggagaagaagccggagaacaagaacgtgaggcagattgatgtggtttga

SEQ ID NO: 38272 - DNA, 744 bp, Glycine max
  Peptide Sequence Number=SeqID_155050
atggagaattcagcggggaagaacatggcaatggatttcataattccaagaactcatgccacggagctgttgtcatcgaaagttgtcagcaatgccaatttctctagaaaagaagagaatctgccgatagatattaaagagaaccttgctatcaccaagtgcagtggcgagacacaagccaatttggcttcagttattactcactatgtcgagactctaaatcagtacagcttgcgcaacttaggctaccccactaatcaaaacttcaactatgacacattagcatcgttgcttcattttcatttgaacaatgccggtgatccattcctaggaagcagcttctccctaaattcaacaagatttgaagtgtgtgtgcttgattggtttgcaaatctgtgggagatagagaagaataagtattggggatacgtcacaaccggtggaaccgaaggaaatcttcatggaattttagtagggagagaacaacttccggatgggattttatatacctcacaagattcacactattcaatcttcaaaatagcaagaatgtatcgaatgcagtgcatgaaggttagcactttggtctctggcgagattaattgtgttgatttaaaggctttacttcttgctcacaaggacaagccagccataatcaatctaaacatagacacttggagaaacataaatatggttcttgtttcagggacaactatgaaaggaggagttgatgaccttgatctt

SEQ ID NO: 38273 - DNA, 1082 bp, Glycine max
  Peptide Sequence Number=SeqID_155051
atggatttggtggaaggcgtcggagagagttcctcgccgccgcgcgccttcagcggctacagcaactacgacgtccgcaacgatgtctacaaccgccttcttcaaaccggccacgaccaagccgtttccaaccccgacttccgcgaacacttggaggctcacttcaatcgcttgccaccgagttatggactcgatgtgaatatcgatagagctgaagatgttctgttgcatcaatcccttcttgctttggcaaaggaccctcacaagcgccctgtataccatatacgcttccttgagctgtccgctttgctgtctgatattggacttaacatccgtgaagctcatgttttctccacaactgatggctattcccttgacgtgtttgtggtggatggatggccagtagaggaaacagatgatttgtatgatgctatggaaaaagctgtatcaagaagcgagggatcatggtctcgttctttaaaatctcattcagctgtggagaaagccttagcaacagaaggaaaatcaggagattgggaaatagataggaagttgctaaagttaggagaaaaaatagcatctggatcctctggagatttgtatcgtggagtttatctcggtgaagatgttgctgttaaggttctgagatcggagcaattgaatgatgccttagaggatgagtttgctcaagaagtggcaattctgaggttttactttaagtatcttactgttaatggattttttcacaaggttataaatcatcagccctatgatcagaaagcagacgtattcagtttttccatcgtactgtgggaattagtgacggcaaaggtaccatatgacaccatgactccactacaagctgccttgggtgtgagacagttcataactaggatcgatcactttgtatctgactcagctgtaatgctgtacatccttcagggtctgcggccagaacttccgaagaatgggcaccctaaattattagagttgatgcaaagatgttgggaagcaattccaagccaccgtccatcctttaatgagataactgctgaacttgaaatcttttgcaagaaatggag

SEQ ID NO: 38274 - DNA, 168 bp, Glycine max
  Peptide Sequence Number=SeqID_155052
atggcattggcaacgccagctctcgtgaaagagaatcttgctccctacagtaatacgaacattttgctgtcctcacctcggcaacaagacatgaacaaaatcccaattaacattaaatattcaggagagcttgttcttttaggttgggctgtggcactgaaagcttag

SEQ ID NO: 38275 - DNA, 1126 bp, Glycine max
  Peptide Sequence Number=SeqID_155053
gaaggaaccatacgatggcatgctcatagtgactgggcaagagccactgtccatggacctatctatatttatccaagaaagggagaatggtggaagaatgatgccagagatgtctatgaggaatttctcagaactggaggagccccaaatgattctgatgctatcactataaatggtcaacctggtgatctttatgcttgcaaaatcagaaacattgagttaaatgcacaccaaggaaagacttatcttctgcgcatggtcaatgctgcaatgaatctcaatctctttttctccgtttcaaagcaccatctcacagttgttggtgttgatagtggctactctaagccattgacaagagattacatatgcatagctccaggacaaacagctgatgtattattgcatgccaaccaagagcctaatgactactacatggctgcaagagcattcaagatccactatgatgagaatcatgctccaaacaaatctctttcattaccttatctcccttattacaacgacaaagaagcagcttttgactactatgttagcatcaagggcttaactgaaacatacccttatcaaataccaaaggaagaaaccaaggttgctcttactaaatatggttcaacagtggaacttgtttttcaatggaaaaatttggttgctgggatagaccatcccatgcatcttcatggtactagtttctttgctgttggatatgggtttgggaattttgacatacacaaggaccacaagacatacaatctcattgatcctcccattatgaatacaatactggtgcccaagaaaggttgggccagcataaagtatagggctgctaacccagacggagaagaagaagaagaagaagatgacgacgatgatgaagaagatgaagaagaggaggagaatcgcggtagcgagagagaagcgcgttggtgcggtggcgctttgtggtggaaatgcattctggtgaggcggaagcgtcgaagatgcggaagcggggtggcgaggaagaagcgtttgggaatgtgtcttgaggccatggtggcgcgtggaacagatccgaaggtggtgccgtggtgccaaggacaatatcttgttaactgtaaaccaattaagg

SEQ ID NO: 38276 - DNA, 264 bp, Glycine max
  Peptide Sequence Number=SeqID_155054
atggatgagaataagaccaagaaaataaaaacccaagaagctgatgacgagaatgatgttgcatttgatgaagattctttgagagtgtctgatgatcctccattaagagcaacacctcttacatctcaaagggggaataattccaaccgcattggtgattattttgttccaataaccactgctggagctcaaccaaccttaaaaagtgtcttgcaaagcaaaaaggtggtagaaaagtgtgacattgcctttgaagatggatga

SEQ ID NO: 38277 - DNA, 426 bp, Glycine max
  Peptide Sequence Number=SeqID_155055
atgggttatgcccttatggctagggtgatcatctttacagcacctgatcttttgtccttgtattatgaaacaggtgacgccttacatagcctgaggacaaatttacaggatcctaacaatgttttgcaaagttgggaccctacactggtcaatccatgcacatggtttcatgtaacatgcaacaatgataatagtgtcataagagttgatctgggaaatgctgttttgtctggtcaacttgttccacagcttggtcagctcaaaaacttacagtatttagaactttacagcaataacattagtggaccaattccaaatgacctggggaatcttactaatttggtgagcttggatctgtatctaaaccgtttcagtggacctatcccagagtcattgggcaagttgtcaaaattgcgctttctgtga

SEQ ID NO: 38278 - DNA, 1614 bp, Glycine max
  Peptide Sequence Number=SeqID_155056
atggccatgttcgattccatcttcaacaaaggttttaaggctgccaaatgtaaaacattgctgaagctgacaattccgcgtataaagctgctaagaaacagacgagagattcagttgaagaacatgcggcgtgagattgccaagctacttgagactggacaagaagccacagctcgaattagggtagaacatataataagagaggagaacatgatggctgctcaagaaatcattgaactcttttgtgaacttattgcagtccgccttccaattattgaatctcaaagggaatgtccccttgacttgaaggaagccatatctagtgtatgttttgctgcaccaaggtgtgcagatttgccagagttgttgcaggttcagatgctatttgctgccaaatatgggaaggaatttttatctgctacgactgagctcaggccagactgtggtgttaatcgccagttgatagagctgctttcaattcgtgctccttcaccagaaaagaaactgaaccttctaaaagaaattgctgttgagcatgatttagattgggatccagaagcttcagaaactgagttctttaaaaagcatgaagatttattgaatggccccacccaattcgttagtgggtctaagttgccccttcctgatgaaaaacacaatgaagagatgcactccactcatgatgcacccaataaagaacaacctgattctgattctggctccgacacattagaatttcctgaagttcctaaggtatcagtccagccaaatgcaaatgttgccacagctccagaaatggttacacctttgactatggaacccctcgaggttgatcttgattcaccaagacattctggagattttgcagatgcaaaacaggagcaagttgaagatagatcatcagttcacaaagatgaaccccacacttcaatttgcaaaacggagaataaacagtttttgccattcatctcccctccatctgtatcatctggatcattttctgcaagacatagtgactcacctccctccttctcaagcacaaaatctgaaggcaatgtggacttacaggatgtgttggctgctgcccatgctgctgctgaaactgctgaacgtgcagcagcggcagctcgcagcgcggccagccttgctcaactccgaattaatgagctgacaaagaagaaaagtagtgaacatgtgcctgacagcagtagctctgagaacccgttttatgctggtggcagtaatgaatctccaacaataatagaaaagcatttcactgagcaaaatactgcaggtaactctgatgtccataatggaaacgatgttgaacatcaccaggatcattatgcttccccagactctcattcatcaagttttccctcctttgagacacttaaggaggattttgcttcttccctacccaatgatcatcgtgtattggatgacaagtcctcgagtcaccagcctaagagattaccttcaatggacgacgactcgtatttctcataccccaacttatttacctctcaaaactctaatgtgggatctcaggctcattcagataacagccgttcccctcattcagataacagccgttcccctcatgatctgtga

SEQ ID NO: 38279 - DNA, 657 bp, Glycine max
  Peptide Sequence Number=SeqID_155057
atgagtaactcaaatagtactcaagaattgattctccactgtgatgatcaacagcagcaacagaatgaggatgattactatgatcttgatgactacgacattgatgaatcctactatttctatgtcatcaatgcaatactaagtggcactgctaggctcaatgtcctcttgccaacagtgacaatccttgccttcagcatttttgcacctctcctcacagatgatggtgaatgcaacactttgaaccgttggttgatgggaaactttttggcccttttggcagtgtcatgtgttttcttcaccttaactgatagcttcagaagtgccacaggaaggttgtactatggagtggcaacattcagagggatatggactttcaatggaggcaagaagccgcgcgtgccgtcggattatagactaagatggagtgatcttttctatgcatcattgtcccttgtctcttttcttgcttttgcagggttgcatcaagatgttgtcaagtgttactacccagcattgcctagaaaggtgaccaacactctcccccttgtgattggtttctttgtgagtgttttgtttgttgtgtttccttccaagagaagaggcattggctaccccttcttgctgcagagagatcctttctactctagaacctga

SEQ ID NO: 38280 - DNA, 627 bp, Glycine max
  Peptide Sequence Number=SeqID_155058
atgttgtgcgtgaagtttgaacctagtgagagctacggaggattagatgtatgcagccttaccctagcaagtggagaggttgcagtcatggtgcaagaaaatggcaagaggaagaagccaaacattctggtgactgggacaccggggacaggaaagacaaccatgtgcactgctctagcagaagcaacccagctccgccacatcaatgttggagaactagtcaaagaaaagaatttgcatgatggatgggatgatgagcttgattgtcatgttcttaatgaagacttggtctgtgatgaacttgaggatgttatggaagaggggggaaacattgtggactaccatggctgtgatttctttcccgagcgttggtttgattgcgtggttgtacttcaaactgataacaccgttttgtatgaccgtttgagtcggagggggtacaaagattcaaagctttcgaacaatattgaatgtgaaatcttccaagttctgcttgaggaggctaaagaaagttactcagaggagaaactgattgcaatgaagagtgataatatagaagacattagtagaaatgtggcaactctgacagattgggtcagaaattggtctttgccctcacagtcttga

SEQ ID NO: 38281 - DNA, 996 bp, Glycine max
  Peptide Sequence Number=SeqID_155059
atggatcctggcttcgccggagcaccgccgggcacggcggtgttcgatcagattctggccgaggaaccagatagctcgttgcttcaccggaacaccttctccggcgactccttctctatccccgacaccttcgaggacgttctaaactttgatttagaacagtttgattttgacatactaaactccccaccaccgtcgccgacgcttccgccgaccgtcaccgttgattcagcttcctccgtggaattaaaagcgcaggcctcggaggtcggcccggtagggcccactgcgggactcgacctcggcggagagaggaaggggaagcggcgtctccggaacagctataccgttggggcgtatgggccactggtatctcgggggaagaggaccatgaactctgaggaacttgctgaacttgctagggttgatcccaagagggttaagaggattctttgcaatagaaaatctgctgctaaatcaaaggaaaggagagtgatttatgagaaagatttgcgagaaaaggtcccgcagcttgcgattcaatcagctaacctagatgctaaacttagatttcttgcggaagacactacaaatagggatgttcgtcttaagcagctcagattaaccatagatgctatgcgacaagaagcgcagattaaagatgctctctctgcatcggtaaaggaagaacttcgaagcctccgtaggaataaacatggtcatgttggtgttatgtcaagttgtggttctgtggacgagttgacctctcaattttcttcacagttggctctacaaaagtttcataatcatccgtcgtcgtctcagaaacatctagaccttcctcagcaaacacagctctccatgcctaatcctcttccttactctactactcagagttttagtgggcaatatggccctaataactacttctccaacttcaatcagcaaaactacgtctttgttggtacttatgttttactgtttcaggctagatag

SEQ ID NO: 38282 - DNA, 1113 bp, Glycine max
  Peptide Sequence Number=SeqID_155060
atggagaagaacatggcaattgctttcatgggtgctaagctcactactagaagtgaaaaatatgagaatgacaatagtcatacgaaccttgctatcacacagtgtagtggcgagacacaagccaatttagcttcactagggagcagcttctccctaaattcaacaacttttgaagtttgtgtgcttaattggtttacaaatctgtgggagataaagaagaatgagtattggggatacgtcacaactggaggaactgaaggcaatcttcacggaattttagtggggagagaacaacttcctgatgggatattatatacctcacaagattcacattattcaatcttcaaaatagctagaatgtatcgaatgaagtgcatgaaggttagcacattaacctccggtgagattgattgtgttaatctgaaggatttagttcttacacacaaagacaagccagccattatcaatttaaacatagggacgactatgaaaggagctattgatgaccttgatcttgtaatacaaacgcttgaggaatgtggtttcactcgtgatcggttctacattcattgtgatggagctctatttggaatgatgttgccttttgtcaagcaagcaccaaggattaccttcaagaaacctattggaagtgtgactgtttctggccataagttcttgggatgcccaattccttgtggtattgcaataactcgtttagaatacatcaatgcattgtctaaaaatgttgaaattattgcttcaagggatgccacaatcacagtgcaaaaatgcataatgaaagcacggtatttacaaaatcgactacgtgatgctcaaattagtacaatgttaaacaagtttagcgacattgtcatctttgagaggcctctagatgatgactttattcgtaggtggaatttggcatgcaatgggaatattgcacatgtagtggtgatgcaacacattaccattgaaatgttggactcctttggtggtgagtttcgtaaaaagcgatccttttggtttgaagatggacaacttcaacctctgtgcattgcaaatgacattggttctagaaattgtgtctgttcaatgcaccgttcactatcatga

SEQ ID NO: 38283 - DNA, 366 bp, Glycine max
  Peptide Sequence Number=SeqID_155061
atgcagaagaatgatgttctgagagtgttaaagttggatggtgatgcgaatttgaggatttatagttcatcatataaagggagtggaacttctatcataagatgggctgctgtgaaagatcacaatacaaggactcagaattttgagaagattgatccaaataatagtaggaaagggtgtaggatgaagatcaacccagaggtgttgtatacacctatgtcagcttgtagagaaatttgtctttcagctggttcttgttttgcttctacttccttgtcagatggatcaagattctgttacgtaaagacaaaagatatatttggtggatatcagagtccagcactaactagcactacatatgtcaag

SEQ ID NO: 38284 - DNA, 2511 bp, Glycine max
  Peptide Sequence Number=SeqID_155062
atgttcctcaaaacgcaatttctgttcctcacccttgctttagcaaccactacagtcaccaccgccatagacccaggttctaccctcgcagcttcttcttccaaccaaacgtggtcttctcccagcggcaccttctccctccggttcatctccgttcagccaccgaccactcctccttccttcatcgccgccatcgtcttctccggcggagctcccgtggtctggtctgccggaaacggcgccgccgtggactccgccgggtccctccagttcctccgctccggtcacctccgtctcttcaacggctccggcgccaccgtgtgggacaccggcacggcgggtgcttcgtcagcaacccttgaggacagtggcaatttggtaatttcaaacagcactggctccctatggtcaagctttgaccaccccactgatacccttgtgccctctcagaatttcaccgttggtaaggttctaaattctgaaagttactcttttggtcttagttcaattgggaatttgaccctgaaatggaacaatagcatagtgtactggacccagggtttgaactcctctgtgaatgtgagtttggattccccttctttggggttgttatcaattgggctcttgcaactttctgatgcaaatttgagcccttctattgatgttgcttacagtagtgactatgctgaagggaatagtgatgtgatgcgggtgttgaagttggatagtgatggaaatttgaggatttatagtactgctaagggtagtggagttgctactgctagatgggctgctgttctggatcaatgtgaggtttacgcttactgtgggaactatggtgtgtgtagttacaatgattcaaccccggtttgcggctgcccgtctgagaatttcgagatggttgatccgaatgatagtaggaaagggtgcaggaggaaggcgagtctcaacagttgtcaagggagtgcgactatgttgacactggatcatgctgttatcttgagttacccccctgaagctgcgtcgcagtcatttttctcggggatatcggcgtgtagagggaattgtctttccggttcacgtgcctgttttgcatctacttccttgtcagatggcacggggcagtgtgtgatgagatcagaagattttgttagtgcatatcataatccttcgctgcctagcacttcttatgtcaaggtttgtccgccactggagccaaatccgccaccctctatggggggtgtgagggaaaagaggtccagggtgcctgcttgggttgtggtggtggttgttttgggtacccttttgggtttgattgccttggaaggtggtttgtggatgtggtgttgtaggaacagcacgaggtttggtgggttatctgctcactatgcgcttcttgagtatgcttctggtgccccagtgcagttctcgcacaaggagctccaacaagcgacaaaggggttcaaggagaagcttggagctggtggatttggcactgtgtatagaggaactcttgttaacaaaacagttattgctgtgaagcaacttgagggcattgagcaaggtgagaagcagtttaggatggaagttgccaccataagtagtactcatcatctgaatttggtgaggcttattggcttctgctcggaagggcgccaccggcttctggtttatgaattcatgaaaaatgggtctcttgataattttctattcctgacagaactgcattcgggaaattttttgaactgggagtatcgatacaacattgccctgggcactgcaagaggcatcacatacctacatgaggagtgccgtgactgcatagtccattgtgacataaaacctgaaaatattctcttggatgagaactatgttgccaaagtctcagattttggtcttgcaaagctcattaatcctaaggaccaccggcatcggaccttgacaagtgtgagaggaaccagaggatatttagcccccgagtggcttgcaaatcttcccataacatccaaatctgatgtttacagctatggcatggttttgttggagattgtgagtgggaggaggaattttgatgtgtcagaggacacaaataggaaaaagttctccatttgggcttatgaagagtttgagaaaggtaacataagtggaattttggacaaaagattagctgagcaagaagttgaaatggagcaagtaagaagagcaattcaggcaagcttttggtgcatccaagagcagccatctcagagaccaacgatgagcagagtgctgcaaatgctagaaggggtaacagagcttgaaaggccacctgccccaaaatcagtaatggaaggagctgttagtggaaccagcacatactttagtagcaatgccagtgcattctccacagttggagtctcacccgctggtccctcctcttcatcatcatttcagactagtgttgtttcaaccttcaccttgggaaggaaccctgagaaggcaacctcgtcccttttacaatcagacacatga

SEQ ID NO: 38285 - DNA, 672 bp, Glycine max
  Peptide Sequence Number=SeqID_155063
atggttgtggacttgtggtgttgcagaaacattccaagatttggaggactatatggtcagtatgatctcgtggagtatgcttctggtgcaccaattcagttctcatataaggagctcaaaggcctcacaaatgggtttaacgaaaagcttggtgctgggagttttggttctatttatagaggaatgcttggtaatggaactattgttgtgattaagcaaattcagggaattgaactagaagagaaacaatttaagttggaaattgctaccaaattttatctcggcactatttttattcgatgtgggacttcaacatgccccatcaccacattgcaagggggtatcaactatcatgatttcgaggccaaactctcctatttcaaccttgtaaagctcataactcccaaggatgacaggtaccaaaccgtgttaaatatgagaggaaccaaaggcttttggtgcattcaggagcaaccatctcagaggacagcaataagcaaagtcttgcacatgcttgaaggtgttacaaagattaagaagccaccagcaccaaaatcaatgaatggagggtcgttcagtggaaatgaagaatggttgagaaagaatgtcagtgctctttccactgtgtcaaccccaacaccaacttgttcttcctcttcgtttcattattaa

SEQ ID NO: 38286 - DNA, 627 bp, Glycine max
  Peptide Sequence Number=SeqID_155064
atgggtgataacaaggaccgggatttcttttcccacaaattccccacaacctctcaggtgatggaagagatgaaggaactgtggggcatggctctacccataacagctatgaacatgttggtatttgtgagggcagtggtttctgtactctttttgggtaggcttggaagcctggagctcgcaggtggtgcactttccataggcttcaccaacataacagggtactctgttctcgtgggtcttgcagcaggcctagaacctgtgtgcagccaagcctatggtagcaaaaactgggaccttctctcactctctctccaacgcatggtcctcatcctcctcatggcaatagtccccataagcctcctatggcttaacctagaaaggatcatgcttttcatgggccaagacagtgccatcacaggaatggcatcactctactgcttctactccctcccagaccttttaacaaacaccttgcttcaacccttaagggtgtttttgaggtcacaaaaagtgaccaagcctatgatgaagagggaggtggtggtgaagtgggggtgttggggtgtgggtggtggagtggtgtgttctgcgttggggcagttgatgaggttttgctgtgcctag

SEQ ID NO: 38287 - DNA, 306 bp, Glycine max
  Peptide Sequence Number=SeqID_155065
atgaaagagccaggcaccatcacgaccgaagatgatgggaagaaaggaaacgagggggggttcggttctaacccgaaaacttccagatctgacaagcaaataccgaccccatatgcattgactttgaatgacaatctgggtaatataattacccaagttcagttgaagggtgagaactatgatgagtgggctcgtgctatgtgtactgcattacgagccaagaagaaatatggctttgtcgatggatccattaaacaaccaggggacgattcaccagagcttgaagattggtggactgtcaattga

SEQ ID NO: 38288 - DNA, 2611 bp, Glycine max
  Peptide Sequence Number=SeqID_155066
atggagaacgtgaaggatctctgggaagatatcaaacagcgattctccattgggaatggtccacgtgtgcagcaattgaggtcaaaccttgcaaactgcaagcaggaaggaacaagcgaaaaatatgatgaagatggatatgggacaatacgttccaatatcctgagcactaaacctttgccaaatctgaatcgagtatatgctatggtcgtgcaacaagaacgagtacggaccatgacacaaacaaaggaagaaagagggaaccccatgagttttgcagtgcagaatggtggggcgacaggccacgcacaatcgcaggtggatgcagtggtggacgtggacatggggtccagtagggaactagtgaaggacaagggcgcaaagggactgctcgtgccaatgcagttcaagcgccaagagctggtggaccacacttcgaggatgatgattggagcaggtgaacagctcggggggctttattttctcatagaagtggctcctgctcgtgtttacaagacaacccgtattgcatcttctgagctttggcataaaagaatgggacatccctcttctaggatagtagatttaatttctgaaattggtaatgttggtagaagtgatagtgtcaagaataagttttgtgacatttgttttagagctaagcaaaccaaagaagaattcatttctagtaataataaagttgcagaatgtttttccttgatccattgtgatttgtggggagcttatagagttcctgcttcttgtggagctgtttatttcttgactatcgttgatgactattctcgtgaactgtggatatatttgttgaatagaaaagatgaggttgcttgtgctcttaaaaatttcatcgtaatggttaaacgaaaatttgaaaaagatatgaaagttgttaggagtgataatggtactgagttcatgtgtttgaaagattattttgctgaacaaggaattttgcatcaaacttcttgtgttgggacaccccaacagaacaggcatgtcgaaagaaaacatcgtcatattctcaatgtaacgagagccttgcgctttcaagcacacttacctattgagttttggggtgagtatgttcttatagcgggatatttgattaacaaaacaccatccgttattttggatggaagaacaccgtatgagatgctatacgaacaggcacctacttataaacatattcaaacttttgggtgcttgtgctatgcccacgctcagaatcgggataaagataaatttgctagtcagagtcgaaagtgcatttttattgggtatccatttggaaagaaaggttggaggttgtatgattttgaaaatggagaatattttgtttcaagagatgttgtcttcattgaaacaaagtttccatattctaccaatattgcaagctctttcgtaaccaagaatggggttacgaattactttgcagacaatgaggactcgtatgtacaaaatgaaatggaggagcagcaagctccaacctcgggtgtggagcatgaagtgaatgttgagattggtaatgatgtggaggtgcctagtaatgtaaacactggagtagtagaaaggaggggtaccaacatagaaggacccatggtgttagaggaactacttggtagaggaaaaagggttaaacaaccttctgttcgtttgaaggactttgtgactcataccattcgaataatcccctcagcaggttcatcgttccagtcaaaatcctcagggtatgaacctaacacgtatgttgaggctgtaaaagatgaatgttggagagaggcgatgcgcaaggaggtacaagcccttcaggacaatggaacatggacaatagaagacttgcctcttgggaagaaagcaatcggaagcaaatgggtatacaagattaaatataattctgatggaagcatcgagagatgcaaggcgcgcttggtaattcttggaaacaaacaagttgaaggtatagattataatgagaccttctccccaacaacaaagatggtcactgtgcaaacatttcttgcctttgtagctgcgcgaagatgggagttgcatcaaatggatgtgcataatgccttcctacatgatgagttggatgaagaggtgtatatgaagtttccacctggtttttcttccccaacgccagcagcgctgaacaggtatggatttcaacagtcgtattctgattactcattgtttacttataaagatcagcatgttcaactccacgtttttgtctatgttgatgatctgattatatctggcaataatggggtggctgtgcaaaggttcaaagattatttgagtcaatgttttcatatgaaggatttaggaaaactaaaatacttcttggggattgaagtggcacgaaacttagaaggtatcttcttgtgtcaacgtaaatatgcgttggacatcatttctgagactagattgttaggagctaagccgttcatgcaacaaccaaaagaagaacattgggaggcagctttgagggtcgttcgatatttgaagggaaatctaggacaaggtattctgttgcgtgctgattgcgacctgaaactgtatgcttactgtgacttcgattgggcag

SEQ ID NO: 38289 - DNA, 360 bp, Glycine max
  Peptide Sequence Number=SeqID_155067
atgagtggggataaaccgaggaaggcgttaaagttcaacacacaagggtatgtaagggtggaggtggcattagaagtcggtggcactaccctgcaacgtgaagcatcttttctgggaacatgcttcgatgatgggcaaggagggttctcgagcatggctctcgaggctgctgcttattgcttgaagtgcattgcttgcaggggtgatggtgagttggcagttgaaattggtggagatggtgccactcattctttgatgaggttgttgcctcactctgatggaaggatgcagaaggacagttgttgccaccaatggtggggtggaaatcatcgttggtttgttgagttcttgcaccgatga

SEQ ID NO: 38290 - DNA, 114 bp, Glycine max
  Peptide Sequence Number=SeqID_155068
atgacatcaattgcttactacaaattaaagatgcacgagggttttcagtactatattacagatggtatttattctgattggaccacatttgtgaagatcatactaatgccataa

SEQ ID NO: 38291 - DNA, 218 bp, Glycine max
  Peptide Sequence Number=SeqID_155069
gctcttcgccaatctcttggaagacaaagaagcaacaaacagtgtctcgatcttcggctgaggcagaatataggtccatggcaaccaccacttgtgagttgaaatggttgaaaggcttgttgtctactcttggtgtgatgcattcgggacctgcgcttctgcattgtgatagccaagcggctttgcatatagctgctaatccagtttttcatgaatga

SEQ ID NO: 38292 - DNA, 333 bp, Glycine max
  Peptide Sequence Number=SeqID_155070
atgagggaaaagaatcgaaccagttgctgccttctgagtctcgcattctcttcttccaagtgttcaactcaaacaacagattcacgattcttaatgagtcttgcttttctcatgtccccagatgggagaatcctcatattcccaaaagggttgccaaaaggttcaacctttgagtcatttttgtggtggggttgccctaattgcaaatccttgtgcgtggcagagtcaaagtggaactcagaacgcgtgctcaaggtacgagcagtcacaggaggagaagggtctgaggctatggtactgaagttggtgaaggggctagacagaaaatcttga

SEQ ID NO: 38293 - DNA, 885 bp, Glycine max
  Peptide Sequence Number=SeqID_155071
atggggagagctccatgctgcgagaaaatggggttgaagagagggccatggactccagaagaagatcaaattctcatcaattatatcaacacttatgaccatgctaattggcgtgcattgcccaaactagctgggctgttaaggtgtggaaagagttgcagactccggtggataaattatctgagaccggacatcaaacggggcaactttaccagagaagaagaggacaccataatcagtttgcatgaaatgttgggaaacagatggtcggctatagcggcaaggttgccagggagaacagacaacgagataaaaaacgtgtggcacacccacttgaagaagaggctgccacaaaattataaacaaagccacgaccagaaaaaacgaagcaaaaaacaaccaaagttagatgtggacgcctccaaatcaaaccaagacgccaaactagaacaacaacaagagcccgtgaataataattttccctttcatgcatcgaactcagaggacatgatgccactatctcctccacaatgttctagccacatgtcctcctcctccctcaccactagtgacaacaacggtagcattaacaataaccatgacatgtccttaaatgttaatgatgatatcgacacgccggagaataatcttgcattggacgaggatttctggtcggaagtgttgtcgtctgataattccggtgagacaacaagcggatttccgaccattgactatgatcatcagtttctaccgatgtctcctctaatgaccgaagaaggggtccttatagatgctagttcgtcgagtgtgtgcgacgacggcatggacttttggtgcaatgtttatgccagagctgaggaatttacgcagttattggaattgtga

SEQ ID NO: 38294 - DNA, 213 bp, Glycine max
  Peptide Sequence Number=SeqID_155072
atggcatctacagctagtcctcttctttggaaacaacaccttcatagatgtggagaagtaacaaacgatgtaatccagtcatatgctcaggcaatgccctctccaaatcccaaaattgaaactttgttggttcaagctgggttttcaaatgttgcaaagctcagacaagttaaaattgatgacactttagtgattattttggttgaaaggtag

SEQ ID NO: 38295 - DNA, 228 bp, Glycine max
  Peptide Sequence Number=SeqID_155073
atgcaatgtgaggtaaaaatcgtatggggaaaaagcaatgtggggacacatcctttttctggcacaaaggataggattcctgataggctgttaaatgtcattagtgcaatctcggtcactctactagcacagaggacaaagctctataggattcctgacgggtcatcgattgtcgtcaatgcaatctcgaccactcctttttctggcacagaggataaaatattgtag

SEQ ID NO: 38296 - DNA, 330 bp, Glycine max
  Peptide Sequence Number=SeqID_155074
atggaaaacaatccatgggagcttctcaacattgataactcaaacctcccatcctttgtttgcccaactaatcattcatcctccagttcaacaagacatattcctggtccagctagggccgtacaagctgccacgatgaatcaacaatctagggaatgcaacgaaagacaaaggagaagagatgagaggaggcgccatccactagggaataagccatggaaaaaggagcttcaccaccaagatgagccttggataagaagcttggagaggatgcttcaatggaggaaaagaaagagggaaagaaagagagaggggggagcacgaaattga

SEQ ID NO: 38297 - DNA, 600 bp, Glycine max
  Peptide Sequence Number=SeqID_155075
atgttgcagagttatcttcctgggaacccaaaagaagagcaccctggtagtggtgggtgcaagcaagaagaaggtaacaatagaaacatgttcggtggcttcgatccacgtttcttggcagaagcatccaacgtgaagaagaaaaacccaagacccgagaagaaagaagaggtggtagaagaaaaagaaatcagaaagcgcaagcacctcaaaggagaacacgagggatgtggagaatgcgaagagaaaactagaacacattactaccttcgccgcgagtggcatgaacataaaggacaacaagatggaaaagaagaatcacgagagagatataaggaacgtggtgaaggtagtaatgtgttggaagaaagcttgtgcactttgaagctacacgagaatatcgctgacccttcacacgcagacatattcaacccaagagccggtcgactgcgcgccatcaacagcttaaccctcccagttctcaaattgctccgtctcagcgcccaattggttaaactttacaagagtgacatttacgtgccacactggagcatgaacgcaaacagtgtggcctctgtcacacacatgacaaataggtga

SEQ ID NO: 38298 - DNA, 321 bp, Glycine max
  Peptide Sequence Number=SeqID_155076
atgggttttgcaaatagcaattcgaaaaagaatctttcatccctgcaaacaagtacatgcaggcggcgcttttcaaagaattggaaacttacgatcacgagcaacggattcgctgtgtttaaagagcacttcaagcctatagctcttgtcaaatgggaaccacctcctctcaatgtcattaagattaacattgatggaagctctttcggtaatcccgattcttctgggtttggtggcctgcttcgcgatgctttgggaaattggcttttgagatacctgggtagttgtggtttttcaacaaataccactgctgagctctaa

SEQ ID NO: 38299 - DNA, 129 bp, Glycine max
  Peptide Sequence Number=SeqID_155077
attcaagccatccaaggcactccgtgttttccttccaaagattggaacctaaagattccaagtggttctatggagtttgatttaaaaatgatgggagaggcccaatggggtaaagagaagggaacatag

SEQ ID NO: 38300 - DNA, 1458 bp, Glycine max
  Peptide Sequence Number=SeqID_155078
atgttcaggtcatctcagcagaggaattcgagatgcaaagacttcaaggtgaaacatgctcttcaaatatgtgttcttcttggcgtttgtatctggatggcttatctagttcagcattctcgtgagaaaaaaagatcctatggtgaagggacaaatgctgacagtgaggttgtgaagttagggaggaaagaccccgatcctaatgtggagcaatcttcttctatcttacatgcaagggacaaggaggaaaaggatgaagaagaaaacaaccatgaaaagcaaaagaagacagatgacgttaatcgtgtggaaaatgagatccagacacaaaagaatgagcagaataacaatgaagagaaatctgagcagagaaaggatccagtagatcaagacactgaagagaatgagcataaggcaaacaaggagagtgatagtgtgataaaggagaatgaagacaacaaaaataaggtggaggaggacaatcaaagtagagggattagtgaggaaaaaaacgagacaaaaaaagaagagacagataaagaggaggatgaagagataaaccaaaacagaactgaagcaagggaacgtatggaggaagatcacaagcaagaagatgaagaggagagcaatgcaacagacaatgagagagaagagaatgaccatattcaggaagtggattcacctgaagatcgagttcgggatcaaaacagcgaaaggaacaatgaggaggcaaaagaggaatattatgcctccagtgaaggtttgaacaagacaaaacaatctgacaagagagaaaacaatgaatttgagttggagtctcaaacaaatggtaccgaagtggctcatgttcatgagaatgagagggtcttaaatgtaacacaacgaaaagctacacaagtgactaattctgttgtcacaaatataaccaaccaaggaaatggtagtgagaatcaagctgagaaaaagaatgattcacaaaagagttctattgccgagtcagataagcaggagcgagagcctaataagccctctagtgatgatgtagaagctcttcactcacagaatggtacagatacaactgaaaaacaacttgaaacacctgaaaactccaaggtagaggactccattttgcacaattcaacgttgacaatgaaggatcttaagtcagatgctgcagtggaacaagttgattccatcttaacaaattcatcaggagctcatgagagaaacgtgactaatggagaatataatggcaaagcaaatgctaatggcaatagtcatgatgggtcaggcagtgcttctgattcttctattgttgaaggaaaagatgcatcctcgaggaataatggtgacgccgggcaggttgagaatgagaacattgatacaagtaaaaatgaagatagagctcaaaatgaaccggttgaatcatcaataaagaaagaagaatccgcacattga

SEQ ID NO: 38301 - DNA, 1515 bp, Glycine max
  Peptide Sequence Number=SeqID_155079
atgacctctaaactaattgcttccaatctccgtcaccaaatcacaaaatcagctcaaaaccttcgccgccagcttctttccacggcggcggcggtggcggtgcctgaacacgatgggaacaactccaactcgtcgggaatgacgatgaagggcgttcgaatctccggaagacccctttacctggacgtgcaggcaacatctccggtggacccgcgcgtgctcgacgcgatgctccctttctacctctctcgctacggaaaccctcactcccgcacccacttctacggctgggaatccgacgaggccgtggaacacgcgcgcgctcaggtagcgtccctcatcggcgcgtcccccaaggagatagtcttcacctccggcgccaccgagtccaataacatctccgtcaagggcgtcatgcatttctacaaggacaagaagcgccacgtcataaccacgcaaacggagcacaagtgcgtcctcgattcctgccgccacctccagcaggagggtttcgatgtcacttatcttcccgttgagtccgacgggttgattgatttggatgagcttcgggcttcgattaggcctgacaccgggctcgtttcggttatggcggtgaacaatgaaattggagtggttcagcccatggaggaaattgggaggatttgcaaggagtttaatgtgcctttccacactgatgcagctcaggctttggggaagattcccattgatgtggagaggtggaatgtgagtttgatgtcgttgagtggccataagatttatgggccgaagggggttggggctttgtatatgcgtcggaggcccaggattagggttgagcctcagatgaatggtggtgggcaggagagggggattaggagtgggactgttccaactcctttggttgttgggatgggtgcggcgtgtgaggtggcgaaggacgagatggagtatgatgaaaagaggatttctgctttgcagcagagactgcttaatgggattagagagaagcttgatggggtggtagtgaatgggagcttggagaggcgctatgtggggaatttgaatttgtcgtttgcttacgttgaaggggagagtctgcttatggggttgaaggaggtggctgtgtccagtggcagtgcctgcactagtgctagtttggagccttcttatgtgttgagggcgttgggagttgaagaggacatggctcacacttctattaggtttggaattggtaggttcactaccgaggctgagattgatagggcggttgaactcactgttcaacaggtggagaagttgagggaaatgagtccgctttatgaaatggtcaaggaagcgatgtttatgaagaagaaagacatgcattggcagtttggtactgtatggactaacaaatgttggaatggcggttttaagttttgctctatctctgttcttgatcagggagagggggatctggcgcaggcttctttcacgatgtctagctttgcactggaaattgcgactagttactga

SEQ ID NO: 38302 - DNA, 1158 bp, Glycine max
  Peptide Sequence Number=SeqID_155080
atggaggcaaattcaggtgccagcgaccgaatttcgagaatcgccggccacctccgcccccagagagaggatgatgtttgtttgaagcgtagcgattgccgtgcaaaaggtggggtctccggattcaaggtggccatattgggtgccgcaggaggcatagggcaacctctggcgatgttgatgaagatgaatccactcgtttcacttctccacctctacgatgttgttaacacccctggcgtcacttctgatataagtcacatggacaccggcgctgttgttcgaggatttttggggcagcagcagcttgaggatgcacttataggcatggacttggtgatcatccctgctggtgttcctcgtaaacctggaatgacaagagatgatctcttcaatataaatgctggaattgttaaaacattgtgtgaagcaattgcaaagtgctgtcctaaagccattgtcaatgtgataagcaatccagttaactccacagtcccgattgcagccgaagttttcaaaagagctggtacttacgatcccaagagacttttgggagtcactatgcttgatgttgttagagccaatacgtttgtggcagaagttctgggtgttgatccaagggatgtggatgtcccagttgttgggggacatgctggaatcacaattttacctcttctttctcagattaaacctccttgctctttcaccccaaaagaaattgagtacctgactggtcgcatacaaaacggtggaactgaagttgttgaggccaaagctggagctggttctgcaacactatcaatggcatatgctgctgttaaatttgcagatgcatgccttcatgccctgagaggagatgctggcatcattgaatgtgcatatgttgcttcacaggtgactgaactcccattctttgcatcaaaagtacgacttggccgagttggggtggaggaaattcttcctcttggtcccctgaatgattatgagaggtatgcggtgatcacttgcatttctacttcagaatttcctatgcacataggtgaaactgaaacgttagagtttatctactgcttttatttcaacagggagagtttggaaaaggccaagaaagagttagcagcaagcattgagaagggcatttctttcatcagaaaatga

SEQ ID NO: 38303 - DNA, 2436 bp, Glycine max
  Peptide Sequence Number=SeqID_155081
atgcggcggcaaccattgtttctgtttttgcttttatcatgtttattgagctcaagtactggtttatctcaagttttgtccctcgagacagagactcaaattctactgcgggtcaagaacactcagcttgaagacaaaaacaagagtctcaaaaactgggtgcccaacaccgacctcaaccccagcagctggaccggcattacctgcgactcacgaattcactcacttgtctccattgacctctccgaaactggagtctacgacgagttccccttcggtttttgtcgcattcacaccctccaaagccttttcgtggcttccaatttcctcaccaactcaatctccctcaactctctgcttctctgttcccacctccgtctcttgaacctctccgacaattatttcgtcggagtcctgccggaattcccgccggagttcaccgaattgagagagctagacctctcaaagaacaacttcaccggcgacattccggcgagcaacctcagtgagttaactcatttggaactcgcttacaaccccttcaaaccaggacctttgccttcccaactaggaaacctctccaatctcgaaacactgttcctcgtcgatgtaaacctcgtaggggaaattccacactccatcgggaacctcacctcgctcaagaatttctatttgtctcaaaactccctgtcaggtaatatcccaaacagcatttcagacctctctcagaacgctctcacgggaaaactaccagacacaatcgcttcattgcatctctcttctctcaacctgaacgacaattttctcaggggagaaattcccgaaacttcaaccaatgacttggtgggagagttgccaaagtatctctgccaggggaacaaactggagcatctcatcacgttcgtgaatcgcttctctggaacgctccctcaacaatacggcgagtgtgtttctggaaatgtccaccaacaggttccaaggcctgtctctggttccatctctaggggactcactaaactcattttgtccggtaacagcttttctgacaatttcccaatagaaatatgtgaacttcaaaacctccttgagattgacgtcagcaagaaccgcttcaccggtcaagttcccacctgcgtaactaggttgattaagttacagaaacttagacttcaagataacatgtttaccggcgaagttcccagggagattccggtgaagttgacaaacttgagactcaaccaattcaacgtctctggtaacaagttgcacggggtggttcctttaggtttcaaccgccaagtgtacttgtcgggtctaatgggaaaccctgatctctgtagccccgttatgaaaaccctgccttcgtgctccaaacgcaggccgttttctctgcttgctattgtcgttttagtttgctgcgtttcgctcctcgtggggtccacgttgtggttcctgaagaacaagacgcgtggttatggctgcaaatccaagaagagctcttatatgtcaaccgcgtttcagagagtggggttcaatgaagaagacatggttccgaacttaaccggtaacaacgtgattggcacagggagttcgggtcgggtctacagagtgaggctcaagacggggcaaacggtggcggtgaagaaattgtttggtggcgcgcaaaagcctgacatggaaatggtgttcagggccgagattgagagtctgggaatgattcggcatgcaaatattgtgaaactgttgtttagttgcagcgttgaagagtttaggatattggtgtatgagtacatggagaatgggagcttaggggacgtattgcatgtcgcaattgctgtgggtgcggctcaggggttggcttatttgcaccatgattctgtgcctgctattgttcacagagacgtcaagagtaataacattttgctggaccgtgagtttgtgcccagagtagcagattttggactcgctaagactttgcagcgtgaggccacccagggtgctatgtccagggttgctggatcatatggttacattgctccagggaatgtgtacctaattgattctatttcagagtatgcttatacagtaaaagtgactgagaagagcgatgtctatagttttgggatggtgctgatggaattgatcacgggcaagaggcctaatgattttccatttggtgagaacaaggatatagtgaagtggatcactgagactgttttatcaccatctcctgaaagaggaagtggcaatattgggataggaaaagattatattatgagccagattgttgatccgagattgaacccagtcacttgtgattatgaagagatagagagggttttgtatgtggccctactctgcacctcagcgtttcccattaatagaccctcaatgcgaagggtggttgaattgctcaaggaccataaactgtcatga

SEQ ID NO: 38304 - DNA, 913 bp, Glycine max
  Peptide Sequence Number=SeqID_155082
atggccacgggcaccgttgacaacaaagcggcgaaatcgaaacctccaaggccgaagcgaatatgtttctcattcgcagcgtacgccggcgacctccttaattgcctcaaagcctcgaaggtggcaatcgacgaaggactctccgacgcagaattatcaaacatagaatccaaattgaaattctcgttcccaccggacttacgcgcgatcctccaacaaggccttcccgtatcccagggcttccccaattggcgttcttcctcaacacagcaactacaaatcctcctcaaccttccagcctcctcgattctgcgtcgcgtctccagtacgcgcttctggcacccttcctggggcccagaaccctccgaccctacccgagtcattgcccgcttattacatgatgcgccgccgctcgttccgatttaccgccattgttacattccctcctcccccggcgccgccgggaaccctgtttttcatgtcgacaacgacggtgatgttcgcttgctcagctttgacgtggcgggattttttcgggagtttctggcgccggggacggaggagccggtgtgggcggcgacggcggcgaggagggtgaggttctggtcggaggtggcggacgcgcaggggggggagctaggcgggtgtctggagagggtggtgtggaaattacgtgagggagggtggacggaggaggagatacgcgagatgatgacggtagaagagaagaagaagaataaattgaaattgaaggacaaagaggcgttggagtggcacgtgagagcgttgtccttggttttgctgcgtgggggctggagcagggaggatgtggtgtactcgctcggtcttgttgctgatcaaggaaaatcgtggttggaattccatcaggatcaacacaatctcaatatcaacg

SEQ ID NO: 38305 - DNA, 1101 bp, Glycine max
  Peptide Sequence Number=SeqID_155083
atggaagacaaaaagaaggatcaggaacgcggtttcgtttgtaatcaagaatctcagacaaattatgaacctcagaacaacctacagaatggacagccaaatgtgtctgttggtcctattgccaaaattagtagtcctccaccttcacgtgacaacacgccatactcaaatcaacaacaacagcctccaattgttccatggccctacactcctcaaaatgccacaatgcacttccccacccaagcatcaccacctggtgccttaaatcaatggccgcagtttgcttattcgcagttatttgcacagtcagcatcacccttttggcaacctcaaccgccaggagcaaatgcccctaaattctttcagcccttcactgatactggctttcgaggaggaccttcctcaacaatacagacaccacttcccaatatgtgttacaattacacatttcctggctttccaaattcttggaatccatcttcttacatggctcagctgtaccaaatgcagcatccttatgttttcagttttcctggtgcacctaacttttcttcagcaactcctaaggtgcctgattgcttagcttccggagagcattcttctcaaaaaggaattatgagaccaccttcaaaactttctcagaagcatcaacaactttgggaagctcagtcagcggagaatgttaagctgtggagtgtgataaataaattgcaagctgaagtttctgatcacaaggatcggctgaagaagcttgaagaagaagtatcctcattcaaaaaggaagcagaagtgctcactaacaaagttattgggacaatcccgatattaacagagcaaccaacaaagagagggagggctaagcggtcattggccttggtggatgcatcatatgagtctcatctcccagctggtggtaaaaagcctgcactaagtaactctctgtatcagagtaaatcaccctttggagctgttaaatcatccatttttgaaaaagttatccttaaaaaagtggaaaataaagaaataactacccgttccaatactaaaatggtgcagcatgaaagcaatgttaaagatggtgagctgcaacacccagattaa

SEQ ID NO: 38306 - DNA, 669 bp, Glycine max
  Peptide Sequence Number=SeqID_155084
atggcattagatcactcatccgtcaaccaacccaaatttgtccatccaaacaatgaccttgagcaacaagaagccctagaggttgaaacgaaggactttgactactcaaagcgatctcaatggctacgtgctgctgttttaggagccaatgatgggttggtctcaacagcatcactaatgatgggtgtgggagcagtgaagcaagacatcaaagttatgatcctaacagggtttgcagggctagttgctggggcatgcagcatggccataggtgagtttgtgtcggtgtattcgcaattggacatagaagttgctcaaatgaaaagagagaaagaaagggacagtatagatcaagatcaggaagatgatgatggtgatgagaaagagaaattgccaaaccctatgcatgctgcagcagcatcagctcttgcattttcagttggtgcaatggtgcctctccttgcagcctctttcataagggactataaggtgaggctaggtgtggttttgggagcagtgagtttagctcttgtggtgtttggttggttgggggcagtgttgggtaaggctccaacatttaggtctattgtgagagtcttgcttgggggttggctagccatggctattacttttgggctaaccaagttaattgggtcaagtggtctttag

SEQ ID NO: 38307 - DNA, 849 bp, Glycine max
  Peptide Sequence Number=SeqID_155085
atgggttttgctgtgcctagttgcctaatgatatgtttggaatggtggtggtacgagattgtcactgtgctggctgggtacttgccacgtccaacactggctgtggctgccactggtattctcattcagacaactagcatgatgtacacagtcccaatggcacttgcaggctgtgtttctgccaggactatactacactttgtattcattgatactcctcctaaacctagggagaggtatttagtcaaatttttacatgctcacccaaatgtagggaatgagcttggagctggaaaaccatacaaggcaaagctagcagcagtggttgccttaggatgtgcttttgtgataggcttcatcaatgtgacatggactgtgattctgggtcaaagatgggctgggcttttcaccaatgatgagcccgtcaaagcgttggttgcatcagttatgccaattatgggcttgtgtgagcttggaaactgcccacaaaccacgggctgtgggatccttcgtggcatggcccggcctggtattggggctcacataaacctgggctctttctactttgtgggcaccccggtggcagtgggcctggcattttggttcaaggttgggttcagtgggctttggtttgggcttctgtcggcccaggttgcatgtgctgtgtcaatcctctatgttgtgttggtgaggacagattgggaagctgaggctttgaaggctgagaagctcacaaggattgaaatgggtagttgcaatgggcttaggaataaggaaaatgagagagatgaagaaagaaaagggttgttggtgaatggaaatgggaacaacaaagatgacatttgctaa

SEQ ID NO: 38308 - DNA, 1242 bp, Glycine max
  Peptide Sequence Number=SeqID_155086
atgggggttgtagaaggaagggggttggaaatgagacaatggcttttcctccgaagattctctctgtggtcgatgaagaaggaacctgacttagaatccgcactctcacgcaatcgccgttggatagtcaacaaccaaatcaagaacatcatcctccgctaccccaacaacgaaatccccatccataccctccagaacaagttcaaaaccctagatctccaaggcaaagcccttaactggctctccaagtacccttgctgcttccaaatccacgacaaccgctgccgcctcaccaagcgcatgatgaacctcgtcgcagaggaacagtccctcctcgattccctagagcccctcttcgctcgcatcttagctaaactcctcatgctatccctcaccaagagactcaccgtcctcaaaatcaacgaattcaaacgtagtttcggcttccccgacgattacatcctcagaatcgtccccaaataccctaatttgttccgaatcgtcaacgaaagcggcaggagaagctccatggccgttgagctgctgcattgggatcccgacctcgccgtctccaccatcgaagcatcggcgaagaagctcggcactccgccgcggttttcgtgctctttgccgtccagttgggtgaaatcatgggagaggtttcacgaatttgagtcaattccgtacttttcgccctattcggaatcgagagggttggtggagggatctaaggagatggagaagaggaatgttggtttggtgcatgagttgttgtcattgactctttggaagaagttttcaattgttaagttgggacattttaggagggagtttgttttgcctgataaattgaatgtgttgctgctcaagcaccctgggattttctatgtttcaaataagtatcagatttacactgtgcttcttagagaggcctatgttgggtctcagcttgtggataaggatcctttggtgattgtgaaggacaagtttggggagttgatgcaggaggggcttcacgagtacaatcagcggcggtgccaacttaatgttgaaaagaggaggaagaaaggggttcctttggttagtgtggatgatggtgcaaggggtagaaggagaagtcgccaagttgttgatgatgatgatgatggtggtggtggtggagatggtaaggtgggtaggttgtttgaccctgaagaaagaaaacggttttacagagttctttttgacgatgatgcttcttga

SEQ ID NO: 38309 - DNA, 418 bp, Glycine max
  Peptide Sequence Number=SeqID_155087
ttcctttctgtgcaatggtcttgcggcaagcaacacagctcgtggcaatcaccgatggttggtggcggtggaggaggagattgggggtgttggtggtcttgcgacaagtaaccacaactcgtggcagtcaccgatggtcggtggcggtggaggaggaggttgggggtgttgggtgagggtgaatgtcatgttcaatgctgagattgatggttcgaagaacctaggggaattagcaagtggtgactacctagcatttggtgcactcatttggcacagggaactctcaggcctcactttgctactcttgatgggttttgagactatactttttggagttgggagcttggagatcaatatacgttgtaccgagcctttatctaaggaggatgaggatgatccttccaaggatccgccttag

SEQ ID NO: 38310 - DNA, 858 bp, Glycine max
  Peptide Sequence Number=SeqID_155088
atggccccgaaaaagcttcccgcaaaaaggtccaagaaggacaccaccggagaaggctccagcactgcctcgcaagctgacatggacttcaatcggcaccaattctggagtgccaagcatcagcaacactttgagaccatcaaggggtggtcattcgtcagagaaagatgggtccagctgagcaacgatgagttctctgactttcaggaggagatagcccgcaggcactgggcaccacttgtgacacccatggctaaattcgacctggagatactcatggagttttatgccaatgcctggcctaccgaggagggagtcgaagatatgcgctcctgggtaaggggccaatggattcccttcgacgcaaacgcccttagcctatacctaggccacccattggtcttggcagagggccagcagtgtgagtacaaccagaggaggaggcaggtctctagctttgatgaggaggccattgcccagctattgtgcataccggggcaagatttcacccagaccattgtagggagatgggtgagtgtgcacgtggctcaactgatttctgatgccatttatccgtttgcagggacggcacctatgagacaccctatggactcggagaagtccaacagggccctagggtttcctgctctgattacaggcctctatcagttctacagagtgcctgtcgcccccagcaaggtcatctggtcgcccattaccagagccttcatcgagaagtactacaccccaagtaggcgcagggcgaggcaccacagcagcctggagacggccagccgtaggcaaccgatgcatcaccatcacccccgaagtccacctcagctcacttatggaggttag

SEQ ID NO: 38311 - DNA, 228 bp, Glycine max
  Peptide Sequence Number=SeqID_155089
atgtgtggtacaacactgattgtccaggacaaaaagctccaccaacatgggcccctatggctgaaaattgcaattgatgtcgcacgtcaccttagctatgtccactttgaccatgctggtcctcgtgggaacctcaaaccagcaaatatgttgttagatacagatgacttgaatgcacgtgtaggactccttcacagatttatgactcaggctcgtactatttattga

SEQ ID NO: 38312 - DNA, 1050 bp, Glycine max
  Peptide Sequence Number=SeqID_155090
atgatggaaattgcgaaccactactacttgcctgaacttggaattgaggatccaaccttgtttgatcaatacccgatggattcatttgcatgtccactcgatgactttgacttcgagtctttctccgggtccccagagagcaactcctcttatcagttcaactccgaaagcacaccaaattgtttccctgctgaaagtcctgatcagtcttttgtccctgcaagaccaaccaagaggctcaagacattcaatacctccaacacttgtgccagtgacataatttcccacaaggtttctgcctcttcatcctcccaagttatttcctttgaccacttcaatgccccatcagatgcttcttccctgcaatttcatcgaaacctggacttcgatgtgaagccgaaaatcgagaaagcgtctagtgggaacatggattttgcagctttcgtttctcacggttcgtatgtggacaaaacattcctaagttctgatacgaatcaggttggaataacctctaggaacccaatccaagctcaagagcacgtaatagctgaaagaaaacggagggaaaagctcagccagaggttcattgctctttccgccatcctccctggcctcaagaagatggataaggcttctgttttgggagatgctataaagtatgtgaaacaactacaagaacgtgtgcaaactctggaggagcaagcagcgaagagaacagcagggtcgagagtgctggtgaaaagatctattctctttgctgatgatgaaaattctgacagccactgcgagcattcactcccagaaatcgaagtcagagtttctgggaaagacgtactcatcagaactcaatgcgacaaacacagtggacatgctgcaatgatactcagcgagttagaaaagcttcacttcattgtccagagtagcagctttttgcccttcggcaataacaatactgatgtaactattattgctcagatgaacaaggaaaactgcatgacagcaaaggatctcctaggaaggctacgacaggcgttgaagcagttcatttga

SEQ ID NO: 38313 - DNA, 525 bp, Glycine max
  Peptide Sequence Number=SeqID_155091
atgtcctgcttctttgagttccaagagaacatgtgtgagcctaaggaaaaaacatattcaatagtgctcttcatgtcatcaaggtttaaaccagattctaaattgagtttcaagtacttaagtgctctctttgctactacaaaatgtaacacacttagacttttcataaatgttgagagtaagctggctgcatacatactagggaaagcatcgggtggaggagttataccaattagtgcagttcttgcagacaaagatgtgatgctttgtatacaaccgggacagcatggaagattttttaaaacagggggaccaaatgtctctattaaaatggaaggatcaaaattacggattgagcaaaatagggggaccaaaactgcatttaagcctttgttttattttgggttagggatgttacttctgttcaagttgataggatcatgggacaaaattagactactccatttgcaaaagctatctgtgaacagaaccatttatatttccaaaagagaaacaattgactga

SEQ ID NO: 38314 - DNA, 864 bp, Glycine max
  Peptide Sequence Number=SeqID_155092
atggacgacgcatcagaagccagctggttatctgatttgatgttgaaggaaacggaggattgcaacttgttccgacacagtcaccttgagacgttgctcgacgatgatgacgagttactttcgcatgagatagcaagtgcctttgagaacttgcaccaacctttgtattcggagacttttgaaaggtccaccaagcagcccaaaacgaatgcctcttcctccccttcttctccaacctccaagattcttctgtctttcgacaactcctccgattctgctgccttaagcccaaatcagatcaagaacaaaggtgtttcagtttcagtttcactaccacaaacccgaaaacgttcatcagaaaaccacaactttcaaactgaaagccccaaaggcccaagaagctacaagtccccatcttacgctcgggatcacatcatcgccgagagaaaacgaagagagaagctcagccagagcttaatcgctctagctgctcttattcccggcttaaagaagatggacagggcatcggtgctgggaaatgctataaagtacgtgaaagagctgcaagagcgtctgagaatgcttgaagaagagaacaaggtgatggtgaacaaagcaaagctcagctgcgaagacgatatcgatggttcagcttcacgtgaagatgaagaaggcagtgaaagactcccccgtgtggaagcgagagtgtcagagaaggacgtgctccttcggatccactgccaaaagcagaaggggcttttgctcaaaatacttgtcgagattcaaaaattccatctctttgttgtcagtagcagtgtccttcctttcggggattccatacttgacataaccattgttgctcag

SEQ ID NO: 38315 - DNA, 144 bp, Glycine max
  Peptide Sequence Number=SeqID_155093
atgaatgcaaaggcgcacacggcacacggcacacggcacagggacatgaaagaagtactagacactgaattcatggttgtgagagatctgaacatctatatcagagacaggagagagagcagtgttcagaaagagctagggtag

SEQ ID NO: 38316 - DNA, 435 bp, Glycine max
  Peptide Sequence Number=SeqID_155094
atggattcagcactattcaaacaatttgttgtctccttgagatatctctgcaataacagacctagtatatgctatgcagtttgtttgatcagtaggtttatgcatgaacctaagcaagttcatatgacaactgctaagagagtactaaggtacttaaaaggaattcagaactttggagtaatgtcccctaatgaagcaaaacaggaagaggaagaactgattggccattcaaactttgattggtgtagagacaaaattgatactaggagtattactgcttgtatctttgagttttctggtgcaccaatctcttggtgctcaaagaaacaaccagtggtagcattgtcctcttgtgaagcagaatatatagctagagcatttgctacatgccaagcagaaacaacccagactcacaaggaagaagcaaacatatag

SEQ ID NO: 38317 - DNA, 1830 bp, Glycine max
  Peptide Sequence Number=SeqID_155095
atggagccggccaacatcagggtggacatggtcaaggttctacgttgtgatacctgtggggcatcagggtttgacaatgaactcgttgtttgtcacaagtgcaatgaaggcgcagagcacacttattgtatggatcctgatgagcagtcaaaattagaagcaaaaccggaacttcgtaaagattggacatgtcaagagtgcatgccgagggaaggtactaacaaattagtgcaagatgaagttgaagtggctgaaagaaaaaggaaggggcatctatttgaaagttcaacagactctgaatctcgtaaaggctcaaaattaaaatctagatcttcatgtactggtaaaagtggggaaaatggtgctgagttattatctagaagaccactagtccctgttaaaaagtttaaattgaaatcggtaaacaaaatactttattctgggccggaaagatctagtggtgaaacttcatttcctggacatagaatactggtaagtaatcacgacactcacaaagacccaaactctccaaatgcaaagaagaaaaatgaaagccagcatggtgaacagcccacaaaagctggtacatcaatgagcttgtctgaattatggacgaatcctgattttgatggaaatacctacttgagaaacctggcaagcaatcacaacactcacaaagacccaaactttctaaatggaaaggagaaaaatgagagtcagcaaggtgaacagcccacaaaagctggtacatcaatgagcttgtctgaattatggacgaatcctgattttgatggaaatacctacttgagaaacctggcaagcaatcacaacactcacaaagacccaaactttctaaatggaaaggagaaaaatgagagtcagcaaggtgaacagcccacaaaagctgctacatccatgaccatgtatgaactaaggactgatcctgcttttgatgaaaagacctacttgagaaacttggtgcatgttgaggcagcatatctttcacatcgtgttgtcccaaaggctgattacaaatggctaggcaagtttcagatacacaacagtgaggggattgcaaggacttgggatgggattcaagctcacttatcaaattgtgcatcagttgaagttcttgaagtggcgaataggctttctgagattattattatattggaggaactacctcgactgaggacttggccatctcaatttatgagaagtcaagtcactgaaaatgatatcgctctctacttttttgcacatgattctgatagctatatatattatgaacaattggtgaattacatgatgaataatgatttggctctgaaaggaaatttggatggggttgagcttttaatttttccatctaacattctgcctggttattcccagtgttggaatggcatgttcttcctttggggtgtattcagaggacaaaaggcgaataactcagccagcacaccagtgtcaaattctctcaagctaaaagatggagatgctgcaacaattttgccatctgatctcaatgtttatcctcaagatggagatgccgtggcaataattgatgaaattcctgaatctgaaccttcaggagacacagttttgctggttggagagaattccgatggtaaaggaggagtggcagatgcagagcatgatgcagttatagaagatattaatgtttcactttggcctgaaagtgaaacacaagaaaatggttctgttgggattgaggactctcttgtaccactttcaactccagattcagacgagttgcaagctgcgagtgctttgttgttgctcgctgagggtttcataaagttttga

SEQ ID NO: 38318 - DNA, 591 bp, Glycine max
  Peptide Sequence Number=SeqID_155096
atggttgttaaggaaggctataggtggaaattggttggtggtgcaaatattgcgttatggagtgagtcgtggttgaggaatgataagttatggagcaatatagatgtgactggtttctcagttatccacaaggcagatgaattttaccaagattggtaccatgcaaaggaggtgtgtggaagtgttgtgagggagtctaatgatgtaggagtgatggaatccctacctataggctacacgaaatgcaatgtggatgctagcttcaaacaacactcaaatttaactagagcagggatgtgcacttgggatcatcatggtaaaattattgtgattagaactaattttatagagccttgtatgtcagttccggaaggagaggctagggctcttaatgcatcaattagcttcacaactgggagggggtaccaaaatgtcatctttgtgattaactacaagaccataatggataaaataaaaagcaaagcagcgaacaattctaagttgggtcacatatgcatagtccaacattgtagaagtttgatacatagtaatcatatatgtcattggattttccaagagacaagtcaatga

SEQ ID NO: 38319 - DNA, 489 bp, Glycine max
  Peptide Sequence Number=SeqID_155097
atgagcaaaaaaggaacaatagcagtccatatgaccatcgccggtggccaaggtgcccacgctagcggccaaggtacgacgtttggagaggaaggtttagagaaggaggcacataaggaaaagaaaaaggatgtgtttcttgcttgctgccaatgggttcaaaagggagagtttccttattcagttaatgatataagcattgaactcattccaaaagtggatcacccgagaagtggttgggcctattcctccaagaaaagccttagacaaagtaatcttctctctccttatttgttcatcttatttgttgagggtttttctactgttatcaaggatgcaaaaagaagaactggacttcatgtgatgatagcttcttgtaatatccttgattttcaacttctcagcggctctcacactactacacttcacgcgatgacacttcctcaacatctttgttggtcaaaaccctctgttggtagccctttctaa

SEQ ID NO: 38320 - DNA, 103 bp, Glycine max
  Peptide Sequence Number=SeqID_155098
gtatcgtgtttcagaggttgagtggatacaagatattttgccaccagaaggaacaagtgaaagagagactggcaaggagattcctaagctggctggggcttaa

SEQ ID NO: 38321 - DNA, 1161 bp, Glycine max
  Peptide Sequence Number=SeqID_155099
atggcatcttcatgggaatattttggggagattgcaaatgtggctcagctaacgggcatagatgcggtgaggttaattgggatgattgtgaaagctgcaaatacagcacggatgcacaagaagaattgcaggcaatttgctcagcatctgaagttgatagggaatttgctggaccagctaaagatctcggagcttaagaagtaccccgaaacccgggagcctctggagcagctagaagatgcccttagaaggtcttacattttggtcaatagttgtcaggaccggagctatctttatttgctggccatgggatggaacattgtttatcagttcaggaaggctcagagtgaaattgacagatacttgcaccttgttcctctcatttcactagtcgataataatcgagtcagggagagacttgaagttattgaaaaggatcaatgtgagtatacattagatgatgaagagcaaaaggtgcagagtgttattttgaaacctgagcccgaaaaagttgatgctgtggtgctgaagaaaactccttcctgttcttaccccaacttttctttcactgaagcacttaaaaaagaaaatgaaaaacttcaagtagagctacaacattcacaagcaaatatggatttacatcagtatgaattcattcaacatttactagatgtcacagaagttgcagctctttatcattctgaaaaaagtcacaagacagtagagtacagtgactacagtttttctgatgccaatggtgacaaaggtcattcttctaatgaaaaaatccacgaaaagaatgatactcattccacatcaagatcatcagtttcagaaaaggatcagctatcaactggaggctcatatcattgggaagattggcatactgatttacttgcctgttgttctgaaccttgtctttgtataaagacatgcttctatccttgtgggacattgtcaaagattgctactgttgcaaataacaggccaatatccattgacattctatgccaggggggctttattgatgattttctttctcatttgatgtgttgttgctgtgcccttgtgcaagaaaggagagaagtggagatccgtggtgttgaaggtcctgagaagaccaacacaagacctccaccctcacagtacatggaatcataa

SEQ ID NO: 38322 - DNA, 1329 bp, Glycine max
  Peptide Sequence Number=SeqID_155100
atgtgtgtgacaggctactaccaaaagaagcctctctatgtgttgattgacagtgggagtacccacaattttctggacattgaggtggccaagagattgggttgcaaaagtaatgcttttgattccctgagtgtggtggttgctgatggcacaaagttaaacgtgtctgccgtctggttggtttccttgggtgatattgtatggaattttaataagtcacagatgaagttctatgttaagggaaggagacatgtgttgagaagggcctctactggattgaaaacagttaagagccaacaattggggaaggctatgtcaactggtgttcatttgtcaattttgcaagtatgtgatggacaaaggggtcttctgaactcacttacaactcaagctgctgataaagaagtccctcctactcttgccaagttattggatgagttctctgatttatttcaagaacctagtgggttacctcctagaagacttgtaagagaccatacaggtatgctaaacaacataaagatgagattggtaaaagttggtgcgggaatatttgtcggctgggatcttaacaagcatactgttaagaacaagtttccaatccctttagtagatgatttattggatgaattggtcagttctagcattttctccaaaatcgatttgaggtcaggatataatcaagtgagaatggatcctgctgatgtgtataagactgcttttaagactcatgctgggcattttgaatacttagtgatgccctttggtctcattaatgcacctacaacatttcaagggcttatgaactcaatttttaaggagtttttgaggaagtttatgctggtgttctttgaagacattttggtttatagttgttcattggaagaccatttgctgcatttacacaaagttttggcaactatgagggcaaattccttgtttgctaagaggagtaagtgttattttgaggtttctaaagtagagtaccttggccacttcatttctaaggagggggtatcaactgatccagttaaagtgcatgcagcagaacagtggccactacctaaaactttgaaacaacttagaggcttcctggggttagctggatattacagaaggtttaagaagcttactgagactccagttttggctttactcgacttttcaaaaatctttgtggtagaggtggatgcttcaggtttgggaattggagcagtcttaatgcaagatcaccaccctatagcttacataagtagacacttgaatcaccaacaacagtcttactctacttatgaaaaggagttactggctatggctatggctgtctaa

SEQ ID NO: 38323 - DNA, 465 bp, Glycine max
  Peptide Sequence Number=SeqID_155101
atggacttcttgtttaagcccccccaaaaagcaactcagcctatgctcctcactcatatccaaatgagctacaatagcattaaaagcttcatgttagacgtgttccgcaagaataagaagatctctcacctcgaattgggtttcccccctttgaagaatgagttgtgcccttactattattatgtagaaggtcctgcatttgttgtgatatcgacaaggctaacgactgtgttagggaatcgtgaagagtttgttcatcgaagctgccatctccatgaatctttcatcaatcttggaactgagacgattctccacgcaatcttcaatttcatgctcaagagcacgatttcgtgtagcatctgccatgtctggtcacacttggaaggttataggctgataccacttgttaagttgttcacctggtggtggcccaacgaggagagagtgaaagagaagaagtcctaa

SEQ ID NO: 38324 - DNA, 1422 bp, Glycine max
  Peptide Sequence Number=SeqID_155102
atggagtttgatttttcaattgagtataagcagggacatgataatgtagttgctgatgccttgtcgcgagtggaaccagttgcttgtcaagctctcgcagttcatcaggtggtttctgaattggtgataaagattaaagcctcttgggattcagatcctgcagttcagaggttgattttagaattacaagcaaactctggttttcacaaacattattcttggaaggatagagggttaatgaggaaagaaagactagtattgggtagagatgatgctttaagacaagatattcttctgcattttcatgcttctgccgctgctggtcactcaggaagaaatgcaaccttagaaaggctcaaatctatggtttattggaaagggatgagtaaagatgttagagcttttgttcagaaatacagtgtatgtctgaagtgtaaatatgagaccaaggcttttcctggattgctgcaaccattgcctatttcagatctgatttggcaacacattaccatggattttatagaaggcttgcctagttcctttggtaagcaggtgatttttgtagtagttgataggttgagcaaggcagcccactttatggctctttctcatccttattctgctgctgatgttgctcaatccttccttgatcatgtattcaagttgcatggatttccagattctatcaccagtgacagagattcaatatttctcagtcagttttggcaggaccttatggcttttcaaggtgttcaggtccagctctccacagcttattaccctcagacggacgaccaaacagagattgttaacagctctattcgagctactccttatgaagtggtctatggacaaccgccacctgtgaatctgccttacttagtaggagcttctaagattgagttggtggatagaagcctcttgaggagggaggagatgttgaaactcattaaatttcacatgaagagggcccaaaatagaatgaaacagctagcagataaacatagatctgagaggcagttcagtgtgggcaatatggtctatgttaaattgcacccttaccggcaaatttccgtagttgccagaagcaatgtgaagttgtcccccaagttttatggcccatttcaggtattggaacagattggtgcagtggcctacaagatcaagcttccttcgagttcaagcatgcatgatgtattccatgtctctcagttgaagaagtatgtaggtgaagcagtaacttcttcgagtcttccaagttcagtagaaggagatcctctaatcaaagaacctgaagctattttggatcgcatgacagtaaagagaaggggtcgagctgttacaaaggtcctagtaaagtggaagcatagcttgctagaggatgcaacttgggaatttttctttgatgttagacataaatag

SEQ ID NO: 38325 - DNA, 231 bp, Glycine max
  Peptide Sequence Number=SeqID_155103
atgaaaaggattatgatggggttaccttgttcgttgcacgcgatgaagatgatggtgccggtttcgtcaccgatgaggcactcgctaacctcctgcaaagtgaacgacgtcgttggggtcgagggaggagaggagggaggggtgacatggagggagggaaggggaaagggttttgggtttggtttgagatatatcaaggcaaaaggagaggaatgggcacgaggggaatga

SEQ ID NO: 38326 - DNA, 855 bp, Glycine max
  Peptide Sequence Number=SeqID_155104
atggggaaggtgtcgctgaaagagaagggttggagggttaagggtcggaggcaggttcggagctccgggaacaagtacctgagacccggagccctggctcagcttcggtgctccaagccttcaggttcgggtggtggaggtaagtgttgctgtaccgatctcggaaaaaagagagtggcggtgttgcactccagaaagagtggtggtggttgtggcggcggcggcggtggttctgtacagcagcggtatgtggagaataatattagggttttcgataagagtcctgtgatgttgtcgccggtgaatttggtgaaacacaacagtggtttcgttgggacccccaaaacccctcgcctcgacgattcgctgtcggaatcgaagcttgagtctctccccatggatttgttggttaaaattctgtgccacctgcaccatgaccaactgagggctgtcttccatgtttctcaaaaaattagaaaagctgttataattgcaaggcagtttcacttcaattatactactccagatcgctctcggcaggagatgttaagtacaatgactcctcgtcctactgagcattggccttttttgtgcaagggtgatgggaagggagttaggattccaagcccacacacacctaaagcacctagacatggccctcgacctccttctcgcctaaaaatttcagagatgaggcaggttacagctgttcttttcccagagtcagcattcccttctcattgcttggtgccatcagttatatcaaagcccctatgcaaatccttggcttcgaatagagttctcttctatgaagatgaactatgtcaggcagttgctcagaataaactacgctga

SEQ ID NO: 38327 - DNA, 165 bp, Glycine max
  Peptide Sequence Number=SeqID_155105
atgaaacatggagctagtcaagctgctatttcaaggttaggagtgaagcagcacagaattaagaccctgtataaacaacaatatgcagcaacaaaccattttggaaacaacaaaaacatagcatgcaaaataaccaatcaaggcagaacgaagaaggcagaataa

SEQ ID NO: 38328 - DNA, 180 bp, Glycine max
  Peptide Sequence Number=SeqID_155106
atgactagacctactagattctcaatctcgcacttagggggtgaactaagcacatcctcaaggaacacacaggacttgctaagcttgactatcgtctacaggcaacaaggatcatgcatacttgggtacttcctctcgaaacaccttaacatgattggcaagggtgaagatgagttctaa

SEQ ID NO: 38329 - DNA, 645 bp, Glycine max
  Peptide Sequence Number=SeqID_155107
atgacggcgtacaccaccacacctgaccacaacattcagtcaacagctcaaggcatgacccagaccctccgcgccagcgaacacctccactgtgtgatgaatagcgacggctgctcccctgattggtgggtgcagttatacatgcccccttacgcctacacccgatcgatgctccatgagctcagatgggcagggatttcattggagaagaagccatgtacaggacggttttccaatggcagaatccctttagactttttagctgaaatacttggactaaaagaggccttgccacactttcttgatccaaatctggagattgaagacctcttaactgagtcaatgttgtcagtggaggatcaactgaatatgttcaacgagtacataggaaaactaaaggcagttgtgggggaagcaaggacaactctcattctagcaaaaagcttatttaccatcagcatgggaagtaatgacattgcaggaacatatttcatgaaacaataccggagagatgagtacaatgttgaagagtatacaactatgctagtcaatatatcttcaaattttctacaggaactttataaatttggagcaagaaggattggagtactcaacctatctctaataggatatgggccactgtaa

SEQ ID NO: 38330 - DNA, 195 bp, Glycine max
  Peptide Sequence Number=SeqID_155108
atggcgagagatgcattaaagtttcttcatatttctcccaaaaatagtgaacatatgacctatggagacaacaacaaagatgcttgtaatcgattaccagtaacaaaacttctgaaattcaaattgaaaagtcatgtcccttcaaaatataactatgtaatcgattacgagtatcctgtaatcgatgaccagtga

SEQ ID NO: 38331 - DNA, 944 bp, Glycine max
  Peptide Sequence Number=SeqID_155109
atggaggtggagaaagctagcaactcgcaattggacaaatttatgagtgttgccaccatccaccagtattgtgatgttgtgatgcaactcagaggattcagagagtcttcctattctgcctccgaaggtcattgggttcctagaagaggtggtcaaaacaagaaaggaggtcatttaattctaaggaagacaggcatccttgacatcgcattaaggctaagttgtggggaatcacttgatagtggcgttggaggattcaaagagtcttcttgttctgtctccgaaggaaaggaaaaatccatattgtcatcagcaatgaacaaatggatttgtggtttgcatcgatactcgacgatgcaagaggagggatcacagtgggcagagcatagtgggttgaaggtggggaaaatggatggttatggatggagcggcgatgatcctggattgaacctcgcgatgaagttcaggaatgagtctagagataaaacaattgagaagaaatgggggtgcaagacctattgtgcggttcgtgagccattcaaacgaagcatgattctaaggcctataacatggtcgcccaagatgtcaagaacccattacgtgacatccattgataccagcatagagttgggccttccatgtagaagggctcaaccgccaggcactcattgtcggggatgcattggtaattatagaactaggagatttttaaaatccatccctgtggatcctggtcataaaagcgcgggacatctaggttcatatgaggatgatggggtagttaaggtggaggaggaggtgtcggtggggattttggtgaagatgagaatcatggttctgagtgaaatatgtttgaccttgtctaaggcagttaacaacctccttgagccgttctgtggtggcctgacaagtgttatgttccaacatggcggaaaacagggcag

SEQ ID NO: 38332 - DNA, 918 bp, Glycine max
  Peptide Sequence Number=SeqID_155110
atgaatttactctatcaaaaaaagctcctttctcgatggcttatagccattctttggtgttctattatagcccccatctttcaacatgtttctgttatgagcctaccaaacaatgagactgtgccagcggtgatggtatttggggactctatagtagatccgggaaacaacaactatatcaccacacttgtcaaatgcaatttcccaccatatggtagagattttggtgaaggaaatcaaccaactgggaggttcagcaatggcttagttccatcagacataattgctgcaaaacttggagtcaagaagcttttacctgcttatcttgacccaaatttgcaacttcaagatctcctcactggtgtaagctttgcctcaggcggtgccggatatgatcctctaacagctgaattagtgaatgtgatgtcattgtcagatcaattagacatgttcaaggaatacataaagaagataaatgaagcggttggaagaaacagaacgacaatgatagtatctaagagcatatacatagtatgtgtaggaagtgatgacattgccaatacttactatcaatcaccttttaggagtgctgagtatgatattccttcatacacggacttcatggcttcagaagcctcaaaattcttgcaggaactttatggactaggagctagaagaattggagtatttggtttatcagttatagggtgtgtgccctcacaaagaacactcggtggaggcttgaatagagcatgcttagattcttctaaccaagcagcaatgctcttcaactcgaagctcaactcccagatggttgtgcttggaaaaaagttttcagactctaggcttgtttatcttgattcttacaacggatttcttagcatgcttcaaaatcctgctaaatttggtaatcactaa

SEQ ID NO: 38333 - DNA, 315 bp, Glycine max
  Peptide Sequence Number=SeqID_155111
atgaggcccaatattggtgatggacctttcattcacacgatgggtatggtggaaaaagaagccatggggaaggtgggtcgtccaacaatggtagtggctgtaataagaacatccaaaacatctaaaaatccaagctcaatcctttggacgaggggtggatatggaagaattgagagtaaggacaaatgccttgcaaatggagttaaagataatcaaatactatatttttcttttgcttttggtcatggttgcatgttcatggttggtttaggggtgttagttgctaaattgaggaatgtatttgacatattataa

SEQ ID NO: 38334 - DNA, 556 bp, Glycine max
  Peptide Sequence Number=SeqID_155112
atgactgcagctgtgacatacatagattctagtgctgttcaggctttgaaagacttgtatcaggagtacaaattacgggacattcagattgcaatatccaatccaagtccagaagttctgcttaccttgtctagatcgggtctggtggagttgataggcaaagaatggtactttgtgagagtacatgatgttgttcaagtttgcttgcaacatgttcaaagcttgaaaggagcatctaacagtccacaagcaccattctcttcagtagagaacaaaccaagtttgtttgcacgattatcaaaagagagactggagaagctttcaattaccgacttggagtctggtcacgaagcttcggccgtgaagtttaaactggttattgaaaaggtcagcggatggcccactggggacagtggattccggtgtttaagttctgccaacaataccattacatcaggccaatacatcacaggccctcacactctcatctcccctaacagtgtcttcaagttaggattcttcagccctcaaaactcatcaaattgctacccttcaa

SEQ ID NO: 38335 - DNA, 969 bp, Glycine max
  Peptide Sequence Number=SeqID_155113
atggtttatttgtgtctcaactatataaataacaactttggaggcctcaaggttgccaaagatgcaggctttgacaaagtcatttgtgaatcagatttggcttccactatcaagttcatcacggatggagtttctgatttccactcttatgctcctctgatcaaacatactttacaacaagacgatgcttgtgttgattgcttagttgagtttggagctacttcgcataacggggatcttatggatcagttctgccataatgaagctatgcatgtcgtcattgatgagggtttcttgggcgaggaagaagacaatgattacgaggacctttacaacgacgtcaacaccaaggaagtgttccttcaatcattgcacaagaacgacagttcggggttccaaaatagcgacgttgaagaaaagaagccttcatcaccgtcgctggttttggatgtcgtcggggttttgatttcgggtgttggtggcaatggagagggtgccattggtggtggaggaagagaggttatggaatctagggtttcggggagggttgatgggtttcaaaatcaagggtttattgggaatgagatgggtgccaaatgtgggattagggttgaattagggaaccaatctaggaatttgagtgaaattaaggatcagggtgggaatgatggtgttgtcaagatggtgttggtggtggtggaggaagtggggaatgctaatagggtaggtggaaatggtgttaggaatagtgtgattgttgttagtcatgttaatactggaggagttggaggtgctattagtgatggtgttgttgttgttggttctggtggtactatattgtttgtgggtgattcgcattggtggactattgatgctgagcttgaaattgaacttagtaagtataagcctatgaaggaagtgcaatttttttatgagaaggcgagtgggaagtcgaagggttatcactag

SEQ ID NO: 38336 - DNA, 1099 bp, Glycine max
  Peptide Sequence Number=SeqID_155114
atgaaggtgtctccaggagcctcaatcattgctaagggaaggcgaagcaatggtctatacatcctggaaggatccacagtaattggacaagcatctgttgcaagtcacacaatggaagataagtctaaattgtggcacttgcggctaggccacattagtgagaaaggcttgatagaacttgaaaaacaacacctgctgatgcacacctcaaccagaccttttgagtatgctcatgcagatctatggggaccatctaggatccaaacacatgggggtggatcctatttcttgagcattatcgatgactattcaagaaaagtatgggtctacatcctaaggaacaaagctgaaacatttcagaagtttaaggaatggcatactcaaattgaaaatcagcaaggaaccaagttgaaggtcctaaggacagacaatgggcttgaatttgtctcagaccaattcaatactttctgcacacatcatggaatcaagaggcacaaaatagttgctggtacccctcaacaaaatggccttgcagaaaggatgaatagaaccatcctggaaagagtgagatgcatgcttcttggagcaggtttgcccaaggttttatggggagaagcaacaaatacaggtgcgtatttgatcaacaagagtccctcatctgcccttgaatataaaacaccaatggaggtttggagtggaagtccaacaaattactctaacctaagggtgtttggaaccttggcatatgcacatgtcaaaaaggacaagttggatgctcgagctaaaaaatgtttattccttgggtatgctgaaggagtcaaggggtacatgctgtggaggttaggtcctaattcttttaagctcatcatcaacagagatgtgacatttgatgagacaagaatgggaatgtattctgaaaactcagagtgtggaaaggagaaaactcacattgaggtgaagccttttactgataaggtgcaggaaaacactccgataaatccaattactgacccagacaatatagcagacgaaattggacactcaatttcaaatttgaggagatcagatcatgccattaatgattaccaactggttcgtg

SEQ ID NO: 38337 - DNA, 219 bp, Glycine max
  Peptide Sequence Number=SeqID_155115
atgcttggctatgttcatgcaccgaaatctccttacacattttttgcatcgtctacatcttctgtgtctactctacctgatatgtacatggagcctgtcgtgcaactatatgactcttcatcacccctagagtgctccatttgcttggagaaatggttgctgatgctgaggataaagatgtcatggagttggactcgtcacaagataatgcctagttag

SEQ ID NO: 38338 - DNA, 237 bp, Glycine max
  Peptide Sequence Number=SeqID_155116
atggctgcagcgacacctaatgaggaagacattgatgtgcatcatcttcgacatgcagtggatgactttgtaacaattgctgataagttggacatgctactgaacatgaggatcttcactgaaggaatagaagcctatactgttgttgaagaatgtctgggcatcgcaagacgctacattggtcagccaactgcaggtcacagatcgaggcgaaagcagcgtacaaacgatcattga

SEQ ID NO: 38339 - DNA, 368 bp, Glycine max
  Peptide Sequence Number=SeqID_155117
cgggaggggtcaccgacccgcacggtggccccgcagatgagtgcgacagcgcggtggccgcaacggcggaaccaggagaggacaatgaggtcgaggaggttgccgaggtggagggattcctcggtggggtcgaagccgcaataaaccttgaagggtggcggtgtcaggcacgtgctgtggagtcattcactgtggtgacaaaggcaaaggcaaaggcaaattgtccctcttttgagacaaggaacttgccatctttgtcaatccaattcattagagaaccatttattaccccgggtactaaggtatatgataattcgaaggagactacggcctccaaattgacatgcatgtttagagatcagaagtaa

SEQ ID NO: 38340 - DNA, 330 bp, Glycine max
  Peptide Sequence Number=SeqID_155118
atggagtggttttttcggatttcgcacccgttcgtcacacggaccgaggagactgctgagccgagacatccgcctccccctcatgatgaggagttcatcgagccacccatccccgaggtttcagtcacgtccgatctccctacgcattcagtggttgactgcaaaggatgtcaagggatggctgaggatttaggagcgattgctaaggatttggagtgggtcatcaacctcaggatggtcactgaagacaatgacttatatgacatcatgacttgttgtctgaggagagctagaggtgacgccgcagatggaagtcttaggccgcgatag

SEQ ID NO: 38341 - DNA, 354 bp, Glycine max
  Peptide Sequence Number=SeqID_155119
atgacattggcagcgaagtgtgttatggttcgccgtgaccctttcggaactcctctttaccttggtccctgccgcccaacccttggcctaccccctatctccaagttctccgtcactgtcacttccctaggctctccctccactaacctcaacctaaatgaggagccccacctagtttcccttgccgtctccatcaccccctatgacccctacctagttcctccaagaactttgcgtcgtcgtcgacatctaacactgagtttttcgtggtggttacggtggaagaaaagggttgcaagaggaggaggaatatgggtttgtgcttgtgtttacacaacatcgtttttactttaa

SEQ ID NO: 38342 - DNA, 336 bp, Glycine max
  Peptide Sequence Number=SeqID_155120
atgacgctaactgatgttgatgaaactagtggatcccaacgtggtatcggcgacttcatacattgtggccaagagcacggtgtcgttgatgatttggttaaggatgccatccatggcagcgttatcgatggcgtacataagtcaacgactttgaccattttgtcgttgcagtgtgagttgtgctctaatagttttaattgtgttagtgagtacacacgtaagtttggagttgcttggtgggatctcatacatagtgtggaaggggttaatggaggatggatttcctcagggatggatgaatggactactctgcattttaggctaggatttctatag

SEQ ID NO: 38343 - DNA, 291 bp, Glycine max
  Peptide Sequence Number=SeqID_155121
atggaaagaacaataccattcaccgacaaaaaagaagaatcattctcaattcttgaatgggcaaatttgttgaaagagaaaggtagtctaatggagctagttgatagaagattgggttcagacttcaacaaagaagaggtactagtgatgatcaaggtggctctcttatgcactaaggtgactgcaacacaaaggccaaccatgtcatcagtggtaagcatattagaaggaagaactattgttgaggaagtgtattcagagacaagtgaggtattggatgagaagaggtag

SEQ ID NO: 38344 - DNA, 1572 bp, Glycine max
  Peptide Sequence Number=SeqID_155122
atggatgcatcaggtactcacaggcactatgcagaggatctatggattgataaatacaagccttgttcactggaagagcttgctgttcacaagaaaaaggttgaagaagttaagacatggtttgaggagaggttgaaaccttcaaagggtgcctactgtaacaatgttcttgtcatcagtgggcaggcaggagtcggaaaatctgcggctattcatgtaattgcgtctcatctaggagcagtggtttgtgggtggaacacacctacacctgtaatttggcaagaacatctttataattctggcacagggacaaaatacacatccaagttagatgaatttgaaagttttgttgatagagtacggaaatatggattattgctaacttcccatactggggagtcaaagccttccgtcatacttttaatagatgatcttcccttgactaatgggaaatctgcttttagaagacttaaagattgcttgcacgttttggtgaattcaactcagatacccacagcaatattgttcacggactatggaaatgctgattcagcagattataatgctcgttgtctggaagaactgaagctatctctagagagttctggggcttgtaaggttgcattcaatccaattacattgaatactatgaagaagatactttttagaatatgccaaatggagcattgtgatgtgactgctgagtatgttgatctaattgcaaaaactagtggaggtgacatccggcatgcaattacttctttacagtttttctgcttgaaaccatctacctgctatcgtggagcattaaaagaggaaagtgataaacctgttagatcagatgatggatattccttgcactttggcagagatgagacattatctttatttcatgctttgggtaaatttttgcacaataaaagggagagtggagtttcaacagaatatgatcaagatggatttctaatgcaagaaagactttcaagattaccattaaaaatggatgtccctgagaagattctttatcaagcccatgttcaacctggtccagttgctgattttctgcatgaaaatgttctggattttttgaatgacgaagcaatagatgatgcatggactttgtcttcgtatctgggtgatgctgacattcttcttactaaacttcggggaatgctaagtacttataatgaggcagagagtgttttacggtcagctgctgcatccatagctgttcgtggggtgttatttggaaattctcatccactatcctccaggtggcatgcaattcggcgaccaaagctctggcaagttgagaaagcatcattatacaagaatgaggtggataggctcagaatccctgcctgtagacggtttagttcttatcatatgtcaattatgaccactgagtacatgcccatgcttaaattgcttggaaatggagcatggggtggacatcatgaaccaagtccggaatcattactgaacttggaaatggaagattttgattttgacaaaatggatttagatggacaatctagggagatttctgatgatgacatagaagattggtag

SEQ ID NO: 38345 - DNA, 360 bp, Glycine max
  Peptide Sequence Number=SeqID_155123
atggcaaagcgaaactgcgtcgtcattctgtcatcggaagacgaagaagaagacggtttcatcgttcgttcgttgagttcgagtcacagctataatacgaagacgaagtcgaagtcgaagtccacgtcagcatcctcacgtgggaggaagagggcacgtgcttcggcttctcgctctcacctctccaaactgcacgagatagacttatttggagatgacttcaatgaagtgtttactgggtcaaaggtatccgctgaatttggactgttcctcttctcatcaactactaagattgcttattttacacttgcttgctttagacaagctaaatctgataagattactgatcacgatgcatag

SEQ ID NO: 38346 - DNA, 1540 bp, Glycine max
  Peptide Sequence Number=SeqID_155124
tttctatcagccacagcttgcaactccccaccgaaccgaacctgagctttacgttgccaaagaaggcaccgttttagcagaacaaaaagaaacaaacacaagccagccagacagcaagcaacaaaggtttattgccattcccgtttttgttttcttcggttgctgtgttgttgttctaatgggttgctgctggcattcaagaatagccagggaagaaacggcactgtcgcattgcaaggccaggaagcgttgcatgaagcactttgttgaagcacgacactccttttcatcgtcacactccatgtacattcgctctcttcacaccacagcctctgcacttgttcacttcgcaaacacagaagaaaaagaagaaaaagaaacagtcactctccaccaccattcaccaacaacatcactgccacaaccacttcccacgagtcccgtttcagataatgcattgactgttggattacaagtgttttctttatgtggtgtctcgtggtcctcaggtgtaaaagaggtccacggttgctttctcaaagctgctgatgccggcaccaatgtttctttgctccttgaagttccaacctctgccttttctaatccttgtaaagcaagtaaagtgtacaactatggatggatcttgaatccattgttgcggtcacggttttcgattcgaaagcggtgcaagaaattttttggggctattgctgatgtaaatggtagccactgttccactgtggagagactgtacacattggagaagaagttgtgccaagaggccaagcttgaagacctcaacaacactgtcccatcaactaaccccacatctgagattcataggaaatcaactcttcagcgagaagttggaatacagcaatggcaccaatccttcggcaacatcttcaaggcccacagggattatatccaatctctcacagcttggcttaggctcaaccttcaccactttagcagaaaccctctaaataaatctgctgatgagtcaaagatatacaccctatgtgaacaatggaaccttgctcttgatcatactccggacaaggtcgcgtccaaaggaattaagagcttgttggaagatattcatgccattgtggttcaacaaacggaggagcataaacagaagaagaagttggatgctgcactgaaagagcttcagaagaaggttgttcagcttcaatcaattgagtgtaagcatggctcgcgttccatgtcggaatcctctgatcccaaggaccgtgtcacgaagaagcgcgccaaggtggaacacctgagagcaaaggtggagaaagagaagaccaaacatgaaaactcaatcggagtaacacacagaatgacaaagaaaaatctgcagatgggtttcccacaagcttttgaggggattgtgaggttttcaagtgtgtgtgtggaggtttttgaatcagtatacaataaagccaacattgatgatgtgaagagaatattacctaaagagaatcgacatgtatcattcatccagaatcggcattttttaataaaataa

SEQ ID NO: 38347 - DNA, 372 bp, Glycine max
  Peptide Sequence Number=SeqID_155125
atgcaccttgaaacacccttaacattcttgtgtgaaggtgttggaggtttcaacatgaaacttcgctctcatagcaggaaaggtaaaatgatgcagttcagctcgatcccgaaactgaacaacaagatcaggtttcattttgacggtgctgggttatgggggttgcagatctgggttgagggggtggagggatggttcgccggtgggtttgggctcgctgccagcacgcgatggtcgtggcgtgatgatgcggtggttgtggaaaatcaagaaaaaaaattaataaataacttaactgaaccattaaggtttttaacggaaataggaaaagatgatgtaaatgaaactttcaaaatcttttttaaaggataa

SEQ ID NO: 38348 - DNA, 842 bp, Glycine max
  Peptide Sequence Number=SeqID_155126
tgaaattgctacaagcaatatcagacaaggtagagaacttgaattggaaagttacacaacgttcctgcaacgtaaaaggggatagaggatttgataacaggaaaatttcaagggatcaggctcaaatcataaggaatgtcacgtgtgattgcacttctaacaatttcactacttgccatgtgacatcaatctctctcaagggtctcaatatatctggacctatacccgatgaattgggaaatctaaatcgacttgaaatacttgatctcactcggaataatttcaatggctcaattccaaaaagccttggacgcctctcatcagttgtcactctgtcacttttgggaaatcgacttactggttcaattccctcagaaattggtgacatggctagtctgcaagaactgaacttggaagataatcaacttgagggacctcttcctccgagccttggaaaaatgagcagcttgctgagattacttctttctacaaataatttcacagggacaataccagaaacatatggaaatctaaagaatctcaccatgtttaggatagatgggagcagtttatctgggaagatacccacttttattgggaactggaccaaacttgatagattggatttgcagggcacatccatggaaggcccgattccttctgtcatatctgacttgacaaatttgacagaattgaggatatctgatttgaagggaccagctatgacatttcctaatctgaagaatttgaaactcttgcaaagactggaattgaggaattgcttaataactggtcccattccaagatacattggagaaatagaaagtttaaaaactatgtaa

SEQ ID NO: 38349 - DNA, 1506 bp, Glycine max
  Peptide Sequence Number=SeqID_155127
atgttgcaagacatgtggaatgctcctcccggtttcagaccctccaagtctgcaccttcttctccggcgaagcctcttgggatggttcccagaacgcgttctgagaccttccacgtggctcacaaggtccccatcggtgacactccttatgtgagagcaaaaaacgttcagttggtgaataaggacccggagagagcgattccgctgttctgggcagccattaatgcgggagatagagtggacagtgctttgaaagatatggctattgttatgaagcagcaaaatcgggccgaagaagccattgaggccattaaatcgcttcgaagtagatgttcagatcaagcccaggaatctctcgataatatcctcttggatctctacaagaggtgtgggagacttgatgaccaaattgctctattgaagcacaagttgtatttgattcaacaaggtttggctttcaatggcaagagaacaaagactgccagatctcaaggaaaaaagtttcaagtctctgtggagcaagaagccactagattgctgggaaacttgggatgggcactgatgcagcagaacaactacattgaagcagaagaggcctatcgccgcgcacttttgatagctccagacaacaacaagatgtgcaatctgggcatttgcttgatgaagcaaggaagaattggtgaggcgaaggagacgctgtaccgcgtaaagcctgcggtgatggatggccctagaggctcagattctcacctgaaagcctatgaaagggcacagcaaatgctgaaggacctcgagtctgagatgatgaacaagggaggagttgataggattgaacaaagcaggctctttgaggcctttttgggttcttcatcaatttggcaaccacagccttgcaaggatcatcaccacacaaccttgccagcagcagcaacaacaacaaattcagccaaaattcatgatgagtttgctgatgagaacatcaattccaacataatttcaacaaatcacacagcacttccaccaactaagggtagcaacaacaacaaacaacttggtgccattttggggaactcactcaatgttgcagcccctccattctatgcatcatcaaaatcatctatgttgagggaaccaattgagaaccatctctctgagacacttaagagaacaaggtctggaaatgctgcagggtccatgagagtagtgagtgatgtgagggatgccaacaacaacaacaacaacaagaagttgcatgtggaattaggtgtgccagtgccgcagaacaaaacaagaaggctctcatcagaagatgctgagaagaacaagttaacagacttagacttgttgcccgacgacgacgaattcgaagaggccattcttgcagcaattttgggacccccaaacgaatcagataaagctaattatgacacaagcagcaccacctccaggatgttgaggcttaaggtttttcaggatatcacattatctttgagtccaagggcctga

SEQ ID NO: 38350 - DNA, 195 bp, Glycine max
  Peptide Sequence Number=SeqID_155128
atgacacttgttgaggcagggacaattccaattctcattgacttgatgaatgttgttgatgaggttgaggaacaaagggataatgttgacgaggctcttgccaattatgttgatccattattaacttatattcgtgcatcaaacgagcacatgactagatccttgagaagaataagtgttgggcagctcacttga

SEQ ID NO: 38351 - DNA, 813 bp, Glycine max
  Peptide Sequence Number=SeqID_155129
atggcggttctacgtctggaaatgaaaattcatctcttttcctggttcagcttggacctcttctctttatccgtgattcaactctcctcttgcctgttcatttgtcaaagcagcacttgctgtggtatggctatgatagaaagctttccttttgaagctatggctaagtatgctgagatgatgctcatgctaaatggaatgcattctctttgtccagcagtgtggtcaaaacacagaaggtggctgttaatgtccatgctttgcctgaatcccgtagcttgttcatttgtggatcttcaattccctaatgggcaactaacctacgtatctggtgagggtctaagtaccagtgctttcctacctgtttgtggaggtcttcttcaagctcagggtcaatatcctggggaaatgagattcagcttttcatgcaagaataagtggggaacaagaatcacaccaatggtgcaatggcctgacaaatcgttttctttgggtcttgctcaagccttggcctggaagcgatctggtctcatggtgaggccatccgttcaattcagtgtgtgtcctactgttggtggaagcaatccagggttgcgggcagaacttattcattcagttaaagagaaacttaatctaatttgtggatgcgctttcatgacatatccttctgcatttgcttctgtatctattggcagatcaaagtggaatggaaatgttgggaactcgggtctggttctaagagttgatgttcctctctccaccgttgggcgcccttccttctccattcagataaatagtggcattgagttttga

SEQ ID NO: 38352 - DNA, 1014 bp, Glycine max
  Peptide Sequence Number=SeqID_155130
atggatcaagttcaacgtcaggcttttagcaaggtatatgggaagatctgggatctggcaatgatagaattgtcagttgaagccatcacatctatcactcaatactatgagcaatcgctgagatgcttcacttttggggactttcagttagcaccaaccatagaggagttcgaagggatcttaggatgcccgataggaggaatgaagccatacctcttttctgggtactatccttctatggaatggagtagcgggaataccaagaaagtgcttggaggagaaggcggaaactctggcaagccaaggaaagtggtggatctagcagcgattgatgcttttcttgcttatcaccacagcaaggaaagctcggtcattgctgttttagcagatgcgtatgatatgttcgacttaagatgcgagaagagcagtgtgaaaattgtctgttgtacgcctactctttataacgaatgcactttacggtacccttaccaaacacgtgccaaggctagaatcatgagtgatgtagaggaagttcaaaaacaaatgaaggccagcatggaggccatgaaaaatcacatgacgaccatgatggaggccatgatgagtatgagaaaaatgatggaggtcaacgcgactgtagtcgttgccacaagtaccgccactaaggtggacccgactcacccatccggtatcaatcaagtccagagcaagcatccattcccaccatatggcttgcctcctaactatccaccacccaatgttgcacacgcgcttgatgagaatttcgacaactccgctcccatacccattgagagccaacaaccccagtctggtcatgctcatgtctctcaacccatgggggagacacatgaagtaccccgagaccacattctagctgacttcgagcctcacctcggatatgctactgaggggcaggcgttttatggtgtacccttgccaaacactttggggggccctcagtatctcccacaaccacgacccttacattttgcg

SEQ ID NO: 38353 - DNA, 843 bp, Glycine max
  Peptide Sequence Number=SeqID_155131
atgtcgcggagaccggcgaatccgtctcggcgattcggggacagtggaggtggattgttttcatcttcgaaatcaaaggcgtcaccggttttgtcggttgggctcataattgtgggatgtctgtttctcattgcgtatgtgtacaagggctcaggcgggtttggtagccatttggagtctgtgagcagggttgaaggatggcaatatcctgccatgctttatggacctgttattgtctatttagaacttccaaatgcaggagattatttgtgtgctagagaggtcctacgagcaattcccgttttgcagaaagcatatggtgatagcttacataaagttttgcatgttggtcctgatacttgctatgtggtctctaaatttttaaaggaggaggaaactgaagcctggggtatagaaccttatgatgtagaggatgctgatggtaattgcaaagcacttatcctcaaaggcattgtgcgtatggctgatatcaagtttcctcttccatacaggccaaaatctttctctctcgtaattgtttcggatgcccttgatttcttatctcccagataccttaacaaaactcttccagatttggcaagggtatcagctgatggaatagtgatatttactggttttccagataatcaaaaggctaaggttgcagatgtttctaaaatgggaagagcggctaagatgaggagttcatcctggtgggttcggtttttcctttcgattaacttagaggagaatgaaactgcttccaaaaagtttgcacaggcttcaactaagagttcatacatttcaaattgccagatattccacctgaagtctctccattga

SEQ ID NO: 38354 - DNA, 618 bp, Glycine max
  Peptide Sequence Number=SeqID_155132
atgaaggaggacgcggagaaagataaaggcaaagacaacaataggatttggggagctattctcttcggcttaattggcgccaccgtcactacctttgcgcgtttagaatattacaattgcttccgaatttgtaggtcggtcagctgcggaggagtgttgaatggttctatactcaggacacagtcatcctggaaaggagagagaaatggttctttccgatcagctttacaggaagaggcatggaggaggcacaataagcgaatgcaagaagagttagaggaggagatggaaagagtggaacgaataaggcgtatgcaaagtgtgtttaacagagaaaggaataagtataaaagaagctatgagagctggaggggaagtggtcctggtgcatatcatcagcatttccaaagagaagattggtactggaaggctgatacatcctttagagacaagaggactaattatcaagaaactccaagagagagtggaaactatgcattatcacatcattactcagttttgggtctcgacagatgtgagttggattggttgttgaatcacgactctgagattacagcaaggatgatgatcttgtctgtagaattgtgcgatagctaa

SEQ ID NO: 38355 - DNA, 177 bp, Glycine max
  Peptide Sequence Number=SeqID_155133
atggcttattatgtgaacaatgtttttcttcatggggagctggaggaagatgtatatgaaggagtggattgcagggagaacaataaaagttcgatggaacctgatatttataggagtggaatggacccgttatttgtaaggactgttataaccttccagataattatcggcttataa

SEQ ID NO: 38356 - DNA, 330 bp, Glycine max
  Peptide Sequence Number=SeqID_155134
atgtccatccgcgagcaatgtggcacttttgtttttatcacatgcactcaatcatctcacgcttgtttgaggaatgttcaagaaaattttctcaaccctctgccaccgataatttctactcacttcgtctcgcagtacacatcttgttggaagtttgattatgccgacacgtggcacgaatgcaacgactatggcaagcagttgttgtactacactttgcattttggacgacgatttcccgaacaaagacattgtgaggtcattcaagaaacatttgagcatgttccaactattcttaaagctcttcaagtccagatccgacaagcttaa

SEQ ID NO: 38357 - DNA, 153 bp, Glycine max
  Peptide Sequence Number=SeqID_155135
atggtaatgagaaacggagtttcaaaaatacagatacacactcaccacgacgccattattgtttccactagtctattactaatggcgtctaaattcctctcagtggagagtggactcggaagattggcttcggtgcagaagatcggttgttag

SEQ ID NO: 38358 - DNA, 252 bp, Glycine max
  Peptide Sequence Number=SeqID_155136
atggcggcacaccctctcccctctctcctagtcagcctgtcccgcaaagtgtgtgatgctgttgaagtagcaggaaaaagtgtcatgtcaacatctaacaccgtgacaactgagcttgtcaatcacagatacggagaagaagctgccaaggcaacaagtgaaggactggatgctgctggtcatgcagtggggactgcatgggccgcatttaagattccacaggctttgaatcctaagagtgtgtttggatga

SEQ ID NO: 38359 - DNA, 294 bp, Glycine max
  Peptide Sequence Number=SeqID_155137
atgtttgaaaccatcatttcggctaaaaacgttgaatcattgttacaagctgtaggagacattccagtgttagtcactgcaggtgctggagattcccttgtctccttggaatcctgtcaagctatggcctcaaaacttctcaattctaatgtgactagtaatgaaacttgcaatgctgttcatgagaatatcaatattgcatctgatcattttgaagcaaatccaactgatcgagctgcagaatcagaagttgagtacagaacccgatgccatctggcaataagcctcaactga

SEQ ID NO: 38360 - DNA, 1086 bp, Glycine max
  Peptide Sequence Number=SeqID_155138
atggcagattctcttccagattcttccaactcgctaagcaagctgagtgcctcggttagcggatgcttagacattgatggaataccctcacccttaccttggggacaccaataccatcctactgccagagctgccaaatggattcattttgacttcaagcatgagttcctacaaatgttggagaacaacctgtttagtggtgctacccatgaagatcttatgcagcaattgaggaagttcatcaagttgaccgacatgagcctagttcatattttctatggtggagtagtgtcctcacacaacaggacaagtttagatgctagttgtgggggtaacatcatgttaaaaccccctactaatgccatcaagatgattgaagatatgtgctctaacccttataacaacttacgagatatgaggattatgaagagaggcatgaaccaagtggagaaagatgattcccaaactaaattgggaaaacaaatgcaagctttgacaataaagattgagacactcatgagagctcaagcccaaaatgtgcatgggccaagagaatgcactgtagatgttgagctagttgcaaccatagatgagataacctttgttgggggaagaaatagttcttataatcaataccccaacaacttcagtcaaggacaaggcttcaggcaaaatgaagggatgtataggcctcaacccatgcaaaatcaaaggccagtgcaggaggagagacaacctactcttcaagagaccacgcttcaatatatgactctgaatgatcagagaatgaagctggatgacaaagctgttatgattagaagcaaaagagtccaagaggactttgaagagaaagatgattcttcaaaagttgtagatgatgtctttactgaaagacaccaagcaccagagaaggttaaggttcctattgataggaacccaatgccacaaaatgaagggtataagaagaatgagatattgacatctcctcaggggaaacaaaagatatctcaggaggttagtcctttgaaatcttttgtttatgggaaagggaagaatcaaaagaattctcagactgtgccgtcttga

SEQ ID NO: 38361 - DNA, 417 bp, Glycine max
  Peptide Sequence Number=SeqID_155139
atgggtggggagcgcaaggtttacactttggccgaagtatctgagcacaacacatccaaagattgctggctcatcattgatggcaaggtttataatgtcacaaaattcttagatgaccatcctggtggggatgatgtcttgttgtcttccacagggaaagacgccactgatgactttgaggatgttggtcacagtaaaggtgctagagccatgttggatgatttatatgttggagacattgatccatcaaccatccctaccaaggttcagcacactcctctaacacaacctcaaaataatcaggacaagacatcatcatcatcagactccatgaccaagatgctccagtttctacttcccctgcttatcttgggtgttgcggttggtattcgtttctacaacaccaaatctacatag

SEQ ID NO: 38362 - DNA, 795 bp, Glycine max
  Peptide Sequence Number=SeqID_155140
gaggaatcatccgattcggattcctcctcgagtgatgaggagggaggaaaagcaaaacgtcagaataagaagaagaagaagaaagattccaattccaatttcggtgccagcgtgttgagccatggcttaacaatagcgtcgaaggggcaggaggatttgctgaaggagctggacaaggtgttgcaggaatgtagtgctttctcggtgcagaaggtgtcggagaaggcgaagaaggagggggatgtggtggatgcgtcggtggcattggcgatatctccggtggatttggagaaggaggagaagaaggagatgatggaggagaagtgtgccgcgtattggactacattggcccctaatatggaggattacagtggaaccgctacgaagcttattgcggctagttctggacaattggttaagggaattctttggtgtggggatgtgacagtggagcagttgcggtggggaaatgaggtcatgaagaggaggatgactctgggttcacaaggggagattagtcctaaaaccttgaagcggataaaaagggttaagaaagtgaccaaaatgacagagagtgtggcaaatggggttctcactggggttgtgaaggtctctggatttttcactagttcagtggcaaattcaaaagccggaaagaaatttttcagccttctacctggagaagttgtgcttgcatcattagatggattcagtacgggtatcgccattcctcctggcgggataaacttctcagtgcatacgtggacaatcccgcctttggaactgacgggatag

SEQ ID NO: 38363 - DNA, 654 bp, Glycine max
  Peptide Sequence Number=SeqID_155141
atgcaaaggggatcccaaactgaaccggttgatgaagaaatgggagatcgattaaaggatatgagtcgttatcttgggaaagagtcttttcagcaagcacatgtccctgtgtataatacattggaaagtgattcaaagaagcctttgtatctggggtgcaagaagtctttgatgttgttgctaatagtgttaagtctggttaatgtcaaggtcagatatgggtacagtgaaaaaaagctttacttcactgcttcaggtagtgcaggatatgcttccagaggaaaatacattgcaaaaaagttaccattaggcaaaaaagatattgtgttcgttgggtttaagcatctgtttgctaatgaagatgatgcaaaagaccttacatggcacacaaatgggagaaattacgatggaatgctccgccatccagttgattcctctcagtggaagaagattaatagtttgtatccagaattcagcaaagaggcaagacaaaggatggttattcatcaagatctagctgagatgggtatacgtgaccaactacaacaaaggtctaatgctaagaaaaaatacttgccttcagcatgtcatactttgtcaaggaaggagaaaacaagtttctgtcagtgtttgtgttgtgtcaaagtgccataa

SEQ ID NO: 38364 - DNA, 1056 bp, Glycine max
  Peptide Sequence Number=SeqID_155142
atgccttactttggagtcattgaagaaatctgggagcttaattatgttaaattcattgtgtgtgttttcaagtgtaagttggttgatagcaatatcggtgtgcaaaccgataattttgaatttactttggtagatctaaagaagctagcttatcagaatgagtctttcgtcaaggttgacaagctaaataggtgttttatgttcaagatccttgtgatgaaaggaggtcagtggttctacaaggaaaaaccattggtcttaatcttgaagatgatgattcaacccttgttacttgtgtcactcctttctccacacaaatgcctaatgtcaacggagaagaagttgacgatgtccatgcaaattgtaatgatcatgatgaagcacatgactacaccaccgagcttccatcctcctcttgagttagtaccttcgttatcgccgaagaagactagaagagcaacatggctcaaatcattggctaccagactcgttggcatgaagcctgatggtccctacagaaagaaattaaggacatgtttgggggtcatcgctcgagacatggtggacgttacatttgttaaccggaaacaagttcctacaactcaaaagtatttgatttggggggacattcaggctaaatttgatattctagaagaggatgatgatgacactatatgtaagaagtacaatattagtaaagaaaagtggcaacaattttgtcaaactcgtagagacccttcatgggaggatgtgctaactgttgctattgagcgatcgaagcactctggctgtgtccatgctgctagagtcggtggactcatactgcctcatgagcctgaggttggttcttctgctgtccgtgtcagcacaaagggaagctatgtcgatccctcaaggcaagacccagacataggtgaattagaaaaatttgcattgtatattgatgacgatcctccctgcctggttgcccttggaagagtttatgaggggtcaacaactgtccacaacatttctttgggaaatgatcaagtgaaggttggtgttgaggaagtttga

SEQ ID NO: 38365 - DNA, 222 bp, Glycine max
  Peptide Sequence Number=SeqID_155143
atgacgttgtttggatgcgagagaaatagggctcaaggtttacgagggaaaaggtttacacgagagagggtttcagcccctatgacggtggcctcgacagagaaagggcttggcacggcagcaaagggaggccagcgagaagcgaagcatggaaaaggtttacaagaggaagaagtcgagaatggaacgctaaaggataagctcgagactgaggggttttag

SEQ ID NO: 38366 - DNA, 884 bp, Glycine max
  Peptide Sequence Number=SeqID_155144
atggattgcagtgctactgctagttcaaagggtaatatattgcagcatatctattctatttttattatgtttgtaggcttacatttaactgatgagagggatccaggagaagggccaatacctcgccttgatacctacttgtttgtgttattgtgcattacaaccctcgtagttgctaaccttattggagaagaggaaggcaaactttttgaagaagctgaacatagccctgcgaatcaaaggatggacaaacaggctttgggagtgcgtcatggggaatcggttatcagcttacagctattgggtgattatgagaatttactcactcatcctcaatctgttatttggggagccaatcaggctgctgccaaggctaacttgtttgtattaggacatagtggatatttggaacataaaaatgttttagaagattgtccaggtgatcttaataaatggtactgtcacatttcaaaaggtgcttggcctttttcaactacaaatcatggatggctcatttctgactacacatctgaaggactgaaagctgttgtattattatccaaaattgcaccagaaacagttggtgagccaatagacttgaagagattatatgattatatgaatgtcattctctcactgcagggtgtagacttctatgcaataaatacttatgctcaggcactgttaaattctatagttgagaaccctattaaaattggagaagttctgactcgtggattagatcaggcactctacttgcatagcacaggtgggaatccacttttgggggaacaagctatagaggaatcaagaaatgctattgtcgatgctcttaaggaatcagatttagtgtttataacggttgggatgggtgggggaactgg

SEQ ID NO: 38367 - DNA, 264 bp, Glycine max
  Peptide Sequence Number=SeqID_155145
atggagagagaaaaccgaatcgcacaaagccattacaaaatggaggcttcaatccttcttcaacatttgagaaccctatcaaagcattcaaagaaaaaaattgagaaatctcaagaatttgctagagatgccgctatcgctgtcagaatacacgtgagcccgcttagagttgtgagttatgaactgtgcgatcacacaattgtaagaccctttaagggcgacgagtattgtgatgagatctactgtgaaaacccgacgagttaa

SEQ ID NO: 38368 - DNA, 276 bp, Glycine max
  Peptide Sequence Number=SeqID_155146
atgggtcgcttagcgggtttcacaaaaaacaacactgggcttagcgacacagaagtgctgcttagcggaaattgctatggcttagcgaatcagcttcgcttagcgtactgtaccaggtggatgattgttcatcctctagaaataaactcgcttagtgcacaatgcgcacttagcgagtgctcatataaacacctatgttcagggaagaactcgcttagcgcggtaagagcgcttagcgagttcttcaggaaaacgcttatattcaacgaatattga

SEQ ID NO: 38369 - DNA, 528 bp, Glycine max
  Peptide Sequence Number=SeqID_155147
atggtcatggtgaagaaatcaaccagaaaatggagaatgtgtgtggattacatcaacctccataaagcttgccctaaggacgcttacactttgcctagcattgacaaattagttgacacgacatgtgccacatatcaaaggctcatgaataaggttttcaaggaggagattggagaaaacataaaagtgtatgtagatgacatggtagtgaagtacctctcttctgatcaacatgctcgtgacttggctgagatctttgcagagcttagaaaactcaacatgaggttgaaccctaaaagacacttttggggttgggggtgggaatttggaaatgaggttgtgtcaatacttccaagatcaccagatcaaaagttatttgagttcggactgaaattcgagctacaaagacctattaaaactcaatgcatggctgacttcatggcaaagcttccccctaaacttgtggaagcaatgccttccaagattattttgatgatgctaaagaatcaagagtcaaggaagttttaa

SEQ ID NO: 38370 - DNA, 528 bp, Glycine max
  Peptide Sequence Number=SeqID_155148
atggcattggggagaaggagtggactctttgctcttgaaaagcattttgctttctatggagcataccacagcaacaaaattaacatagcaatccacgtgttgtttgtttggccaatttttttctcggcccttcttattctctattttgtccctctccctcccttattcaaccttcaaaacttggagttttccatgtgggagaactatgtgatattggtttggaatgttgggtttttggttgctttgctctactcagttttctatgtttctttggatctgaaagctggctctttggctgctttgctttgtgctctttgttggattggtagtagctttgttgcaagccaacttgggttgtctctagcttggaagaaaggaatggtatgggaaagagcagggagagaagagagggccaagagtggggtcagaaagatagagggagagagtatgaagagagcatggagaaaaggatggggatggaggagaaagagagtgggagagagacaagagaagcctacctcctcttaa

SEQ ID NO: 38371 - DNA, 366 bp, Glycine max
  Peptide Sequence Number=SeqID_155149
atgtcagtcaaagatgtaacatatactcctctcactaaaagccaagcacgtattttggtggaagcattcaacaaagaaatacttgggttggttcaaagaggatgtataaatgattttttcggaggaaagaattataatcgaggcagttataaaggagacaaaggtggccacagaggcagtttcagaggtagatatgttggaggttggggcaataataaccaacatcctataggggaagatgaacaagaaaatcccccatgtgcagtccgaggtgtaattaataccattgttggtgaaggttgtacaagttccatttggaaacgacatctccaagctctgaaaagtgtcaatgcaataagaacataa

SEQ ID NO: 38372 - DNA, 507 bp, Glycine max
  Peptide Sequence Number=SeqID_155150
atgtcgtatggtggggtcaacatattgcatattgagtaccaaaacattcaaaaagtgtgtcaaacgaatcggtacttcgaagaaggagttgatgccatcatgagttcattagggaatatggttccatcatatcgatcaatgtccagaggcttcattcatagagaaggggggcatcaaggattttgtcaacaaaaagatgttgacgatgtaactcgactacttgaccctgagatctttgatgggatcgtccaactatgtttgtatgacagttggtgtcatttaaccttaacactgaactcccggtcgctaccatatactcttgagattgaaggaaatttcatttcgacctcgcagtggacaccaaatgttcttaccaggctcttagtagttcaacctatgagtagtttccttcctgtgtttccaagctccttctccaatggtggattagagtacctgaaaaaggactccaatgctaaagtcaatgtctatttagggagtgtacaatga

SEQ ID NO: 38373 - DNA, 243 bp, Glycine max
  Peptide Sequence Number=SeqID_155151
atgtgtgtccaagaggaagggagacttgttctagagattggtgaaagtgcttttaccgtgactctagataaagggaagaaggaaaggaaggaaaagaaccatatacctcttattgccaaaattaagaagagtctagatctacgattcatatttctaataccatgcaaggcttctcaagccaaagggatccaaatgaaggtgaacgactcatctactttgagaatcggatgcgttcacgtgtga

SEQ ID NO: 38374 - DNA, 369 bp, Glycine max
  Peptide Sequence Number=SeqID_155152
atggcacctattgtgaaaggtgatagattcaatttgaatcaatgtttaagaaacattccatatgcttccgttgtaggaagccttatgtatgcacaggtgtgtacaagacatggcattgcttttgtggttggaatgcttgggagatatcaaagtaatccaggaatagagcattggacaatcgcaaaagaaaaagttgttggctactcaaactcaaattttgctggttgcattgactctcgttggtcaacatctagatacatcttcatgatggctaatggagcaatatctcagagaagtgcaaaacaatcattagttgctacttctaccatggaggatgagtttatttcattatttgaagcgacatcatag

SEQ ID NO: 38375 - DNA, 1149 bp, Glycine max
  Peptide Sequence Number=SeqID_155153
atggcttcagcaaaagccaaaccaaggaaaagactaggagaatttctaaaggagcaacaagagcctttcatcctagagctttaccttttagaaaaagggtactcaacaaatattggagaatctggcaagagcaaagagagatggtcaataagcaaaaagagagagcctctcttccaattctccaaagttctaacaactctacacaagaagcttgttttccacaaccaaagttgtattttaattagggactccgacattatagacgaacatgttaatgttaatgttaacgtcagtgtccctcgtgaagctgagagcactgatcaaagtcatcaaacaattgaggacacagatcggttctcattctcaacatctatcaactcaaccgtgtacctttcgtgctcagatattgatgaagatggaacctcgttgtcgccgcataaagacaaagctttgttttctccaaacactttccaagcttccaatatagaagtactgcagagccagcaggctaccaacaatgaagagcaccaccagagatgcttagaaggtagccctgttccagagtctcgaaatatttctgtggcgcacgcgacattaaatcaggatgtttcgggaatggaagaaagaagaatgagcagttgctgtgtctttgtaccgaagaaaatcacggaggattcgctgctatcggtggctctatggagttcgcttattcaatcagtcaagagagaaaggtgtagcaaggagttgcgagagttccttggggcaaatccagatgtttgccacgtgttgaagtctagaacgttgttgcataaggcaaaacagcttttgttttattgtgtgagagaaattagtactcctaaaaatctttcgagaaaagattgtagacaaaaacaatgtttgaaacaattaactaggggacctgaagagctggggaagataatatgggagaggacaagggaattgggtggaaatgagacaaatctaataaccaagttactgagtttggaatacttgaattcgatggatgaatggagtgagttgaaaccgcaagtgagacatatttgcgttgaggttgccgaagcggttttggaacgtttgacctacgaaattgtagaagagatgattcaagtcttgtcaccaaccttataa

SEQ ID NO: 38376 - DNA, 1137 bp, Glycine max
  Peptide Sequence Number=SeqID_155154
atgaatttcaagatggattccgatagagcgaagctgttcgtaggaggcatttctcgcgacaccaccgaagacgttctcaaactccacttcgccaagtacggcgtcgtttccgactccacaatatccgtagaccgcaccacccgaagccctagaggttttggctttgtcactttctccgacctctccgcagctgataaagccctccaagacacccacgtcatcctcggaagaacggtagaagtgaaaaaagcgattcccaggagtgaacaacatcaacaccaaaaccaattacagagtagagtgggtggttattataataataataataataataataataattatagtaatgactgtagcagtgactacaacgttaggactaaaaagatttttgttgggggtttacctgctggtatatctgaggaggagtttaagaactactttgagaggtttggtcggattaccgatgtcgtggtgatgcaggacagtgtaactcaccggcccaggggatttgggtttatcacttttgagtccgaggattccgttcaaaacgttatggtgaagagttttcatgacttgaatggtagacaggtggaggtgaagagggctgttccgaaagaagggaaccatggctatgatgggtttagtaaattcagaaataagagtgaaagaggagttcctaagagtttgcctccttatagtcctaggaatatgttcccgggtttctcaccttcgccgtggtatagtggtgatggagtatatgcatatgggtctaatgcgtatggttgctggtaccctgtgggtgggtatggggggaatggttatgcggttttgtgtgatgctcctaggaacttctggtatgggccaatgatgactggtcctcaggcatgtcaggtgccttacactagtgctgttccggatgttgtgtatgtggggggtaggattggagtagtaggtagtggtgctggatcttgggggtacagtggcattcttggacctgcaacaaatttgaaatttgatcaagcttttaatgccaatggatttgttcctggcaatgtgacatcacttcatggtgtacagcaggatgttatcgactcgtcaagtcttaaaggaagcaatggtggaatttctagttga

SEQ ID NO: 38377 - DNA, 399 bp, Glycine max
  Peptide Sequence Number=SeqID_155155
atggagcacactcttaataacgatgtttactttcaagaaaaagtaagcatacccttctcttgggaacacaagcctggtctctccaaagtcactcataaaaaaaatgactcaaggcacagtaatttagtgttacaacctcctccaccacaatcatcatctatgaatattggacgcaagaagcaacttcaagttgaggacacaaagggtcctaattttattctatgtgcagttcagccttcttccttgagaattagatcgtttcggttggagagtgatcagaaaggagatccttttgtcgaagcttacaagaaatgcaccgaaacccccaaagagtacccctttatgcataaagggtctacaaatggattagctccgctcaccaaaggttcgcctgcgtga

SEQ ID NO: 38378 - DNA, 966 bp, Glycine max
  Peptide Sequence Number=SeqID_155156
atgggtgatcttgaaaatgcattggggcttcaaagtgtttcagaaatgacagttagttctgcctctatggctatgccttcaggcgcggctaatccttttctttcttcttccgcttgggatccacttgttcctttgagtcaaacttttggaggctctctcgtggtttctcatagtgagtttgcccattcagcttacccttttgttatgaactgtgactctcactttgttcaatatgtatctgactcaaattttgagcacatggcccttaaggttccctccattggccaaacgggttgttatgatatagataataacatagggtatctgccaaatcataatccgagtaatgagtctggaatagaaaggaatcaattaaataatgagaaatctaagcacgaagattctacttctgaagaaggagctgcacctggtgaacataaaagaaaacgaggactttactataatgttactttcagttcaaataagaatgctgagggggaaacacttcaaaattcttctgggaagagctgtgatgatgtgaaagaacaatgtgaaaagaaaccaaaatttgcacaaaatagtgcagctaacttatgtggaaagcaattgctgaagcacaagaaagatgactccgagagtgaagaagctcccaaagaaaatttcattcatgtgagaacccgaagaggtcaagctacaaacagtcacaaccttgcagaaagggtaaggagagaaaagattagtgagcgaatgaggttgcttcaagaacttgttccaggatgcgaaaagataacgggtaaagcggtaatgctggatgagattataaactatgtgcaattactgcaacaacaggttgagtcacgcattggacatgcacctattggtggatatggtgccagcatcagcatgcctagccaatcaaacacaattccttccaatgccacaggatgcttgaaaacagagttatag

SEQ ID NO: 38379 - DNA, 2112 bp, Glycine max
  Peptide Sequence Number=SeqID_155157
atggcaccaccgttgttcaattggggggtgaaggacactcacaggggaacccctgtggtggtgaaaatggagaacccaaattggtcgatggtggaacttgagggtcccgaagaagaagacttaatgcttacaaattctccttcttcgggcgtttcaagagacaaaggaaggggcaaaaacgccaaacagctcacgtgggttctgctccttaaagcgcaccgcgccgcgggttgcttgacctccatcgcgccggcattgttgggcttcgtcgccgccgtgaagcgccgcgtcgctgccggaaaaaccgacgccgacaccgacaccgacggcggcagggagaacgagaaccccgccgtgaagacgcggttctattcctgcatcaagctcttcctctgcctctccgtgttcctcttggttttcgaaatcgtcgcgtacttcaaagggtggtacttcagcgcggcgaggtttcagttggagcattttatgtggacaccgtcgtttggagtaaagggtttcttcgattggctctacgctaggtgggttttcgttcgcgtggagtatctcgctcctcctctgcagttcttgaccaatgcgtgtatcgtgcttttccttatccagagtatggataggcttgctctctgtttggggtgcttctggatccggtttaagaagatcaagcctgtccccaaaggtggcggtgtgttagatcttgaatctggagaagaaaaaggtttctctttttccccaatggtgctcgtgcagatccccatgtgcaatgagaaagaggtttatcagcaatcgattgcggcggtatgtaatttggattggccgaaggggaagttgttgattcaggttttggatgattcagatgacccagcgacgcagtcgttgataaaggaggaggtgcaaaaatggcagcaagagggtgccaatattttgtaccggcatcgcgtgattagagatgggtacaaggctgggaatttgaaatccgccatgaattgtagctacgttaaagactacgagtttgttgcaatttttgatgcagattttcagcctaccccggattttctcaagaaaaccgttcctcattttaaggataatgatgatttggggcttgttcaagcgagatggtcatttgtaaacagggatgagaacctgctaacgaggttgcagaacattaacctgtcttttcattttgaggtggagcagcaagtcaatgggattttcattaactttttcggattcaatggaaccgccggtgtgtggaggattaagactttggaggatgctgggggttggttggaaaggactactgttgaggacatggacattgccgttcgagctcatcttcacggctggaaattcattttcctcaacgatgttgagtgccaatgcgagctaccagaatcttacgaagcttacaggaaacagcagcatagatggcattctgggccaatgcaactgttccgcttgtgtttgcctgatatcatcagggccaagataagtgtgtggaagaaattcaacatgatattcctcttcttccttcttagaaagctgatattgccattctattcattcaccttgttttgtataatcctgcctatgacaatgtttgtgccagaggccgagcttcctgcgtgggttgtgtgttacatccctgctgccatgtcttttctcaacattcttccagctccaaaggccttcccttttattgtcccttatctcctatttgagaacaccatgtcagttaccaaattcaatgccatgatctcaggcttattccagcttggtagtgcatacgagtgggtggtcactaagaaatccggtcgttcctcggagggtgatttggtttcattgattgagaaaggaccaaagcatcaaagagggtcctcagcacctgatctagaggaacttcggaagcaggagcagcaaaaggcctctaagaagaagaaaaaacataacagaatatatatgaaggagcttgctttggcttttcttcttctaacagcctcagcaaggagtcttctctctgctcaagggatccacttctactttttgttattccagggaatatcattcctgttggttggtctggacttgattggtgagcag

SEQ ID NO: 38380 - DNA, 663 bp, Glycine max
  Peptide Sequence Number=SeqID_155158
gtcagtagtgaactggtgaccttggatgtcgatggtgacttgagggtagcgacgagtgcaatggataacgccatcgtcaccaaccatgacgcgaaggagggtaaccggagtcaaagggagactgaggaacttagccacgcgcagttgcacaaagttgtacgtactaccaccatccacgaggatcgtgagctggtgtcggtggacagtgtcataaacacggaaggtttcgggggcgcgcatgccgggcaatgcattcaggctcaacaggggagaggattcctcgagtggggacaagggaaggttggcatcgtctgctgcaatgagaagatggatacgggggtggcagcggtgccccggagaccatttctcgtcacagtgatagcaaagccccttgtcgcgtttcaaggcgatttccttaggagagaggcagcgaacgaggagtttggttgtggaagaaacagagggtggcgtgccattgcctgtggtaaacacataggttgtagagcctggacctcgcgtcgtaattcgggggatagacccgaaatgaagcaactcagcaacaacggaggggcgagcccgacaacgcggttagcaagtctctcgaactctgagaggtactcgttgacggtgcccctttgctggattttgaaaagcgttccgtag

SEQ ID NO: 38381 - DNA, 642 bp, Glycine max
  Peptide Sequence Number=SeqID_155159
atggaggccgtccataagctcacccaacaccaggccactctctcccatgccaacacagacctcaaccagaaacttgattcagtccttgaccgccttgtcgccctcaccactgcccctccctcacccaaaacacccccatcaccccctcctttccaccatttgcgtccccacatgaagcttgaagttctgtgcttcaatgcccaagatcctctcggatggatctttaaaattacgcagttcttcgactatcaaggtgtttctgatgctgagcgcctgactgtggcttccttctacatggagggccttccctttgctggtttcaatggatgtcgaggaatggccttagaatcacgttttgccctgtcgtactacgacgacccctacggaacgcttttcaaaatccagcaaaggggcaccgtcaacgagtacctctcagagttcgagagacttgctaaccgcgttgtcgggctcgcccctccgttgttgctgagttgcttcatttcgggtctatcccccgaattacgacgcgaggtccaggctctacaacctatgtgtttaccacaggcaatggcactggccaagcttcaagaagataagctcctcgaccgctgtcgaagccaccgtcccacttcccatatgtaa

SEQ ID NO: 38382 - DNA, 2286 bp, Glycine max
  Peptide Sequence Number=SeqID_155160
atgaagatcatgttggtgacgatgacgatgatcacgacaacgcttgtagtggtgattgtggtggaaataacgatgacaacaatcatggtggtgataacggttgacagtggtaaccatgacagttgcagcaaaaatgatcatgacaatagcagtggtggtggtcatgatagtgataggggttttaggaatatggctacgacgactgaagaaggggtcgagtacgagagtgatcccgaagaggccacgagatcgctcgcaatgcggagaaggcgtgaggcaagtgatgacgaagaaggtgacgccgacgctgacggaagagactccgccaccgccgatcgccggataactcattccgatgactccgacggcgagggcggcgtggcagattatgatgacgaagaagagttggaagaggaagaggaagaggaggaggaagaagaagaggaaggagaagagagggttggacttgaacatgaacatgaacatgaaggaggtgctaatggcacagtggttaaagattccgatgatgctgatgtgaaagcccctttggaggaatcagggaatggaaatgaagaagagaagaaagagaatgaaccatttgcggtgcccactgctggagccttttatatgcacgatgataggttcagggacaatgccggtgcacgccacaggcgtatgcgtggtggaaggagactgtgggagtccaaggatgataggaagtggggacatgataagtttgaggaaattactttgcaggaaaggcactataaagagggaaggagaccttctaagggtaattttcgaggccgtggtggtaaaacacgaggtgttgaccacagtggaagatatgttagaggtagccggaaagggtatgataacagaggcaatcaaactcaagcaccaaagagtgttgtgcgagggagaggaccccagaggtatgagcctactaataagaacaatgattcagcatcccaggtgcaaaataaacaacctgggaagcagccagagaaagcatcacatgctagtttgggaaaaacttttgctcctgtctctaattcgaagtctgatcctgtgcctgctaagaaacaagtgtttgcatcaaatttgaattatgcatccccccccttttacccttcgagttcttccaacaaagatataagtgtggcaccaaaaggggatgtccaaacgggtggtacaggcaggactgttcgccctggtgttgtggatgagggttttttggttcaacagaacaatgtacttcttcgaggaaagaatgttgttgatcatgtcagcatggagaagctatatattgatgggcctggcactccatctgttggaaaggcttttaacaatatgcatattccaccacctggatcttctggagttaatccttctcagtctgctcatccaagaggtcacgggaggagtggagcagtaccagtgcagatgaattatcagcctgttacctctcataatcaaccaagtaaaattgatccaacacaactcccggctattcaaagaactgctccagggcgaacttcaccttctttgcaagcccctgctccacaggttggtaatcgacctggtagtgggtctcaagcttcatctccccccaaaacatccagcgcgattagttcattggattctggagaaattgatgcagcttcagattccgataaattgaagggtgcattggttgggaagggaaggggagctccacagggtagtggaaggggctcttttgtttatggtggagctatggggactgctggaaatatcagtggtactcatggagatcataacttcccaaccttcttgcccgggcaacatcccggtggcataggagttcctgctgttggcatggcatttcctggatatgttggtcagcctcaacttggtttgggaaactctgaaatgacctggctaccagttttgactggggcagcgggtgctttaggggcagcgggtgctctaggggctacatattgtccaccctatctcactgttgatggtgcttatcatgcccgacaatcaggacaaacatctgcaacacctatttcaagcaaggaaaataatgtgaataaagctaataatgaatggaaatcaccacagaaatcagagcctgtaaatgatgagtttggacagaggcaaaataagccccgcagggggagcgggaaggggtatttttctttggattctaggggccttcttcctcctggtcctttgtcttcaagcttttgttcaggagtacttgggcagcaatatgtttcaagaatttttaggtga

SEQ ID NO: 38383 - DNA, 198 bp, Glycine max
  Peptide Sequence Number=SeqID_155161
atggagtctgcagcctcgacgggagatgtgccggtagtatacggggccaatgttagaggtggtttgccatacgtgatctcgtatggagaaatgccggcagcagagtggaaaagagtgccacagggcaggcctgtcatggacgaacgagcggaggtgttgctcgagagttcgattaagaaccttggtttgtccgtctga

SEQ ID NO: 38384 - DNA, 1059 bp, Glycine max
  Peptide Sequence Number=SeqID_155162
atggaggaaagcatcaatagaggggaatatcaacctaatttggctaaacagtcttctttgagattaggtggcagttttaaatcaacattgtctggaagatcaaatcctcgaaattccccttcattccggcggcttaattctgtgcgaacgccaagaaaagaaggaaggatcagcgtaggcggtgcactgtggtttcggagcaatcatttacttttgtggttgcttctaatcaccctctgggcttatcttggattttttgttcagtccaggtgggctcatagtgataagaaggaagaattttctggctttggaaccgggccaagaaataccaacacagatgctgaacagattcagcgacgtgatttgcttgctagcgataaatcattatctgctaataatgagactggtgcagatatagcagggatcagtaaaactataagtgtagctttggcaaagaaagacaatgatgttccatctcatcgtaaaacaagctcaaagaagaggagcaagagcagacgttcttcgaaaggtaaatcacgtggtaagctgaaaccaactacagaaattaagaacactgatatagaggagcaggagccagaaattcctacaaccaataatacgtatggattgcttgttggtccgtttggcccaatggaggataggattctggaatggagtcctgagaaacgttctggcacatgtaacaggaaggaggactttgcacgtctggtttggtccagaagatttatcttgatattccacgagctttccatgactggagctccactttcaatgatggagttggcaactgaacttttgagctgtggggccactgtttcagctgttgtgcttagcaggaaaggtggtttaatgtcagagcttgctaggagacggatcaaggtgcttgaggacaaatcagatctcagcttcaaaactgcaatgaaggctgatcttgtaattgctggttcagctgtctgtgcatcatggattgccttgaaattaatttctagctctcaatcaaaaggatatgatcattaccaacttaccattgctctttga

SEQ ID NO: 38385 - DNA, 153 bp, Glycine max
  Peptide Sequence Number=SeqID_155163
atggggatagcgatatggctttactatgactggtttggcgtcaagggtgagatgtatatggtgggaaatggggcggacaggggacgggggtgtgatgggaacatctgctatgaggtggacagggaggcccatatgggtgaaggtcctggatag

SEQ ID NO: 38386 - DNA, 2020 bp, Glycine max
  Peptide Sequence Number=SeqID_155164
gccatctgttgagagtttgctaccaactctggaccttgatagcctcaaggatccggcggaattcttcttggctcatgaacggttggaaaatgcaaaaagagaaatacagaagcagctgggtggtgcctcatttgagtcagatcaggataatgtggccgctagaccacgacaacgtcgaccggggcttttggggaataatcaattgccaatcaagtacaagcatcggtatccaaaagaaacctctgatgatgttctgtcctctcaagagacattagggtctcagagtcttgctcctgtgaccgagaacactgacaaaggagaggctagtatggcatcatcagaaaaagaagtaatagattcatctggtacgaaagggattgagcttgatgaattgttggatggattgcttcattgtgattctgaagatctagagggggatggggcaattactcttttgcaggagaggttacagatcaaacccattgctttagagaaattttctgttccagacttcccagataagcaaatggttgatctgaaatctctgcaagggaacaagtcaaagccaaggaaggctttatccgatattgataatttgttgaaaggaatgagtatgaatatgaataagaagacacctcttaaaaaggctgtacagtgccctgtacagcaattagcttcacccacccctccaagaagtccatttgcttcgttgtcgttgttgcagaagcacatttcacagtcaaaacaatcaatggatcctttttcagctcatgaaattgatcacttatctagcaaaaactattccccaactcatatggaagaaaaatctgggaagtcatcaaataaactgaatgcgccctcaattcaagatataattgcagtaggtgggactagtttggctgaggacacagtcagaaatggcaccagtacttctagaaagtccatggtggataattcaagggaacctaggtttgatgttaatattctctcaaatgaacctcatggtgacatggatgtagatgttggaggcagtggtatgggtgacaacaaggacaggtctaatattgaggcacacacaattgaaggtgacattgccgttagtaacacaagtacagttttggacacagacataaatggcacccacacttctgaagtttccaaggaagataattctgggaagtcatcaaataatctgaatgtgtccttgattgaagatataattgcagtttatgggacaagtttggcagaggacacaaccagaaattgtaccagtacttttaaaaaatccatggtggataattcgagggaacccaggtttgatgttactcttgactcaaatgaacctcatgtcaacatggatgtagatgttggagtcagtgctgtgggtgatagggttatggatgacaccaaggacaggtcaaatatcgaggtgaatgcatcctgtcaatctgaggacaaagcagaaaatatgcagacatttacagcttctatcccaacagatggcatgaatctcaacgtactgaatcctctagctgatcaaccaaatcctgctggatatgaagctaattctgtggataaacgtgccagaagatcagatgatgatccagaacattgtttacaggaaaagacagatggttctatggtgcctgttaatggacaaaagagagttaagtcacttgtgcaaaaagtgtccaagaataaaaaactttcgaatagacacagccttgcagctgctggtacatcatggacttctggattaaggagaagcaccaggatcaggacaaggccattggaatactggaaaggggaaagactggtgtatggccgtgtacacaaaacttcgattgtgaagattattctagacacaggattaaaagaatttgtcatgtgtgcaggtttggctactgtcattggggtcaagtgtatttcaccaggaagtgatggaaaaccgattatgaaggtgaaatcttatgtatcagataaacacaaagagcttttcgagttggcatctctatattga

SEQ ID NO: 38387 - DNA, 348 bp, Glycine max
  Peptide Sequence Number=SeqID_155165
atgggtgactcagacaaatgcggactgaaaagagtttatgagggatccacagcggttcacaacatccctttgttgcatggccaagtgaaggttgatattgaggagattaaagatgtagatgctcttgttcctgtactcactgacgagttgtgtctcaaacaaagcttccagataggtcggatcctaagcgcatactggcaaatggtcatcattttgcctaaggaaaatcctgtctggttttgttccttgcataacaggccagaaaactaccttaaaggaataattaattgtgctttgaaaggacttgatgatactccacaacctaaatccaaggctggtgctaggtag

SEQ ID NO: 38388 - DNA, 267 bp, Glycine max
  Peptide Sequence Number=SeqID_155166
atggaggaaaccaactcaggactaatttcagagacaacgagttctctgatagccaaggaaagttcctccaactcagatagcaatccaatgctttcaggtaacataccaattaaccggttaaaagataagtacaaaatcttaaatatgtctctgttgcaccatgaagaattttggaagaagctagaaatttccccattcaacttgttatttgagaggtctaacctctgcaatgtgcacatgttaccaaagaaagatggaatcttgtag

SEQ ID NO: 38389 - DNA, 1227 bp, Glycine max
  Peptide Sequence Number=SeqID_155167
atgtccgatactaaaagaagtgccaacaacagcggttccaagcggagcctgccatcgtggacgaattcaagggaaaatgagagcgataacagtgcaaagaaaccaactttggatggccaaggtgagaaatccagtgacgctgagacacccaacaagagcaaagtccaaaatgaaaatggtggaaatgcctcaagtttggaatctaaaagcttcaacaagcttctggaaggggtggtttttgtgctttcagggtttgtgaatccggagaggggcatgttgaggtcacgagctatggaaatgggagcagaatataagcctgattggaactctgattgcactctcttggtttgtgcttttccaaatacccctaagtttagacaagttgaagctgattgtggaaccatcgtgtccaaggattggataatagagtgttacacacagaggaagctgattgaaattgacagttaccttttacatgctgggaaaccatggcgcaaaggaaatggatcacttgaagtaaatgaagataagaaaccatctgtacccaaaaaattattgaagcacgttgaaagagaacagccttcagcatcaactgcctccataaaatcaaagggaaaagacactgatgttgctaggaaatgctttgagccttcggaagtgaaaaagtgggccattgatgatttgaataaaacaattcagtggctggaaagtcaagaagaaaagcctgatccaggtgagttgacaaaaatagctgcagaggggattctaacttgtttgcaagatgcaatatgttctctagaggaaaaacagtgcagtgcctttatcacagggatgaatcaaatatatgatttcacagctggttgtgtttgtcttattatctttaaccaggacatccggaaaggaactgaggactggatgttcttacctcgtgttgttgaggagcttgcaaagtttgatgtagtaggaaacaagggctcattgtcaaaggaagatcttcgaagacaggctttggattgtaaacgtatttatgaggaggaactaaatagtttagatcatgaaaggaaaaagaattcaaaggtaaataaagaacagaggagcaaaactggaagaacaaatgccatgtcttctggtgcagttgagtatgatagtgatgagacaattgagatgactgaacaagaaatagatattgcatataaggctttgtcctctaatatctgccacttgtga

SEQ ID NO: 38390 - DNA, 534 bp, Glycine max
  Peptide Sequence Number=SeqID_155168
atggccttggattgcttctttgcagtttggtttgtagtaggaaatgtttggatctttggaggtcacacttctccttctgatgctccacaattgtacagctgtatcggatatgcaatgccatttatactttgtgcaactatttgttgctgcctgccttgtataatttctgttttgggcattcgagaggatttttctcaaaatagaggagcaacagtagaatcaattaatgctctaccaatctttaagttcaaattgaagaacaatgaaaatggtgatgaccaggatgccaattcagctatagatgaaggtggaattttggctgcagggacagaaaaggagcgaatgatttcaggagaagatgctgtttgttgcatttgcttagcaaaatatgcagatgatgacgagcttagagagttaccttgctctcacgtttttcacgtcgaatgtgttgacaaatggttaaagataaatgcaacctgccctctctgtaaaaatgaagttggtacgagtaatggagggtccccttcagcctga

SEQ ID NO: 38391 - DNA, 300 bp, Glycine max
  Peptide Sequence Number=SeqID_155169
atgtgtggggcgagggttcttacttttgatcagattgaggggttgaagaaccctgatatgcagtgttggggcactgaggaaggagtggacgaaaataaacacctaggaaatctcccaaggacttatactctaacccatacggatataaccgctaagctcaccttggcaatctctcaaaccataaataattctcagcaaaaatttagtgaagaggatgcagatgttgccgcaaaacaaaagaagccagtgtatcttacattcttgctgtgtaagagaacactttttggtccaaaacggtag

SEQ ID NO: 38392 - DNA, 1911 bp, Glycine max
  Peptide Sequence Number=SeqID_155170
atgattttgagcagttttgagcatgactttgttgaagaagaaaatgccactgagcctagagactcctccaacaagcttctggtgggacaacttccaaattcagaacatggaaatacagtttggaatgctaaaataatcttgatgaatggacttagtaggtctgcgttggaggagctgtcatctgataaaattgtagatgatcgcattcctcatttttgcaatttccttagatttggggttcttaagaaggatcattctttcatggcagttggtggtccatgggaacctgttgatgggggtgatccatcgattgacaataactctttaatcaaaactgccctcagatatgcaaatgatgttattcaacttgacttacagaattgccaacattggaatccttttcttgagatacattacgatagaattggcaaagatggtttctttagccacaaggaaatcactgttctttatgttcctgatttgtctgactgcctcccttcattggatgaatggcgtgagaagtggcttgcccacaagaaatctgtggctgaaagagaacgtcaactttctttgaaaaaagagaaatcaagagataacaaggaagaatctaaagataaatcagataaaaggaaagattctactccatcaggaaagtcagatgtaaagaaaaaagaaaaggataataatactgttaaggaagaaattgaaggaaaaactggagtgaataacaataacatcgttaaaaatgaaggttctgacattggtgaagaaggcaaaagtgctgaaaaaaagctagctggggaaactgccactggtcaaaccacaggtggtgtgaagtctgtgaaaaagaagattataaagagggttgtgaaacagaaagttgccactaaggcaaatgctgctgccaccaaacaaacagacaaagcaggtgaaaaggatgttgctgaggaagtgacaacatccaatgttactgatcgggatggcaaattttctgtggatcctactggggttcaaactcccgtaaaaaacttagttgctgaggatatgtctattgggaaaattgatggtgaagagggcaaagatacagaaataaatagttctgaagataaacctcaaaacaagccagatccaatagtaaatgcagttgcgagtgatcctgctgtgaaaacaacaaagaaaaaaaagattattaagcgggtacctaaaaagaaggtggtgggtgaagcttctaaatctcttgtatctgaacctaaaaaggatgtggagaatcaaggacaggatggtaccctgagctctggcaagcagactgcggatgcaaatactgtagtgactgaggtgaagaaacctgggaaggtagttcctaagaaaaagataaaaacacctgtctctaagaagcaagaagaaactgcggattccaataaaacagaaacaccgtctgacaaaaaggatgaagggagtgttgtggcagttcaagcacaagatgacacacagagcactggcaagcagactgccaatgcagataccacagtgacgccagaggtgaagaaaactgggaaggttgtccctaaaaaacaatcaaagacccccatgcctgaaaagcgagacaatgcagataccagtaaaacagaaacaaagtctgacaaagatgataaaaaggaagaaagaggaggaactggtgaaaaaagtggggcaaagacagacaagcagaaagcctctgatgttagcaatgtaaaggggaaagtaaaagagggggacaagtcaaaagatgagaaagtaacaaaagagagggatggaaaggacgaggggttcaaaagcaaatctagtaaggaagtgaaagacaagaggaagtctgatgaacctcctcgtcaccctggatttattcttcaaacaaaatggaccaaagattctaaa

SEQ ID NO: 38393 - DNA, 156 bp, Glycine max
  Peptide Sequence Number=SeqID_155171
atgattggaaataagattcgcgcggaacgagaaggtgcagtgagaaaaccgggttgggtggtgcatttagccagcactttgaaaagaagccatccagctttcaagtgtccaaattcagcatttgacatgtggagagagggttttgaaggatcataa

SEQ ID NO: 38394 - DNA, 228 bp, Glycine max
  Peptide Sequence Number=SeqID_155172
atggggaggggtgacacctctggtgttggagaggttgcagacgctggggtagacactgactacatcgctgatcacaccaccattcctgctaaggctagaagtgcgcgtttagtgcgagtcacttacgtcattttgacaaacatgcttgttgtcttcaaaatgctagagtggttaacacaaggttggagggtgcttggagtgcccttgatcttccccaaaatggcttga

SEQ ID NO: 38395 - DNA, 528 bp, Glycine max
  Peptide Sequence Number=SeqID_155173
atgacacaagaatgctacattgcaagtctcaagattgctaaggaaaagaaggtggcaaagcccaaagaacaactaatatcatgcacctttctcaacaacaatctaggaaaagtagaggtctaccctggagaaacagtgcaaagaataaagcctgccaaagaagattcatcagagaagtacaatacaccacatggttgcccaatgtgctttttagatgtttattatgggtataaacaaatctcaatgttcaagtccaatggtgaaaaaactacattcatgatggatacgactaactactattactcagttatggaatttgatcttaagaatgtcgaagcaacatatcaaagactgatggataagatattcgtcaagcaactcaagagaaatctagaagtctatgttgatgacatggtggtcaaaagcacgagcaccacttctcacacagaagacttagcagagatctttgcagaaatgagaaaatacaacatgaggctaaaccttgagaaatgcatattcgatgtatag

SEQ ID NO: 38396 - DNA, 318 bp, Glycine max
  Peptide Sequence Number=SeqID_155174
atgcctgaggaacaccaaaaattgattgtagatctacgaatggagaaagaagatgctcgaaacaagcattcaaatgcagtagaaggaaaaggaaactcgttaacgagaaaaaaatgcacgaaaaatgaattggagaaatcgaaatcaggtgttccactgaagtacaaaaataaagaatctttgatcaccatcaccacagagatggaggaagaagtggattctaatgaagtcattcctttcaacgtgtcattttccaagcgtttggtggaacttcaagtcccaaaacaactacggaaactttcggcaatggaaatataa

SEQ ID NO: 38397 - DNA, 516 bp, Glycine max
  Peptide Sequence Number=SeqID_155175
atgtatttttcgaaatcagtcactggtactccaaggaaacatccatcaagcagcagaactattgatggacatttttcatctggtccaaagaagagtgaactgaagattggagagtcatcagactttttcacctatgtcaaagcaacaactgaagagagtgctcatgttgacaatagtaacaatactactatcactactactactacagaagttaggatggaagatatgaatcaagcatgtactgaacaaggggatagtggccttaaaacacaaaaaatggagaaatgtttggaaaccattcacaagatgacttaccgagcagcaacagtatccccgattctttctctattgagagatcttgtactcctcccgcatcgatggaagtttcacaacaaaagcattacaaggaagaacattatcagggagtggtgcatccaagaaatggaagtcacggttctatgcctgctcaacatggttatccatattatatttcaagagctgttaatcatgttatga

SEQ ID NO: 38398 - DNA, 288 bp, Glycine max
  Peptide Sequence Number=SeqID_155176
atgacgaaatactcccaccttacccctatttcgtcaatcacaatgacgaaacaccactattcaagtttattttgccaatatcgtttgctaaactcgaatgtcacttgtttggccattgccaatgacaaaatctccgtctcactgctccacattagtctttatcttgtcagcatacatggcggctcacctgtgaatttggcagagaaagattcagagaagtgtgacgctgaattatcaggcaagcgcaaaccaacgcgccaaaaagcgtctttggttttttatttttaa

SEQ ID NO: 38399 - DNA, 255 bp, Glycine max
  Peptide Sequence Number=SeqID_155177
atgttctgcggccaatcgcaacccccatttacatcgacgccgatagggactcgctccacgtggcatccgttgacgaggccatctgaatcggaccgccactggcatggctcagctattcaccgtggatatggatacttttcgattatcaatcttttttttggtatggattgtggcagtgcatctaagagaataatgggagctgtaggtgtgcctgttgtgcttggatatcatgggaggattgatgtggttttgtaa

SEQ ID NO: 38400 - DNA, 192 bp, Glycine max
  Peptide Sequence Number=SeqID_155178
atggcatatatccatccagaaaatttgcagcagatgctttgctgcacagctacaagaggtttttggttttttcacatcagtgctgccaagggaaacgatgttgaaaccgcaacttattacattagtgctacgacaagaaacgatgttgaaatcacagtttactacatcggtggtttcactaaaacgatgtag

SEQ ID NO: 38401 - DNA, 492 bp, Glycine max
  Peptide Sequence Number=SeqID_155179
atggagttcatgcttgaaatcgtatgtgacatcaagaataacaaaagaaagccaaatgaggactctcacatgacactcggattaagaagtggttacaaaagagggtttaaatggagcaagttacttgatcctgacaagaagggccaatggtggttgtctggggatgtggcttcttcaacaggtaatgttgaagaagttgccaacagaatagacaaggatgttcatgaaacccaaagaatgcttcagctcgccgctgctcaaaagatgaacacaaatgcccgaagggaaatcttttgtataataatgagtggggaggactatcttgatgcatttgagaagcttctaagattggagttaccaggcaagcaggacagagatatcatgtgggttcttgtggagtgttgcttgcaagagaaagtttttaacaagtattatacagtgttggcttccaagttatgcgagcatgacaaaaatcacaagcttactctatag

SEQ ID NO: 38402 - DNA, 249 bp, Glycine max
  Peptide Sequence Number=SeqID_155180
gtcgactctagaggatcccccagtctggcggtggcctgcgcgcgcaaacccgatcaccgcaaagcggcgctggagaagaagatcgccgtcacgccgttattgacgttcgaaggcgccgacatcgtggatctcgatgccgatcggccgatcgaggaggtgctttcggcggcggaaaaagccatcgcggaatttatggcggcgcagggttatcgctattccgctgatgaagtatcaacggctgcgcactga

SEQ ID NO: 38403 - DNA, 495 bp, Glycine max
  Peptide Sequence Number=SeqID_155181
atggatcaaacaatgcttgacttccgctatagttttggtgttggtaaatggaagtcccacaaaggagtttacgctggagagagggttgagacaaggttgatgtcgttgccttttgtctacttggggattccaatggtagaaaacctaaggttggaagaaacttggtcaccaatcttaaggaagattaataggagattagcaaagtggaagcacaaagttctatcattggctgggaggatgtcgggtcaggttgtgaagaagattatcataaaagaaagagacttcttgtggggttgtgaggagggaaataagaaagtttcttggagtgaaagacatatcatctttaatgactcactacttgaaaagtcgaggtgggaaatttttcatcaaactgatagcttgtgggcacaagttttagaattgaaatatgggggtcagaggggtcttagggaccaagggggtgacatagagaatccatttggtggagtgacctaa

SEQ ID NO: 38404 - DNA, 208 bp, Glycine max
  Peptide Sequence Number=SeqID_155182
atgactcgcgtgaggggaccaaagcttttgatgctccgccagccactccgtaaggacgacgacctattggtagtgaccctagcctctttttgtgtccgtccccaagtatctgaaagtaggaaacaacgaggtgtggcaaatctcgaccgcgtcgtctgtcttaccttgattggtttctactgctttaactttgtctccaccccagaag

SEQ ID NO: 38405 - DNA, 991 bp, Glycine max
  Peptide Sequence Number=SeqID_155183
agggctgcacgccatcgccttcagagggctgcaagccctcgccttcggagggctacacgtcctcgccttcagagggctacacgccctcgccttgggtactagtaccctcgccttcagaggactacatgtcctcaccgactacacacctcgccttcagacgactatacgtcctcacctcagagggctacacgccctctccttaagagggctacacgctctctccttgagagtactacacgtcctcggcttcagaggactacacgtcctcaccttcagagggctacacgcgctcgcctttagagggctacatgccctcgccttcagaggactacacatccacgccatcagagggttgcgtagcctcaccttcagagggctacacgccctctccttcagagggctacacgccctcgccttcagaggactacatgtcctcacctttagagggctacacaggactacacgtcctgaccttcagaggactacacacctcgccatcagagaactacacgtcctcaacttcagagggctacacgtcctctcctttagagggctacacgccctcgccttcagaggactacacatcatcaccttcagaggactacacgttccgactttcagaggactacacatcctcaacttcagaggactacacatgcacgacttcggagggctacacgtcctcaccttcagagggctgcatgccctcaccttcaaaggactgcacatcctcacctttaaaggactacacgtcctcaccttcagagaactacacgttcccacttttagaggactacacgtcctaaacttcagagggtttcacgccctctcctttagagggatacacgctctctcctttagagtactacacgtcctcacctttagagggctacacaccctcgccttcagagcacaacacatcctcgccataacagggtcgcgtatcctcaccttcagagggatgcacgcactcgccttcagacgactacac

SEQ ID NO: 38406 - DNA, 314 bp, Glycine max
  Peptide Sequence Number=SeqID_155184
gttccaagtctgatggatgtgcaagacaggttgcttcctatgagcttaccaccttaacttgcatcccaggtgtcatcacatatcgtggagctaaaatccagctgagtgcattgtgctcggagggtcctgtggttgactggggggggggggggggacaattcattggaaaatacatgttattgctctctatacgacataattgtaatttcagttctgcacctcagcacttgcctcaattcgggggccaggaaccatgtatcttgcatattatgtctctctatatctttgaagcaaagtggggcccttttctctaa

SEQ ID NO: 38407 - DNA, 237 bp, Glycine max
  Peptide Sequence Number=SeqID_155185
atgaggacgagagaggcacttgcagagatagataccaaacaaataattcaatttgctgcatcaggaattgtagcaagggataacgaattggtggaaataataataaagaagggtgagggttacttacgtagacagagtgagtggtcgaagaaagagagaggaatggactgcgacggaggtgcagcggaggacggaggtgacggcgagcagagaactaaagatgcgagactacaatga

SEQ ID NO: 38408 - DNA, 223 bp, Glycine max
  Peptide Sequence Number=SeqID_155186
atggacaaagatgagtggatgtatgaaataatgtctaaacaagcggatatggattatgaaaatgaagaagcatgtggtgcaaatgaaccacatgttgattgttcggatgcgttcaatacttctcaggtgtttgagtgccgagaggatgttttgtggtgggctcgatccgttgctcatgaaaatggatttgtggcggtgattttaaggtcggatacaaacacag

SEQ ID NO: 38409 - DNA, 501 bp, Glycine max
  Peptide Sequence Number=SeqID_155187
atgggggcccgttgctgtgtattaccaaccagagagggttatgcggcagtttggatacacccagaccattcctgctcgcctgtcgattcatgggtgtcatatgatgatatacacgacaggtggatgcactattcgaatcatatggttctagcaggtgaggtgtgcgctgtgccaggccagacatcagatcctctgccaaatggtcatgctttgcaatcccgagtcatccctcaggccccagagacagatatccctcacgtgctagagccaggagcaccatcgacatctgcgaggcccgctgtggaggagcctagacatgcaatggaagtttgctatgggattgttgagaggttggagcaccatttgagcctaggggtggtcacgccaggcttatcgacacatgaggtgatcgaagaatgcctcaggatggtcaggagtgtcacacaagaccagctagtatatgttaggtctcgacgtaggcagcacacagatcaagcgtag

SEQ ID NO: 38410 - DNA, 342 bp, Glycine max
  Peptide Sequence Number=SeqID_155188
atgaatgatttacaaggtacactggggtatagtggacaaagaggttcaaagaatctgggggaattagcgagtggtgactactcaacatttggtgcactcatttggtacgaggaactcataaacctcactttgctactcctgacgagcttcgagactattctttttggagttgggagcttagggatcggtttatgcgctcttgggcatcaaaggtgttgcttgcctagaaaagccatacatcatggttataggactcacccctacaaccaacaactttcaagtatcgatgtcagaggaaaccatgatgatctcatgcctgcggagatagaggagtatagatag

SEQ ID NO: 38411 - DNA, 215 bp, Glycine max
  Peptide Sequence Number=SeqID_155189
gaatttctgccccagtgtcctctacatcagctggtgccatcgggtcatccggaaatatgtcaacctctacatttggcgcagggagcactgactcatcgtgcaccgcagtcacaggtactcgctacctctatgcggatgcggtaggacatcgacgctgcggagcatcatcggaatcatcacgatctcctttgcccgcacctctgccagtaacgtga

SEQ ID NO: 38412 - DNA, 220 bp, Glycine max
  Peptide Sequence Number=SeqID_155190
atgcctatatgcgttagaccaatgaaatttgagagaatgaaatcagtgatggaatttgcggagatcgtgatgattccgatgatgctccgcagcgtcgatgtcctaccgcatccgcatagagtgctccctgcgccaaatgtagaggttgacatatttccggatgacccgatggcaccagctgatgtagaggacactggggcagaaattcctgcagacacag

SEQ ID NO: 38413 - DNA, 291 bp, Glycine max
  Peptide Sequence Number=SeqID_155191
atgagggggtacaagtacacccctgaagccagccaaccagcgtccgcactggtgctcaaagcaggtgacacgcaaaccgccagtggaactggcaagtttggtgttttagaaggaaccgccagaactactggcgatatcgtatccatgggaaccgccagtcaaactggcgagttccaagttgctgaaaaccaggcttttttcaggcgcgtaccaggtttttttcatgtgctttttagtggtagggtagctttttcagagaaagggaagttacaactagcattggcgagttaa

SEQ ID NO: 38414 - DNA, 267 bp, Glycine max
  Peptide Sequence Number=SeqID_155192
atggcgattcttgcgtccctgcaacgttcacctgcgctcctgcacgtagccctgcaactagctgccctctcctgccacgaactcgccagtttgactggcggttcccccatgcatggcgaaatcaccaatggggatgacggcttcttcactgccagcgaactcgctagtttgactggcgttgtacacaagtgtacgtattggggttataatgcatataataatacctgctttgcacggttactcacgttacatctcactggtttttga

SEQ ID NO: 38415 - DNA, 682 bp, Glycine max
  Peptide Sequence Number=SeqID_155193
atgttagaaggtcccattccagatggatttgggaaagtaatgaactctcttgaagttctttacctctccggtaacaaactgcaaggcgagattccatctttctttggtaacatgtacgcattgcagagtttagacctctcaaagaacaagttgaatggggaaatttctagcttattccaaaattcttcatggtgcaacagagacatatttaagaggttggatttatcttataaccggttgactggcatgttacctaaaagcattggattgctatcagagttggaggatcttaacttggctgggaattctttggagggtgacgtcactgaatcccatctttctaatttttccaaattacaatccttgtacttatcagagaactcgttgtctctgaaattggtcccgagttgggttcctccattccaattaagttcattgggactcagatcttgcaagtcgggccccagctttcctagttggctcaagactcaaagttctttgtatgagcttgatatttctgataacgggattaatgactctgtaccagactggttttggaataacttgcaatatatgagatatttaaatatgtctttcaattacctcattggtgcaattcctgatatatcattgaagcttcctatgagaccatctataattctgaattcaaatcagtttgagg

SEQ ID NO: 38416 - DNA, 330 bp, Glycine max
  Peptide Sequence Number=SeqID_155194
atgtgggtcctatcaatgaagaaatcgaatctgattttgaagttgcttctgattccatggttgttcaagtgtgtgatcgatcatccaccctcacgtgcttatgtttgtatgcttgaagctgaacttgccaaaaccagagaatttcttgctcaagccttgaaggatcgtgctcatgatgaaaagagggcttgcaaatgctggaaacctcctcgtcctcctacgcccccaagtagacctattcatctcttatctgactttgattactctggtgatgagtttcttaggaagttggatgaagaagttgccaaacaaaaggaggagaaaaagtaa

SEQ ID NO: 38417 - DNA, 1017 bp, Glycine max
  Peptide Sequence Number=SeqID_155195
atgaaagccttggttttacgaaacaatggtttaatgggtgagttgccttcttctttgaagaattgcagcagtttatttatgctggacctgagtgaaaatatgttgtccggtccaataccatcatggattggagaaagtatgcatcaattgataatcttgaacatgcgaggaaatcacctctcaggaaatctacccattcatctctgttatttgaaccgtattcaattgttggatctttcaaggaataacttgtcaagtggaattccatcatgcttaaagaatttgactgcaatgtctgaacagaccatcaactcaagtgacactatgtctgatatatatcggaatggtaagacttacgttgtatttaatggttacatattcggaggttatacgcttgacataacatggatgtggaaaggtgtggaacgggggttcaaggatccagagttggagctcaaaagcattgatctttcttgtaacaatttaatgggtgaaataccaaaagaggtcggatatttgcttgggttagtttctttgaatctatcaagaaataatttgagtggagaaattccttctcggattgggaatttaggttcactagaatcacttgacttgtcaagaaatcacatctctgggagaattccttcatctctttctgaaattgatgatttgggaaaattagacttgtcacacaactctctttctggaagaatcccatcaggaagacattttgaaacctttgaagcctctagttttgaaggaaatattgatctttgtggcgaacaacttaacaaaacttgtcctggggttggagatcaaacaacagaagagggtcaagaaccaccagtcaaaggtgatgattctgttttctatgagggattatacatgagcttggggattggatacttcactggattttggggcttattagggccattactactgtggcgtccttggagaattgcttacacgaggtttctgaacagattaacagactatgtatatgtatgcttatga

SEQ ID NO: 38418 - DNA, 330 bp, Glycine max
  Peptide Sequence Number=SeqID_155196
atggcactgtggaaattcgaatggataaaagatataatccatttgacccattcatcagtgcacataatcaataagaagggacaagcatggttgaatccgataatgtacaacgaagtagaggaaatgtcacatgtcaatgaagtaattgaagttgaaagtatttctggattgcaagatttaataggtggtgttgaagaagtggaccctgctaatctgttgacaaacgaaggagaatcaaataatttgaatgaagaatcaaataattttgaagaagaaaatgaaggggaattagaatatgactttgaagtttataattctgaagaggattag

SEQ ID NO: 38419 - DNA, 165 bp, Glycine max
  Peptide Sequence Number=SeqID_155197
atgtctggagcaaaagtacttccgcaacagcaatgggaacaaaatagcgtgcataatgcaaaaggtgcagcatataacaaagctttggaggatgctattgctgttcttatcaaaatagcaatgcgtattgattcttgggattgtaatttctttttgcttaattag

SEQ ID NO: 38420 - DNA, 813 bp, Glycine max
  Peptide Sequence Number=SeqID_155198
atgactaaacaaaggaggaataccattcatactcttatgttagatttagggacttggtgttgtgatgttgttgtcctcaaagatgaggcaaaaaatgtggatgcttgccattctctcacgacggaagtgactttggaggaagtcagaagggctattatgagcataaaggcctacaagtcccttgggctagatggtttccagccattcttcttcaaaatgtattgggagattatgaagaaagacttttgggacctagttcatgatactttcaaaaatggattctatgaggataagattgttgaaactcttattgttcttgttccaaaaattgaccatccgaaacatttcaaggacttcaaacctataagcttgtgtaatgttatctacaagatcattaccaaggttattgttcaaaggcttcgtcccttccttgatgagcttattagtcccctttatggtagtttcattcctagtcatggtactattgagaatgctattgtggcacaagaaataatctattttatgaaccattctaaggctaagaaggggaatgttgcttttaagactgatcttgaaaaggcttatcatagggtgagttgggattatttaaaaaaggttcttcatgattttggtttccctcaagctactatatctcttatcatgtggtgtactagagcctcctctctgtttgtcttatggaatggagcaaggactaatttctttaaacctactaagggtctcaggaaagaagaccctctctccccctatctctttgtgatctatatagagaaactgtccatttatatccaataa

SEQ ID NO: 38421 - DNA, 651 bp, Glycine max
  Peptide Sequence Number=SeqID_155199
atggcttatccagcaaataatggtggctcccaacaagctccccttatcattcctaaatggttcttgccctctgaaaaccaatttaaattgaatgaggatggtagtttcctctcatcctcgaaggatattggctttggtggagtagttagaaatcatgatagacagtggatttctggcttctttgcatatgatggtaaaggagattgtttgaaagtagaaattctggccatcatgcatggtcttactctggcttgtgagaaaacgctcaaccttttgacctgtgaaactaataacaaagagctggcatatatcttagagtcttggagagtgcttcaacaccaccctcatgctgctcccatttttcacattttagatatgttagatagatgttggattatggatgctactcacttattggctaaccaaggtgtccatcagctcacttgttggctaactgatgagaacatgaccaagagcaagggcaaggatccacttgaaggacttggaggacctatgacaagggctagagcaaggaaagccaaggaaactcttcaacaagtgttgtccatactatttgaatacaaacccaagtttcaaggagaaaagtccaaggttgtgagttgtatcatggcccaaatggaggaggactaa

SEQ ID NO: 38422 - DNA, 1017 bp, Glycine max
  Peptide Sequence Number=SeqID_155200
atggctaggaggagtgtgggtatggtttctcctagtagaacacagggtctacagtatccacctatggttagacaaggctcatattatagcctcctcactcttgatgatgaggttcagagccattatcagttgggaaacacagggaagcctctccatagtatgaatttggatgagcttcataaaaatgtgatctcagctgatcagagtggacaacttcttcaagacccttcatctgatcataataattcatttattcttggtagcaatggtagtttgaataatgacacattgagcaacaaaaccaataatgatagtattagtgagtcttggaggaagtttgttctcgaagaacaggtgagcaggtctatggacacccccttgaagcaacaacctagtttgggggaaaacctagaaaattttctagctcgtgcaggtgtgatcaatgtaggagatcatcaagatcacaatgttaatgttgttattggtggtgatactcatcatcaggccctgatgggaatggatccaatggtgatgcattcacagcaggaacattggttgcaaatgcaaattcctgcagctattaacatacaccaacatcaggagcaacagcatcatcatcaacagatgaattttgggggatgtcaagatttcagtgttcctaagtcattattttatgagaaccaagtaatggaaattggttactcagaaaattcagcggggatttcatcaatgtcacctgcatattcagattcaaagagtgctgtgtttggaaagaacaagtattcagatgaggtgctggaaaggactattgagaggaggcagaagagaatggccaaaaaccgcgaatctgccggaagatcaagggcaaagaagcaggaacacattaataggttagagaaagagaagtgtcgcttgcagaaaatgaatagccagctcaaaaagctgaagatgacaaagttaaacctgagcacaattagagtcattgcaagtgaccaaggaaatatgcgaaatgattaa

SEQ ID NO: 38423 - DNA, 2518 bp, Glycine max
  Peptide Sequence Number=SeqID_155201
atgaagctttgcttccacatctgcctcgtcggaaacattgtcggcaaccccattctcgtgctcattgatggtgggagcacccacaatttcatccaggagcagcttgtagctcaattgggtcttccctgtcacaccactacccctctatgggtcatggtgggtaatggtcaacatcttgaatgtcacaccacttgcgaagccattactattgatcttcagaatcagtccttcatcgtcgacttctacgtgctccccattgccagagccaatgccattctcggagtacaatggttaagatccttgggccctgtcttgactgattacactaaccttcgcatgcaattcttttatgatggcaggcttgtcgagctccaaggtgatcctgaggcccatcgtagcatgctctcttccccgcaattatggcgactctgccgccatcaacaaaacctttgtttccacatcacggtgcttcccaaggaacctgagcacaaattccctgacaatattcacccagctgttcaccacctcctccaccaattctctgctctctttcaggaccccaacaccctgccgccggctcgcgatactgatcacaacattcacctgcttccccaagctacaccagtgaatgtcagaccttataagtacccctactaccagaagcgcgaaatcaaaacacaggtagaggccatgcttcaaaaggggatcattcaacccagcactagccctttctcttctccggtattgctagtgaagaagagtgatggtacatggcggttttgcgtggattaccgcgcgttgaatgctctcacgatcaaagaccgcttcccaattccgacgatagatgaactgttggatgagcttgggggtgctcgttgcttctccaagctagacttattacaaggataccatcagatacgtatgcaaccgccaaacatacccaagactgccttccgtacccacctcgggcactttgaattcaaggtcatgccctttggcatttgtaatgcaccctcctcatttcaggaaacaatgaatagcatcttccggccatacttacgacgctttgtcatcgtcttcttcgatgacatccttatctacagcgtctccctcagtgatcacctccatcacttacagaccactttccaggccaccaccattgaacccttccaatggtccctcgccacacaggcagctttcgactccctgaagcaagccttgacctttgctccagttcttgcattacctgatttcagttttcctttcacggtggaaactgatgcttctgctatcggtatggaggccgttttgtcacagaggggccacccaattgcctttttcagtaaggctttcagtccaaagatgctaagggcctccacatacgtcagggagttatttgcaatcaccaccgctgttgtccagacacctgaagaacatacataccttgctcgcttgctcggatatgattacaatatccaatatcgctcgggcactcataaccaagcagctgacgcattatccaagttgctgaaaactgattcacaggcttgcctcatcctatttatcccttgcctcaccttcatgactgaacttcattcgcaactccattctaattcgacatttcagcaacagatgaagaaggtccaagaccacccagaccaattccatgatttctcaattgctaacaaactcttactttataagggtggacacactggaattgcgaagacagtagctcacctcatgcacaatttttattggccggacctccgagatgacgtctcccacttcgtcaccaattgtgttgactgccaggtcacaaaatatgagaccaagaagtcagctggtctcctgtgtcctctccctgtgccaagtcgaccctgggaatatttatctcttgattttattggtggtttacctccataccgtggcaactcggtgctacttgtcgtcgttgaccgcttctccaaaggcatacacttaggtatgctacctcagagtcactttactctcactgtggcgaagcttttcttagatatggtggtcaaaattcacgatatcccacgcagcctggtatcggatcgcgatcctcttttcatcagtcatctatggcaggagctgtttcgatccaatggaacccaactccggatgagttccgcctatcaccctcagagtgatgggcaaactgaagtcttgaaccgggtgatagagcagtatttgagggcattcgttcatcagaagcccacgagctggggcaggctccttccttggatagaatggtctcataacacttcttggatggccaacacaggaacctctccctatgaaattacttttggccggaaaccattcaatattccgaactatgttacaggatcctcgaaggtagctgcagtagaggacctgctctcggagcgcgaagctacatttcaaatcattaaaaagaagttagtgaaggcacaagagcgcatgaaacactatgctgaccaacaccgccgcgacattcaatatgccatag

SEQ ID NO: 38424 - DNA, 177 bp, Glycine max
  Peptide Sequence Number=SeqID_155202
atgcgtgaggcgaggcggtcgagggcagcttcgatgcggtcgttgccagaatcagccatgggagcaggaagaacaatgaaagcaccagtgataggttctggaattcgaggtccagtgcctcccgagagcagaataagcaaaaggaagcgagaagaagaaagagtaagatggacctaa

SEQ ID NO: 38425 - DNA, 855 bp, Glycine max
  Peptide Sequence Number=SeqID_155203
atggtgagttatagggtttcggactttgaaaccttctgggctgggccatgcttggtgaggcacaccagatccagtgatcactggaaaaaatggcggtggctggcggcagtgatgttggcaggagataatgggcgacagcatacggcaggcagagcgagatcgacccgctttgataccaacaatgaatatcccctttttatacctcgccaaaattattgctctactgacggagaaaactcatggtctgagagaagctcaagcaattttggagttgcttcggtggaatctgagaggaggcatcgcctagattcatctgggagtactagctttaattattctttggcttcttcgcattctgttcaaacacacaaagatttgcagaaaggaatttcacttctaaagaaaagcgtagtctgcatcacagcttactgttacaactccctgtgtttagatgtcccttctgaggcatctacatttgaggcttttgcaaagttattggcaacactcgcatcatccaaggaagttcgatctgttttttccttgaaaatggctcgctctaggacatgcaagcaagttcaacaattgaacaagtctgtttggaatatgaattcggctatttcatcaactactttgctggaaagtgcacattctgtgcccacaacgagaattgaaaattatctgccaagttctactggtagttttctttatgccgctgatttatctgacggcaaaaatgagtgcctaattgaagggtgggatattgttgagcatcccacttttcctcccccaccatcgcaaagtgaggatgttgagcactggactcgagccatgttcatagatgctaaagggaagtga

SEQ ID NO: 38426 - DNA, 1125 bp, Glycine max
  Peptide Sequence Number=SeqID_155204
atggacaaaggatggggactcacccttgatacctcttcctctcaatctcttccattattcccttccaacgataataagatgtttcctctcctcggattccccgtcaacctcagccgcgcctccaaggaagacgatgaaaaccgcaaagttgtcggtgaagttgacttcttctctgatagaaacaaacctacacctccaccctctcacgaccacaacgttaaacccaacatcgtcaagaaggaaatcgatgaaacacctcttcacattaatactggtttacaactccttactgctaacaccgggagtgaccaatctaccgtggatgacggggtttcatctgatgcagaaaataagcgagccaaaaccactgagcttgcacagttgcaggtggagcttcaacgcatgaactctgagaacaagaagctgaaagagatgctcagccatgtgaccggtaactacaccgccttgcagatgcatcttgtcacattaatgcaacagaaccagcagcgaacaggaagcacggaaaatgaggttgttcagggaaaggtagaggataaaaacgttggtgttggtggagggaaggtaccaagacagttcctcgatataggtcctagtggcacagcagaagtagatgatcaagtttcggattcttcttctgatgaaagaacacgatcgagcacacctcagaaccataacattgaagctggagctagagatggtgcgagaaataacaatggtaaaagccagttgggtagggaagagagtccagactcagaatcacaaggttggagtcccaataagcttcagaaaatgaacccttccaaccctatggatcaatccactgcagaagccacaatgagaaaagctcgtgtatcagttcgtgcccgatcagaagctcccatgatcagtgatggatgccaatggagaaaatatggacaaaaaatggccaaggggaatccatgccctcgagcatactacagatgcactatggcagttggttgcccagttcgcaaacaagcacgcataaccatccactgccacctgctgctatggccatggcatcaaccactacagctgctgctagcatgttgctttctggatcaatgtccagtgcagatggaataa

SEQ ID NO: 38427 - DNA, 1518 bp, Glycine max
  Peptide Sequence Number=SeqID_155205
atgaaccccaactacagcaaaatgagaaccatttctttagtacagaaaaaagcaaaaccgggaaacaatgaaacactagtctttaattttgagggtactctgttacgatccacttcattgttcccttacttcatgttggttgcttttgaagctggtggggtactacgatctctcatcttgtttctttcataccccttggtgtggttggtgggtgaaaaccaacttggtttgaagatcatggttttcttgagcttctttggcctcagaaaggacacattcagaacaggatcagctgttctggcaaagttcttcttagaagatgttggattggaaggctttgaggccgtaatatgttgtgagagaaaagtggcatctagtaagttgccaagggtcatggttgaaaatttcctcaaggactatttaggggttgatgctgttatagcaagagaattgaagtcctttagtggcttctttttgggagtttttgagagtaagaagccaattaaaatcccttcatataaagttaatggaggaactaaagagggcaacatcaacaacaacaacagtattggtattatagacaatcatgttgaatatattgaccaggaggagcttttccaacaattcaaggagttttacataactgatgagaggagaaattggcatgttcttccaagagagaggtaccccaagccattgatcttccatgatggaagattggctttcagaccaactcttgcatcttctgttgctttgttcatttggttaccctttggattatttcttagcctcttcagatttacaataggcatagcattacctcttaatgtgtctgctccaatattggctctctcaggaacaagaaccacagtttcaagaccccagagcactttgtctttggtccactatgaagaaaatcaaaaggggatgctctatgtttgcaatcacagaaccttgcttgaccctctttatgttgcaattgttttaggcaaaccactttctgcagtcacatacagcttgagtagattgagtgaaatagtgtcccccatcagaactataagactaacaagagacagagagaaggacagagaaataatggacaaaatgctgagcctagggaaccttgtggtttgtcctgagggaacaacttgtagggaaccttatttgctaaggtttagtcctttgttttctgagctcaccgataacattgttcctgtggctgttgatgtcaaggttagcatgttctacggaacaacagctagtgggtataaatgtttggacccctttttccacttcttgaatccaaatcctacatatttcataaaatttctcgggatgttacctcaatcccaaacatgtcaagctggtggaaagtccaagattgaagttgccaatttcgtgcaaaatgagatatgcaatgctttgggatttgcatgcaccaacttgaccaggaaagacaagtatttggtcttggcaggtaatgagggtgtgagcccaagcaatgattgcaaccggtag

SEQ ID NO: 38428 - DNA, 243 bp, Glycine max
  Peptide Sequence Number=SeqID_155206
atggagccgatcaggacggtgtggaggacactgtctgtgagaaatacagcattagcaaggaaaaatgggcccagttttgtcagtctcgcagagacccttcttgggaggatgtgcgcaaaaaggcacaggccatccagaagcagaacattgccccctacgttttgcctcgtgggggttatgattatttggaagcagaagctcctggctgagaagacgaagaagaagctagaggaagctgcatag

SEQ ID NO: 38429 - DNA, 246 bp, Glycine max
  Peptide Sequence Number=SeqID_155207
atggcatctaaggttaggcttttacttgtccaaccaattagtcaatgcatatggggaacgaaaattaggtgtattgtccatggctaccatatttcttttgatctagataatttaatttttgtggaacctaatgatgatgcacaatctgaggaagaccttgatgatgataatggagatggagatgatgatgaaagtgatgatattcatggagatgatcctattagaggattggacatgcttctttga

SEQ ID NO: 38430 - DNA, 1524 bp, Glycine max
  Peptide Sequence Number=SeqID_155208
atgggaaacatgccaaatgtggttgtgttgtgtttctgtctctggaccctgttgtttcctcttgtgttctgtgcacccaacgatgggttgcgtaggattggacttaaaaaggtgaagttggacaccgatgacgttgtggggtttaaggaatttcggtcttcaattagaaagcatcaccttcagaacatccttggaggcgctgaggacaccgatgttgttgcgctgaagaattacttggatgctcagtattacggtgaaatagccattggtacccctcctcagaagttcactgtgatttttgacaccggtagctctaatttgtgggtgccatcatccaaatgttacttctcggttgcatgtttcatgcacgctaggtacaggtctagccagtccagtacctacagggaaaatggtacttctgctgcaattcaatatggtactggagcaatttctggtttctttagcaatgacgatgtcaaagttggtgacatagttgtaaaggaccaggaatttattgaagcaactagagaacctggagttacatttgtggctgctaagtttgatggtatactaggacttggatttcaagagatatcagttggatatgctgttccagtgtggtacactatggttgaacaaggtcttgtaaaggatccagtattttcattttggctaaatcggaaaccagaagaagagaatggtggggagcttgtttttggtggtgctgatcctgctcactacaagggcaaacacacttatgtaccagtgacacgaaaaggatattggcagtttgacatgggagatgtgcttatttctggtaaacccactggatattgtactaatgactgttcagcaattgcagactctggaacttctttgttagctggtccaacgactgtaattaccatgataaatcaagcaatcggagcagctggagttgtaagcaaagaatgcaggtccgttgtcaatcaatatggacaaacaatcttggaattgctcttggctgaagcaaagccaaaaaagatctgctcacaaattggattgtgtacctttgatgggactcatggtgttagcatgggtatcgagagtgtggtggataagaatgaaaaaaaatcatctggtggcattcgggatgctggttgttctgcatgtgagatggctgttatttggatgcagaaccagctgaggcagaatcagacagaagataggataatagactatgccaatgagctttgtgaaaaattgcctaacccaatgggaccatcatccgttgactgtggaaagctctcttcaatgcctattgtttcctttactattggtggaaaagtttttgacctttcccctgaggagtatatactgaaggtgggtgaaggtcctgaagcccaatgcattagtggctttactgctttggatgttcctcctcctcgtggtcctctatggatccttggagatgtcttcatggggcgctatcacaccatctttgattatggtaagttgagagtcggatttgctgaggcagcatag

SEQ ID NO: 38431 - DNA, 1308 bp, Glycine max
  Peptide Sequence Number=SeqID_155209
atgggaaccactatggtttcaagcaaattttcttctttctcatattgcagttcaagaagaatagctgccacaatcaatgtgccgaagattaaggtaaccaaaatctccactccaaggcctcccaacaaagacttggtggcagaattgaattatctaaataactacatttcagccaccagcacaactcatgcaaaagagaatccttgctactccaatatcagcactaacagttccacagcacctagaacaagcacaccaaattccattgaggctgttaagcttcatttgattatggagattgtagcagaaagaatggagatgcacaagaatatcggagcacagcgcgacaactggaactgcctgctaacgacatctgttaatatgatcactctctctgctgcaaccatggttggccttgcagctgttggttcaagtggagcacctattgtggccttgaaggtgtcctccacaattctttacatggcagccacagggttacttgtggtcatgaacaaaatccagccatcacagcttgtagaggagcagagaaatgctgctaggttgttcaagcagcttcatggagaactcagaacaaggctttctgttgggaatcctagtgaaaattatgttaatgaagcaatggagaaagtcttggcattggacagggcttaccctcttcctctattgggctcaatgcttgaaaaattccctcaaactgtggagccagcagtgtggtggcctagacagaagcaaaggtgtgtgagaaaagaagagtttggtgggattgggaatttgaaagggaagaatggatgggatgcaagtttggaagatgagatgaaaaaggttgtgatggttttgagaaagaaggacatggaagactacttgaggttggctaaaggagttttgaacttcaacaaggtattggcagtttctggtccactgctcaccggccttgcagctttaggatcagtttttttgggttctgtgaatgcatcttggcctgctatgcttggggttattggaggagcttcggcaagtgttgttaacacattagagcatgggggccaagtagggatggcgtttgagatgtataggacaaccactggcttctttaagctcatggaagagagcatagagctaaatataaatgaacaagatcctcataaaagagaaaatggggaattgtttgaaatcaaagttgctttacagctaagtaggagtctctcagaactcaggcaatttactgcttcaatttcatcctcatataaagagaatgattgtgaagagtttgctagcaaacttttctag

SEQ ID NO: 38432 - DNA, 411 bp, Glycine max
  Peptide Sequence Number=SeqID_155210
atgatcacctggaagcctccgtggcacggcagcgttgacccggcggcagtggtttataggatcggattcttcggcgaggagccggagattcctagttatgtgtcggagcaggggagggactttttgggaaagtgtttgaagagggaccccagtgagaggtggtcggtggaggagcttctaggacacggtttctgggattcgttagagacagctccgcatgaagcacgtgattgtccctctcttagggacagaattcgtaggttgttttcgaatgagcctgtttgtgcatggaacgatgatgaatgggttacggtgagaggcaatgaggtccatgacatgcagttggagggtgaagggttgtccttcacaaaacggacaccactttttgtgatgaagagaatgttttggtaa

SEQ ID NO: 38433 - DNA, 258 bp, Glycine max
  Peptide Sequence Number=SeqID_155211
atgactcaacataagaagaagcagatgatgatcagagcagtaccaagggagagaagtacaactgatttgatcccagaaggatataaagttctcattgcaaatagccctatccagacgaatgtcaacagcaatggaagtcaagtccagccagagctgtctgcgaatgatatgcgaggtggaagcataaatagctgccaaacaccagatattggggataagaggaagtctggtattgaaggcaatgaacttcatttgtag

SEQ ID NO: 38434 - DNA, 693 bp, Glycine max
  Peptide Sequence Number=SeqID_155212
atgcaaagactaaaaaccaaggagactccaagcttcaattcctatgcattgtatgcatatgaaactgtttggttagtagcccgggctcttgatgcttttgtcaaaaaaggtagtgttgtgtctttctcctttgaccctaagttgctcgaaacaaatggaagcatgttgcatttacattcacttcatgtttttgatgatggccctttgtttcttgagacaattttgagcaccaatttctctggtctgactggaacaactcactttgatattgaaaggaatagaaatcatccagcatatgatatgttgaatattggaagatgtggaatgcgcaaaattggttattggtctaattactcaggtctctcagttgtcactccagaaattttgtataagaaaccagctaacacttcaacaagcagccatcaactgtatggtgttatatggcctggagaaactgcaactaaaccaagaggttgggtgttccccaacaatggaaagccactgagaatagcagttcctaaccgagtaagctacaaggagtttgtttctaaagacaataaccctcctggagtaacaggctattgcattgtcttggaagctgccataaagttggtgccttatcctatcccacgagaatatatattatttcgacctggtaatataaatcctagctatgatgaccttgcaagtcag

SEQ ID NO: 38435 - DNA, 360 bp, Glycine max
  Peptide Sequence Number=SeqID_155213
atggtaaggcaacctttgtttccaatggaagctttttttacttttactcatctattattgtgtggtcgtaatccaactgctgggcatgttcagaacaaccagttgaatccagtatggaatgagcactttgaattcattattgaagatgcgtcaatgcagcacttgaacctggtaaagtcaaggacgtgtggcttaacctggttaaggatttggaggtccatagagataacaaatacaggggtgaggttacttcacgtgaatcagattataactaaggaagttggtgatggaacacaggtacaagttgttgcagaagcctgcagcatacgtgctctcggaaagaagaaaatgtccatgtag

SEQ ID NO: 38436 - DNA, 867 bp, Glycine max
  Peptide Sequence Number=SeqID_155214
atggcttttatgatgcaggacgagatcggctgtttatgcctgttgagtgttatgagcaaaatcattgtcttgcttctcgtgaagtcatccttttggacagattgtttgttatcttccagaaaattcgatgaagagttggatgctgttatgctagctgctcaggcattggtttataatttgaagaagttaaatggtttaaacagatatgtgaaccaggatggggttgataacttgcagatggcatcactgcttgcactctttgtatctgatcattttggtggcactggaagtagcactagtataagttctcccactgaaccagttgcaaacaccatagaagatatcactctttcgaagatgggttacctacatttttcaccacatgcctggaatatcattctgattaagaggggtgctacatgggttcaaatgctgattgatgcttgtcgacctcttgatataagagaagagaaagatcctgaatatttttgcagggggctccttaaacaccgtgtattaagatctgcaatttttatggagtatgtggaagggggctccttaaaaaattatctggagaagctgtcagaagctggtgaaaagcatgttcctgtggagttggctttgctattgccaaagatgtctcatagagatgatggaactcccactgtgaagctctgtcattttgatagtgcagtgccactaagatcaactttacatgtgttttgtattgctcatgcgggaacacgtcctccctgtatatgtgttggaacacctcggtggatggctctagagatcgatacagatataagattaatccagtatctagagaagggtgaagacaaggtcagccttggacatagtccaagg

SEQ ID NO: 38437 - DNA, 388 bp, Glycine max
  Peptide Sequence Number=SeqID_155215
atgcaagaggctagtgcacatggaaataaggaaatgcatgagcctaacctcctacggaagaataggaaaaggcagatgaagctcatgaatgcagatgaaaacccgaaactcacatttcattttccacatggggagacaaccataactttacaagatgtggccctgcaactgggcctcaagattgacaagctgtcagtaattggtgccattactggtgatgtacgtgttgcttgtcaaaccttaccaagtgacactccacctgataagtatattaagggaaaaatgattcatctaacctggttgcggcaaaattttcgacaacttcctattgatgctaatgatgttgtgattgcacaacatgctagagctcatatcatgatgctcatag

SEQ ID NO: 38438 - DNA, 312 bp, Glycine max
  Peptide Sequence Number=SeqID_155216
atgaagttcagtttttccgccgaagatggtaccaagacatttccccacgttgaagcaagagtttcagcaaaagatgtcctcattagagttatttgtgacaaagaaattgacattgtaacgaagttattgtccaagcttgcagctcataatctctccatagtttgtagcaatgttgttccatttgggaattctactctaaaaatttccatgattgctaaggtggaccgtgaattcaacatggcaatggacgacctagtgaaaaaattgaacgaggatttgctgaagtgctgcaacttgcaacaagaatattaa

SEQ ID NO: 38439 - DNA, 714 bp, Glycine max
  Peptide Sequence Number=SeqID_155217
atgaggcgtgccctaactcatcaagtagctcatcaattgtcggaatcgggaagcaatcgcaaacggttaccgaattcaacgcacgataatcaacacatattctccaggttccgtccttcttcttcactaagaggactgcggtatggctggacgttcattggaggggttgaggggaggaaggttatatggtggtctatggctcactacggcggaaggtggaaaggtgtttggaaaagttgttggaattggttgaggagtgctttgatggctgaaatcaggtggaaggtgaccataaaagggtggccttggaggcacgtgaagagaggaagtaggttgggtgaaaaggtggaggaactgggcgattcgcggttggaggaagttgtgggtgctgccgctatcaatgaggatagtgaggcgtttatggcggataacaccgaagaggcgaaaggtctcaatgatggaagacccgaaagtgcatggaggctaatttgtagcaaaggcccttctcacggtggagggccatttcatctggggttctttggacgtataaaggcttgggtcttgggtttgggtgagtgtggtgggtcgacggtgaaggcaggattatgtaggtttgtcatgattcatattctccaagaaaaggtcctaaggcttattctaagtccaactcttgagaaggtacttcaatgtgcaaaggtatctaaggtttactaa

SEQ ID NO: 38440 - DNA, 474 bp, Glycine max
  Peptide Sequence Number=SeqID_155218
atggtacaatggccacctccaaccttggccaaggaacttcgagcttttcttggcctcactggtttcaatcacaagatcattaagaactatgcggccatcgcaacacctctcacttcactactgtgcaaggacgcattcgagtggacttcgacctctcaaaccaccttcgatcagctcaagatcacgatgaccagtgctctggtcttagctctaccaaatttcgcgaaatcgttcgtagttgagatagatgctttcgacacagccatgggggcagttctcatgcaacatggccaccccgtcatatttttcagcaaatcctttgggcccaaattactctgtgcctccacatacgtaattcagatgctggagcagcactactacctatccaagcagctaggattcaactacaccattcagtataagtcagacgcttccaacgccgtggcagatgccctctcgcgtacaccaccatga

SEQ ID NO: 38441 - DNA, 171 bp, Glycine max
  Peptide Sequence Number=SeqID_155219
atggccaggggtccatcattcaaaggagagtatgacgctcacaaacaaaatacgaagctgctagtagccatcgaaccaatggttgtcaaagcagaagaaggtgacaacgatatgaagaagaaagaggagatcttgagtgtggggtatccggagaaaattgttgctcattaa

SEQ ID NO: 38442 - DNA, 1335 bp, Glycine max
  Peptide Sequence Number=SeqID_155220
atggcttccatacaaacctcaaccctactttctcatacttccatgtcttcaaagaaaatacatgccgcaatccacgttccaaagaaactctcaagagtggatgtttcagccccaaagttacgcaccataaagcaggcagaggaattaaaacccaaagacacaagtctaatgttagaaaagaagagtttcaacagcacaatatcacatgatattggtgaacaacagcattctacaaaccctaacgcgcttattcaactctacgcaatcttggaagctgtagctgatagagttgaaatgcacgacaacattggcgagcaacgtgacaactggaacacgttgctcttcaactccatcaacatgattacactcactgccacaaccatggctggtgttgcagccacgtgcggtgcaggtgcacctcttttggctctgaagctatcttctgctcttttgttttcagcagccacggggatgtcactcatcatgaacaagatccaaccctctcaactcacggaggaacagcgcaacgcttctaggttgtttaggaaccttcagagcgaaatagaaaccacacttgcactcgggaataaccctacggaggaagatgtgaagggtgcaatggagaaggttttggcgctcgacaaggctttcccacttcccttgttgggagcaatgcttgagaaattccctaagaagtttgagccagctgtgtggtggccttctaaaccctacgagggaaaaggaaagtcagagagtgctgtgcatctgaaggaggtaaacaccggagagacttacccttggactccaacacagagaatgggaaagatgaatggatggagtgaagaactagaaatggaactgagggaggttgttgaagtggtgaagagaaaagacagtgaggactatgagaggcttggaaacatggttttgaaggtaaacaagactttggccattgcagggcctttgctcacaggaattgcagctgcaggaactgcatttataggcaataatggttcttggggagcattggtgcctctcatggctgggtcattggcttcagcagttaacagctttgagcatggagggcaagtaggcatggtttttgaaatgtacagagcctctgggggattcttcaagatgttggaaacttctcttgaatcaactttggaagaggaagatttggagagaagggaaaatggggaactctttgaaatgaagatggctttgaagttgggaaggagtgtgtcacaactgagggaacttgcttctaaatcaacttcgtatcgcatggaaggagttcttgacatagacgaatttgccagcaaacttttctga

SEQ ID NO: 38443 - DNA, 327 bp, Glycine max
  Peptide Sequence Number=SeqID_155221
atggaaaaactccctaacaataaagtgtttagccctccattagcatggagagctcattacaaggctaaaaacaagatagaaatggaatgccttggtgttgtgttttcttctcacctatgctgcatgtgtcccttggtttccctttctcttctagctttaaagacttttgagtttctcagattacgaatgcgcgctcagcgagcatgtctcgctgagcaagagttagtgactaagcgcttaacgaatgtagacgcgctaagcgtgagaagcgacaaaggcttcgctgagcgagctgactttctcgctaaacagattagcctcgcttag

SEQ ID NO: 38444 - DNA, 1254 bp, Glycine max
  Peptide Sequence Number=SeqID_155222
atggcttctttacaaatttcatctttgctttctaacaccttttgttcaacatcatcatcaagaataaaatcttttatccacatcccaaaaaaactccctatacctttttccaccgctccaaacccaaaaccaagtagaaagctgtttgaggaattaaacggtttctcacacacaatcccaatactccaagacaactcatgcaacaacaacacaacctcaaatgctaccattaaactctacgcaattgtagaagctgtagcagatagagtggagatgcatcacaacataggtgagcaacgtgacaactggaacacccttctcttaaattccatcaacatgctcactctcaccgcagccgccatggccggtgtcgccgccaccatcgccaccggtgacgcgccacttctggctctaaaactatcctccacgctcttgttctctgcctccacggggatgctgatggtgatgaacaaaatacagccttcacaactggccgaggaacaaagaaacgctacgaggttgttcaagcagctcaagtcccacatcgaaacaatactagccattggaaaccctaccgaggaagatgtcaaggactcaatggaaaaagttttggcacttgacaaagcctacccacttcctttgttaggagccatgattgaaaaattccccaaaaaatttgaaccagcaatgtggtggccttcaaagagaaacaactccaaataccatgaaacaaacaaacaacatggtatgaacaatggttggaatgaagggttagaaattgaacttagagatgttttgaaagtggtgaaggaaaatgacatgaaggactacgagaggctagggaacttggtgttgaagataaacaagagtttggccattgctgggcctttattcactggcgttgcggctgtgggatctgcatgtttgagccaagattcatcatggggagctatagtggcggttttgggaggggcattagcgaccactgttaatgcttttgagcatggcggacaagtggggatggtgtccgaaatgtacagaaactgtggtggattcttccaactgctagagaattcgatccaagagactatggaggaagatgaagaacaaagggaaaatggggagttgtttgaaatgaagttggcgttgaaattgggaagaagtttgtcacaactcagagatcttgcaagaaaatcggcttattctcgggtagagggaacaaccaccgatgaatttgctagcaagctcttctaa

SEQ ID NO: 38445 - DNA, 651 bp, Glycine max
  Peptide Sequence Number=SeqID_155223
atggcatatttttcttcatggcattacaatatttcagagaattattggcaattgaagaaacatgtgcctatcgaagaagagtctgtttctcagatcagaaattcatccatactgagaaatgaggattatttttcttcatgtgctatgctatctcttaatgtcaaggatcctcgagaattgccatggaaaaagactgttgttccagtggagtccatttcaactaagactccgagtgatgcacaagaaaagaaatacaaagaggttgctgaattgggaggaatattggaagagaatagagatttatcttcattatcaaggtctaaacttgtagacagccagtttgatattgatggatctatgaccagagggttgaggcctccagtggaagacagttatctttctaaggagaaacaccatgaacgtatggttaatttctgccttgatgatatacattctggagaggtcaactctacaactacggtgcagtgctcgagatgttgccctattcttcttttaaaaaatgatatgaaggaattgactataggggttcagggttcagggttcagggttcgggggttcggggttcggggttcggggttcggggttcagggttcagggttcagggttcagggttcagggttcagggtttag

SEQ ID NO: 38446 - DNA, 542 bp, Glycine max
  Peptide Sequence Number=SeqID_155224
atgttgtggctggccagtttgaacgtggactattggttgatgttattggtgttgtggaggaggttgtcttccggcaagtttcaggaaaaggtagaagggtagtcttcaaattaaaggacttaagccagcaattgctatcttgcactttgtgggatgattattgcttgcagtttttgaagttcttagatgattatgaaggatcttatcccgcatcgatcaacaattttttcaaggcttcaaagttaattattaaccagcccgtgatggagattcaagaattcaatgaacgatattttttgcttgcagagttgggcattgatgcccggttaggttttaaatcccatggtgaagggagtacacaactttcaggttctatgcaattatcatcaaaagaatcattctttggcaaggctgaggcaaagactattgctgacattaacaccatctctaaagaaattgtttgtgtcactgttggcacaattactaggattgttctggacaatcattcatggtgttatacagcttgcattcagtgccattaa

SEQ ID NO: 38447 - DNA, 774 bp, Glycine max
  Peptide Sequence Number=SeqID_155225
atgatgtccgccacgcttccctgcatcgggcgtttcgccccctctccttccggtgatcttcatttcggttcgctgatagctgcattaggcagctacctgagcgcgcgcgcgcagcagggccgctggctggtgcgcattgaagatatcgatccgccacgtgaagtcgccggtgccgcaacgcgcattctgcgtcagctgacgcattatgggctgcactgggacggcgacgtgctgtggcagtcgcagcgccacgaggcctatcgcgcggcgctgagctggctgcgcgaacatcgtcaaagctacttctgtacctgcccgcgcagccgcattcagcagctgggcggcttttacgacggtcactgccgcgatttacatctgcagccggagggcgccgcgctgcggctgcgtcagcatgcgccggtgtacggttttgacgatcgcctgcgcggccatctgcaggcggagccgcgtctggcgcaggaagactttattattcaccgtcgtgatggactgttcgcctataaccttgcggtggtggtcgatgaccattttcagggcgtgacggagattgtgcgcggtgcggatttgattgagccaacggtgcgccagattgcgctgtatcagcagtttggctggccggtgccggcttatctgcatctgccgctggcaattaacccggacggcgctgagcttcctagggcagtcggttttgccgggctggcaggaccatgggctggaggcgctgctggaccatgccgttacacactgggatag

SEQ ID NO: 38448 - DNA, 279 bp, Glycine max
  Peptide Sequence Number=SeqID_155226
atggatgggctagtggatcaagtggcaatcgatgcttctcttgcttatcaccacagtaaggaaagtccgatcgttgctgttttggtcgatgcctatgacacgttcgaccagagttgcaagaaaagcagtgcgaaaattgtttgttgttcacccactctctatgtatggctggtctctcacattttttgtcatgaaagtagacccgtctatccctacaaggtcacagcatgtgcgctaagaaagggaaagcaaattgggcgtagctcttggctggtatga

SEQ ID NO: 38449 - DNA, 477 bp, Glycine max
  Peptide Sequence Number=SeqID_155227
atggtaaaaaaggctaatgggaaatggcacatgttcattgactacattaacttcaacaaggcatgccccaaggacgcatatcccttgcccaacattgacaggcttgtggatggtgcgtccagcttccaattgttgattttcctggatgcttattcaaggtataaccaaatcaagatgcaaccttcagacgaagaaaaaaccaccttcataattgaagacgccaatttctgttacaggatcatgcccttcggattgaagaacgcaggggccacataccaaagactaatggattgggtcttcaaacaatgtgtaggtcaaaaggtagaattctatatatacaacatggtcgtcaagtctcacagcgtggcccaacacgtagcgaatttggaagaggtgttcagagaggttcacaaatatgactactcaggaaaactaagccattcctatgggatgaagcttgtgagcaagctttcttag

SEQ ID NO: 38450 - DNA, 354 bp, Glycine max
  Peptide Sequence Number=SeqID_155228
atggcttctccacctgcctcgcctccccctcctcctcctccttctcctcctcctcatcctccttcttctgacgcatcagcttcaccgtctaccgtgaagcggacacgcaaagcctcattggtcaatgttgatcctgctactggcaaggtcgacggtccccccaggaagaaattaagaacatattgggggattgtggcgcgtgataaggtggacgtgatgcagaatttgaaatcccagaggcttctgaaagtaggacgaagaagaagttactttagactgtcgacgagagatggaggcggttcaaatcagacctcacaaggaaatgggcccttgcagccgattaggacggtgtag

SEQ ID NO: 38451 - DNA, 3399 bp, Glycine max
  Peptide Sequence Number=SeqID_155229
gtcaacccggtgcctggtaatctctccaagggttgcatggcctctttgattacagactttaacatcatcaaacactttgttgtggtcactctcctaagcctccttcgatcacccaagtcacttcgtgcttgcctcttaagggttggattaaaggaaactcagatggggttgctagaggcttgtcaagcccctcaacttggacaagcagtgtcctggttaaaattgatagattgtctaagtgcattgaagagaaaagttttgtcgaatcatgtgtatacttctgaggatgggaattcactttggattatgggtttcagacctgagcagaggatggctactaactttgtttccccctttgatcaaaatcttcttcgattagttgggggtgcaaaactcaaccgatgttgtgaagtggaacatcccaaagtggccaatgctattgccgtcctagctgaagccgttacgtctaactaccagttgtcgtccaaggttgatgatgtctttgctaagctaataagcataagaatggattgtgacaaggtgttcaaacgccataaagacttattgaaagaaaagaatgacttggcgagcaagctgagagagttggagctcactgtgtccagcctccaaactaagctgaaggattccaagcttatggcgacaaaggagaaagagcaagccatgttcttcactgagggtcttgacctaggtctttttgacccatttaaagatgtgaaggtcggtcaatttcttgacaaggaagagattattgacggtgcgatttttccttacttgacgaatttgtatgaaataaagaacaagatggcatccgatcatctcgagtttaatttcaacctggttgaagagactcaccaagggtggaacttgggtttgacaagcctttggagattcgaccagggatgcgtccgtcctgagtttggcgagactcaccaagggcagaccttaggtttgacgagtctttggaggttcgaccaaggacgcgtcgatcttgagtttggcaagactcaccaagggcagaccttgggtttgacagggatgcgattcaccatgggtgcactcgttgaccatgttggcgaaatgttcttcctcttgggggcatctcacatgagcctccaactcatcatggccggccttcaattttctgagttcctcctcatggcaacgttccatctctgcagtgtgggaggatttgaattttctgggagtggctctcgccgaagaccagagcatgtgctaacgatgagtgcagggagagagaggcacatgcttgttgctcgtgcgttgaattgtgtgaatgatcgtgtagagggttcgatggaacctgctctaagtcagcttgtgggagaaagagattgtccaatgtcgaaggagattgtcccatgtcgaaagaatttgtctgatgtccggggtagtagtcttgagaatcctcgagtttggacaagtgttgtctgggctgcttttgtcacgttgcctgtgatggacacgtgtgtgcaatgcacgcacaatactcttgtatacgtgtcactcacgaattgggcacttactagagtcgtggttcgtgcatgggtgggggtacttccatcttccactatgtcttcattcttgtctgattccgccatcggcatgggtggtgcctccgacaggaagtcatcctcttcggagaaggtgagggcttcgcgtcgtactggtggtgagcttgtcccggttattgtgatcctccccccttctgcttttggggttgtgagaagaggtagtggtggagatgtcagggagtctccccgcgtgcgacttagcaatagcgttgggtcgccatcatccatacctatcattgctggctatgagtgggtgagggacaatgttttgaaatacaagtcctctcttacctctgcgtcgagtgtcgctgcacttcactaccaggtgaagctggcgagtcctgaggactcttgcaaaattatgtttgaggtcttgggtctcattcttcccttgaccgttttccagtgtgctctacttgagcacttaaatgtggcgtcttctcaactccacctaaaaagttggccaatgctgactggcgagattggatgggtctccttgaacaacgtgtccaagaagctatttaagtttgactcaaacatttttcaccattttaaggactatttctttaacgttctagctaccggtgtcgtgactgacgatacaccactaatgtttaatagggatggagagccttactttccattctactggcagtttgaccctaccaggttcaagtggtatgatgaggatctgttgaaccttgtggaaaagaccgacaaggctatcttggaaaagctgtcgacctcgctggatgcacaagtcattttatctcttccttcggtaagcgatccccttgttgtcgtggatgccatcgaggctcttgtggctgctcctactcattcgcctccccttgttgttgttattcaaaaggccactcctgttgctactagagttcttgtgctagctactttggatggttcttatgtgacatcgtcatccaccattgtttcacatttgctgagtgctgatgtggtgaccactaatgctcctgtagtacttccttcttcctcttcagctctaatggttcccccctctactattttggtgacggcgttgccttctttgtcttctcgccctcgcgtctccttagatcatgtgtacacctctagtgatgttgattcgttgtggggtgcaacttttaagccggagcataagaccctgattggatttgtgttagtctttgataagaaccttattaggtcaactggggctactgctcgcactatttggagagtggagcgctctaaggtggctaatgccaccattgcttttgctgaggccttaaggtcgaacctccaactgtcttccaaagttggtggtgtgttggcaaagttgttgcgcaccaagctggatggtgatgacttgttcaaacgctgcaaggatttgcaggtggagaaaaaggacctaggcggcaaggtggagagcattacgactgaaaaggatgagcttgtgaaggtagttgctgagttagaggctcgacttaaggagtcagagtctaggctagaggagtttaagctacaagcagctaaggagggggaggctagcaaggagcttgaggaggaactgctcatttacaagaaggatgccatggagcaacatgaaaaaggattcaacaaggtcgtcaagcaagtcggattcttcgctaaagaccttgacttgggtctctttgacccttttaaggatgtgaaggatggtgtcctgcttgatgaggaggacattcctgcgaaggaggctattgatgaggagcagagtgttgtggagcaaggcggtgatgcctgtgtctag

SEQ ID NO: 38452 - DNA, 738 bp, Glycine max
  Peptide Sequence Number=SeqID_155230
atgtataccaaatgggttatgtactgcccagggttcacaaaatataagtggcatcctacatggcatttgaagacacatgtcaaccctccatgtcagtcaacgtgtaaagtcttggagcccactttggccatgtccatcctgatgtatcttatctccaaattttgcactcagtctggcctcagacgcgagatccctcttgaagactctcatcctcgttttacaactatgacagacacagacactcgacaacaactccaaaactacatcgcagagatggagcgacatcacaaggaggagctaagaaagctaaaggctgactatgatcagctagaggctcgtgtcagacgtccccaaggtaacgagcactctgcttacactttgtctaagtgcacccaaggggaatcacacccccgacgcataatcaacactgcaaatgacttaagtctctcccgcatgcaccatgtagtagggcgaaccacccatcgacatcattttgtcgaccacattatagagacatacataccctttgggtggaaaccactcaacctcgagcggtacgatgggacaatagattcagatgaacatctgaatgccttcctgactcaagcgaacctctacactaataacgatgcgattccatgtcatgtctctccaacatccctcaagggggtgacattgacctcgcttagtggactcccacctaggtccatagacatcttcgacaccctcgttgagtga

SEQ ID NO: 38453 - DNA, 1527 bp, Glycine max
  Peptide Sequence Number=SeqID_155231
atgaggaagggtattgacttagagaatactttcttgttgaatttctacttggccttcaaggatgatcccggccttgcttcctctcatgttggacacaccgtcaacataaagggacatcatccttcctacgagttcaggctttctcaaaacctacttgatggggtagttcgtcatgactaccacttgatgactatggaagttgagctaatggcttcgccagctactaagagatacaggagtgggggtacccctggcatgggtcaacttaaaactgtcagtgtggttgtggtcttcttgaaacttctggatttcttggatgttggttgggatgcacatcttgagtatggcagtgcattagttggggttggcttcaataccccaatgagtagtcatgaagtcgaggaacttgcctccacctaccctggaacatgccctattcaaattagtgtagtcgatgcatattcgccatttgctattggcttttttgaccatgacgacgttggcgagccagtccctactgagtcgcgtgcactgcccgggtttaggtccaagttacagcttaacaagctcttcgataggttttgggcctctatcagaggtgtcgtctcgcggatctatgtcgaattcattgcccaggctcgcttagtagatggtcaggactcggatttgagacccttcatccacactcatgacttgagtgccttcaaccgctataggctaaggcttggcaagctccttggtgaaaggatatgggtagggaatttcattttcaaatggggcgtggagactggctccaagctcgttaaagctcctagagagcttgccttgattaaaggtggtcatcaagtccatgtagcctttggtttctactctcttttccgcaaagccgaggaatggatcgacgtgaggatggacagtgtcaagggagatcccaagtctttggaaagtcttccagtgcaggatataagtggaactgccctgatcaataaggaccctggacaccatgaagtttgtagtgatgatcgagacaaccacggggtcgtcttggttgatggggttgatacccttgaagtccatatccgtaaagagattattgctcacgccgctattgttgttgtctttgtctaccttggtctttcgctcttcttctgtctgcttcgtggttcctatgttgctactcttggtgtcctccaggtcttgcccaacaatattatgtgttatgaccaataccgcgatgatagtttgatgggtaccttcaagttgaaagcttcctctagaatcgtagtgcgattagtcattagggtcggtcttggtgtttgtttctcacttgtaatgcttctgtccatcttgttggacttcattcctgaatctgaacatttcttccatttaaatgtagtcattggcttgttcgcacaactcgtcaatgctaccgtgaggttttttccacagactgtcggcgaacttatctgggcggacttgttgtctacttgtcacaaactggccaaggcggtcgaggtcatgcaatga

SEQ ID NO: 38454 - DNA, 228 bp, Glycine max
  Peptide Sequence Number=SeqID_155232
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcaattcttcatttgacattttatcttgccttgtgcattgtgcagcccgatctcattccttga

SEQ ID NO: 38455 - DNA, 339 bp, Glycine max
  misc_feature (15)..(15): n is a, c, g, or t
  Peptide Sequence Number=SeqID_155233
aggaaaggcttaggnccaattgaaggaggtgaagattatgcctttgctaacctaaaagagttgttcctagtacccaatatcatcacccctcccaagttcaaggtgctggactttgacaagtacaaggggactacttgccccgagaaccctctaaagatgtattatcggaagatgggggcatatgcaaaagatgaggaattgctgatgcattccttccaagaaagtcttactggggtagctgttacttggtacactaacttcgaaccttcccgagtccattcttggaaggacataatggttgccttcgttaggcagtgtcaatataatggcttcggataa

SEQ ID NO: 38456 - DNA, 770 bp, Glycine max
  Peptide Sequence Number=SeqID_155234
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctctcggtgcgccatcccgaaggcgggatgaccacgatggacgaagtcgattttgccgacatggtggagcatacgccggtcaccagctacgtggtcgaatatcgtgagccgtcgccggacggggttacgccgggccgcctcgtcggcgcctgcctgaccgaccggcagtgcgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 38457 - DNA, 399 bp, Glycine max
  Peptide Sequence Number=SeqID_155235
atgaggggagcagtgaccttgttggatatccctggtgcgggaaatgcagtgggggtgtatcactcagtttggaactctcttgagactcaggctgatcaccatgggggggaggggggagttgcctgtgcacgacagggtggcctcgacacttactgcttagttttcctaagtgagagtgtcgtatggacacgcttaggctatttccttggggatggtaccacattgcatctaagagttgaggtcagtattagttctttttataatgaactcacccttgcaattttgtatcgtgcggttgatacttgtgatgatcgcgaacctagttcgtgggagcagaatgacagtagtagagtgcaggaagtgaaattctgttgtggagctgccgagccaacgcgatga

SEQ ID NO: 38458 - DNA, 237 bp, Glycine max
  Peptide Sequence Number=SeqID_155236
atgacaagtgctaagtgtagggacaagtggagaattctgcataaaccatatcatctctttctccctctctcatctaatccagcatctgcattgggtcaattgtatcagcgattcaaaaaatttgcaatgaactcgctcagcgagccttcaacgcttagcgagttcatctatactcattgcatacatgcatttctggtagaacttgctgggcgcacctgtcgcgctaagcgagtctag

SEQ ID NO: 38459 - DNA, 228 bp, Glycine max
  Peptide Sequence Number=SeqID_155237
atggagatttgtaagacccatatttctttcctaggaacagaaatagcaaacggaaaaataaggcttcagcctcacatctcccaaaaaatccttggctttccagacaaaatggaagatataaaaaccctaagagcctttctaggcttgcttaattatgcaagaaattttactaaagacttagggaaatatacaactcctctttacaacaagacctccttaactggatag

SEQ ID NO: 38460 - DNA, 615 bp, Glycine max
  Peptide Sequence Number=SeqID_155238
atgccatatcctgagagtgcaaatcctgcatcgtgtctagagaatagcttgatattgtctgaacttaattacaacaatgatgaggctagatcagaattcgaaaatcattttctatccatgacagacgaacaaaaacaaatttatcacaaaattatggaagttgtcaacaacgatgaaggtggcatgttttttctatatggatatggaggtacaggaaaaacatacatatggagaacattagcaagttcactaagggcaaaaaatcaaattgtgattatggttgcttctagcggcatagcttctttgttattgccaagaggcaggattgctcattccaaatttaagatacctgtgccaattttcaaagactcaacatgcaatatacttcaaggaagtcaggtagcagaattgttaaatcagacaaatctgataatttgggatgaagcacccatggcacacaaattttgctttgaagcacttgatcaaactttaagagacattattaaagaaaaaaaaatcccaataaaatttttggaggcaaagttattgtatttggtggagatttccgacaaattatgtcagtcattccaagaggaagtcgttcagacattataa

SEQ ID NO: 38461 - DNA, 309 bp, Glycine max
  Peptide Sequence Number=SeqID_155239
atggaatttggttctagaaaatccactatgaaagacataatgacaaaacttgaatattccactgtgagaatgattggactgcatggaccaggtggtgtggataagagcactttaatcaaagtaattgctaagaaagcacgagacaagaaactatgtaatgtggtggttaaagtagaaataacacccaattccaaccaacaaagaattcaggaagaaattgattacgtgttaacaggggagtccaattttcaaaagaggatattttttaaaaataaattgaaaggaaaagtggaaatatcaaatgtctaa

SEQ ID NO: 38462 - DNA, 210 bp, Glycine max
  Peptide Sequence Number=SeqID_155240
atgggggcaaaatggtcaatttgggggcattcctcagcccttgggccaacctgggccctgtcataccctaatttcgtccggggaccattgtttcatggcatgcaacctttggttgactgcttcgaggtacttggcaccctttcttgcacaatacgtgaagttccgagacatgccagaaatcaaaaggaagcattgttacgcaatccgtga

SEQ ID NO: 38463 - DNA, 138 bp, Glycine max
  Peptide Sequence Number=SeqID_155241
atgcatactaagaggaaacttcaagtaacctttgtttctgttgtattattgttggggctagggttaggctatgaatcatggacactgctcatcattggggtgtccccctatccgacactaacacccttacaacactaa

SEQ ID NO: 38464 - DNA, 246 bp, Glycine max
  Peptide Sequence Number=SeqID_155242
atgtatgcatcggataaatttagaggatgggctaaaccagtaagacagccacagagaagactcaacccggtgattcttgatgtagtgaagaagaaggtaaccaagcttttgcaagctggaatcatttatcctatcttcgacagccaatggattaaacaagtaaataacacaagagaattgttaacccagttcggtgcaacctcacctacatctgggggctaccaagccagggaggaaatccactaa

SEQ ID NO: 38465 - DNA, 145 bp, Glycine max
  Peptide Sequence Number=SeqID_155243
atgaggaagaatccagaagaagatgagctattaggttcactaagcgcaccgctccaggtcatcaagcgcactgcttcagctcatctgctaagcgagataagcgcgctgagccaaaaatcactaacatgcgctaagcggtccatac

SEQ ID NO: 38466 - DNA, 291 bp, Glycine max
  Peptide Sequence Number=SeqID_155244
ggactttgggaccttaccttgaacgtcacacatcttcatggcctcatcgatttcgcatatcagttatgtaaaagagttaagctaatatgcgaccttcattcactagatgtgaagcaacctccctactgggggaaccctctaacccactttcccctccccgtcagaggagtattgtacatttacctcaaagatatggatcggtcaaccgcagcaggggaagagaagcagatgggaaataataagctcgacttaaaggagaggaagaataagaagagcaagctagacgtgcag

SEQ ID NO: 38467 - DNA, 180 bp, Glycine max
  Peptide Sequence Number=SeqID_155245
atgaccacatttaaggtttgcaacaaaccattcactatcctaagagaaaaattgcctaaaattattacacacaaatggaagtttggtaacctattggaggctcccaacacacttccaatgaaaggccttttgttacaatatttgaaagcaatgaaggaattaatgaagcattgggcttga

SEQ ID NO: 38468 - DNA, 237 bp, Glycine max
  Peptide Sequence Number=SeqID_155246
atggcagaatcgtcaaagaagcgaaaaagatcatcctccaccaccactgctgctggccatcgccaccacagaccatctgaagcacccacaacaccaattcatccttccttatcatctccaagatcatctactctattttcttcagatgatcaacatctaggtcaaggtgcatcctttgagggcaccattgttgatgactggaagtttcattattctagtcatgatgctcgccgtatg

SEQ ID NO: 38469 - DNA, 369 bp, Glycine max
  Peptide Sequence Number=SeqID_155247
atggttttgaagggcgaaactcatgttagtctaatagatttagttaacattgaaggtgtcgcaacctacccttcggcgggagggcgacgcggggctcacaggtgcatcttccaagagagaaaggcgcgcggagttgtcaccaacgtttatttgaggaaaacgtcggaaaaaccggaaaggtgtggtctacgaactttaatcgtgaaaggttcgggagttgtttttacgcacggggaagtggtcgacaagggtgtttccctcgctcctacgtattcctcaattgtgatgaggaaatcaaacctacgtagttctttgagaactaaacgttggttaagttgttttgatctttttccgcgagatcgattttaa

SEQ ID NO: 38470 - DNA, 474 bp, Glycine max
  Peptide Sequence Number=SeqID_155248
atggtggaagtggtcaagataaatgaaatcttgataaatggaggtgctactattgatatcctgccaattatcatgctgaaaaggtttggaaaaacattggaagatcctatttcaaacaatattgtggtgtctgattacagtggaaaggcatcaagatctcaaggtatgacaacacttgatcttatagttggtagtaggaggagaccgactttttttattgtcatttcttctcaagttagtattaatatgttattgggacgagagtggattcatggaataggggcagtaccatcaactattcatctcaaattgttcatttggaatgaaaaaggtggtcttcaagtggtgaacagtaatcaaaagagttatgattctttctatgtttcgattgctaagaaacatgaaagaacaatggctttgacaacaccattcgaaattgaagattcttattatgtcaatcagagggaagcatag

SEQ ID NO: 38471 - DNA, 915 bp, Glycine max
  Peptide Sequence Number=SeqID_155249
atgacacatgttgaattgtttgggaagtttagggaatatgaaagagagttgacaaggatggctgaagaagaagatatagataagataaatagaggtttagcattgaagactagcattccatcaagtaacgaaagtgaggatgacaatgcagaagggttggatgctgaaaatctaaacttgcttatgataaggttcaacaaattccttaagaaaaagaagaactatggaaacaaaacctttcagcctaagaagaatctcaagaaagtggaaccattttcctccaacaaacacacttgcttcgagtgcaaaaagataggttatattaaggtaggctatcccatctaccaaaagaagcaacaaagagataagaagaataagggttcattcaaaaagaagaagaaggtatatgttgctttggatgatgatgaatcaacaacttccagcaacaatagtgaagaggatcaagcaaagtcgtgcttgatggcaaacaatgaagctgaaagtgaggtaaccatttctgattcgaaaaatggtgataattatgataagctactagatgctttcaatgaaatgcatcaagaagcacaaaagttggccatttcaaattatcttctaaaaggtaaactaaggtggcatgtggataaactagtggaaattcaaaaagagttattggaagaaaaagcaaaagatggtattttagaaaaagaaaagaacaactcttcttgtaattgcactaaaaccactaatgtcacttccccttgtgaaggatataatgttttagaagtaaaggttgaatacttgctaaaaactttatccaagctcactatggggagatacaatttggaagcattacttgcacaactgttagacttttggcaagcatacccattatcgtcacaacttatagatttgtaa

SEQ ID NO: 38472 - DNA, 898 bp, Glycine max
  Peptide Sequence Number=SeqID_155250
gagaaaagagggaggtggttgccacccagctcgcccaagcgaactgggttgcttccatcagaaggcaccaccttcttttggaaccctcaggaaggcccaaaatgttgcgaaactttacggattatgcaacgatgcttgtttcatgggttccgaagggagcaaacaaggttcaaggaccgaccgcaagtactcccagataaaattagggtatgagagaagaaaaatgaaggcaaggtattatacacaaatccatgaaccagagttagttaggatggaagcggcagatctcaatttttttattcatgagaaaatagtcaacaaacatttaagtgatatgtcacagttggcagaaaagggaaagctcaacatagccaagttaaaacttggtccatctcatacttgtcaaatgttaaaacctgaagaaagtcagaacaagttttcaaatgctaaatatagttttgatgtttcaaaagaaagtaaaatatttaatattttacttcaaaacaagaagattgtttcatcgaaagggcataaaatacttcaagtcgaacaaagaaaagatactttaccagagtttctgataagaaatgaaaatgctaaagggaaattgttatgcccaaggtgcactgttgtgtttggaaaagtagcaaccaaatcattagagaaatttgaatatgtgagaaaatctcatgaagatgctgctcacaaggaactggataaggggaaacaacaaattagcatgtttgtcaacaaaatccaaaatcctgcaaatttttatcaagggaagtcaaattttgtgccacaacttgagtgcctccaaatagatggttcaactatgaggcaagttaaggaggaaacatgggtgggtattttggaggaaaaagtgttgctagtttga

SEQ ID NO: 38473 - DNA, 2212 bp, Glycine max
  Peptide Sequence Number=SeqID_155251
atggggtctaaaagacccttttcaaattcatcaaaaccctcgtcaccatttgttgaggacaagaagaatgtgaagcttaaagggttggaagccagccttggttccaagaagcttgttgttgaggagaatgatgttaatagctattcgattgagcttgagagattaagaaatgacccaacaatagtagacacggtgactgttcaggaactccggaaaaccttgaagagatttaacgtccctgccaaaggtcgtaaagatgatattttgtctgcctggaagagtttcgtgggcagtaacatgtgtgaactagattctcatgcacaagaaaaaaaatggccatggatttcttctgaaaatgcatctgtagaagtggaggctaaaaaagtattggatgaagaccatattgaaaatgtcaatgaaaatcccgagatatctgaacttaaccaggctaagagaaggttaaaacaatcagaatctgagagaaaaactatcaaagtgacaacaaagaagaaagtttcattgaaatcagacgaggattcagattttaagccttccagggcaaagagaaaagtatcttcagatgttgctagcattgttgtacagtcagaggaaatcagtacagctactattcaaactgaaccatggacagttcttgcccacaagaagcctcaaaaaggttggattgcttataatcctagaactatgagacccccacctcttgctcaggatacaaaatttgtcaagcttttgtcatggaatgccaatggattgagagcattgctaaaattagaaggattctcagcacttcaacttgcccaaagggaagactttgatgagaaggatattgaggaaatcaaacaccatctaatagatggctatgataacagcttttggacatttagtgtttctaagcttggttattctggaacagcaattatctcaaggcgggtcgtattcaccaccgtctgcgccgccgttcaccgccggccgtcttcactctggccaccatttcggccggagattgcagggtttggtgctcctcaaagagcgcaacccaacccaactagtcgcctgaccggaaacctctccacgcgcagttcccgttcgtgccaaacaccggcgcgtgaccaccacgcgccgccttcccgtggccggaatcacgcgcgtcctgtgccggccggctcgtcggactctcctgagtccatatcagtcatcgcgaaaatgacctcgtatggcctagtgctttctttttctggaacccccacaatcacaacagcaaagctcaattggaaaaattacttatcctggtctgcttcagtggaactttggtttcttgggcaagggcaccatgatcatcttgaaaaaggcgctgaggcagttccaaatgataaaagacccgagtgggaaaagctagattatcagctttgtgccgtcctatggcagtcagttgaggcggatgttttggagattctcagatcgtttaaaacatgctgttcattttggaaaaaggctcgagaaatctttgctaatgatattcagagtttgtttgatgtaaccatgaaggttacagctctcaagcaaaccaatcatgatatgattgcacacatacgtaaggctcgggctgcagtggaagagctgaagaggttccttgtggctgaatcgctggaggaagtaaataggaagctggataagttctgtatggttcttatcttgaggagtctacattcagactttgatcatgtacgtgatcaagtcctagctggagatcaagttccattgatggactctctcatcactaggctgcttcgtgtgcctcatgcactgaaagaagaaaatccagctgagctaatggaaacatcagtcatggtttcacctcgggggagagggggaggacgaaacagtagaggaggtcgtggaggaagaggtggacgtcctcaatgcacatattgcaagaggatggaccacactcaagagaattgttactccctgcatggcttccctgacaaagtagctcaggtaactcagacagaaaaaccagagtctaagttctctgataaagaatatcaggagtatctgaagctgaaatccgagaaatccagcagccaggcttcatcttcctctgtaccatgttattcaacagcatgcatttctcaatctgttgacggtcccagtccttggatacttgattcaggtgcctctgatcatatttctg

SEQ ID NO: 38474 - DNA, 2586 bp, Glycine max
  Peptide Sequence Number=SeqID_155252
atgaccacgtcacaaagacagggggaccctaacagtatgttagagttcaacgactggatatcggcattagaggttgaagaagtgccatgtctgggcagaaaattcacttggattcgaccaaatgggactgcaaaaagtaagttggacaggttccttgttttcgatgattggatgtctaaatggccgggtagcacgcaatatatcttggatagaaacttctccgatcactaccctatcctactcagagcaaaaattgttgactggggacccaaaccttttagggttctagactgttggttgaaggataagacatttcaaaatatagtcattggcagctggtcgagcacacaactaatgggatgggggggctactcgctgaaacaaaagcttaagaagctcaaggaaaggatgaagagatggaataaagagcaatttggagatacagctaagaaggtgcaacagcttcacaatgagttaaataatctggaagctgccagccgtgacagacaattgacccccctcgagttatcctctcgtaaaaagatacaggagaatttgtggactgcaacccaagcacatgagtccttgctaagacaaaaggcaaggacaaaatggattaaggaggggtactgcaattcaagatatttccacaagctcatcaattataatcgtagacaaaatgcagtaaaaggtgtgcggattgatgggtcatgggttgaagaaccaaacagtgtgaaagaggcagcccacaatttttcccaactcagatttactgaacctgactatgacagaccagtaattaatgggactacatttcgcggattagggcagcagcaaaatcagttgctggtggcacagtttcaggaggaagaaataaaggcagccgtatgggaatgtggtagtgataaaagccttggaccggatggcctaaattttaagttcattaaacacttctgggagctgttaaaacctgatatcagctgcttccttgatgaatttcatgtcaatggctgtatctataagattgtggccaagatcttggcaaacagattgaaaaaggtgctccccgacatcattgatgagagacagatggctttcataaaaggaagacatttgctgcatgctgtactgactgctaatgaggctgggtttttgcccaaaatggatacaatggatttcgggatgtcttcattcagcatcgatgtctattttgaaggcctaagcggcttgatgaggaaggctgtgaataaaaaacactttagtagttttctagtggggaagaataaggagcctgttagcatcttgcaatatgctgaggataccatcttctttggggaggccacaatagaaaatgtgaaggctgtaaagacaattctcaggtgtggggcaatctacaaatctgaacaatggtgcaagaaggctgctgatttcctaaattgccgcatgttgcctatgcctttcacctatcttggtattccaattgctataaacccaaaccgtagggagatctgggatcctagtaaaattgcgtgggtcaattgggaaatcgtatgtctcccaaaagataaaggaggtttaggcataaaagacttgcggatgttcaacacagcattattaggaaagtggagatgggaaatatttcaacacaatgtagagctgtggaccagaatattactctctaagtatggtgggtggagaaatttagatggccatagaagaagctgttaccattcacactggtggaaggatcttcagctgcttaatcaacaacaacagacaatagcactcaaaaggcaaatagaatggagggtgggctgcggagacaagatcaaattttgggaagacacatggacagccgatgatagaccattaatggtaaaatatgccagtctataccaaatttccaatcaacaacagcaaacaatcagtcttatggggagtcacaatgatgaaggatgggaatggaactttagttggaggagaaacctatttgacaatgaagctacaatggctgcagaattcatacaggaaactgcagtgctaacagtacagcagcaaggagcagattcatgggtttggaaggctgatccgagtggaaattatttgacaaaatcagcatatgacatactgctggaggcaaaaaggggggagacagatgacgggccttttgtggaactgtggaaacttaggataccacctaaaacagcaacatttgcatggaggctcattagagacagcacaccttttcttcaattgcagcaaaacaatcccctctggtgggaatcattatcttgggtgaaaacaaaggatactttcccacagaacccgaaggaacactttttgcagcacaccattgggaacgctggtggtaccaaggctacaagatggaagtgctggtgggtagccctcacatggaccatatggcatcacagaaataagacagtatttgagaaccagaccttcatcacaagtaaagtgctggatgatgcacttctcctactatggtcatggctgagggccatggagaaagattttacactgcactacaatcagtggtcctctcagctgagagaaacctttgggtaa

SEQ ID NO: 38475 - DNA, 319 bp, Glycine max
  misc_feature (97)..(97): n is a, c, g, or t
  Peptide Sequence Number=SeqID_155253
gctggtccagccggattgttggatacggagcagtatttgcggcatttggttcgccagcaggcgaccaaccaccgggcacatgtacagactcatgatngtctttatcagatgagtctcagcctgcagagccagggctttacttcttttccatgccctactccggaccagttcagggcagaggtcgcatggcctggagattggcctgaggcccaggtaggagaggcaccagcaggggcaccagcagaggctcccgacgaggcacatgaggctcgcgaggacgaagagatgaccgatttacttgatttcttgggagggagcg

SEQ ID NO: 38476 - DNA, 300 bp, Glycine max
  Peptide Sequence Number=SeqID_155254
atgataaaagctttttggtggggtccattggaaaacaacaaaagagagttgttccattgtagagatttattacttagagttacttgtattgggaaaagtattagtagccaaatctgcaaagtttatgatgatgacaagttcaatgttgaagttgagtatttatctgaagagttgcacagtgggggaaacatggcttgttccaaatgccaaaaaagattgattacaaataggaattatgcaccttttgtcttgtttgcatcaagggaagacttcaacgatgctatcaaggcatatatctag

SEQ ID NO: 38477 - DNA, 2164 bp, Glycine max
  Peptide Sequence Number=SeqID_155255
atggcttccttatcgaatatcttactgatgttttgtttgttcaatcttctagcatacccagtttcagttcattcagctggtgaagttccaattaatgtgacaaagcacttttccttctataacttcagcttcagcaacaaccccagattagtccatgatgtgaagctcctaggcagtgccaagttctcaaatgaaaagggtgctcttcaaatccccaatgaatcagaagatataagacaccaagctggtagaggcatctattccttcccaattcgcctgctagatccaagcaccaagactccagcttcatttcaaaccactttctctttccaaatgaacaattccactgcctctgagcaagctgcttatggaggaagtggcctcactttcatcattgtccctgatgagttcaccgttggaaggtcgggaccgtggcttggcatgctcaatgatgcttgtgagaatgactacaaggcagtggcagtggagttcgacacaagaaagaacccggagtttggagatccaaatgacaaccatgttggcatcaacttaggtaccatagtgtctactaaagtcatcaatgtttctgatgttggattgtcccttaaggatggttctgtttaccgcgcttggatcacctatgatggtcctcaaagaagaatggacattcgtcttggaaaggcaaaccaagaggattatccttccaagcccatgttctcagaatctatggatctctctccttatctaaatgagtacatgtttgtggggttctcagcttccacaggtaaccatacacaaatccacaacttactctcttggaacttcacttccacaagccaagcttttcttcacttgccttcatctgaatcctgccagggtaagatcttacttgagaatagcactgctgccacagaaccaacaaattcacagaagtcttctaagaatgaaccaccgcgaagctttttgatttttgtggcagctgtggcattggctctggctcttttccttggcttttacttcatcagcaagcacaggagaaatgctgccaagttgaacacttcagtggagacagagcttcacatgccaaggcctccaaacaaaccacggcgctttgccttttctcaactttcaactgcaactcggtcattcagtgagatagagttgctcggcagtgataatagaggagagtactacagagggaagctttctggtggcagtcaggtggccgtgaaaaggttctcagctcagtttctcagcacacatggatcagacaagaagcgtttgttgaaggaaatcaaaggcattagccatgttcgccacccgaatttgcttcctgttagagggtggtgtcaagacaaccatgaaatcatggtggcctatgactttgtccccaacggcagcctagataaatggctatttggggccggtgttcttccgtggactcggcggttcaaagttattaaggatgtggctgatggcttgagcttcctccataccaagcaactagcccacaagaacttgaaatgcagcagtgtgtttctagatgtcaatttcagagctgttttgggtgattttgggtttgtgttgatgggtgcagaatcaaaacactttgagtcacaagtgtgccaaggtgctgatgtgtttgaatttggtgtccttgtgttggaagtgatagctggaagggtaagggatgagaaagaggagggaaatccagaagagaggaacctactgggttatgcttggaacttgcatcagattgatgaaaaggtgaagctggtggacaaaaggatgggatcattgatcaacctggagcaggcaattcgcgctcttgaaattgggttgctttgcactctaaatgagaacaaaggaaggccctcaatggaacaagtggtggattttcttctcaacatggataagcctattcctgagctgccaagaactcgcccttgtcttgctggaattaaggagttggcatatgcgacaattgacactatgtggtataacataggtgggaagaggttggatattggctatgaaaaggatagtgctgctaaaatcagttttggtgagactgaaaatgatgcaaatactgatttcgatattttttacaatgttaaccagaaagcagggttgggagggaaagaaaaagctaaaagtgaaagag

SEQ ID NO: 38478 - DNA, 318 bp, Glycine max
  Peptide Sequence Number=SeqID_155256
atggacctttctcctgaaaaagttatcatttttctcttcaagcttttcagacattccttctcgactactatacatatgctgatcgctgatcaaataattggaatacacaacaagtttcaaaagctggaagaggtatgtcctgccatggaaaaacaaattactaagtggacaaaagttcttctaagtagtgaaaggcttctgggttttagttgttctgctttccgaactagcatgttcaatccaggaacaaattccaaatctggtcgttggtatcctgttggactagcacagatggaacaatggattgctttgctttag

SEQ ID NO: 38479 - DNA, 330 bp, Glycine max
  Peptide Sequence Number=SeqID_155257
atgaaagttgcacctaaaggcgcaaataatcatcaggtcatacaacaacttatgttgatggcacatgagggccgtgtagctggatgtagcttagctgaggagggatgctaccgtagaaagccaacaaaggtggaagaaaaggtggtcgcaagggcacttgaggacatttggcaaggatggatttcttctagagatcagtcaatcattgcatacaactccatgagacctttagaactaaaatgtgaaaggatgaaaatcatctttcccaagttttcgctgtgcaatttgtcaaagggcaattttaggatatggctaaagtgcacctattga

SEQ ID NO: 38480 - DNA, 180 bp, Glycine max
  Peptide Sequence Number=SeqID_155258
atggcatccatgtttgccgttcttcgtcgtcctcgtgtgcgtcgctgccattcgacaccgccgttcgctgtgcagggtcgtgtgcgtcgcctttgcggggtcgtgttgctgccattcgtcgctgctgccacacttgcaaacttcttgaaaacctatcaagaaaaactactctacatgtag

SEQ ID NO: 38481 - DNA, 3861 bp, Glycine max
  Peptide Sequence Number=SeqID_155259
atggcagattccacgagatctaaggccaacacggaccgattggaggacgcaattgcaaaactcaccatctccctcaatgacactcttcacgggcttacccacaaaattgatgagctaattatccacctgcagaaaccaaacccaaacagcaactcaccctcatcatcaccttcgtcatctgctcctcctgtgatgaccacctctccacaccgaatcaagttggtcccgatatttgatggctcagactcgctcggttggatcttcaagatcaaccagttcttcgagtatcacttgactccggagcacgagcgactgacaatagcttcattctacatggatggtcgtgctctgtcatggttccagtggatgacgagcaacggccagttcacctcgtggccatccttcctccaagctctgcaatctcagttcgcaccttcacaatatgaagatccaacaagcacattgttcaaattaatgcagagagggacagttaattcttacctctcagaatttgaggacctggcgaaccgcatcgttggtttactggctccttttctcttgagctgctttatttcaggcctatctcctgagatacgaagagaagttcaagcacttcagtcgttgacaatggcgcaagcggcggggctggcacagctacaggaagagaaactccgggatgcgcgacgacaaacgcgtaacagatatggtcctcctcaactacctcactcttcccattcatcacccttggtaacccaagccccaccttccccaatttcttcaaaccctatcttcaccccaccttcccctaattcgttaatactccccacacccttgaaactaccaccacctaaccctaatccaattcctctcagacgtctctctccggctaacacccacaactttatacaagcaccccttgctaagtcattgggcctgccctctcgtgcaacaactctgttgaatgtaatggtgggtaacggccagcagttgcattgtgaccagctttgtgagggagttaaactcctgattcagaacacatccttcatggtagacctgcatctccttcccttgagtggtgcgaatgtggtgctaggggtccagtggcttaaggccttaggacccatcctcacagattacaacactctctctatgaaattctttcaggatggtcaattagtggaattaaagggggaagatgcatcaaccttgcacctcatctcgcaaccccagctccatcgtcttctacgaaaggatggagcgagtgcttactttcacatagacattacctcagagctcccttcgaacccaaacacttcaccttcaaacacttcacccatcccctccgaaattcaacctctcctcaccaaattcacctctctcttccaaccaccccagtccattccaccctttcgaaccacaaatctccacattcaccttcaaccccactcagaacctgtcaatgtgaggccctacaggtaccctcatttccaaaagcaggaaattgagaatcaaatcgaagatatgttgcagaagggactcattcgcccaagtacaagccctttctcctcccctgttctacttgttaagaaacatgatgggtcctggcgtctgtgtatagattacagaggactaaatgcaatcaccattaaggaccgatatccaattccaacgattgacgagttattggatgaactcgggggtgcaagctggttttccaaacttgatttattgcagggctattaccaaattcgaatgcatgaacctgatgttgcaaagactgcgtttcgaacacatcacggccattatgaatttaaggtgatgccgtttgggctgtgtaatgccccttcttccttccaggctactatgaatgatattttctggccatacttccggcgtttcctcatcgtcttctttgacgatattttaatatacagtcgcacccttcctgaacatctagtccacttagaacaaattttcgaggtactccttcgcaatcaatttgtacttaagctctctaaatgtttttttgcacaaagacaggttgagtacttggggcatgtagtttcagagcacagggttacaccggtagcatctaaagttcatgatattcaacaatggccgatcctgagaaccacgagagccttgcgaagcttcctgggactcgcaggtttctatcgaaagttcatcagaggctatgcctccattgcagctccattggttaagctcaccaccaaggattcttttgagtggacttcggaagctgaccaagcatttaaagctctgaagggggctttaacatctgcccatgttcttatgttgccggacttctctctcccctttacacttgagacagatgcatcaagggtgggcataggtgttgtgctttcgcagaaaggccacccaatcgcgtttttcagcaaaccgttcagccccaaattgttacaagcttcgacctatgtgcgtgaattccttaaggagctcatgactcagattgttcaaacaccagagcagcaaatgtatttggccaggcttatggggtatgactactccattcaatatcggtccggaaacactaatttggtagttgatgccttatcgcgcttgaaggaggaatcagaaggaaccatgctattactatctgtaccatgcctgacatttttagatgaattcaagaagcaattaaaacaggaaccaacctttatcgaattcaggaagaatattttggcccaacccacagccttcccggaatattctgttacttgtggattgattttgcaggggaatcgtatttggttaccagaaggtattcccttcattcagactttgttaatggagtatcattctacttcgacagggggtcacatgggggtcacgaagacattagcgaggctcaccgagaatttctattggcctggtataagaaaatatgtgaaacaattcgttgcagcttgtgtggattgtcaacacaccaagtacgaaactaagaagactgtcggacttctatgtccacttccgataccctcaaggccatgggaggacctctcgttagatttcatcacggggttaccaccctttcgcaggaacaccactatcctagtggtcgtagatcgtttctccaaggggatccatttggggatgttacccacgcagcattctgctcattcagtcgccgtcttgttcatggagattgtcgaaaaactccatggcatgccacggagcttggatttattccgcatgagtagcatgaagcttcgaatgagctccgcttaccacccccaaacagatgggcaaacggaggttctaaaccgtgttatcgagcaatatctacgcgccttcgttcatcagaatccttcatcgtcacttatgggcggaagccccccaattggccgcagtacctcacaggttcttcgaaggaagaaattgcagaaggctcaagaaactatgaagctgacagcagacaagaagcgtagagaggtgcagttccatgtcggcgatatggttatggttcgtctctggccacgccgtcaaccatttcactcacctgtctctgctaatacttctcccactcttgcattacctttgctgattgttgacaatgagcctgtaatctctccgaaatccattgttggcactcgttatacctctgattccaaaacacctaagttacaggtgctggtgcaatgggaaggtttgcttcccaaagataccacttgggaagattgggagcaactgcaagctaactaccaccttgagggcaaggtgattcttgaaggcccaggggatgataggaaccgtgaagatgcatcaattaggcccaagaggaaaagcagtgctccttcatacctgaaggactacatatga

SEQ ID NO: 38482 - DNA, 735 bp, Glycine max
  Peptide Sequence Number=SeqID_155260
atggatactggcggaggcggagcatcacctacagccgccatgtcgcggtggaagttcgcggcgtggcggcagtaccagcacctgctggacaaatcgacgccgcacgtcggacgccggtggctggggttcgcggcggtggcgcttttgtacttgctgcgcgtgtactttgtggaaggcttctacgtcgtttcgtacggcttaggcatatacatcctcaaccttctgatagggttcctctcccctcaggtggaccccgagaccgcgattctcaacgccgacgaccctatactccccatcgccgcctccgacgagtttcgccccttcgttcgccgcctccccgagttcaagttctgccaaaatgttgaaatttgtgggttatctgcactgcgattgtgcccggatttggctacaattttttgcggtattaaggattgtgaagaaatggcaattctgtctgcaaccgcagcaattttaaaaccttggtgttttcttcacagttcacacatggcactgaatgtgcagagtagggatgtgagactgcttcacagttcacacatggcactgaatgtgcagagtagggatgagagactggtgctaggtattaactcaaaagttcgtttggcaagatatgccaaaaattataagaggacacatgccgcaatgatgacactcatagtggccactatagtgacagaagttgaaatcgctaattcaagaaactctacaatgcaatag

SEQ ID NO: 38483 - DNA, 363 bp, Glycine max
  Peptide Sequence Number=SeqID_155261
atgcgcttacaaagcaatcaatctaacacaagtgttgaggagcttcaacaattttcggaatggttgctagctgttggaaatggacaagttggtggagcaaatgacgactatgttgaaattgaaatcccttatggatttctcataatagaatttgatgatcctattgatgcaattgtcaacaacacttacccaaatctgatgcaagaatacaaaaatgaagctcttcaagcaataactccagaatttttgcatggactgaaaacatttggattgcctaatcataagatcaagttgaagcttaggactcctattatgttgttaaggaatttatatcaagcaaaagggttgtgcaatgggacatga

SEQ ID NO: 38484 - DNA, 1458 bp, Glycine max
  Peptide Sequence Number=SeqID_155262
atggggcctgctccggacacaattgatttggaaggttatgatgatgtgagagcgattctgaaaccgaaaggttctaattctaaggattgtaggttagaaagacgatggaagagatttgaaaattcaggttcaaacaaacaattgaagcacaatcacagtgacagtggtacaagatcaactgtgaagagtcatggaaaagtggcaagtttaacaataaagaagggtcatatgtcagaggatgaagtggatgaagattacaaattctttttgcttacatatgatcctcatattgatgttgtcagtgatagtgatgtggatggttctgatgatgacatcaacattggccacaacaatgaccataatgatcatccttacagggaagaagaaagcttgcataataatcccaagttagacaagggttcaaaacaaagggatgagacaggaaatcaaagaaacaaagggagtgattctgtgggaaaacagacaagtgggtcaatgaaagctaagcagaatttggaggctaaaagaggacttagtaagaaaaggccacatgaaaatgtttctggtgtccccaacaataatgcccagactaatatggagttaattgttgtggatgaggattaccagatattcctgaattcttgtagggatgactatatacctagtgaatcaataggaaagcagaatttggaggctaaaagaggacttagtaagaaaaggccacatgaaaatgtttctggtgtccccaacaacaatgcccagactaatatggagttaattgttgtggatgaggattaccagatattcctgaattcttgtagggatgactatatacctagtgaattaataggaaagcgatcaaatgttatacagaattcccttgtttctgattatgtgctgagtgaggttgatgaagattacttacaatatctgaattctgttttgattgttgatggtgaggtggggtgtaggcctgagaggaatacctcaaagacagacaacgtggatggtgacagtaattcctctgagccagatgttattcttctagaacctgatcaaattcatgaaaacactccatttgtttcttcgaaaacatatgattcatcttggttcgaaactgaaaagaatcccaaagacaactggcaattacctgcttacggtaattctcagtttaggagaagacttatgaatgatcttcaaaggccttatgaccaagaagaatgtgatagacttctgcttgaagtacgtcagaaaaaacaaaaggaacgtcatagagaaacacgtcatggggtggtcaagttttgtcgcactaggggtgtcagcgaatcatatcttgacttgtaccctgatctagctaaagcaattgccgaattcaaaaaaccggaaaaggttttgtttctcttgcgtggatttattttctggttgcaagtgatgggttcttatggtatggaattttga

SEQ ID NO: 38485 - DNA, 354 bp, Glycine max
  Peptide Sequence Number=SeqID_155263
atgtatcctgccactctcgcaagaagtttgtccaaatccctgggttgcttccggaaaaggttgtcagtgaacagcctcgacttcagtgctgtgatcatgaaatacagtgcaacaccgtggtcaagatgctcattcggatctgatgtaccgttgtatctttcaatgttcaacgacttccaggttatgggcaaggaacctgagtctgaagtggattgtggtttcctcccaattactataagaggagagttgggtatggattttctgggtacgtgttttgacatgggtgggtggttgagacgacaaagaagtgtggtagagttgggggtgggtgatgaatggcaagccttgctctga

SEQ ID NO: 38486 - DNA, 231 bp, Glycine max
  Peptide Sequence Number=SeqID_155264
atggctcacactcatccacatagcaagtgcacatgtgctaaatggccttccacgatgtgcatcgtgttcgcgttctgggtctggggtggtggggatggcgtcacgtggcaaatctttgtgttctcgcaagtggccactagaggaagcacaaccgaagtcgggaacggtgtgcgttgtgacaacatggagagaggagtggggtattgtctggtgggtggggttggcttttag

SEQ ID NO: 38487 - DNA, 156 bp, Glycine max
  Peptide Sequence Number=SeqID_155265
atggctagcgggccgggcaagtctccttatgtggtggctcgtggtccacaagtgtacccctcgaatctccccaacaattggtataagagccgatggttcaagttagtgaccgactcagacgagtatgcaagtaccgcaggtggccagaatggctag

SEQ ID NO: 38488 - DNA, 894 bp, Glycine max
  Peptide Sequence Number=SeqID_155266
atgtcctcaccgttgaacgttttaggcatgatcatctcgatgacgcatctcacgatgaagttccccaatctgaaaggcgacatcatcactattagagtcaatcagatggaaaaccatgaatgttatgctagaagcctacttgttaaaccatgcaccttcacctctgagaaacacccccgagcagtggacatcaaaacaccgggggaaccgactcaagaagagatgaagaagacaaacttgttacgccaagctgggtcaacttcgacccacagaggtaaatttttgggcttcatgatcacctataagggtatcaaggccaacctagataagtacaagtatttccactcggacatcaagggcatcaaccccgtcaaccaagacaaccccgtggttgtctccatcgtcatagcaaacttaatggtgtccatggtcctcatcgaccagggcagttttcctgacatcctcgagagagtcgagactagacgctatgtggacttgatcactaccttcgatcagggcaagctctcaaggagcttcaccatcaaatatttattggttgacccaaacacatcatattttgccttaatcggcagaaagatgctcaacacagagattttaaccattaaagttgaccaaaagcaagcacgccactactatgcaaagagcctaaaggtagccccatatcctcccatctggaagctaaccatgccttaccccatagcagctgaaggtactcaagtcatgacagtggacaaagggtctcaaattcgagccctgaccatctgcaacatgggcaaagaatttgacatagatccacgagacgacacctccgacagaggcccaaaacctatcgaagagcttgtccagctccaactcggacctaaaccgaggtag

SEQ ID NO: 38489 - DNA, 573 bp, Glycine max
  Peptide Sequence Number=SeqID_155267
atgggagctcagactgtgaaggttgtcaggaagaatgtgtggcacgtctacaaactcttgacatcgtatgcatctcctggtaaagttgaggctgtttgccctgactattggccaatagtagccaacttgcaccgctttggtggggttcatccagttttgttcctcctcttctcaagccataatttcctcaatatctatggtgagggtttggagcatctcctagatgatggtcttgaagtgtctgaccttcttggtgctcgccagcttggagaacctggaatgagcacctcataccctgtttggctgtttgaggctctgaagttgagcttgagggcttgctctagagtgatattgtcaaagcctttgaggatgatccctgccccgcttcgttttacggctgagctgacagcttcatcgactattgggagatacaggagcaggggtgctcctggcctgggtcgactcaaaacggcgaaatggagaaggaagaaatatgattggagacgccacttcaaggagaagatgagtcaagaagaagctcaccaccataagaatccatggataagagcttga

SEQ ID NO: 38490 - DNA, 1263 bp, Glycine max
  Peptide Sequence Number=SeqID_155268
atgtcttctttcttgtctgatttcatcattggactggacagaagtgattctgggggctctattcagcaacccatcatggatcgggaggtcatcttgataagcggtttctcgtctaaggatactcatagaggtgcgtctgatagcgagtcctcctcttcagagagggagaggacgtcatgccaaactagtgggggcatttcttgcccatgcggaagggtacgaccttctgttgctgttggggagccagtctcggttactgtgatcctcccctcttttgcttctgggggtgcgaggagagctggcggtgacagagatgtgaggtcgtctccctgcatacgacctagcgtgagttttgggtcgttgtcgtccaccccggccattgctggctatgagtgggtgagggacgacttgttgaagtacaagttctgtctaactttggccacgagtgtcactgcgcttcagcaccagatgaagctggtgaaccctaaggactctggacggggagccctacttcccattctactggcacattcacttcctcccacgactgttgttcaggagactgctcctgctgctgttgaagctgctgggtcagccattcaagctgactttgttgtgttgtcattgtccaccgttgtggcccctttgctaagtgcctatatggtgaccacttgtgctcctacggtgtcatctccttcttcattggctccagttgtcctccttgctattgttttggcggctatggcatcgccttcttcatcttcgtttcctcgtgtttcccttgatcatttgtacacctctagtgatgccgaatcactgtggggtgcaacttacaaactggagcagaagaccccgataggctttgtgttagccttcgacatgaaccttattaggttggctggggtgcaaaatgctactaactctgccaaagtgtttctccaaaagagtttggcaattctagaagataatggactatggcaccaagaggttgtgcaaaaggtggtgtcttgggaggcggaggtcgccaaatggatggctacttcttggactctttggcgagtggagcgccctaaggtggccaatgccatcattgcttttgttgaggttgtaatggctgagaagatggacctgggtgacaaaatggagagcatggcggctgagaaggatgacattgccaagagaattgttgagttagaggcccgacttagggagtcagagttcagattagaagagtctgagctgtgggctgccaaggagaggtag

SEQ ID NO: 38491 - DNA, 108 bp, Glycine max
  Peptide Sequence Number=SeqID_155269
atggcggtgccatcaacattttccaatcgcgcctctgtgtggaatgacccgcaagcagaggagaacacacagacgacattcttcaaagataagtcctatgaaaaataa

SEQ ID NO: 38492 - DNA, 444 bp, Glycine max
  Peptide Sequence Number=SeqID_155270
atggagtgccttcttagtgttagagatcacattgttgagttaataccatcttggcaaacatttccagatggaagtcagcttgaggtgattccctcttttcccttgtttgtgtacagagctcaagaagaatggagtaaaatgaagcacataacaatagtgaacacgatagatagtcgcatcgtatatctctccacagacaagctcgtcggtgattgggtggggagaccgttgaggaagtggtgggtggcaccaatttcgagggtggtttgggttcagcactcaaggtggaatcaatggtggcagacgagggagcaagcgtggtgggtggacttggagttgagccggttgattcccttttgtgcacaaaaattggcactcccttttgtgctgcggaaacacgatgccgtaatgtttttcgagaggatgttaatcttggaattttga

SEQ ID NO: 38493 - DNA, 2016 bp, Glycine max
  Peptide Sequence Number=SeqID_155271
atgaccctctctgttagagcctcctcaaaacccttcataaccctcaatgaagcgcgcttcctcttccccttctccttcttcagctccagcaccgttcagtacaccaacaagttcctgtttcatgccgcggtcgccgaaccgcaattactcgtccgggttctcaacacggtccgccatcgccccgcggtcgcgctccggttcttccggtgggccgagaggcaaaccggtttcaagcgatctgaattgacctacgccgtcatcctcgacattctcgcgcggaacggcttgatgcggtccgcctattgcgtcatggagaaggtcgtctccgttaaaatggagaacggcgtcgtggatgtcgtttcttcctccgaggcatcaatgtcatcggttaagcttattctggatttgttgctttggatttacgcgaaaaaatcgatgcttgagaagtgtttgttggtgttttataagatggttagtaagggcatgttgcctgatctgaagaactgcaatagggtactcagattgcttagggatagggatagtagcatcgatgtcgcaagggaggtttataatgtgatggtggagtgtggaattcgccctaccgttgttacttataacacaatgttggattccttttgcaagcaagggaaggttcaggaagctctgcagcttttgcttcagatgcagaagatgggatgtttgcccaacgatgtcacgtataatgttttggtaaatggtttgtctcacagtggggagttggagcaggctaaggagcttatccaggagatgttgagattggggctcgaggtttctgcgtacacatatgaccccttgattcgcggatactgtgagaaagggcagcttgatgaagcctcgaggcttggggaggagatgttgagtagaggggctgtgcctactctggtgacctacaatacgattatgtatggcctttgcaagtgggggagagtgagtgatgctaggaagttgctggatgttatggtgaacaagaatctgatgccggatttggtttcgtataacactctgatttatggttacaccagattgggaaacataggggaggcttttctcttatttgctgagttaagattcaggggtcttgttcccagtgttgtgacctataatacgcttatcgatggtctttgcagaatgggggacttggatgttgccatgcggctaaaagatgaaatgatcaaacatgggcctgatcctgatgtatttacttttacaattcttgttagaggattttgcaagttggggaacttgccaatggctaaggaattgtttgatgagatgctgaatagaggattgcagccagatcgttttgcgtacataacccgaatagtaggtgagctgaagcttggtgacccatctaaggcttttggtatgcaagaagaaatgctagccagaggctttccgcctgatttgatcacttataatgtcttcattgatgggctccacaagttgggcaatttgaaagaagcaagtgaacttgtgaagaaaatgctctacaatggacttgttccagatcatgtaacatatactagcatcatccatgctcacttgatggctgggcatcttaggaaggctagagcggtgttccttgagatgttgagcaaagggatatttccttcagttgtcacttacacagttttgattcattcatatgcagtcaggggaaggctgaaacttgctattttgcacttttttgagatgcatgagaagggtgtacatccaaatgtgatcacctacaatgctttaatcaatggactttgcaaggaagctttgaggttgtataaggatatgctagatagagaaattcagcctgattcatgcacacatagtgccctattaaagcatctaaacaaagactataaatcgcatgtagttcggcatcttgagaatgttattgcagctggtgtaaattccccagacagaatcatgtatatttttctgacagtcatggttgaagatgcctgtggtgttcttgatgattaa

SEQ ID NO: 38494 - DNA, 198 bp, Glycine max
  Peptide Sequence Number=SeqID_155272
atggcctatgatttgagttatagaacaattattgttaagactgattgtactgaagttgtcatcaagcttgtggaggatcccaaatatcatgaaggccaatttgtagatcttgcctctaagattgcgaagaccaaggaaagtttacttcttgttccattgtccatcttccatgagaatggatacaattacaaatgttga

SEQ ID NO: 38495 - DNA, 723 bp, Glycine max
  Peptide Sequence Number=SeqID_155273
atgtggtatatgcatccttcatccaatgtagaaccacctactagtggtagttctcaaaatccacaaatttatagtcaaccatcaactcccaccaactcaaacacgtgttataggctttctttatccaatattgtgctccctagcaatgaaattgaatcacccgtcggtgtagatggtattcaactagatgaaggagatgaaaattcaagtggaaaaaaaagtcgtaccgcattctcggtcacggaagatgtgattctcatccgatcatggttgaatgtatcaaaggattcaattataggagtcgaccaaacatcaaagcaatattgggcaaggataaaaaatgcatacaacaatgacgatatgcgtcaaagcggacaattttgtgaaagaagctggactcaattaaaatctcggtggaacaagatccatcctctagttcaaaagtttaatgggtgctacaaacaagcagataaacctaggagaagtggaagttcagagaaggatgttttggctgatgctcatatgatttactcacaagatacagagacacccattgaagtcgaagaatatgataggccatcaccaatgtctcgcccaattggacaaaaagcagcaaaaaggaaaagcaaaggaaaagaatgtcataacactctcaatttatctagcatagaaagtgtaatgaagaacaaaaatatgaacacatcaatacttattcaattatag

SEQ ID NO: 38496 - DNA, 539 bp, Glycine max
  Peptide Sequence Number=SeqID_155274
gattggatggatcagttcctaggttttctagtcatagcaaccattttgctctagttctgacaattgagtatgataatgattcagtgtttggagtatcatttatatcaattgattactccatggagatgtcttcagctgtatacaagaattgggttttcactggccaatcattgccaactaatctcatcaagagaggattggcagttcaggatcacacttcccgacatggccttccccttgtgataaaggactatccttatgttgttgatggattagaaatatgggatgctattaagacatgggcagttgaagaagatactgaactgcaagcatggtggaaggaagttgtggagaagggtcacagtgacttaaaagataacaaatggccaaaaatgaagacatgtcaagagcttactgactcttgcactataactatatgggttggtttagctctccatgcagttgttaattttagacagtacccttatggaggctgtatcctaaaccgtccaactgaaagcagaagattgctcccataa

SEQ ID NO: 38497 - DNA, 204 bp, Glycine max
  Peptide Sequence Number=SeqID_155275
atgaattccggcagatatcttccagcctgcctcatcatccagacaggaggtctttcaacggggaagttcgttatccaggacattaatcgccagattgccacagaagtgaaggaactgctcatgctggcagtttccgataataaatcgggaaagagcatctgcgttcttcagtaccttaaacgttccgaaaccgtgttttcgtaa

SEQ ID NO: 38498 - DNA, 240 bp, Glycine max
  Peptide Sequence Number=SeqID_155276
atggcttctccacctgcctcccctcctcctccttcttctccttcggacgcatcggcttcgccgtttgccgtgaagcggacacgcaaagcctcacgtggacgccacctacgagaactggaaggaggtccctactgcttagaaggacctaatttgggaggatattcaggatgtgcgcaaaaaggcacaggtcatccagaagcagaacactgccccccacgtgctgtctcgtgggggttatga

SEQ ID NO: 38499 - DNA, 1101 bp, Glycine max
  Peptide Sequence Number=SeqID_155277
atggcagcaatgaaggctgcgataggtttcaaggttcattgtcttgatgttgagaaactgaatcgaatgtatgaaggaaggattctgagggcagctattgaatacttttggattggtgggctacaagtggatgttcagctgaaatctcccttttcatgttacattgaaggaaattccagttatgtggagaaagaattaacttattggggaaccaatatcatatggtctttaaaccaatatcaatgtcatgataagcctctggttctttgggatataattgcagcattatcaacattcaaggataacaatttaaaatatgcagaacatttacttattaagtggatctcatcatcttttctacaattagatatggacctttatcctgaaaaagttttatcattcttctcttcaagcttgtctgacattccttctcgactactacacttgctcaatataatctgtagacgagtaatgttagcagagctggatgctgatcaaataactggaatacacaaaaactttcaaaagctggaagaggtatgtcctgccatggaaaaacaaattactaagtggacaaaagttcttctaagcagtgaaagagagctccgtgaaaggcttgtgggttttagtttttctgctttccgaactagcatgtccaatccagaaacaaattccaaatctggttgttggtatcctgttggactagcacagatggaacaatggattgctttagatcaggaacatatacatgaccagttaaaagccattgcatcagaagttaagcatgagaaaaggtttctgagcagtagatgttcagcagtggagacatgtagtttttgttcagcatctgttccatttgaatcccctgaatttggtttttgccaaggtgaaaattctactagtggtgatgttaagaatcacaggtcagggtttagattggcaccagaaccactttttagaatgtcttcatttcatctagattcagactcttcctctaaatctttcactcaagctgtatcctcaaaaccattctgtcctttttgtgggatactgctacggagaaaacaaccagactttctactttctcctactcctgtataa

SEQ ID NO: 38500 - DNA, 345 bp, Glycine max
  Peptide Sequence Number=SeqID_155278
atgtgtcgccataatcaagacaaaaagctaagtatagcccttagccaccaagcgatctttgtagcgatcaattatgccattgggtgtgatattcatcgtatatacccaatgatacctaacagtggatttgttgggaggcaacagaaaaagctcccatgtgatggtggtggaagaacatttagagcaagagatgatgctggaggattaattagcagcatggtcggttgtgcttgtgtccgttggtggtacataagaagtggaggtggagcaggagcaaccaatggcactggaacaataggtggaacctccagagggacatcgtcaatggtggaagaaaagaaatga

SEQ ID NO: 38501 - DNA, 432 bp, Glycine max
  Peptide Sequence Number=SeqID_155279
atgggtttgtttgatgccccagactttaatctgagagccatctgcgagagtaacagaaggcaagtttataccacgtccaccaccaccacatcctccatgatgagaggagtgagagacaagagtagaggaatccttggtagatgtggaaaagggtccaaagtgatcgacacggccttggccttgaaattggaattgaacgacgatggcccaagtgctatagttggctgtcccagtgagttttttgcacaggatcaatggaataatggtaaaagtcacaatgaaactcaaggcgaatgcggtagccatgagaaaagttccaaaccacagtcaaaacaaccaaatggtcgctggaagaaggcacgccagaaaaggcgtgtcacgcgtgagaagttgctgacgtctgagcttcatgtgccaaagaggcactactag

SEQ ID NO: 38502 - DNA, 510 bp, Glycine max
  Peptide Sequence Number=SeqID_155280
atgaatcccaccaccaggatcaaaaatgaaaaagttcttctcaacataactaatggccttcttgtcaagcccataaacaatggcagccatggtagacaggtggatagttcgcatcacattgagcccagaattgacactaacatccttggtggtttgacgttgtgggtcgttgaagtaaacaggcacagggacaaccacattccttatggtggtggacggtggaggaagtgcctgtgttttggtgttccagcgttgccgttggcactacagaatccatggaaggcggagtcggcatggtccgcacagtttgtaaagccatggtaccgcacaaggctagcaaacggatccgggtactctcaaaatcaaccccaagggattgagctggatgtacataaggagaaggtgtgtgctaaaacggaagggatgggtccagcagaggtagttgttgatggatggttgtgtggagaggaagaaacaagaagaggtggaccggtgggtggtgtggtctag

SEQ ID NO: 38503 - DNA, 216 bp, Glycine max
  Peptide Sequence Number=SeqID_155281
atggcgaagctaatggacagagccattggtggcgtcgtcgcgattcttggaggtcgtcatcatcatcttgaactcctcaaagttgatgcacccgtcgacgtgtgcaacttgtactgtggagatgacgacgctgataaatgggtcgacgctcaaattggccactacattggaattgatgcgccttcgtctaggatagagcaaatgctagaagcttag

SEQ ID NO: 38504 - DNA, 1212 bp, Glycine max
  Peptide Sequence Number=SeqID_155282
atggcggcgccatggcggaatagcgggaaaggcggaatagcggccttttttgttttttttcgtgcgcagcagcacgaccccgcagcagaaacagaacagcagcacgaccctgcagcagccaccagcagcgacgaccggcagcagcacgaccccgcgaagcagcgaccagcagcaccacgaatggcggtgacgaacggcagcgcgaacggcagcacgacgcacggaagcacgatggcgaagacaaacgaacgtggacgacagagtgctgtttgcaactctgaaggacatgtgaagatttatcgtccacctttttgtgattactgtgctgaatggattgagaaaaattcatcagatcaaacagattctatgtatgaagaaaatgggacattgttaagtgctgatcaatatgcttcgcgtagtgcaatgctatgttcacttgttgtttcatggtctcccttgctgcgtttagcatctgaattgtatccagtttgtgattctgttagtctgcttgctgttggcgggaagtctggtaaaatttctttatggagatttcacccaacagattgttataccattgaggacagagaagtcccaactactgtgaagtttgttggtcttcttcaggcacacaattcatgggttacaactataagttggctgttgtttgcttttgattcttcgaatcctcaaattttattagcttccggaagctctgatgggagtgtgaagatttggttggctgacaatgacaaattgctgaaatcatcaaaagtggatcaaacttccttctcattattgaaggaggttataactgtcaatgctgtcccagtttctgtactttcagtaaccacacatgttcaatacccttccaagatgcttttagccacgggcaaagtttctggttcatttgaaatatggctatgtgacatatcttctggggaatttgataagcttggctcatataatgcacatgatttggttgttacaggtttgacctgggcattcggtggaagatttttgtacagctgtagccagggagccatcgcggagatgctgaacctcaatcccaaggaaatagttttgagaatccacacacttgtcccttatgaagatggatgcagaagagggcagtctgttaataaaattgcagtgagaattgagaaaggcatggtaccgaaactgcaagggaagcttagcatgagcccggagtag

SEQ ID NO: 38505 - DNA, 276 bp, Glycine max
  Peptide Sequence Number=SeqID_155283
atgaaagagaacttcaaacaaagaataggaaaagaagaatacatgtcgcagaggattaaaagggaaaacataacacaaaagagaatagtaacccaagttataagtggagaagcttcagatagtcaattgcaccctgttccaagaagagtaaagggtgccactttgttgagtggttttattagtattttgttagttgaaataaaggcccaaacttgtgttaaagtggatgtcaattctctttggatttgcaccacctatgggcttgttttaatttga

SEQ ID NO: 38506 - DNA, 240 bp, Glycine max
  Peptide Sequence Number=SeqID_155284
atgaagctaaaatttatgattgcggtgctacttgccaccgctggagcaatcatgtccataaaaaatttcaacaacctcttcaacaatagtcatcaaagattaggagttgcactatatggtgttatctggctgcaagttttacttggcatttttcgaccacaaaggggatccaaaagaagtgtgtggttctttgcacactggatacttggaactgcggtcacattccttggtgtcctgaat

SEQ ID NO: 38507 - DNA, 246 bp, Glycine max
  Peptide Sequence Number=SeqID_155285
atgaactcgcttagtgaggcggattggctaagcgaacctcattcgcttagcgaggcagttagctcgcttagcgaggcagttagctcgcttagcggatgcaaaaccatagaagaggataagtcagagatcagcacacttagtgcgcagccagctcgcccagcgaggacgttgtctcttccccctttaaaacacttagttggtggtaaaccaaaggtcaccaagctagacacagctgaagctatgtga

SEQ ID NO: 38508 - DNA, 222 bp, Glycine max
  Peptide Sequence Number=SeqID_155286
atggactcgtccagtgcagcccaactttgtcaagatgtcttcccactggctcgcacttggaactcagcaacgagttctaccatctacggaggtggccttgttcgtgctcgtgcgcttaccacagatgaagcggtgcacttagcgaacctgtacaactcatcttcttccagagtcttcctcgcgcttagcccaagagtgttgcgcttagcggatgctcgctaa

SEQ ID NO: 38509 - DNA, 154 bp, Glycine max
  Peptide Sequence Number=SeqID_155287
atggaatggggtggtggtgacgacaataacaatgatggagaggatggtggtggtagttgcgttgatgacaatagtggtggtggctgcactagcgatgatgatggtgacaacaatggtagtgacgacagtggtggtgacgacaatgataatggtg

SEQ ID NO: 38510 - DNA, 534 bp, Glycine max
  Peptide Sequence Number=SeqID_155288
atgaaaaatcaagagttacgcaaaaatgtggatgaacttcagaaagttcatgaatctactttagtccagcttacagagggctctcgattagctgctgagaaatttcaaattttggagtcagaatcggaaactttaatctcaggtctaaaagatgcagagcaaggtttactgctgaaggtttcagccttagagactgaaagcaaagaaaatacacaaagattgcacacagaaatattgaagaaatcagaggaaatagatactatgccaaacgagagaatcaaactagagcagcacgctgattctcttgataaagaagtcatccagcttcagaatgccttggaggaaaaagaaaagtgtattttacattataaggaacaggaaaagaatctggaagatcagatcacacaaaatctatcattattgactgctattgaaagcaaactttcagaggctaaaaaacaatatgatcaaatggtagagaataaacagttacaactatcaaagcatttgaaagaaatatcccaaagaacttag

SEQ ID NO: 38511 - DNA, 3181 bp, Glycine max
  Peptide Sequence Number=SeqID_155289
atggcggacgcgactcattccaggatttcgacagatcctcttcaagatgcaatcacgaaactatcagcgtcgcagctagcaatgaacacgaagattgacaacctcctccagcgtatgacacaattggaggctaaccagcaaccaccgcaaacgccaccgtcttcctcggcaggacagacactgccagcgtacaatccagtccaccgtctgaagctcgacgttccaagatttgatggctccgatccgacggaccctacggggctgctgtgtaagctccaacaacgttcgtcagttagcgcctacttattagagtttgagtctctcgtgaatcgcgtggcagtgacatatgcgcgtttacaggaggggaagctcctcgatgcgcgacggtcgcaggcaccacgaccctcaacgaccatcagtgcacctacaaactcacgaccagctatgggaaaagatgatgaattagtatcagggatcattctgccacatccgccattaccgacagagaacctaattcctgaaccacccccagcccagctcagcttacatgcgttatcaggccattcagcacctaaaaccttacgcctgaaggggagcattaacgagcttcacattagtatcttgatagatggagggagtacgcacaacttcctccatcacagggtggtgacgacattaggtctcacaaccaaggaaatagcaccactcaaagtcaccgtgggcaacgaagacgagataaggtgccagcagctctgcacagccgttaagatacaaatccaggagcacgcgttcatggttgatttccacatcttacccttgtgtgattacacttcatcatccatgaagttcatcacggagggcaagctcgttgagttacacggggaacgcgagaaggtgggtgagcctatgtcaccttcgcagctacgccgccttctgcacacgagtccctctagtaccttcttccatattagagtggaagcgaattcacaaccagttgcaacaccacaaacctttccggagatctccaagctaatcacgaaatactcctctttatttcaacctcttacaaacattcccccgtcgcgttccacagttcactccatcaccttgttacctaatgcgactccagtgaatgtgaagccctatagatacccctactatcagaagcaagaaatcgaagatcaagtgtcggccatgcttgcgaagggcttcatccaaccgagttccagtccattctctttaccggttttgctagtgaaaaagaaagatggtacgtggcgattctgcgtagactatagagctcttaacgcgattacgatgcgagatcactttccaatcccaaccgtggatgagctattggatgaactcagaggcgcttgctggttctctaaactggatttgatgcaagggtatcatcaaatcttgatgaacaaggaggacattagtaaaacagcgtttcgaactcatcacgagcattatgagtttcgagtgatgccttttggattgtgcaatgcaccatcctccaaaatgatagttgatcatcttcttcatctggagaacgcctttcggatcctggtatcagggtgtgcgaccaatgccggagaaggttcaggccatacagacctagcccactccacgctcacctcgagccttaaggggttttcttggccttgcgggattttatggcggttcatcagaggttacgcaaccttagcggctccactcaccaagcttttgagtcatggccagttccagtggtcacctgaggtgaatgacgccttccagaagctcaaagacgccattacaacagcacctgttctcacactacctaacttcaaagctccctttgttgttgagaccgacgcttcaggcacaggcatgggggcagtcctatcacaaggtggtcatcccatcgccttattcagcaagcaattttgtcctcgaatggccaattcctccacatacgttcgtgagctagcagccatcaccgccgccgtaaagaagtggcggcagtatttgctaggacacaaattcaccattatgactgatcacaggaaacaacaccgttatctagttcgattgttgggattcgactatacaatccagtatcgctcaagtcagactaacatagtggttgatgctttatcacgagcaaacgaagaaatgcctgcgtctctttatttgctgtcaatgcctcggttcatctttatggaggatctacgcaaggaactggcatcctcaccagctttcaaagaattgcacgaacaaattcaggctgatccagcaacatattcagaatattcgttgacttcaggccttattctacacaagggacgaatatggctaccctcgacatcacccttcatcaagatgttactcgaagagtttcaccagtcacctgtggggggccatatgggagtacagaagacattacatcgcctacacgaaaacttcacttggagttcaattcgagaggatgttcgtgcttttgtcgccaattgcttgacttgccaatacgcgaagtatgataatcgaaatccaggagggttactatgtcctcttctggtaccggcacagccatgggaggacttatcaatggacttcattgtggggttaccagcttataagggaaatacttgcatccttgtcgtggttgattgcttttcgaaaggattacacctaggcatgcttcccacgcatcacaccgcctacaccgtggctatgacgttcatggagatggtaggaaagcttcacgggatgccgcgaagcatcgtctccgaccgtgatccgctttttatcagtaaattttggagagaactctttgccttaagtgtcacttatggccggaaaccacctagcttccctcaatatatcacaggcacctcaaagatagatgtcgtcgacaatatcctcagccagcgagaagcagtgtttgagttcgtccaccgcaagttgcgtaaggctcaaagacgaatgaaggcgacaacagataaacatcatcgagatcaagagttcgaagtgggactgactccggaagacacctcatgggaggaatggtcagagctcaaatcacttcatcaccttgaggacaaggtgttgtttgatgggcaggggagtgttacgcaaaacactgggggtgtctcattagcaagaaagcagcagaaaacaaatagcagcgagg

SEQ ID NO: 38512 - DNA, 468 bp, Glycine max
  Peptide Sequence Number=SeqID_155290
atggttttcaaccagtttttatcagacttttgggatgtcattggtaaagaagtgggaaagtatatcactcaagtctatgccattgggaatgtcagctttgatttgagcagtttcatcccaggaagaggcgtaggagataatgcacttgttgctcgagaaatagttcatcacatgcacaaagagcaaggcaagttaggcctatgtgtggactggaattttctccaacttaccttgcacgaatttaggttcccttcctcaattgtgaagttgattatgaattgtgatgtaagctccattggagcttgtaggccttggatcttcttcatcaatggatttctttgcttcttgatgtctgattgcagcggaatggataaggagaaagatgaatggagacgccacttcaaggagaagatgattcaagaagaagctcaccaccataggaagccatggataaaagcttggaggtag

SEQ ID NO: 38513 - DNA, 558 bp, Glycine max
  Peptide Sequence Number=SeqID_155291
atggtttgcaatgaccaggctgaaatgaccggtagattgctggctgggtcattaacatttgataatttgattctgatgtgggtttttcttaccggtcgtcagatcgactgggctcacttggttcggtaccaaatgcataaggcattacgggccaatgcacctctcccttaccctcaattgataactttgtttttgcatcattttcaaattccgcttgatgatgaaccatttgttcaagtcaagcgttcctttgcaatcggtgctagtgcagtgactttctttggataccgtaaggatcggaatggtcaatggctgaagaaagacgcactccctcctcaagatgagcgtactccttcacctcctcctcagcgagatgattcagcactcatgactgaagttctttctgaattacggggtcttcgttcttatgttggtgaacgtttcgactcattggatacacgttttgccgtaatggatattcgcctcacacaacttgaagaggatgtgggttacattcgtcagagtttcgatcttccaccaccacctccaccttcttag

SEQ ID NO: 38514 - DNA, 303 bp, Glycine max
  Peptide Sequence Number=SeqID_155292
atgaaggcaaagatattagagaatgttttaattatgtctagattattgcgatccttttcccgtatctcttttcgctcaaattcctcctcttcatcttcttcaagaaacaccaatctcttaaatgatcaagataaccagacccaagaggtcgccccaaaacacaatctcttcgatgaggaagtccgattcgaagatattaatcaaaacatggatgactggaacattccagaaatccctcaggatcaactatacgttcctgaaacaattaaagacaaacacaactttgattacataatcaaaaca

SEQ ID NO: 38515 - DNA, 246 bp, Glycine max
  Peptide Sequence Number=SeqID_155293
atgtatattgttgtggtaaaacaggggcaggatcaccttgggctaccttctgaggtagagacaaaacgtgagcggcagaaaccaatcaaggtagggtacttaaggacggatgcaagtagggatggggtcacgaccgaccgatcgttgccccttctctgggcgagacaagcagagaatgtcgctgcgaggcagccccgtatcctttgtattttgcagctttcttttactatttgtaagaataagtaa

SEQ ID NO: 38516 - DNA, 576 bp, Glycine max
  Peptide Sequence Number=SeqID_155294
atggagaataaggcaaaaacaccaatacgactaaagagggatctaattcgtgagaacttggcaaggataaactttcagaatggcaacccatcgaagccaatgtttcatactgatgattcagtttttgaaggccaatgcattccttggcaggatgccctggttgtgaaacttttaggcaagactattggctacaatattttgaaggcaaactcacgaggctatggaaattcaaggtttccaggacttaatctttatttttatgatgaaagtattctacttgccttggctacaagagttggtagtcctatcaaagccaatgaaaacacattagatttcacaagagggagagttgcacgtgtttgcgttgaggtggatctgaataaaccagttattgggaaggtttggatgaagggtcattggtacaaggtggaatatgaggataaggatgtgggagttaatgggattgatgatcctgtgcaaagtgatgagaatcttgtggagcaaagtgatgctatggaattggtgttaggagatgtgcccaccaatgaaatttatcctggaccaacatcaatctaa

SEQ ID NO: 38517 - DNA, 1122 bp, Glycine max
  Peptide Sequence Number=SeqID_155295
atggaagggccagcctttgcatggttccaatggatgcaccgcaatgcgcagctttcttcgtggtcagcgttcctccatgcattacattcctgttttgcttcgtcgacatatgaagatcccacgggtttgttgtgtaagcttcaaaaacattcatcggtaagcgcctatttgtctgaatttgagtctctagcgaatcgtatcgtaggtcttccggcgacgtttgttttgagctgctttatttcggggttgagccccgctattcatcgagaggtgcaagttctacaacctgtctttttggttcaagcagtgacatatgctcgtttgcaggaggagaaattcctcaatgcgcaccagccaccgacacatcgttctccaacgaccactgtaacaaccacagcttcacaatctcctacaaccaatgctacctctccattgttacccaacccttcacgaacctcggctccttccattcccttcaaacggctcacaccagaagagctcgcggtccaccgtgagaaggggctatgcttccactgtgaagataagtattcacggggacataaatgctcacccttattattcatgttagtggcggaggatgatgagctcgcatcagaggtgacctcgctacagccaccatcaccaactgcggacttactccctgaacctcccccggcgcagcttagcttacatgcattatcaggccattcagcgcctgaaaacttacgtctgaagggggccattaacgagcttcacattagtatcctgattgatggaggtagtacacataacttcctccatcacagggttgtgacggtgttaggtctttcacccaaagagatagctccacttagagttacagtgggtaacagagacaaaatctattgtcatcagctttgcatggccgttaaagtacaaatccaaaggtactccttcacggttgactttcacatcttaccattgtgtggcgcagacgtcatactaggagtagagtggctcaaaacactgggtccagtgctcacagattacacttcattgaccatgaagttcattactgacggcaaactcattgaattacacggtgaccgcgagaaggacgaggagcctctctccccttcctaa

SEQ ID NO: 38518 - DNA, 1209 bp, Glycine max
  Peptide Sequence Number=SeqID_155296
atggtgggtgagggagtaagaccaatgccagaaaaggtgcaggctatacagacttggccaactccgcgttcacctcgggctttaaggggtttccttggcctcgccgggttttattggcggttcattagaggatatgcagctttagcaacacctttcaccaaacttctgtacatggtcccctttgttgtcgagacggatgcgtcgggcgccggtatgggggcagtattatcgcaaggaggtcaccccatcgccttcttcagcaaacaattttgtcctaggatggctaattcttcaacatacatttgtgagctagcggccattactgtcgccgttaagaagtggcagcagtatttgttagggcaccaattcatcattatgaatgatcatagaagtttacgagaactcatgaatcaagaagatacccgtgcttttattgcaagctgcttaacctgtcaatacacgaagtacgataaccggaaaccagggggcttgctctgtccttttccggggttgcacttaggcatgctacccactcatcatactgctcacatcgtagctatgctgttcatggagatggtaggacgacttcacgcttatcgcccacaatctgatgggcaaactgaagttgctaatcgtatcagtgaacagtatttgagggcatttgttcaccaaaaaccttccgcatggggtcgctacttgctttgggttgagtggtcttacaatacgtcgtgtcactctatgactggcatgatcccgtttgaagtcacctttggccggaaaccacctaacttccctcaatatatctcaagcacttctaaaatagatgcagttgacgatatactcagccaacgagaagcagtgttcgagttgctccgccgtaagctaagtaaagctcaaattcgaatgaaggcaacatcagataagcaacgtcgcgatcaagagttcaaagtaggggactgggttttagtgaaactcagaccacaccggctgacatcagctactgttctaagggatatcgctgaccttccaccaatggctcttgaaaatcatcctgtcattactcccctagctatagtagcgtccaaaatgattccttctgaaacaagcccaaagcatatggtgttggtgcagtggaaaggtctggccccggaagaaactttgtgggaggagtggttagagttcaaatcgctccaccaccttgaggacaag

SEQ ID NO: 38519 - DNA, 234 bp, Glycine max
  Peptide Sequence Number=SeqID_155297
atggtggcgtttgcggttgttgctagtttgcttccagttgcgtcatacgctgaagaagatcgtcaattttcgtattcatggcgagctgagatgttacaccctggaatgagtcatgtccaccattattgtgtaatgaaagcaccaatgttacacttgttttcgaggcccaagtatcctccaaaacggagagagagaaagatgagaaacagtgtatttttcattgcctcccaatga

SEQ ID NO: 38520 - DNA, 213 bp, Glycine max
  Peptide Sequence Number=SeqID_155298
atgttattgcctagcgctgttcatgtgttctccattatcaagtgcgaagcttctggtgactgggaagcacgttattctgttgttttccagatcggttccttcgccaaaagaaaaaaaggaagaagtagagacgagagtcgtcatcatggaaaggcagggcggacgaaatcagtgtcctatctttgctttcctcttatctccgatgagaggtaa

SEQ ID NO: 38521 - DNA, 235 bp, Glycine max
  Peptide Sequence Number=SeqID_155299
tgcgattttaatattttgggatagtgtttgtgctcaaatcattgggaaatcaactgttgatcttggagatatagtgattcaagccggtgaagattatcagaaacagtatccaaaagacctagacaataatatgctaggtttgaccttagctttaaagcacaacgctaaagctgataaggcaatgtgtgatataactgaagatattcaatatgccactgtaaagttaaatacatag

SEQ ID NO: 38522 - DNA, 216 bp, Glycine max
  Peptide Sequence Number=SeqID_155300
atgtggaccaagctgaaggaaaagagtgagaccattttctctagtgctggctggaacccctctcaccttgaacctagccagggaattcaagaaaaggaaaagagttcaactgggttggctgtggttgctggccaacaacatatgcaagttcacacacctaggttgatgtattccgaggcttcggtttccatgcttgttgaatgcttcagtgcttga

SEQ ID NO: 38523 - DNA, 168 bp, Glycine max
  Peptide Sequence Number=SeqID_155301
atgtaccaacttcttcaagcctcaaaatggagtgggaatgagtgttgtccgccgttggaggcaatgaaagcaccagttgatgggggtcagggacttgagatttttcttgagtttgaggctaggaaaatacctccagaaatcaagagaggaaaggggacaaaggagtag

SEQ ID NO: 38524 - DNA, 282 bp, Glycine max
  Peptide Sequence Number=SeqID_155302
atggctggccggcgacgactggcagctggaagatttcgacgcgattattcctgtttgtatgtcgatccggcctttcagggccagggcgtcggcagtgcgctgctgaacgcggtgcagcagcgttttacctccaccggcgcgctgaaatgtctgctacagaacgaagcggcgctgcagttttatcagcagcacggctggcagcgcgaagcgctgggagagagcgaacagggtcagtacgtgttgatgcacctgccgctggcgtcacgcaccagcggcagctaa

SEQ ID NO: 38525 - DNA, 2670 bp, Glycine max
  Peptide Sequence Number=SeqID_155303
atggcttctcttgtgagaaagttaaggccttcttctgtgcctactgttactgtggaaactgaagatagcttaagcagctatgagtactcccttgctgtggtgtataatggccctcctctcagttactccattcctgaaatccctgctttcaaaattgaccaaatcccaattgcaaccattgcttctctctctcatgatgacgtctcagtcccagttatccaacctcttggcaaaagtcttcacaaaaggaagcagaatcactgggtgacagattctgttgtcctttcaagcttggactcttgtgcagtagattcaccaccagcaccagacggtgttgatggtgatatgcacaagagtagtccagacactttggaatttcctgatgatagagatggcacttttcttcacacaacttctgacaccacagaatcaggtccaggttcggttacaacctctctatttgccccttctgatgagatttgttccttcagagaggaagagcaaacaccaagtccaactccaaagcatgtgaagcgtgtttctgcggtgaccttctgtgatcctgagtcaaactacatggtggagacagatagtgatgagtttggtgactctcaggttgagagtgttccagtgatggaacgtgctgtgaggcctgggaagaagggttcttgctataggtgcctcaaggggaaccgtcttacgccaaaggaggtttgcattgtttgtagtgcaaagtattgtcgcagctgtgtggtgagggctatggggtccatgccagagggaagaaaatgtgtgacttgcattggctacagaatttatgagagaaatagaagcaagctggggaagtgttctcgtatgatgaaattgttgctgtctgagttgactgtgactcaagtcatggatgatgaaaggtcttgtgaagcaaatcaaataccaccggagcttgtttgtgtcaacttgcaacctctgaatagggaacagcttaaattgctcctcaactgtcgaaacccaccaaaacaactgaagccaggatcctattggtatgataaagcatctggattttggggaaaggatggccaaccgcctagccagataatcagcccccagcttgatgttgggggtcgcctgcacaaaaatgcaagcaatggaaacactaatgtgattataaatgatcgcgagattacgcaaaaagagcgattgatactgcagttggctggagtgccgtgtgagggaacacctaacttttgggtgaatgctgatggatcatacagggaagaggggcagaggaatgataggggctgtatatgggataagcgtgtagcaaggttggcttgtgcaattttgtctttgccagtcccttcaaagtctgtagctctttcttgtgaaggtgaaacagctaacacagacagcgttcatcgaaaaatacttcacaaatttctccttgttggttctgtcaattctggtgcatgtactatatttaaacaggccaagcttctgtataatgatcctttctctgaaaatgagctccaaaatatcaagtcggtgatccaaagtaacctgtttacctaccttggtatactgctggagggacgtgcacatttcgaagaagagagtttgttggagaataggaaaagaaggtctgttgatgaatctacatcatcagggaatatcggcagtgatgatgttgaaacaacactctattccattggctcacgattgaaagctttctcagattggctactcaaatacatggtgtcaggtaacctggatacaatatttccagctgctacacgtgaatatggaccaatggtggagggtttgtggaaggataaagccattcaagcaacatatgataggcgaaatgaactaaaaatgctacccagaagtgcaaactattttctggatcgtgctgttgaaatttccaagactgactatgagccatctgatacggacatcttgtacgctgagggtatatcgttatccaacagcctcacttcaatggaattttgttttcccaagtcaaacagtgaggattctttgtttcctgagtatcaacatgaatcttctctcagataccaactgatcagagtacatcctaaaagccttggagaaaactgcaagtggttggagatgtttgaagagaccgatgttgtaatgttctcagttgccttatctgactatgatgagtacactacagacagtaaaggagtttctaccaacaaaatgttggtagctaagaatctctttgaaaacataatttctcatcgaagcttccataacaaaaaatttctcctagtattgactaaatttgatctgcttgaggagaagattgaacacattcctctagcacaatgtgaatggtttagcgacttccaaccatttatcagtcccaatcagaagaaaggctgtagcaatggcaataataactcttcattagcacaatgtgcttttcaatacattgctgtcaagtttaagagattgttcctttccatcactggccgaattctctttgtttcactggttaatggattggaacctgatactattgatgaagctctcagatatggaagggaggttatggagtgggaaaaatgggatccctctattgtaactgatccaaagtccgagaatacttcaacaagcattgatgagcaaagttacttatgttaa

SEQ ID NO: 38526 - DNA, 225 bp, Glycine max
  Peptide Sequence Number=SeqID_155304
atggaaacaaagcctcagaacttgaatacaaaggctgcagatatattgggaaagagagaattgggcagtgagaaaagagaaacaaaaaatggaagaagggagaatggtggctttggaaggaaggaggtggttaacgaaaaacaagtcttgctaaccgcgttgatttacacgcaggaagagacacaaaggacgggcccagagcagttggtatgcagtggattatga

SEQ ID NO: 38527 - DNA, 417 bp, Glycine max
  Peptide Sequence Number=SeqID_155305
atggaaataaagacagtagggaatgtggatccaccttcaaaaccaccaaccgaattagatgaagaagcacaagaaaaggaacaagctacccgtgaaagtgaatcttctcctaacaagaccatgcatgaagagggttatgttaacatgcaagctcaatctaatccttcatccattcttcaaaaatgcactcctactcatgtcacttcaacaattcaatcaaacccaatggaaaaagaaccttcgagcattgctcataccaataacaaagcaacagttagagttcaagaggtcaccaaaaacccatttttgctcctcaaacttatttcgagtgattcgaccatctccaaaggatctgacaccagtgtgccaaagcctacctccaaccaaatctttgagcaagcaatcacatatttttga

SEQ ID NO: 38528 - DNA, 1002 bp, Glycine max
  Peptide Sequence Number=SeqID_155306
aaagttctcaaaatctcattctcgaactcacgactcttccctcacgtcgatgatcctcttcttcaagaaacatcgtttgagctcatggagcatcgtcggtgcggaaggtctggatcatgccttgcgccgttgactgaatgttgtggtcggatgttggagaataacatgtttagtggtgttgcccatgaagatctaatgcaatacttgaggaagttcatcaagttcaaaaacataagaatagtatcactacatgcaactagtgctaagtatgtttttaaggaggtattcctctccatgaagacgaagcaatacatttgggacattggaaactttgttcaaagggaacaagcgagcatacctaaagcttgggaaaaattgcaagagaagttgggcataacagacttagaacctactaacatcactcttcaccttgctgatcgttcagttgtctatcttagaagggtgattgaggatgtgttggttaaggtggacaagttcatcatttcagctaattttgttagtttagatatggagaatgatgaagatgtccttatcattttgggatgtcctttccttagtacttgtgatttacttattgaagttaggcttggtagactcacccttagattaagggatgagagagtgtctgttgatatagttgatgcactgataaaaggggcattcccaagtgtggggatgcctaaccctctaaagacagttctcactaatgaggaccttgattgggagttgaatcttgaactaaagcctcctattgatgaacctaccgaattggagttgaagcctcttccttccaacttcaaatatgtttttattaaccaaccatcttctcttccgattatgatttctgcaggtttacatgaaactaaagaggataaactgttgcgggtttttagggacaagaaggaaacctttgggtggaacattcatgacatgaatggttcaaaccccacgctcagcactcacaagatcaacactaaatag

SEQ ID NO: 38529 - DNA, 116 bp, Glycine max
  Peptide Sequence Number=SeqID_155307
atgacacgccaacagatctacacatcacaacaccatgacacatacggaggttcaaatttgggacggagatgggttggcttcacagggaaggggaactacgaggagtgggctcacag

SEQ ID NO: 38530 - DNA, 204 bp, Glycine max
  Peptide Sequence Number=SeqID_155308
atgacggtggcttgggtgatcgttgggagcggtgatgtgatggaaggtggtgatctggtgtttgggtgcgcaggagtcaatagcaatggtataacaagtccaaagaaagtgtccaatgatatggatgaattaagttggcattattggcaccaaaaattaaagaggccttggacaaagatgggccaaccaggcactgttaaataa

SEQ ID NO: 38531 - DNA, 1398 bp, Glycine max
  Peptide Sequence Number=SeqID_155309
gggctcaaaatctaccctaaggctcatgagaaccctagggccttcccttggatctctagcccaatctacttggagtcttctacccaatgcccttgcgggataggattgcatcaaatacccccatcacgatccaaggaattggggcccatagttactgactacacctcccggacgatgcccttcacttggttgggggccccagtccagctcacggcagacgttcccctcctccctgctccggcctctgtccaccaattccatcgactggttcatacgcagggtgtcaccgctttgttccaactcacccacatgcctgacccgcatccacccaccatcaactcttccccctctgatacacctcctgccatattacctatcctctaccgatatggccatctcttccaagaaccatccacccttccaccaccacggcctatatcccaccatatccacctacaaccaaactctcaacctgatggtagctggaggtgttgcgttgattacagggcattgaacgcgattaccatcaaggatcattttccaatgccaaccattgatgaactcttggacgaattacccaatgcttcttatttctccaaattggacctccgtcaaggcttccatcaaatccccacggcgtccaccaacatccacaagattgcattccgcactcaccaaggacattacgaatacaaagtgatgcccttcggtctttgcaacgcgccgacaacatttcaggcaaccatgaatcagctgtttaagccgttcctctgccggtttgttgcagtcttcttcaatgatattctcgtctatagccccaccttggagacatatcttgaacatttgcaggcagttatggaagctctcgctcaacaccaatttttgttgcacctcaacaaatcaagggtggcccctgacccctccaaaattagtgccacggtggactggccacttcctcacaccgcttccgagttgcgtgaatggtcatataacacctccgttcattccgccaccggtgtatctccctttgaggccacttttggtaaaccgcctccctcacttcccagttacttagcaggggacttttctattgaagttgtggactccattttagcttcacggactcagctccatgcagtgctccaacgtcgtcttgctaaagctcagactgccatgaagaaacaagcagactctcaccgtagggacgcacatatcggtacggtggcttatcatcttcaattaccctcagcctccaaaatccaccccgtgtttcatgtttcacttctgaaatcgtacaaggggcccactccttgggatcatagcctggatccaccagtacaaaaggtcttggtccagtgggccagcctcgctccagaagatacctcttggaaggattag

SEQ ID NO: 38532 - DNA, 1296 bp, Glycine max
  Peptide Sequence Number=SeqID_155310
gatgcgcagaaagagtgtcttcttgtcaatgcacctttgatttgtagagctgctttgcgtgttcccttttccgttcttaagtatgctatgacccttgatggaaaaattgctgctaccactggccatgcatcatggataagctgcaaacagtctagaaatctagtttttgagttacgaggtagaagtgatgctgttattgtgggaggaaatacagttcgaagggacaatccaagactaacggctagacatggaggggggcatatgccaatgcgcattgtaatgacccagactcttgatcttccggagaaagcaaacctgtgggatatgtctgaggtttctaccatagttgtaacacaaaggggtgcaagaaggagtttccagaagctgcttgcatcaaaaggagttgaggttgtggagtttgacatattgaatgcccgagaagttatggagtatttccatgatcgtggttatctttcaattttatgggaatgcggaggaacattggctgcatctgctatttcatctggagtaattcacaaggtttatgcttttgttgctcctaaaattattggtggaaagaatgcaccttctcctgtgggtgatcttgggatggttgagatgtcacaggctttaaatctaattgatgtttgctatgagcaggttgggcctgacatgcttattagtggatttcttcagcccttaccagacatggtacctgtaatcccatcacccgatgaaacttttgttgctgatcctactgtctcaccatatgattcaaggatcatatttttctataaaacatgggatccttatggtgcattttcaaatttctctcctcatcccattcaaatgcctgatgaaaatggtgattatgtgacttggatgagtgtcgagcattactaccaggctcacaagtttattggggtggatgatcctttggcacaagattgtgttgaaatgattaaatctgcaaaaagtccagaagaagctgcaagaataggaaggtcaatgcaaaagcagaaaccctatctgataaggtctgactgggacaacataaagatcgatgtcatgtacagggcactgaaatgcaagttctcaatctacccacacttgaattctatgctgctctctactgctggttctgttctagttgaggcttcgccacatgatctgttttggggtggaggccgagacggtgaaggcttaaattatcttggtaggctgttgatgaaattgagatcagagtttcttggggagtcttcatcatcaagtgagacccctagtttaactgtatag

SEQ ID NO: 38533 - DNA, 267 bp, Glycine max
  Peptide Sequence Number=SeqID_155311
atggtccccgagacagtatccaaagccgtcgatgctctcctcaagtggcggcgctcccaattagagattcagaaaccaaaactcttggacgaagacgaagaattcgtagaagagcattgtgccgctcctgccgcggcttctggggaagagttttttcaagaagaggaagatttcggtgccggtggacctgaagaaggggagctggaaggagcaggtggagagggcctgctcgtccgccatgctgttcatgaggacggggacttgtag

SEQ ID NO: 38534 - DNA, 360 bp, Glycine max
  Peptide Sequence Number=SeqID_155312
atggcggtgtccgtgacgcgtggttcggagaaaggaactatcgctagttcgcatcgcaaacttcttactaatggtttgccccctgttctcaaccggcaagtgtaccggatcgcacaagatctcacaatcactcacaaactcatctcaagctctcagaacggcttccgcttcgaactcgcgtctctgcagatcttcacacagcaaaatctctcagaactctctggaacttggacctttctctctctagaacttcctaaacatgcaaaagcttcaagccaaggccagactctcgtgcatgcagaggcttcttcaagaaaaatgccaaactccctttgcaaatctgatttcaggcttaaatag

SEQ ID NO: 38535 - DNA, 315 bp, Glycine max
  Peptide Sequence Number=SeqID_155313
atgaaatataatcccagattgtcttctaggcgacatcaccaagttgacccttgttatgaagatgctagaaagaaaagtagtgatggatcctaccttgctgagattaaaaattacacgcatgctgcagaggattcgttgagggggacaagcaaaattttattggtttcgtgcttgaacccatcattttgccaagacactatttacatggttagcttggcatcacggtcatgtcattggatttgtcgggcattcttagattccaccaagagaaatgcaagttcagcaaaacaaatggtgaattctcataagaactag

SEQ ID NO: 38536 - DNA, 228 bp, Glycine max
  Peptide Sequence Number=SeqID_155314
atgttccaactgggcaggcaagtatccagagctcaatgtgtttcttcacgaaatgcaaggtcgagccggggcgttggagccgtgaagtccacctcgtccacttcaatagaagaacaacaggtagggtgttgctgtcaaagggattcaggtgtaaacatggtagagcaaaatgtgcggaaagaggctagggttcataaagttgtggacgaatgcacggaaaaaggctag

SEQ ID NO: 38537 - DNA, 1269 bp, Glycine max
  Peptide Sequence Number=SeqID_155315
atggaactcacggacgtcgtcgccgaagtgctgggaaccgatctggtgcgcaccggctggttcgagtgttcggacccgcgtctcgagcaactgcaccgcaacatcgtctggggggccagaggcaacttcctcgacctgccgacagattgcccgcaacgggcggagcgcctcggttggactggagacatccaggtgttcgcccggaccgcgaatttcctcttcgacacgtcgggtttcctcgcgggatggctcgaggatctggcagcggaacagcgcgatgacggatccgtcccgtggatcgtccccgacgtctatcccggggagtgggtgccagcagcagggtggggagacgccgcgacgctgttgccagtgagactgcacgacgcgttcgccgatgatgagatgctcgcgcgccagtacgcctcgatgaaggggtgggtggatcggatcgcgggactcgcggatgaccgtggcgtatggttcgcgaccggccagatcggggattggctcgacccggatgctcctgccgaagacccggccgccgcgaaggcggatcccgctgtcatcgcgacggcctatctctaccgttcggcgggagcggtcgcagaggcggcacggcggttgggtcacacggacgacgcggcggcgtacgaacagctcgcgtctcgggtcgccgagggttttctcgcagagttcgtcgacgacgacggccgtgtccgcagcgactgccagacggtctacgcgatcgccatcaccttcgggctgctgtccgatccttctcttctcgcgcgcgcgggccgtcgcctcgcggatctcgtggaggcggcggatgcaacggtgtccacgggattcctgggcaccccgcacatcctcgatgcgctccacctcacaggccgcaccgatctgtcgttccggatgctgacgcagacgagatgtccgtcgtggctctacgcggtcgagatgggggcgacgacgatgtgggaacggtgggatgcgttgcagcccgacgggcacgtgcacccggggagcatgacctcgttcaaccattacgcctatggcgccgtcgccgacttcctgcactgccgtatcggcgggctccgcccactcacgcccgggtatcggaggttcgctgtcgagccggtaccgggcgacctggtctcggcagcagttgcgctcgactccgccgccggacgaatcgaggtccggtggtcgcgggacgatcaggggttcgcgatgcaggtcgtcgtaccggtcggtgcgacggcggag

SEQ ID NO: 38538 - DNA, 609 bp, Glycine max
  Peptide Sequence Number=SeqID_155316
atgtcggaaacgcggtggcgtgacaccgaatgtcacgcacaagagcctgttgcggctgggcgcagccgtcgacaacgctatggacgtgaggcagtgtcgtcaggggaatcgacggagcgctggcggccggaacggggggagcgcgatgcctgtgatcgcgtgcacggacacgggggcgacgcagtgatcaccacgcaggagatcgccgcgaggatgtgcggcgagcagctgccgctcctcacgattgaggagttcttcgacgggaacgcgcagaaggagtcgctggcgccgaaccagtggggatacggtcgcccgactctggttgagatcgccgcgcggctgcgtgcgctggagactcaggacgacgtggcgtgggtgcgcgtcgaactgcaccccgacagcgaggtcgacaaacgggacggcgaagtctggggagagtcgatcgtgatcggcacgacggcacccgcagccgagttggagcgccgagtggatgtcgagtcgttgcggagcgacggcatcgtcgaatccggcaccgggtcactcgacgacgtgtgcgacgtgccggcggtggaggggcatgagcgcgtggtcttcctggtgtgggactga

SEQ ID NO: 38539 - DNA, 363 bp, Glycine max
  Peptide Sequence Number=SeqID_155317
atggctggtatatcatactcctcagtagttgggagtttgatgtatgcaatggtctgtacaaggccagatattgttgatgtggttggagtgcaatttcttcaacagttgggaatgaagcaggaaagttacatgattcattatgaaagtcaaagtgctttggatttaagtaagaatgtgatgtaccactctctcacaaatcacattgatgtaagataccatttgttgcaacgagaagtggaagaacaacacttcaagttggaaaagattcacattgataaaaatcctacgaatatgatgagtaaagttgtagcacgagaaaagcttcaactttgtgtcgagctaatcgatatggattgcctatga

SEQ ID NO: 38540 - DNA, 492 bp, Glycine max
  Peptide Sequence Number=SeqID_155318
atgagtatgttgctgcatatacccttaagaatgaacagtgccctaagactggaagagggatatcatcatgcatccatatctagacagaccagtgcagttccagatgaaaatgggatgaaaaatattcaaccaaagcaactggaaatacaagaaatggggagaagagagagtgcattaggcaaagatatagagcaacaacctaccctcctagaggagtatcacttgaggaataaattagaaagaagccctgcaacttatatatctagtcatggctttactgagaatagccattttcctgaaggaaaagaggaaatatatgaaaagaagttgaaagatgcagctgccagagaacttatgctcgctgaggaggctacaatgttggacagggagctaaaaagagagagagcaaaagcatccgttgctatcaagtcacttcgacaaaagatggaagacaaactgaagacagaactagaacaaaaggtgcacaattag

SEQ ID NO: 38541 - DNA, 402 bp, Glycine max
  Peptide Sequence Number=SeqID_155319
atgcgccttcctcccttggaagacgcacctgtgagccctgcgttgccctcccgccgaagggcaaatagattcaagagcctactaaaccctaaacccctaaattcttccaatggtgctggtggtaagagtacttggggaaaattgcttgacatagatattgattctcacataaacgtgaatgatccaaattatgatggtggcgagctgcttgaaacaagcacaacacagatcactggaatattgacatatgaatggattcttgaagacggtttattaagggatcgttgtggaaagtcaacactttccacgacgttgccttctaagacggttgccaaccgtcatagaaggcttgttacaatcaatgtagaatcgtcattctgcactcgtgtatatagggtatga

SEQ ID NO: 38542 - DNA, 1158 bp, Glycine max
  Peptide Sequence Number=SeqID_155320
atggccacacagacgcaagatccaccttcaaaccctaaccctaatcccaatgccacgtcggcaacgccatcttcctccttcttcttccgcgccggcggcgccaacggcgcctccgtcgctccagtcgccggctccggcgagtcacactcgcaccaccgtagagcgcagtcggaggtcagtttccggctgccggaagacatgatggacctctcgccgtccgatccgttcaacggcggatcctctacggcgagcttcgaggagatcggatccgaggacgacctgttctccacctacattgacgtcgaaaagctcagcggcggcgccaacggcgccggccgaggcggaaacggatcggatcagagcggttacggaaacggcgccggcaccagcggccacaacgacggcgagaagagttcgagcgccgccgcagcgcggccgagacaccggcacagtagctccgtcgacggttccacgtcgacgtgcatgttcggagagatcatggatgcgaagaaagccatgcctcctgataagctcgcggagctttggaacattgatccaaagcgtgccaaaagaatactggctaatcggcaatctgctgcgcgttcaaaagaaagaaaggcacgctatatacaagaacttgagcacaaagttcagacccttcagactgaagctacaacactatctgcccaacttacattgtaccagagggatacaactggtctgagttctgaaaatactgagcttaagctccgtctacaagccatggagcaacaagcacagcttcgtgatgctcttaatgatgcattgatgaaggaagttgagaggcttaagattgctaccggagaggcattgaaccaatccgagtcttttaatctgggaatgcaccagatgccatatgcagggccaaatttcttttcaattccaccacattcaggtccttctgggcaccagaacatgcaattgccaccatttggtcactcccaatccaccgtgccgactcatcagctgcaacaaacaaattctcaccaaatgtcagatatattgcaaaacgaccagcttggtcgtttgcagggactcgatattagtagcaaaggaacacccatggtgaagtctgaaggcccctcaatatctgcaaatgagagtagcaccacattttga

SEQ ID NO: 38543 - DNA, 763 bp, Glycine max
  Peptide Sequence Number=SeqID_155321
atgggcaaattctggggggacttggtggttgaagaggaatctgatacgggtaaggaggaccaagacgcccttgcctttggtgctcagttccaacgtgtcatctccaaatccaaaaaaagaagttggagcaaaggaagacgaaagctcactcccaaaggatccacaatacccgcagtagggatgattctgtatccatctcttgggttttgtgctccgcaccttcatccagatgtcacatcttcatcccttcaacttctctcttgttccttaatttggaataatcgttgtgttcatattaatgctatctatgcggcaactagccatctggtcagaaggaatttgtggaatagtttgtctgcccttttgaacgctaatcgtgatccttggattctgaatggagcgaagactcgacaaagccatctatttggggaatggcttgatttttggtcctctttgacttgcagtactcttcaaaggagtcagtcaaatcatttttcccattctggtggtcatggaaagggggactacaagaaaatcatcgaacaggtgtggggccaatctattcttagttgccctatgttcattctgacccataaattgaaacttttgaaagttgctctcaaatcttggaacaaggattcttttggaaatatccctgacttagttgatagagctaaaaatgagttgtctcttattaagctcttcttaactggttttcttagggggaccgcaacacctcctttcataagatggttaaaacttg

SEQ ID NO: 38544 - DNA, 936 bp, Glycine max
  Peptide Sequence Number=SeqID_155322
atgtatgttaaccaaccgatgaacaaaaaagggcaaaacaaagctcgaaggagagacccactcttggattcgttacatcttttgcagctagtgttagagggttcatttaattatgtaagtcatggcacgcggattaagacccgcaaacgaaatattgctgcgccgctggaccctgcagcattctcggatgcagtggtccagatttatttggataatgctggtgatctggaacttattgctaagagtattgaatcttcagaccttaacttttcaagatacgtgccatgggttttcaatgagctatttggaaatcaattttggattgtgattatagagaattggatgcataattcgtggcttagatgctgtccgatttatcaagaccttctcaatgttgctttcactgggggtcgtacacaacctggaactaccaagcctgatgagggggaccgccacccatactctataatagagtgtgagcctaagcgtgaagtcattttaccatctgtaatctacatacaaaagattttgcggcgaaggccatttctcatcaagaaccttgaaaatgttatgcggaaattccttcagtccttggaacttttcgaggaaaatgagaggaaaaagttggcaatcttcacagcacttgctttctctcagaagctgtctggtctcccaccagaaactgtgttccaaccacttcttaaagataaccttgtggccaaagggctagttctgtcatttatgactgacttctttaaggagtatctgattgacaacagccttgatgatcttatttcaattctaaaacggggaaaagtagaggaggatcttttggacattttcccccctacaaaaagatccattgaagctttctctgagcatttcacgccattggatattgcaagttccaacagctttgttgatctcaatatgtga

SEQ ID NO: 38545 - DNA, 489 bp, Glycine max
  Peptide Sequence Number=SeqID_155323
atggcactgtcgtgtctcacactcactgccaacccttcttccatcatctgcaaattcaaagcgtccctacctaccgctccccacgccctcgacgccacctacatccgacgcgccgcccacctcgccgacaaatccgccggcttcacatccccccaccccaacttcggctgcgtcatcgtctccccctccggcaaagtcgccggcgagggctacctctacgcccagggcaccgccgccgcggaggtccaggccgtcaaggccgccggcgaactctgccgcggcgccaccgcgtacctcaacatggagcccggcgactgccacggtgaccacagcgccgtctctgctctgctccagggaggggtcaaaagggttgtggttggaatgaggcatcccctgcaacatctccgtggcaatgctgtccgtgcactcagaaaccaagggctgcatgttgatcttcttggagaggatctcactagtaatctcattgag

SEQ ID NO: 38546 - DNA, 792 bp, Glycine max
  Peptide Sequence Number=SeqID_155324
atgccggtttacatcatgggagatcatgtaactgtctcgaccactcaacaacacattgcaatccccattgagaaattgaatgcattatcacttgaagttgcaaaggaagaaaaacatgtaaccgatgatgcctatgtggacaatgtccaaaaacctgaagagaaagatgaagaaactcaagaaaagggagattgtcgctactgtcaagaagaggactttatttttaatatggaatcaccctgcaattgcaatggtagcgtgaagtatgttcacaagagatgcattgatcaatggtacaattccaaaggccgcatgatattatgtgagatttgcaggaagccttacaatccaaatgattacccacttccggaacttcattatgatgatgatgacaccgagataactatattaaggcaagttatatctacttattgttcttcaatcatggaggaatggactattcctggaaccagcattgaaatttggtcacctttggtgctggcagaccgtgccaccaagggcctcattgattcaatgaacaaagacttcagcttgaaaaaccctagtggaggtgtgatatttggcatgtcactcgtcatctttatcgcggtgctacttataaaggatgcctatgaatgtgcgccacccaaggaggagaaatttgctcgttttttgtactgcgctgtgatgactatctctgtgccagtttacattttatcgtgggttttacagtgccaagcctatagaaaaagcgagagagggagggaaagagaaagacatcgcaatgcatag

SEQ ID NO: 38547 - DNA, 202 bp, Glycine max
  Peptide Sequence Number=SeqID_155325
atggcacgcagcgtgtccgctctgtgcccctattcaaaggacctatatggaagggagctaacaaggcttttagtgataattcccaaggcggtcatatctctcttgaaggtctctagaggtatcatccccttcgaagaacatattgcagcagtagggactactagcaacaatacattttcgaagaggaaaactctagatgagg

SEQ ID NO: 38548 - DNA, 1020 bp, Glycine max
  misc_feature (1014)..(1014): n is a, c, g, or t
  Peptide Sequence Number=SeqID_155326
ctttggttgttcagcttaccatgcagagagagtgtgtgcatcccaagtgagcgtgagacacttttgaagattaagaataatctcatagatccttcaaataggctttggtcttggaatcataataataccaactgttgccactggtatggagtcctctgccacaacgtcacttcccatgttcttcagcttcacctcaacacttcagattctgctttctatcatgaccatgatggctatctctactcagacttcgatgaggaagcttatgagaaatcccagtttggtggagtgataagtccttgtttggctgatttaaagcatttgaattacttggacttgagcggcaatgaattccttggagaaggtatgtcaattccttctttccttgggacaatgacttccttgactcacctcaacctctcttatactggattcacggggaagattcctcctcagattgggaatctctccaatttggtctaccttgacctcggaggttatttgactgatctcggatttctgtttgctgaaaatgtagaatgggtatcaagtatgtggaagcttgaatatcttgatttgagtagtgcaaacctatccaaagcatttcattggctacacactctccaatctcttccttctttgacccacctatatttgtcacgatccttactccctcactataatgaaccatccttgctcaacttctcatctctgcaaactctccatctttccttaactagttattcccctgccatttcttttgtccccaagtggatattcaaattgaagaaacttgtttctcttcaattatcatataattttcaaatccaaggtccgattccttgtggtattcgaaacctcacacatcttcaaaatcttgacttgtctttcaattcattttcatcttctatacctaattgcttatacggtcttcatcgtctcaagttcctcaacctaggggaaaccaacttgcatgggactatttctgatgccctgggaaatttgacttctctntgttga

SEQ ID NO: 38549 - DNA, 195 bp, Glycine max
  Peptide Sequence Number=SeqID_155327
atggagcttacatcaggggatgtctcctccacctctagaacctcacaatcactcacagactcatctcatggtctcaggatggcttcctcttcaaactcaggtgcatgcactgctcatccttcttccagattcttcctcacgctcagccgcaagagtggtgcgctcagcggatggctcgttaagtcggcagattag

SEQ ID NO: 38550 - DNA, 264 bp, Glycine max
  Peptide Sequence Number=SeqID_155328
atgattcaagagaaaaagatgaagaaaaaaaataaggagaaagcacaacaatgggagaagtgctcacaagtagaaattcaacaagaaagtattctccaagtcaatactcctcctcatcaactgattgcaaaggaagaaagacatggaaaacatgagaaagtcataagtgtcattctttccttaatcactagcacttctcttgcaatgatatggaaggtgtttccgaaatacatgagtttcatggagtcttttgctaagaggtga

SEQ ID NO: 38551 - DNA, 222 bp, Glycine max
  Peptide Sequence Number=SeqID_155329
atgggtattaaacattttgaagtgatcaaacgaaggtcgcatgccgacaaacaatggttctcggacgaaattaggaatactggaagacattatggtgggaacagagtaggcaatgttggacccaggcaaaagataatggaggggcagaacaaaattgagggagtagaactcaatgtacctgctttcaagggcaggaataatccgaacgcctaccttgattag

SEQ ID NO: 38552 - DNA, 934 bp, Glycine max
  Peptide Sequence Number=SeqID_155330
tccgcatttaccgcatttcaagacaaaggttgcatgcatctgcatccctaaaaatcatgtcctcgcctttagagggctacatgccctcgccttcagagggctacacgccctcgcctttagaaggctgcacgtcctcgccttcagaggtctacacgccctcgccttcagaggcctacatgtcctcgccttcagagggctgaacgccatcacctttagaggactacacgtcctcgccttcagcaggctgcacgccctcgccttcacaggactgcacgccctcgccttcataggactgcacgtccttgccttcaaagggctgcatgtccttcccttcagagggcttcacgtcctcgccttcagagggctgcacgccctcgtctttacaggaatgcacgtccttgcctttagaaggctgcacgtcctcgcctttaggggactgcacgtcctcgcctttagagggcttcacgtccttgccttcagaaggctacacgtcctcgccttcagagggctacacgtcctcgccttcagagggctacacgtcctctccttcggaggactgcacatcctcgccttccgaggactgcatgccctcgccttcagtgggctacacgtcctcactttcacagggctccacatccgcgccttcagggaactcaaggatcgttcccacaagacacccagtggacccgaagaagtccaacagggtcctggggtttccagctctgattatgggcctctgtcaattctacggagtgcccgtcgcccccagcaaggcaggcgtagggcgaggcaccacaacagcctggggaaggccagcagcgagcaacagacgcaccaccatcacctccagaatccacctcagttcatctacaaaggctggagcgttgcatacgacacgtggtcgaccagcagaagaccaagtccaaagccacag

SEQ ID NO: 38553 - DNA, 1070 bp, Glycine max
  Peptide Sequence Number=SeqID_155331
atggaagttctgagcgtgagggagttaatggcctattacagtatcggcgaagtggccgaacgatgcggtatcaaccccgttacgctgcgtgcctggcagcgccgttatggattgttgaagccgcagcgcagcgaagggggtcatcgtcagtttgacgatgaagatatcctgcgtattgaagagatcaaacgcctgatgaaaagcggcgtttcggtcggcaaagtcaaagccttgctggaaaacaaggaagtgttgacgcagggcaactggctcgccttccaggaagagatgatgaccgtactgcgttacgccagtccggcaaaactgcgcgccaaagtcggtgagtttcgtcgcgatcacccgatggatgcgctgattgacaatattatctctcccgtccgccagcggatgaaccaggatcaaaacaccgtgcgccacatggcgagcctgtttgatggcgtactgattgaattcgcgattgcaagcctggcggagtcccgcaagaaagccggtaaagacgcgctcctgattggctgggaatgcgatgatcgcacccatttgtggcttgaagccgcgcgcttatcgcagaagggctggcacattgacgttctggcggaaccgattgattcaccgcgtcctgaactgtttcccgggcaaaaaatcttcgtctggacgggtaaatccccaacccctcgccagcaggagcagctcgatcactggcgtgagcagggatttgcgtttcgtatctccgttcacacgctctggggcgatctcaaaatttcgactgccagtgatgatcaggatgcgaaagacgctaccgagtcattttataaatcctatctttccgcattcggtagtgatgatgccaggccttatcctgccgatgaactgcgtaaatatgtttctgctgatacgattgcccggattgatgccattcaggaaatcaatgaacaagagttaatagagtctgactattttacgtatacccaggattattctcgcgaatggatacctgcgttacgagtggaaaacgcaaggccatttttaaacggtgaagtagtgcacttgtg

SEQ ID NO: 38554 - DNA, 231 bp, Glycine max
  Peptide Sequence Number=SeqID_155332
atggagcttacatcacgcgtaggtcgtgtcggggttgtaccatcttgggaaaagagactgctagattcttccaagggaatcagggcaatctccggaaggttcttcactggaaggttcttcctcagattggaactcatgcaagatttaaatcgtcagcgggacgaggccttacaggagtcggggcttcagcaggggctctttgtggtggggcagatgtcctttgctggatga

SEQ ID NO: 38555 - DNA, 177 bp, Glycine max
  Peptide Sequence Number=SeqID_155333
atgttggatatccttgtttctcatgagggggaatacttgtacttggaggcatgtcactcagtttggagctcccttgagactgaggttgatcaccttggggggaggggggttgcttgtgcacaacaaggtgacctcgacacttactgcccagttttcctaagtgagagtgtcgtgtga

SEQ ID NO: 38556 - DNA, 207 bp, Glycine max
  Peptide Sequence Number=SeqID_155334
atgaagcttgcctatgagataagcctcctcattaagcattggagggaggcactttgtgagcattgtggcatctcatgggatttactcttaagtttcggttttgaagaggtgatcataagagattataaggaccttatgatgtcttggaaggaagcactttgtgaggctgctggcatctcgagggttgtagtcctaaattcctggtaa

SEQ ID NO: 38557 - DNA, 300 bp, Glycine max
  Peptide Sequence Number=SeqID_155335
atggacattgctaataaaatagactactttgtggagcgttggagggaaggactttttgttgccattcgcatctcgtggagaggaagcttgattactgaaaagttaacagatctccttgtgaagcattggagggaaacactgtgtgaggctctttgtgaggctgttggtttcgatggtgcagacttatactacagagaaactgtgatggttgataaaatagaactgcttgtggtgaattggagtaaggcactttgcgaggctgttagcatcttggggggtgcacacctaaattccaagtaa

SEQ ID NO: 38558 - DNA, 207 bp, Glycine max
  Peptide Sequence Number=SeqID_155336
atgcatcacgcgcaccgctcagcgcagctggaaccagcggcgccagacgaagcggataatgaaaaactcaacggtacccagcagcaaaaaccagacgcagaacaccatgagcctgctgcagctgttttgccagcgccacgccaaacgaaggggcgggcagcagtagcgccgaaagaaagcccagcagcagaatgccgcccgggatga

SEQ ID NO: 38559 - DNA, 790 bp, Glycine max
  Peptide Sequence Number=SeqID_155337
atgagcaacactgcggtaaatctggcgctagccgccgctggcatggaaagcacacaccttcaggaacgaaaagacgtagatgtcctgctgatcggcgcaggcgtgatgagtgctaccttaggcacctggctgcaggatctcgagccagactggtcgattgagatggtcgagcggctggatgatgtcgcagtcgaatcctctaacggctggaacaatgccggcaccggccacgcggcgctggccgagctgaactatacgcccgaaagagcggatggcagcatcgacattgccaaagcggtggcgattaacgaatccttccagatttcccgccagttctgggcgtatcacgtacagaaaggcaacctgagtaatccacaaagctttattcacagcacgccgcacatgagttttgtctggggcgaggccaacgtggctttcctgcgcaagcgcttccaggcgctgcagaaaagcaccctgttccgcggcatgaactattccgaagatcgtgaccagatcgctgagtggattccgctggtgatgaacgggcgtgaccgcaagcagaaagtggcggccacctggaccgacatgggcaccgacgttaacttcggtgaggtgacgcgccagctgattgccgcgcttgagaagaaagagaatttccgcctgcgtctgcgtcaggaagtgcgcgatatcaagcgcctgagcgatgggcgctggcaggtaagcctgcacaacctcgccagcggtgagtcgcgggtgctgaccgcgcgccagctgtttatcggtgccggcg

SEQ ID NO: 38560 - DNA, 573 bp, Glycine max
  Peptide Sequence Number=SeqID_155338
atgacatttatcgcaaccctgattctggcctttggtatgtcgatggacgctttcgctgcagcactgggcaaaggcgcgtcgctgtatcgtccgggtttcaaagaagcattacgcacagggctgatttttggcgtcattgaaatgctgacgccgctggtggggtgggccatcgggttggctgccagccactacattatggcgtgggatcactgggtggcatttggtctgctgggcattcttggcgggcggatgatcatggaaggtttccgtcagacggccgatgagccgtgcgaagcgccgcagcgccacggctttatggtactggcgctgacggcggtagcgaccagcctcgatgcgctggcggtgggggttggcctcgcgttcctgcaggttaacattgtgctcaccgcgctcaccatcggtgcggccaccactatcatggcgaccaccggtgtgctggtcggtcgctttatcggtccggtaatgggcaaatgggcggaagtgctgggcggcgtggtactgatcagcattggctgcaccatcctgattgagcacttagggctgttccgttaa

SEQ ID NO: 38561 - DNA, 673 bp, Glycine max
  Peptide Sequence Number=SeqID_155339
atgtctcataaaattgcattgattaccggcggtaaccgcggtctgggcaagaatggcgcgctaaaactggcggctaagggcgtcgatattctgtttacctggcgcggtcatgctgaagaagcgcaggcggtcgtgaaggagattgaggcgctgggcgcgcgtgcggtggcgctgcagctggatgtgggcgacagtaagcagttcgatgactttgcggcgcgggttaaagcaacgctgaacgagacctggcagcgcgatagctttgattatttagtgaacaatgctggccacggtcattacaagctgctggccgaaaccagtgaagaggagtttgatgcgctggtgaatgtgcattttaaagggccgtatttcctgacgcagaaactgctgccgctgatcgccgatggtggacgcatcctgaacatttccagcggtctgacgcgcatgacgctgccaggttcaggtacttacgccgccatgaaaggggcgatggaagtgctgacgcgctatcaggcgaaggagctgggcgagcgccgcattcgcgtcaacattctggcaccgggggcgattgaaaccgactttggcggcggtcgcgtgcgcgacacgaaagatctgaacgcgcatattgcttcagtgaccgcgctgggccgcgttggtctgccggatgatatcg

SEQ ID NO: 38562 - DNA, 733 bp, Glycine max
  Peptide Sequence Number=SeqID_155340
atgaattcttcctccatttatattcttgtctttgtccagctttggttgttgagcttaccatgcagagagagtgtgtgcatcccaagtgagcgtgagacacttatgaagtttaagaataatctgaatgatccttcaaataggctttggtcttggaatcataataataccaactgttgccactggtatggagtcctctgccacaaccttactttccatgttcttcagcttcacctccacacctcagattctgttttctatcattactatgatagctactctcacttcgatgaggaagcttataggagatggagctttggtggagagataagtccttgtttggctgatttaaagcatttgaattacttggacttgagcgccaatgaattccttggagaaggtatgtcaattccttctttccttgggacaatgacttccttgactcacctcaacctctctcatactggattcaatgggaagattcctcctcagattgggaatctctctaagcttcgatatcttgacttgagcggcaattatttacttggaggaggtatgtcaattccttctttcctcgggacaatgacttccttgactcacctcgacctctctggtactggattcatggggaagattccatctcagatttggaatctctccaatttggtgtatcttggccttggaggtgattctgatgtcgaacctctgtttgctgaaaatgtagaatggctatcaa

SEQ ID NO: 38563 - DNA, 378 bp, Glycine max
  Peptide Sequence Number=SeqID_155341
atgaaagtcacatcaacccagaatatgagcaaggcgtcgagtagttcttgcaatttgcttcagaaagaagtcgatcagatgaacttgtatcaattgtttgaacggaaggcgacaaatactggacgacatatacgaccatctatagtgaaaaagaggctaagttttgaattgcaaaatgtagcagttgggttaagctcagcagctgggctaagcgcatatccaccactaagcacgcttagcgcaaaggagaatctgatagagcatcaggatcaaaggccgtgcgctaagcgtgacatcaatgcgctaagcgtcgcaggtgccttcagccaggctaagttcgagattggcgctaaacctaatttcacttactcgcgctaa

SEQ ID NO: 38564 - DNA, 357 bp, Glycine max
  Peptide Sequence Number=SeqID_155342
atgcccgctaggaggaagaaagccatatctcttttctgggttatacccctccatggcgaagatagccaaagtggtcaaagtctcggcacaagaattggaccgagtaaaacaaatagaaatggagtgatcggaataccaaggaagcacttggaagagaaagtgaaggctttggcggatcaaggtgaatggtcttcgttcattgatgtcttagtgctattggtgttcggagtcgtcctcttttcgaatatggatgggctagtggatctagcggtgatctacgccttccttgcttatcaccacagcaaggaaagtccggtcgttgctgttttggccgatgcctatgacacatttgactga

SEQ ID NO: 38565 - DNA, 534 bp, Glycine max
  Peptide Sequence Number=SeqID_155343
atggagtgtggtgcaaataaaaggataaggagcttaggggaagcagtaatggggtcatcggctgaaacccctgaggagagcgaagaggtgcaagccttaaaggtggaacttgaaagagcgcaagcggtcaaggaaaagttcaagacgatggccatcaaggtccataaagagtgcgatgagctgagggacatcaacattgccacgaccgaagcattggaatgggaaacgaagagggcccgaaaagaagaatggggccaaaacaagacgaaagagaacatgtgggctatcattgaccaatacaaagagaagctaaatctagctgcgacccatgaacaaagactagaggacgagtatgcgaaagtatcggtcctgcaagtggaaagggaagcaagggagagggtgatatattcattgcacagagaagttatgatgtggatggacaggttcgctttcaccttgaatggaagccaagagcttccaagactgttagccaaagccaaggcaatggcggacgtgtactcggctcccgaggaa

SEQ ID NO: 38566 - DNA, 348 bp, Glycine max
  Peptide Sequence Number=SeqID_155344
atggcagcggtgcgcctgcagctggctgctgctggccttcctcctgctgctgggcatgcaatatttctctatgaaggctttgctaatgggaggccggataagcttggtgggagtgaccaacactttatagaattggcacaagatcatgatcaaagtaggaaaccccagtgccctgttggacttcttcaagtccattggaatgttgctgagcagcaacgtcatccaaatctgtgtaaggggggtcatactagtgcgcatgatctgcacccatctcccagctacgctctgggcaaagtcctgccccagaatgcacagcagctggctgatggcctcctcatcgaagcctga

SEQ ID NO: 38567 - DNA, 336 bp, Glycine max
  Peptide Sequence Number=SeqID_155345
agggtacatctacttggggtttgttatactgagaacaagagagggtacatctcttgtggatcagctcaagtagagggtacatccacttggtttttcaaagagaacaagggagggtacatcccttgtggatatttggcttgtaaaggattttacaaggtagaaagaaatctcaagaaccagttggttgcttggggactggacgtaggcacgggttgtgaccaaaccagtaaaaaggagctaatttcttggagtgtcaaagtggttgtcgcgctaagcgaactcagtgggcttagcgtgtatccatcgctaagcgcggcttcaacgcgcttagcatga

SEQ ID NO: 38568 - DNA, 793 bp, Glycine max
  Peptide Sequence Number=SeqID_155346
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggggactttgggcccggtccgccactgaggacgcttctccagactacaattcggacgccgagggcgaccgattttcatggtgggcttttcccgggttcgctcgccgttactaagggaaatccttggtcgtcgatgggtccagaactgacccggctcgcacgtgattggtctcgagcgtggctcatccaccattttatcacggcgaagtcggccatgaacccagattttcaacccaacccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 38569 - DNA, 1568 bp, Glycine max
  Peptide Sequence Number=SeqID_155347
gctgtgctccgccttgctgccaatcaactcgatctgacagtcgggagagtgcgccagcagccgttgcgccagctgaacaaagtggtcgaccggccagcggcgcagcgtttcggaagcgcccatctgaaagccgatcaggatcttgcccgccggtttggcgcgcgcagggaaagcgacgcgaatgaacatcgccgggttatcggtgcggcagcccaattgccccatcatatccagcttgcgctgaatcaaatggccgccggtgctgcggctgacgccggtcagccagcgctccatgccgctcggtttgttgccataaatgtctttgaacaggtattggcagccggcggcgatggcgaccagcacatcgtaaggcgccttcgagtgcaggatgaccgccagctgaggccggttttttcgcaggcgccggataacgcccaacatgtctttggccttgtggtcccagtaaatcacgtcatgaaagcaggggctgccttcgaccagctgccggtttttatggctggagaccagcgtgatttgcgcgtcgggatagcgttcgcacagtgcgcgaatggcgggcgtgttgaacatcagatcgccgagggcgctggtggagaaaatcacgatgcgctcaaaggattgctgcggatcgaagcttgctacgggccggaaattgcccgcgatgcgggtatagagacgcagcccggcgttggccgccgttattttccactgtttagacattgcagttcgcttccgcttgagatcggcggccaccgtctggcgccgcgtcgtatcatacaagcgcggcaacggcgggccaatggcccgcaacagattgcgacagatgctaaccgggttgcgcggatcgcgggcgatctcgccgcgctgattgccggcgccgtgcaccacgccgacgaacgaggaatgggtgtagcggctgaattcctggagctgatgcacgatgcccagcgccgcgccggggtaggtttcttccgacgccaccgccagcccgatgcgtttgccgctcatgcgttggtgcacctgttccgcctgagggtaggcattggaatagaagctgaacgagcgatcgaaaaaggccttggtttgcgccgacatgccgtaccagtaaatcggcgtgcagaataccgcgccgtcggccggcaggaagtgctccagaaacagctcggcgtagcgatcggccggtggcggcgtgtggcgttcatcgctcagaaaaccgctcaggtaatcatcgagaaaatgcaggctggcggacgtgccggcttcggcggcgcccgccagaatcgcctgcgccagcgtggcgctattgccgtcgcggcgcgggctgccgaccaacaccaccagacgtttggattgatgagttgtattcatgtcatgttcctcgctcaactcatctctagaggtttcgccatgttcgccacgctgcccgtcaacgcattacgcacctttgaatctgccgctcgcctgcgcagcttcaagctggcggcggccgagctggcggtgacgccgacggcgatttcgcaccagatcaaagcgctggaacagcagttggg

SEQ ID NO: 38570 - DNA, 623 bp, Glycine max
  Peptide Sequence Number=SeqID_155348
atggagaggatgagagggatagaaagtgtggtgttggtgagtagaggatccattcttggattcaacagccttcccaatagcgcagaaattaagtgcattgagagtgagagacaagcactcctcaacttcacacatggcctcatagatgactctggcattctctctacatggagggaccatgacactaacagagactgttgcaaatggaaaggcattcaatgcaacaatcaaactggtcatgttgagacgcttcatctccgtggtcaggatacacaatatttgataggtgaaatcaatatctcttcattgatttcccttgaaaatattgaacacttggatctcagctataatttgtttgaagggagtcatatcccagaactcatgggctcgttcaccaatttaagatatctcaatctctctgattcttcatttggtgggagtattccttctgatattggaaagcttacacatttactgtctcttgatctaggtaagaatttttatctccaaggaaaaatcccttatcaacttggaaaccttacacatttacaatatcttgatctaagtgataatgatctaaatggggaactcccatatcaacttggaaatctctcacagttgag

SEQ ID NO: 38571 - DNA, 2187 bp, Glycine max
  Peptide Sequence Number=SeqID_155349
atgacatcatcagtctttcaaggtggtttcaacttcagctcaaaacttcaaaatctttatttgagaagttgtagtcttactgatcgaagttttcttatgtcatcttctttcaatatgagttcttcatcttctcttgtttcccttgatctctcctcaaatctgttgaaatcatcaactatattttactggctctttaactccaccaccaatcttcatcaccttttcctttataagaacatgttagaaggtcccattccagatggatttgggaaagtaatgaactctcttgaagttctttacctctggggcaacgaactacaaggcgagattccatctttctttggtaacatgtgcgcattgcagagtttagacctctcaaataacaagttgaatggggaaatttctagcttcttccaaaattcttcatggtgcaacagatacatatttaaggggttggatttatcttataaccggttgactggcatgttacctaaaagcattggattgctatcagagttggaggatcttaacttggctgggaattctttggagggtgacgtcaatgaatcccatctttctaatttttccaaattacaatccttggacctatcagagaactcgttgtctctgaaattggtcccgagttgggttcctccattccaattaaaatacttgggaatcagatcttccaagttgggccccacctttcctagttggctcaagactcaaagttctttgtacgagcttgatatttctgataacgggattaatgactctgtaccagactggttttggaataacttgcaatatatgagagatttaaatatgtctttcaattacctcattggtgtaattccaaatatttcagtgaagcttcctatgagaccgtctataattctgaattcaaatcagtttgagggtaaaattccgtcatttttactacaagcttcccagctgattctctctgaaaataatttttcagatatgttttcattcttatgtgaccaaagcacagctgcatatttgaccactttagatgtatcacacaatcaaataaaggggcaactcccagattgttggaaatcagtaaagcaattagtgattcttgatttaagcagcaataaattgtcagggaagattcctatgtccatgggcgccctaattaatatgaatgccttggttttacgaaacaatggtttaatgggtgagttgccttcttctttgaagaattgcagcagtttatttatgctggacctgagtgaaaatatgttgtcgggtccaataccatcatggattggagaaagtatgcatcaattgataatcttgaacatgcgaggaaatcacctctcaggaaatctacccattcatctctgttatttgaagcgtattcaattgttggatctttcaaggaataacttgtcaagtggaattccatcatgcttaaagaatttgactgcaatgtctgaacagaccatcaactcaagtgacactatgaatcttatatatgggaatggtaagacttacgttgtattaaatggtgacatattcggaggttatacgctagacataacatggatgtggaaaggtgtggaacgggggttcaaggatccagagttggagctcaaaagcattgatctttcttgtaacaatttaatgggtgaaataccaaaagaggtcggatatttgcttgggttagtttctttgaatctatcaagaaataatttgagtggagaaattccttctcagattgggaatttaggttcactagaatcacttgacttgtcaagaaatcacatctctgggagaattccatcttctctttctgaaattgatgatttgggaaaattagacttgtcacacaactctctttctggaagaatcccatcaggaagacattttgaaacctttgaagcctctagttttgaaggaaatattgatctttgtggtgaacaacttaacaaaacttgtcctggggatggagatcaaacaacagaagagggtcaagaaccaccagtcaaaggtgatgattctgttttctatgagggattatacatgagcttggggattggatacttcactggattttggggcttattagggccattactactgtggcgtccttggagaattgcttacatcaggtttctgaacagattaacagactatgtatatgtatgcttatggtga

SEQ ID NO: 38572 - DNA, 372 bp, Glycine max
  Peptide Sequence Number=SeqID_155350
atgttgattgttgcagatgtgctgcacgcttctgatcagagaagaaatcattgttggcagctacaagaattaacaacatattcgtatagtcgtactatcatcactgttcctgatcttcattttattgagttgtttcatatcagcaaaaatataatgaccaatagttgttttccaaaactaatgtatgcacttgtgctgcttttattgcgtgcttcaggttccattcttggattcaactggctttccaatggtgtagaaataaagtgcatagagatggagagacaagcactgctcaaattcaagcaaggcatcctagttgaacctggcattttgtctacatggagtgacgacgacagaaacagcgattgttga

SEQ ID NO: 38573 - DNA, 267 bp, Glycine max
  Peptide Sequence Number=SeqID_155351
gatgagtggatcaagggcttttgtgggcacattggctttgcagatatcttaaaggccgagttgttgggtctgcactttgggttgagaattgcgtgggaggagaattgtagcaatgttctatgtgtttctgattcactactgcatgcgggtggagttgaagcattctctgggagaggggaatcagtgtgcggatgccctagccaagaaaagggtgatcatgttccacgatcttcttcttttggagttagcttccttactttgggttga

SEQ ID NO: 38574 - DNA, 171 bp, Glycine max
  Peptide Sequence Number=SeqID_155352
atggtggtgggtggcgaatatagccgaaggtgggtgttagtgtttttgggatggtggtggggtgacagatctagtaaaggtttaactcctacaaatcataagaacaaagtagccaaccatgagatagtgagggagggacacctaagaaagagagtgacacatagtttataa

SEQ ID NO: 38575 - DNA, 300 bp, Glycine max
  Peptide Sequence Number=SeqID_155353
atgtgtggggcgagggttcttactttcgatcagattgaggggttgaagaaccctgatgtgcagtgttggggcactgaggaaggagtggacgaaaatcaacacctaggaaatctcccaaggacttatactctaacccatacggatataaccgctaagctcaccttggcaatctctcaaaccataaataattctcagcaaaaatttagtgaagaggatgcagatgttgtcgcaaaacaaaagaagccagtgtatcttacattcttgctgtgcaagagaacactttttggtccaaaagggtag

SEQ ID NO: 38576 - DNA, 464 bp, Glycine max
  Peptide Sequence Number=SeqID_155354
cgtacatctacttggattgttatactgagaacaagagagggtacatctcttgtggatcagttcaagtggagcgtacatccacttggttgttcaaagagaacaaggaagggtacattccttgtggatctttgcttgtaaaggattttacaaggttattggaaatctcaagaatcggtggttgcttggggactggatttccaggacaaaggagagtctggcaaataatcttcaagaagtcctatagcttctccaacaagaagaagatgaaggctctttctcaaagaaggaagaaaataattcttcagaagaagatgaccccttctaccaaaatgaagatgattgttttggtggatgacccagcctgggttggtgacccagaagatgctgatgaacttttcttgattgttgactctgttagagccaacttgaagctctttcctgaacttctgcttgccctcagggag

SEQ ID NO: 38577 - DNA, 273 bp, Glycine max
  Peptide Sequence Number=SeqID_155355
atgacaggtttatcattattgtctttgaccattggcagttggtattgtgttgttggaggtatactagaagttgtatctaatccttggaggtttatactagtaaagtggttttgtgacgtagatctagttagtcctattgggattgatcgggttcttatcgaaaaagaccttcttgctgattcgtatttggatcttgaggcttctattctagatgaaaaagaatttcctattgatggaatcctgattttaaatcaaatttcaaaaaccatttag

SEQ ID NO: 38578 - DNA, 264 bp, Glycine max
  Peptide Sequence Number=SeqID_155356
atgcatacggaagaacgttcttccgtgttcgaaaaaactcttcatctcctacctctctctcccatggtttctcagaccaaaaagcgaaaagtctcctaccctaaaaccaccctaaactacattatactagcagataaagggggaggggagatacaaactactaacctcgacgacagacgcaacaaacgcaccaaaaaacttgagcaacgagcaacaatggcggaagagaaggttgctcggtgcatggaagagaatgatttttga

SEQ ID NO: 38579 - DNA, 504 bp, Glycine max
  Peptide Sequence Number=SeqID_155357
atgaagcaatatttgcaccccgaaaaagaaaagtattttacatcatcaattgaagaggaaggtgaaatcaccatgagccgcaacatcaacaatttcacacctttgccagggtcatggcaaagaggttttagatcctttgatgaccacactttcaatcatcgtgaatccaatgaggtgcctgtgttttacggatctcactctactcatgccaccgatggcagaagttcgggtgtattagctcgacaacgattttcggacttcagaaatcctttaggattccacagtataccaaattttccagcaccaccacctagaagacaacaaattcatgctcacaatgaggatatgggaaggctaagagagattttccttcacccccctcaaagatccacattccaaacaagcacacaagctctcccagtggtagaaattaccaaatcaacagctttgagcaagcttaagaaagtagtctatgaccctcccccaaagaggtatgctaggagg

SEQ ID NO: 38580 - DNA, 114 bp, Glycine max
  Peptide Sequence Number=SeqID_155358
atgctatttatggttctgtccagtggtgtggatagtgctgctagccctcactttgtgacgccaagccctgactcgagggagcgtgttgcgagtcccacatcgggtggttcatga

SEQ ID NO: 38581 - DNA, 249 bp, Glycine max
  Peptide Sequence Number=SeqID_155359
atgggtgtttcggtcttttcctctttgtttatgtggggtgggatatcgccagttgggagcgaccttgaatggcaatcccaaagcaagaatcacttcaaaaatgggttttccctttgccggcggtcatttacctcgccgaaaatttatctgcattcgttattcgccctccctttaggagattcgactgtcctcttcttcggggggaaggatgaggattctcttcatgggccaaggttcaaggtagcttaa

SEQ ID NO: 38582 - DNA, 378 bp, Glycine max
  Peptide Sequence Number=SeqID_155360
atggaattgattgagaatatggttgctagtgaccacgcaatcttgcgtgatagagcacacatcccaaccaaaagaagcctattggagctttcatcacaggatgctttgttggcccaaaacaagttgctatccaagcaacttgaagctttaactgaaacactaaaccgaccgttaagcaactttggagccaacagagagaagaatcctaaggaggagtgcaaggctgttatgactagaagcaaaatggtgagcatgaatgaaggtgagaagaggataggtgaagaaaaacaacagctggtaactgaaccaaaaattgatctagtggtggaacctttgagtgagactgaggaagaagtggaagcagaagatgatcagtag

SEQ ID NO: 38583 - DNA, 150 bp, Glycine max
  Peptide Sequence Number=SeqID_155361
atggagagaagtaataacttcaacaatgggaagaaatcccaagaagtttctcctacacttaaatgctataagtgcaatcaatcagagaaggagatcaaccttctatccaaggactatgagagcgatgagaacatctctcaagaagattaa

SEQ ID NO: 38584 - DNA, 552 bp, Glycine max
  Peptide Sequence Number=SeqID_155362
atgagggagataaaggtgcagaagctcgtcctcaatatctccgttggcgagagtggagatcgtctcaccagagccgctaaggttgaaaccccttcacacctcgcagcttccacaaatgttttggaacagcttagtggccaaacccctgtgttttccaaagcaaggtacacggttcgttcctttgggattagaagaaatgagaagattgcatgctatgtcactgtcagaggtgacaaggcgatgcaacttttggagagtggtttgaaggtgaaggaatatgaacttctcagaaggaacttcagtgatactggttgctttggctttggcattcaggagcatatcgatttgggaatcaagtatgatccttcaactggtatttatggaatggacttctttgttgttctggagcgtcctggctatcgtgtgggacgtcgccgaaggtgcaagtcccgtgttggaatccagcaccgtgtcacaaaggaggatgctatgaagtggttccaggtgaaatatgagggagtgatccttaacaagtctcaggcgattgtttag

SEQ ID NO: 38585 - DNA, 570 bp, Glycine max
  Peptide Sequence Number=SeqID_155363
atggactattccatgaagttacaaatgaattcaggcaaccctctttcagacaaatcttcatcctcgtatcgaagattaataggaaaactcatatacctcaccaacactcgccctgatattgcatacgaagtacaacaactcagccagtatatgtctgctcctaccaccattcatcttcagtcaaagaagcaatccaccgtctcccgtagctcctccgaggctgagtatcgagctctcgcatccactacctgtgagctgcaatggctgacatatcttcttcaggatattcgttcaacattcattcagccagctactttgtattgtgacaaccagtctgcaattcaaatagcaacaaatcccgtctttcatgaacgcaccaaacacattgagatagattgtcatattgtccgtcacaaagttacctcgggtctcataaaactccttccagtctcatcctccctgcaactcgcggatatattcaccaaagcattgacaccagctatctttcagcacctttgtaacaagctgggaatgatgaacatccattcccagcttgaggggggctcttag

SEQ ID NO: 38586 - DNA, 552 bp, Glycine max
  Peptide Sequence Number=SeqID_155364
atgaatggcaacaaaccttacaagcttggcgttaatctctttgctgaccttacacttgaagaattcaaggatttccgttttggactcaagaagacccatgagtttagcataacaccatttaagtatgaaaacgtgactgatattcctgaagctatagactggagggaaaaaggagctgttactccaatcaaagaccaaggtcaatgtgggagctgctgggcattttcaaccgtggcagcaactgagggcatccaccaaataactacaggaaacctggtctccctctcagagcaagagctagtgtcttgtgacacaaaaggtgaagaccaaggttgtgaagggggttatatggaagatgggtttgaattcattattaaaaatggtggaatcaccactgaggctaactacccctacaagggagttaatgggacttgtaacacaaccatagcagcttccacagtggctcaaattaaggggtatgagacagttccttcctatagtgaggaggcactccagaaagctgtggcaccaacctgtgtcagtttccattga

SEQ ID NO: 38587 - DNA, 1803 bp, Glycine max
  Peptide Sequence Number=SeqID_155365
atggtcactgcgctgagtgccaagaacaaggtggaattcatagacggaagcgcgcctgaaccactgaagatagatagaacctatggagcttggcgccggtgcaacaatatggtcgtatcgtggatagttcactcggtggccacctccatacggcaaagtatactttggatggacaaagctgaggaaatttggcgagatttgaagtcaaggtattcgcaaggagattttctgcgaatctccgatcttcagcaagaggcatcgacgatgaaacaaggttcactttcagtcacggagtacttcactcgtctacatgtgatctgggacgagatcgagaatttcagacctgattcaatctgctcatgcaacatcaggtgctcctgcattgctttcaccatcatcgcgcaacgcaagctcgaagatagagccatgcaattcctacgaggtttgaatgaacaatacgctaacattcgttctcacgtgcttctcatggatcccttacctgccatatccaaaatattttcttatgtagctcagcaagaaagacaattgttgggcaacgcaggaccaaatatcaactttgaacccaaagacatctccatcaacgcggcgaagaccatttgcgatttctgtgggcgcattggtcatgtagagagtgtttgttataagaagcatggggtgcctgcaagttatggtgggagaaacaagaataacaatggaagaaaaacgtgtacccactgcagcaagataggacacacagtagatgtttgttatcggaaacatggatacccgccaggatacaaaccctacgatggaagaaccaccgtgaacaacgtggtggcagtagaaagcaaagccacagatgatcaggctcagcaacacgagtcacaaaaggttgttcgcttctcacctgagcagtacaaaggcattacttgccttaatccagcagccgccggcaggaaacacggcacccaaccagtccaaacagagcttaacctaccagtagagagtcacccatcacaacctataataccaatgcattcatgtgatgaacattcaaacaaacaagctccttcacaccttaggcgttcaacacgatcaagacattccccgacataccttcaagattatcacagagaccttgcttcatctacaccgaaagcttcaacgattgttcgttatcctctaagctcaatgctttcgtactcacgtctctcaactgcacataggaacttcgtgatgaccatctcatcagccacggaaccctcgtcatatgtcgaagcttctcgccatgattgctggattaaggcaatgaaggtcgagttacaagctctgcagtcgaacaacacttggagactcacactccttcctcctcacaagacagctattggatgcagatggatatataagattaaataccgggctgatggttccatagaaagatacaaagcgtgcttggttgctaagggttacacccaaatggaggggttagactatctcgatacattctctccggtggtgaagctcaccactgtttgtgttcttcttgcattggctgcgctcaaccgatggcacttgcgacaattggatgtcaacaatgcgttcctccatggggagcttgaagaagaagtgtatatgcaagttcctccaggcctttcggttgagaacccgaaactcatctgtcgtcttcagcgatctctctatgggcttaagcaagccagccgacaatggttcacaaaactatctagcttcttaacctctcatggatttcagcaatctaactcagatcactctcttttcttatga

SEQ ID NO: 38588 - DNA, 1194 bp, Glycine max
  Peptide Sequence Number=SeqID_155366
atggctttcacatgccaaaagcagcacatgctagctctattcctcctccttgcagttgtgatttcacaggtgatgtgtcgcaagctgcacgagacatcgatgcgagaaagacacgaacaatggatgaccgaatatggaaaagtgtataaggatgctgcagagaaggaaaaacgtttccagatattcaaggacaatgtggagttcatagaatcattcaatgctgatggcaacaaaccttacaagcttggtgttaatcaccttgctgaccttacagttgaggaattcaaggcttcccgtaatggattcaagaggccccatgagtttagcacaacaacatttaagtatgaaaatgtgactgctattcctgcagccatagactggaggacaaaaggagctgttactccaatcaaagaccaaggtcaatgtgggagctgctgggcattttcaactatagctgcaaccgagggtatccatcaaataactacaggaaaactagtttcactctcagagcaagagctagtggattgtgacacaaaaggtgtagaccaaggatgtgaaggtggttacatggaagatgggtttgaattcattataaaaaatggtggaatcaccagtgagactaactacccctacaaggcagttgatggaaaatgtaacaaagcaacctctccagtggcacaaattaagggatatgagaaggttcctcccaatagcgagacgacacttcaaaaagccgtggctaaccaaccagtgtcagtttctattgatgcagacggtgcaggtttcatgttttactctagtggaatttacaacggagaatgtgggactgagctagaccatggtgttactgcagttggttatggcacagctaatggaacagactattggattgtgaagaattcatggggcacacaatggggtgagaaaggatacgtaaggatgcaacgagagaacccatcactatctcaactgtgctaccgaaggctttggggaagtcaatataggagaacactcatcttaggttattacttagatgcttttagcaattatttactccacacttggcaacccaacgtttatcgtggacacgataactggcacaccgaagctgatatcgaggtgtcaaaccttttcgtcaatgtgagctttggggaagatcagcctattatccctagagtaacttttactcgttga

SEQ ID NO: 38589 - DNA, 668 bp, Glycine max
  Peptide Sequence Number=SeqID_155367
ttgggtggagacatcaacacaaacatcgtttaggtatgagagtgtaactaagattcctgctaccattgactggaggaaaagaggtgctgtcactccaatcaaggaccaaggcagatgcggtagttgttgggcattttcagccgtggctgcgaccgagggtatccaccaaattacaacgggtaagttggtgcctctctctgagcaagaactggttgattgtgttaaaggtgagagcgaaggatgcattggtggttatgtggatgatgcctttgaatttattgccaagaaaggaggaatagcaagtgaaacacactacccctacaaaggagttaacaagacttgtaaggttaagaaggaaactcatggtgtagctgagattaaagggtatgagaaagttccttccaataatgaaaaggcacttctaaaagctgtggcaaatcaaccagtgtcagtttacatcgatgctggaacacatgctttcaaatattactcaagtgggatttttaatgtaagaaattgtggaactgatccaaatcatgctgttgcggtagttggttatggaaaagctcttgatggttctaagtattggcttgtaaagaattcatggggcaccgaatggggtgagagagggtatataaggatcaagcgagatatacgtgccaaggaag

SEQ ID NO: 38590 - DNA, 663 bp, Glycine max
  Peptide Sequence Number=SeqID_155368
atgtcgctggattatcagcgcaacaacgtcaaggtgatcgcctccgacgccggggtgagcgcctgccacaacggcggcacccacatgtcgttcgaggacatgggcatcgtgcgcgggctggcgcattcggtggtgctggaggtgaccgacgccaccatgttcgccgacattctgcgccagctgatggatctgcgcggcttctactgggtgcgcaccattcgcaagcaggcgacgcgcatctatcaggagggctcgcgctttaccatcggcaagggcaacctgctgcgcgacggcgacgacattacgctgatcgccaacggcatcatggtggcggaggcgctgaaggcggcgcagaggctggcgcagcagggcgtcagcgcggcggtgatcgatatgttcaccctcaagcctatcgaccgtgaactgatcaaaacctacgcggccaagaccgggcgcatcgtcacctgtgaaaaccacagcattcataacgggctgggatcggcggtggcggaggtgctggcggaagagtgcccgacgcagatgcggcgcgtgggggtgaaggagcgttacggccaggtgggcacccaggcgttcttgcaacaggagtatggcctgaccgccgagcatattctggaggccgccgggcagttgctggcgcgttag

SEQ ID NO: 38591 - DNA, 306 bp, Glycine max
  Peptide Sequence Number=SeqID_155369
atgggggcatgtcagtcggtttggaacttccttgagactcaggttgatcaccatgtggggaaagttgcctgtgcacgacaaggtgaccacaacacttgttgcctagttttactaagtgagagtgtcatgtggacatgcttaggctatttcctaataaatgataccacattgaattttagagttgagtcagcttttaatggaactcaagagcatgatagtgtgccgataccgttaactggtgaacaggttcttgagcgggttgacgacattaatactgtatttggaaagacttcattattggtctga

SEQ ID NO: 38592 - DNA, 210 bp, Glycine max
  Peptide Sequence Number=SeqID_155370
atggtttacaataatggcataaacttgaagatcctgatgagtcatctaacaacagctttcaaaattgccccgtgtgtggtgtcgcttggtcatacagtgctcaatggaatgccccagggctcctccatgatatgcacatgttgcgttcaagtcatatcctcggaaaaatggaggttgaggaaacctagcaggggttatggctaccattga

SEQ ID NO: 38593 - DNA, 314 bp, Glycine max
  Peptide Sequence Number=SeqID_155371
gtttgattacgagcctccgtcagttctacggagtgcccgtcgcccctaatagggtcatgaggcccctattaacaaggctttcatcgagaagtactacaccatcaggcaggaacaggggcacccttgttgatgactggaagtttgattattctattcatgatgctcgccgtatggtctataatgaccaggctgatatgaccggaagattacttgttgggtcattaacctttgattgccgcatcatgcactttattattgttcgtattttacttcccgttcttctaacccttctcaagcctccgacgaggatttga

SEQ ID NO: 38594 - DNA, 770 bp, Glycine max
  Peptide Sequence Number=SeqID_155372
atgggttccctgctacaaggtcatgatgaaagacaacgattgctccatcacgccctcgcctctagaggactgcacgtcctcgcctttagagggctacatgccctagccttcagagaactacacgtcctcacctttagaggaatacacatcctcgcctttagaggactgcatgtcctcaccttcaaaggactacacgtcctcgcctttagaggacaccacgtcttcacctttagaggattacacgtcttcgccttcataggaatacatgtcctcaacttcagagcactacacgccctcgccttcagcggactacacgtcctctcctttaaaagactacacgtcctcgttttcaaaggaccgcacgtcctcgccttcagaggactacatgtcctcgccttcagaggactgcacgtccttgcctttagagggatgcacaccctcaccttagaggactacgcgtcctcgccttcagaggactgcacgtcctcgccttcacaggactgcacgtccttaccttcagaggactacacgtcctcgacttcagaggactacacatcctcgccttcagaggactacacgtcctcgccttcagaggactacatgtcctcgccttcagaggactacacgtcctcgccttcagaggactacacgtcctcccctttagagggctacacgccctcgccttcagagggctacacgtcctcgccttcagagggctacacgccctcgcctttagaggactacacgtcctcgccttcagaggactgcat

SEQ ID NO: 38595 - DNA, 639 bp, Glycine max
  Peptide Sequence Number=SeqID_155373
atgtacaattatcatgagaaaggaagagctcctaatcttgaaagtgtattggcagacttcatgacatatcaagctagctctaaagtagattcaatgcaacaagcatttaaaagagctgagactcagattggtaagttggtggacgacatgattaaagttgtggtcaggagagaaaaagagtatgtagagattgaaacacatcaagaaagcattcttcaagttaacacaatacatcatcaattgatcaccaaagaagaaaaggatgaagtctccattattctagaatatccctgcatagcaactacaggatatgttgtaggcaaagataaaggtcggttggaactcagtgcagaggatcagaaaatctcctttgacctctttgaagcaatgaagcacccagatatgagtgatgcctgttttgaagaagaagaggtggagcatgagataacattatcagcttcaaccatgcttgatgatccaaaagacaactttgttggtcatgtggttcttgaagaattagaaaaaattagaccaacagaaaagcctaaagctgaattgaagatccttccagcgcatttaaagtatgtattcttggaggataatgagactaaacccgttataattagtagctccttgtag

SEQ ID NO: 38596 - DNA, 513 bp, Glycine max
  Peptide Sequence Number=SeqID_155374
atggacagcgtcggtagaggccaacggaggagacggaccctcaaagaacgcctcagattcaccggaatcggctgttgtggagccacgtgggttttccgtccaattgtcagggacgaaggaggaggggcacaagcacaacaacagccgcaggaaacaaatgcgggtcaagatccgaatcatactgggcccgaacatgtgggtccgagtcagtcgagttcgggaatgaatcttgcggcggcgctggcggcggagcgtcagttccgtgagggtgaggggacgcctttgagggtgtcgttgatgcggctgttggaggaaacagagggtggggatgcggcggtggaagcagtggggaatgattgggtgtgctgcgtgtgcatgggaaggaagaaaggcgcggcattcatcccgtgtgggcacacattctgtagggtgtgttcgagggagctgtggttgaacagaggtacttgtcccctttgcaaccgttccatactcgagattctcgacatcttctga

SEQ ID NO: 38597 - DNA, 171 bp, Glycine max
  Peptide Sequence Number=SeqID_155375
atggatagtgttcacctgatagtggaaaacaaaggtagcagtaccaacatgtcctttaacctcggcaaagatctcaactacttagtcttaccatactctgatgaggaaaatttgaagggatcgagcagcaagcgtcattttgatggcaactgggatgaggctgagatgtga

SEQ ID NO: 38598 - DNA, 327 bp, Glycine max
  Peptide Sequence Number=SeqID_155376
atggctcaggccactacaatcgagccccgaagcttacccagccttaaggaggtcgtgatctccaagcccaagaagaagatgggaaccaacatcacgctttctgagttcaacaattgcagttttgactatggccttatgcgtgatgagacgttcacccttctcactagtcccaaggagctaatttctcctcctatgatcgctccgacggtcgctcgctcaaccgcgacggcagcaacaatgaaggctcatgaagggggagggaggagacaaaaggtcctacattggattgaagaacgccttaggagaatttttgtccaggctttatga

SEQ ID NO: 38599 - DNA, 294 bp, Glycine max
  Peptide Sequence Number=SeqID_155377
atggagttgttagtgggagaggaagcagatggaggcggtgccgggtgtgggtgcgttcagagatgggaaattgggtgtgagtgtgggaaggatgacagagctgtgccgcgagagagattgggagagcatgcaaaaattgagggaattgaaagcgtaaatgaaaaagtgagagagcacttgcatgacgatattgtttataagaaaatagggaccaaacctgctttgcataggaacaattataaaacacatgccattcattttcaaaattttcattgcaaaaaggaaagattctag

SEQ ID NO: 38600 - DNA, 231 bp, Glycine max
  Peptide Sequence Number=SeqID_155378
atggtggtggttggtgtaggctttaggccgcgggggagggtggcgctgagtggtggctctgagtggtggctcgtggtggctctgagtggtggctctaggccgatggtggtggttcgcggaggaggaaaggggctgttgagtggtggctcgtggtggcttggctgttggtattctgactgttcgtattcacctctgccctctctctctccctctgacatgcacagtaattaa

SEQ ID NO: 38601 - DNA, 345 bp, Glycine max
  Peptide Sequence Number=SeqID_155379
atgaaactggccaaatacaggctaaaggcccaagtggagaaggacgaaggcccaaagtttctctccgggttccttgttgaaccaattatcagacttatcaaggtaatccttgtggcgtctacccggacttatcttccttcaccggaagtggcgtctatcccgacttatcttccttcaccggaagtggcgtctaacctgacttatcttccttcaccggaagtggtgtctatcctgacttatcttccttcactggaagtggcgtcatccaaaacctccgtagcctgtatcaaacgatccgctcctactcaggttcgcatcatctggtatcagagctttggctcttga

SEQ ID NO: 38602 - DNA, 733 bp, Glycine max
  Peptide Sequence Number=SeqID_155380
atacatcatgaattcggttataaaagtgttgtatttaaatggaagagtatatgaagagaatgatggtgtaatatttgaaggcagtaaaaaagcgattcagattaaacgtggaattagtttcaatgctttgaagaaaaaattggagaaaagatttttagtgtctggaaaatatgttgcgttgcaaatttgtgatgacgaagatgttgaaaccatgcttgaaagttttcaacaacaagatcaaatgttagttccggaattgtacatagaaaaggatgtggatggtggttctatgtttcattctgcaaattctcttacatcatgtggaaataatttatctaataatggggcgcaaccgccaagaaatgtgagcaatttacatggtgatgaagatgatggtgatgatgatgattattatcttgtgtctaactcatacgttgaagaatctttagacgaagatgatagtattgacggtatatctgatacagacgatgaagtcaccgacatgattcaaccagtaagaattgttcacccaacagaaggtgtacaaggaattcaaaatccattttggaatgatgctttgcattataataatacaaaatggagtcatcctgatgaggaggacatttgtggtttggagatgtcatcgagttttaatgttggtcaagaattatatgttggcatgaattttgatagtaaagatgcagtaaaaaatgcatcaaacaatatgttatga

SEQ ID NO: 38603 - DNA, 614 bp, Glycine max
  Peptide Sequence Number=SeqID_155381
aggactacacgtcctcgccttcaaagggtcatgtaccttcaacttcagaggactacacgtcctcgccgtcaaagggtcgtgtgccttcacctttgtagggctacacgccctcaccttgggtactagttaccctcaccgtcagaggactacacgtcctcgccttgagaggactacacgtcctcaccaccagagggctgcacgccctcacctccagaggactacatgtcctcgccttgagagggctacacgccctcaccttgggactacacgtcctcgccttgagaggactacacgtcctcaccaccagagggctacacgccctcgcctccagaggacttcaagtcctcgccatcagagggctgcacgccctcacctccagaggactataagtcctcgccttgagagggctacacgccctcaccttggaggactacacgtcctcgccgtcaaagggtcatgtgccttcacctttgtagggcatgccctcaccttcagaggattgcacgtccttgccatcataggactacactccctcgccttcgaaaggcgacacgtcctgaacttcagagggctacacgccctcgcctttagaggactacgcgtcctcaccttca

SEQ ID NO: 38604 - DNA, 390 bp, Glycine max
  Peptide Sequence Number=SeqID_155382
atgcaatggtggttccaaagtcagaaaagatgcaaagacaagctgaaactaacaagaaacaagcgtagaaccatggttacctcgaaggaaaacaaaagttggaagattccgcctcggttgaagggttcctctcggtgtggggtttcaatggagaacaacgacagtttgtggtggctaatggtggctgtgggtgatggagaaagatcttggaatgttggaaatggttttggaagaaagaaaggggaagaaatggcatttttccaaaggtacttagactacaaggctcaaaacgcacaagtgagcaatgctctcggaagcgaaaacattgcacacactccagacatcttcttaaagatcccaacggtcagatcatggacaagtgttctgtga

SEQ ID NO: 38605 - DNA, 228 bp, Glycine max
  Peptide Sequence Number=SeqID_155383
atgaaaaagaattgtcccagattccagaaatggcttgagaagaaagataaatcaatctcattagtatgttatgaatctaatatggctgatgttaatgttaacacctggtggattgattctagatctacaatccctattgcaaattctttacagggtatacaaaacctaaggaaactagtgggaagtggaaataagctaggctcacctgtgaaggctattggaacttga

SEQ ID NO: 38606 - DNA, 201 bp, Glycine max
  Peptide Sequence Number=SeqID_155384
atggttgtgaatgagtgtgtgattgatatttgtagtgatattacttgtcatgtgaggcccaaacggattcttcggagtctaggccttgggggtaaagatactcggtttgagtgctcttttaagcccatgttgatcccatgtggttggggcattctcgcaaaacagagtaaccctgactggtcaccttatgatgttacttag

SEQ ID NO: 38607 - DNA, 237 bp, Glycine max
  Peptide Sequence Number=SeqID_155385
atgtatattgttgtggtaaaacaggggcaggatcaccttgggctaccttctggagtgaagacaaaacatgaacggcagaaaccaatcaaggtacttaaggatgaacgcaagcggggatggggtcacgaccgaccgatcgttacccttctctgtgcgaaacaagcagggaatgtcgctgcaaggcagccccgtatcctttgtattttgcagctttcttttactatttgtttgttttaa

SEQ ID NO: 38608 - DNA, 389 bp, Glycine max
  Peptide Sequence Number=SeqID_155386
atggctggaacaaattccgaggggctctgtggggcagtaacagcgagcttaagctccgaagagaaggaaagggaccaatcgcgagtagacggtttgatcctgaaggatgaattgagggtttgcctaaggtccaaaaggagcttgtctcagcggttatgcgaggccgaaaccaacatgttagccatcatcagcaagtatcaagaagaattagatctagccactgcccatgagcacaaggtagcggacgaatacgcccgagtgtacgcggatggaccggtttgctcttacattgaatgggagtcaagagcttccctgattgttggcaaaggccaaagctatggcagacacctactccgcccccgaggagatccacgggctcctcctctatt

SEQ ID NO: 38609 - DNA, 435 bp, Glycine max
  Peptide Sequence Number=SeqID_155387
atgggggcgggggaagctctccgttcccgaatcagtcggggcctgagaggcggtggtttaccctgtggcggatgtcagcggttcgagtccgcttatctccaactcgtgaacttagtcgatacaaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctggtga

SEQ ID NO: 38610 - DNA, 434 bp, Glycine max
  Peptide Sequence Number=SeqID_155388
gtgctccagtggcttctgtttctatcagctgtccctcctgttcagctactgacggggtgggcgaattggagctccaccgcggtggcggccgctctagaactagtggatcccccgggctgcaggaattcgatgaacctcgtcgctccggcggagctcacccggctccttcttccgatgctgcgggtcgcgcagggacaggtgctgttcgtgaactcgggggcagggctgcgtgccaatgccgggtggtccgcgtacgctgcctcgaagcacggtctcaaggctctcgccgatgcgcttcgcgccgaggaggcgcagcacggagtgcgggtgacctcggtctacccgggacggacggcgacgcatcaagcttatcgataccgtcgacctcgagggggggcccggtaccagcttttgttccctttagtgagggttaa

SEQ ID NO: 38611 - DNA, 663 bp, Glycine max
  Peptide Sequence Number=SeqID_155389
atgggtcaacttcaacggcaagccttctgcaaagcctatggtaagatttgggacctagctagggtagaagtctccatggaaccaattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtgtttggaggaaaagggcaaaaggccttggcaaatcaaggcgaatgggctttcttttattgacatcttggcggttttgatctttggagttgtcctctttccgaatatggaagggttagtggacctagcagcgattgacgctttcctcgcctttcatcatggcaaggaaagcccggtcgtcgccattttggccatgattctatcttcatgcgaaggatgtcccatgagaggagtgccatcagacgaaagcatcacgcctttcatcgcacgaggtttcagtgaccacaacgcgagggtactccaaggagttcgcaaggcatgggatgcagcgtga

SEQ ID NO: 38612 - DNA, 282 bp, Glycine max
  Peptide Sequence Number=SeqID_155390
atggaggattcaatccgggaaaataacaaatctcacattaaccagtcaagagggtctgctcttgacggtgaagaacacattggagaatggaggatcaatcgggaaaataacaaagatcacatttcccactcaagagggtccgctcttgacggtgaagaacacattggagaatggaggaatccaatcgggaaaataacaaacataacatttcccagtcatgagggtccgctcttgacggtgaagaacacattggagaatggaggaatccaattgggaaaataa

SEQ ID NO: 38613 - DNA, 189 bp, Glycine max
  Peptide Sequence Number=SeqID_155391
atgaccataatttgtctccacatgtcatcgggctcaccgcctctggatgacaaaaggcgcagaatgaccataatttatctctgcgtgccatcggacacgatcgtatctggatggaaaaagggtcagtatgacagagattgtggggcggccgacaaaagcgaggctcttgctcctacgtatcctcaatga

SEQ ID NO: 38614 - DNA, 210 bp, Glycine max
  Peptide Sequence Number=SeqID_155392
atgaaacaaaaaggaaaaagaaagaaagaccgcgaaggtcgacatgttatagttaagaagtataaatcattcgtaaagagcaaacgtatcttctggaaacaagggactgacactaagagtttattttccggaataaccgagataagaatgggtgaattcaatgaactgatgaaagaacataacttggaaacattgggtttgtttgtgtaa

SEQ ID NO: 38615 - DNA, 609 bp, Glycine max
  Peptide Sequence Number=SeqID_155393
atggaacggtgggaaggaagtacaaagtacaaaagtaacagagtaacctggaagatgagttttctcgcgggaaggttagctgggaaagaagctgcgtactttttccaggaatccaaacaagccgtgggaaaattagcccaaaaaaaccctcttcccaagaccaacaacaacaaccttaactttcacgaaggatatgatcatgcggatgtacttcccgaggttctaaggcactctcttccttccaaagtgtttagaaatgatgaagccacctccttttccttctctgcctccaaatgggtccttcattccgaccccaaaacccaatcttccgtatcccctgatgctctcaatcctctgcgtgcttacctttccctgccccaagtcacctttggccccaaaaggtggcaactgcctgaagcagcaaacacggtttcagcctcaacagctaatgaatcgcgtctagacagatatgccacccatgttaacccggagaagttgaaagctgcaggtgaagggcttgcacatgataatggtttatggaaaactgaggtcgtagacaaggcccaccataacttacggttatcctgtgatccctcgtatagaatgtga

SEQ ID NO: 38616 - DNA, 531 bp, Glycine max
  Peptide Sequence Number=SeqID_155394
atgtggagtgagattgtgaaggctcagtcgctgaaaaaggtcatcaatggtggtggtcaaggtgtcaacgacagcggcaaggttgatttgactgaagtttggccaaggcggtccatgccagtgggagaaagttcgagtttggaatggcagccatggaaggcagctatgggctctcaacgagagcaccaaatgttaggtgcggtgagtcaagataatatagtttttgaggaaccagtgcatccagagggaaataaggagaaaagaaagaaaggatatgctcataataaaatggattctgcactatggaattggcaggcaagcaggggacaagattgtcaggaaccccttgctgatatcaacaacctcaacgcctctgatgtagctttcaccaccaccctgacagagcatcccgcggtgccaccactgccatcattctcgcagtgtctttggcatcaagttcgccgccccatcggagacaccaccaaccgtcggaacccattgttgttgcaagctaatattacagatctataa

SEQ ID NO: 38617 - DNA, 294 bp, Glycine max
  Peptide Sequence Number=SeqID_155395
atgttaggtgcagtgaatcaagataatctggttttcgaggaaccagtgcctccagaggaaaataaggagaagagaatgaaaggtattttggccttgtgctctttctgttgggccttgccattggcaccccctctttctccttcttcgtatcattccctaacattggtgcagaacaacgagagaaaatgggaaaatactaagagaaagaaagggagtgttatcgtcatccaccggaaatcacctccggcaacgatgatcgatggcagatcagagaactgcaaagatggttactag

SEQ ID NO: 38618 - DNA, 419 bp, Glycine max
  Peptide Sequence Number=SeqID_155396
gttttgatttagagaagagggtgaagacttgggttgagaattggcaaaagttgccttatgtttctccatatgaagatgcttttcatcttgactcaaatagtgaccaagcagagaagtggacagtggcaattttgcatgagttgctttctcttcttgtgtcaaagaagacagagagagacaatttgctctgttttggagagtgtttggggttggccttgagatttaagaaggctttggttcatcatcctggtatattttacctttccaataagattagaactcagactgttgtacttagagaggcttatagaaaggattttttggttaagaatcatccattggtggtagttggtagtggcactaatgctactggagttatcaatcagacaatcgcaggagagtggagtggacatctgtga

SEQ ID NO: 38619 - DNA, 682 bp, Glycine max
  Peptide Sequence Number=SeqID_155397
tggtgatgtcaaccgtagtgacaacgatagaaatattagtagtggtggcaatgtagatgacggtggtattaatgatgatggtagtggtaacaatgttagtggtgatggtggtggtggtgacaatggggatagtgatgacattgatagtggtggtgatagcaatattaatgatgatgctgatgtcagtggttacgatgatgatagtgatggtggtagtagtgataatgacgatagtactaatggtgtggtattggtggtggcaatgttggtggtgatggtgatgttggtattgacggtggtgactatgacgataagggtggtggtagtggtgttgatggtgacaaccaattatggcgatgacatcgatggtgtagtgggagtgagtctttgcttcatagtgcttaatactgatggttctgtgcagggtcagaatttgaaggcaggtggctttgctaagaagattgggatctgctatgcctttgtagctgagctttggggggtgtatgaaggcctaaagctggcttttattgaagggtgctcgtgtttggaagtgcaggttgattccaaagcggttgttgctagcataaagggaggtaagcagggttgtgtaatggggatgagacttattgtaggaattagacagcttttggctcaacgtacaatcaacggtcaacttttttag

SEQ ID NO: 38620 - DNA, 117 bp, Glycine max
  Peptide Sequence Number=SeqID_155398
atgacggtgatagcgacgaagtctattttgttgaagcctttgggaagagacggcaccgtgaggcgccatttggcggaggagattccgattgtggtgcctaggtataagtttttataa

SEQ ID NO: 38621 - DNA, 285 bp, Glycine max
  Peptide Sequence Number=SeqID_155399
atggaaggttcccaacaaaacactcactatcctaaggaaaaattgcctaaaattattacacacaaatggaagtttagtaacctattggaggctcccaacacacttccaatgaaaggcctttttgttacaaaacttgaaagcaatgaagtgcttcttagtccaatagctcttaaggtggttggcccctttcttcttgactcaaattcttcaagggatggcatcaatcctccttccaattccctatatggcaacccacaaacatggaaacaaagagacaagcaataa

SEQ ID NO: 38622 - DNA, 540 bp, Glycine max
  Peptide Sequence Number=SeqID_155400
atgaagcctaattcttctaccttctcagggctgctctctgcttgccctacgtctggagcaatacaaaaactaaaactggatgcggttcttggaacgactcttgttgatgtgtgtgctaaatgtggctttctagatgaggctatggacatatttgataggatggaagataaagatgtgaaatcttggactgccatgatttcgggcctcggagttcatgggcagccaaataatgccattaggcttttcaataggatggaaaaggaggggtttaaaccaaatgaactcacgtttttggcaattctgactgcttgtagtcatggagggcttgtggttgaggggataatctatagagatgttaaattaggaaagtgcgttaaagatgtgctaaagagcatttatgcagagcatcctacaaattccctcctcatttctagcacgtatgcagtcgttggaagaatcgtcgattttacaagaatgcaagaaatgaagcaaaggaataccaagtttaagtggacattattaaatgataaaatagattga

SEQ ID NO: 38623 - DNA, 795 bp, Glycine max
  Peptide Sequence Number=SeqID_155401
atggataccatcacaaaggttctgcctgaagagtgtgtcgcaactattatttccttgacatctgctaaggatgcatgccaattatctcccgtgtccccatcccttaaagcaattgcagattcagatgctgtgtgggcaaactttcttccatctgattgtgaagatatcatagatcaatcttcaacaccaaccctgaatttgttgtccaaaaaacaaatttacgcatacctatgtgactatcatgttctttttgacaatgggaatatgactttatctctagagaaagctacgggcaagaaatgcatcatggtaagtgcaaagggatttaaaatatcgtcgggtgataaaccttgttattggtactgggagtctacaccaaagtccagattttatgaagtagcaatgctcaaatatatgtggtggctagaaattttgggaagtttagaagctaaatttttgtcagcaaatacaaactacggtgtatacttcatctttaattttgaaaatcacggatcagagttcatatatttaaatcaatactttcaacctagaacttatggggatttggttgtgtgcgaaggaaatataaacggatatcgtaaaagagtttgcctagaccctcctggtgaggaagtgcatgagagagaagatggatggatggaagtcgagatgggagagtttttcagtgaagatcatgaagataacttggtgggttttaagctatgggatatgaactcacaacttacacgctttcttgtagttgaaggagtagagttcaggcccaaaaacatgtga

SEQ ID NO: 38624 - DNA, 216 bp, Glycine max
  Peptide Sequence Number=SeqID_155402
atgaccgacaaaaagatgtacaaattcagcaatgatgagagttttatgagggttatcatagaaggaggggacaaaacacatttccaaagtgcatctccaaagcccggaggaagctggaccatggcaaaatctggtcattgcgaaacatctcctgaaaccaacttaaggccgatccatccaaataaaaggaagccacctggagacactcgtcgttag

SEQ ID NO: 38625 - DNA, 414 bp, Glycine max
  Peptide Sequence Number=SeqID_155403
atgaacttaggtgttggcgaggaaaggaaagaggtaaaagttggtacgggcatgaccacactgatccgagatgaattggtggttttgctacggaactaccatgacatcttcgcttggtcgtaccaagatatgcccggtttgaaccccgacattgatgaagccggaaatgtccttaaaaatcaaagaagaggtgaaaaagcagttcgatgctggtttttggtcgtggctcgagtagccaacatcgtgccagttcctaagaaagatgggaaggtacgaatgtgcatggactatcgggacctaaaccgagccaatccaaaggataactttcctttaccacacattgatgtccttgtggataacacaaccaatttcgctttattttccttcatggacgaattctcgggttacaattag

SEQ ID NO: 38626 - DNA, 246 bp, Glycine max
  Peptide Sequence Number=SeqID_155404
atggagcctaagtttgctaagcaagccttgactgaccctacatggttagctgccatgaaagctgagtatgatgccttcatccacaatggtacttggactgttgtttctctgcctcctaacagagttcctattggttgcaaatgggttttcagaataaaagacaatcctcatgctgttgttccaggagcagagatgccacaccatcaaaaggattcccaatattggaaggcacagggcagtgagtga

SEQ ID NO: 38627 - DNA, 318 bp, Glycine max
  Peptide Sequence Number=SeqID_155405
atgtctattttggaggacactagaatgcttgcttgtaagccatctgcagtacctatggaggctgatctaaaattgaatgcagaatcaggatcacaacttccagacctagaaacttatagaagactaataggaagacttctatacctaaccatctcaaggcccgatatttgttacattgttcacaaactaagccagtttgtatctgatcctcgctcaggacacatgaatgcggccaacattctcctaagatacctcaagcacacagctggacaaggggtcctttttaaggccaagtcagacacatccatccaagcttaa

SEQ ID NO: 38628 - DNA, 237 bp, Glycine max
  Peptide Sequence Number=SeqID_155406
atggagttagaaccattgaaatggggaacctcaagcttcacaggaggtggagtcttccgcaaagaatgttaccaaaacgctttctatacctttcttcctcatcgctcaagttcgaaagacctatgtgtcctccttactcaagctgccattgaggttttagacatagttttggctcttggttggtgggttcatgagtttgtgagttggtgggtttgcgggctggtgttcgttgtttaa

SEQ ID NO: 38629 - DNA, 306 bp, Glycine max
  Peptide Sequence Number=SeqID_155407
atggatctcaacaacacttggaccatcactcaactaccgcccaacacgaaacctatcacctgcaaatggctaaataagtctatttatggcctgaagcaagcttcaagaagctggttcaataagttttgctccacattgacctctcaaaaatacattcagtcaaagcatgattacaccttgttcaccaaaggaacatgttcatcattcatagccattttggtccatgttgatgacattgtcattgccagccgtgataaaatagctattcactctgaaaagtcatgcttcaacaattcttcaaattaa

SEQ ID NO: 38630 - DNA, 1104 bp, Glycine max
  Peptide Sequence Number=SeqID_155408
atggccaccccaatgattaatccaagccaagacccaactaaccctcttcaccttcatcattcagatgggcctggtcttgttatcacatctcaaccccttgatcacaagaattacacaactaggagcagagccatgcaggtagcgctctctgtcaagaacaaaacgacgttcatcaacggcaccctcttgaagcctgacgaagacgctcctatctatgctgcttggacgcgtgcaaacaacgttgtcatctcgtggctctacaattctgtctctaaggatatcatcaccagcatcttgtttgtaaatatcgtgaaagaaatttgggatgacttaaatactaggtttttgagggaaaatggtcctagaatcttccaattgaagcgccaactcatgttgttgcagcaaggtaccgatgatatcaacacgtattacacaaaacttaagtctatttgggaagaattaaccggttacaaaccaaccttctcatgcacttgcggaggtcagattcttctctctgatcctttgccttcaattggtaatgttttctccctaattcttcaagaagaagctaaaagggaaattgtcgtcactcactcacccaccaatgcttcagacaatatagctttttctgttaattctgtatcaaagaaccaatatgacagcactaaagggaaatacatgaagaaagaaagacccaaatgtgctcactgtgatatgttagggtacacgaaggacaaatgctacaagcttgtaggttgcccaccaaattacttcaaaaattgtaccatcaactcggtgaatcaagtacatgacacacctgaaagttcaccttctgttcaggcaccacctttcacagctactgagtgtcaacaattgatctatttcttaaccaatcatatgaaaattgaaaccacaattgatgcagtagccacaaatgttatagttatctgtatgaatgatgccttcaataatgatcaccacacttggatcattgatactggggctacctctcacatttgttgtttcaaagaattgtttaattcatatactgccactttcaactcgcatgtcctactgcctaattccacgaaagttaaagtataa

SEQ ID NO: 38631 - DNA, 432 bp, Glycine max
  Peptide Sequence Number=SeqID_155409
atggataccatcacaaaggttctgcctgaagagtgtgtcgcaactattatttccttgacatctcctaaggatgcatgccaattatctctcgtgtccccatcctttaaagaaattgcagattcagatgctgtgtgggcaaactttcttccatctgattgtgaagatatcatagatcaatcttcaacaccaaccctgaatttgttgtccaaaaaacaaatttacgcacacctatgtgactatcatgttctttttgacaatgggaatatgactttatctctagcgaaagctacgggcaagaaatgcatcatcgtaagtgcaaagggatttaaaatatcgtggggtgataaaccttgtgattggtactgggaatctacaccagagtccaggttttactttcaatcactaatattattccataagatatttaagtaa

SEQ ID NO: 38632 - DNA, 1335 bp, Glycine max
  Peptide Sequence Number=SeqID_155410
atggatgagaagagaaggaaaaaactagaggaagctactcaatccggaagcactgaggccgtgattgatcgtccatctcccatcagacaacacaagaagtggaagatgacccgcaccaagaaaaatggtcagatgatgtttgaggcagcaaaggaaattgctgagaagattgtaagattcattggaggagcaggcgtcatagggttcctttgtcccccatggacgccaggatgtcctgactgctgccattggcgactagaacacctaggtcgtgtgcgtgctgttggagctggtgtgacaatcaagcaatactttgaaccggcccaacggacctcctgcacttcatcctccatcgctcccgaagaactaaagcagtcgactcaacaaatcagggaccagctggaggagtcgatcacagaaaaagtgactcggcagctgatgttatccttaagccagatacagtcccagtttcagtcacaaatgcaatcacagggacttgcactgccttcggagcctgaggttggtccttcaactactcgtgtcagcacaaagaggagttattttgatccctcagcaaatgatccagacatgggtgactcagacaaatgtgggttgtacatcgaagaaaatcctccccgcctggttgccctaggaagggtttatgagggatccataatcgttcacaacatccctttgttgcatgatcaagtgaaggttggtgttgaggaggaacttaacaccttccttgcttggccaacacatcttgtcaagcgtttatcagaacaggttatgtgggatgctaccctgttcgggctgtttaattcagacttccccttgtacataaagcatgaagatctatctgaaatagcacaggtggtcaatgttgcagcatctatgttatacagttgtggattcttcatacataatttactttgtgtcaacaacaataggcatctgactgagacaagtatgcgattggggaatttcgatgtgtatagattcctcgagtcacagtccatccaaagatctggacaatcacagtttgaatcagaaagttacatcaagaactggatgcagaattcaaaacgagatgtctacctgggagcctacctgaatggtgcacacgggcaaatggtcgtcattttgcctaaggaaaatcttgttgtctgtgctttgaaaggacttgacgatactccacaacctaaatccaaggttggtgctaggtggattgttgttaaatattttaatgatgttagaccattggaatcaaacacattgaaggcgcttcgcatccagtgggcaaactattatctcaaagttagaaatgaaacttag

SEQ ID NO: 38633 - DNA, 171 bp, Glycine max
  Peptide Sequence Number=SeqID_155411
atggaagtcgagatgggagagtttttcagtggaggtcatgaagataacttggtggatattaagctatggaatatcagctcacaacttacacgctttcttgtagttgaaggagtagagttcaggcccaaaaacattgaaagtgggctattgagtgaaaggatttacatttag

SEQ ID NO: 38634 - DNA, 172 bp, Glycine max
  Peptide Sequence Number=SeqID_155412
gttcagcttcaacccagttcagaccaaaccctactatctcctgctccatgctcactacctcgcagctggtcgttccctcgaagctggagcacctggcggaggagtttggctccctacaggagccagtggagcaactgaagcgcaagagactgaaggaagtgcaagagtctag

SEQ ID NO: 38635 - DNA, 207 bp, Glycine max
  Peptide Sequence Number=SeqID_155413
atgccaccgtcattgctggttgaggtatttaaagatgtcattgtcgctgctggtgaagaagacaagtgtgatagcactcagaacccagggaagatttctggcccaaaaggatcagcaaaaggccaaagggatgggaagaattcatccactaatgtccctacttattctgttatttctgttttatctgtttctgaaatcgtcttaatt

SEQ ID NO: 38636 - DNA, 306 bp, Glycine max
  Peptide Sequence Number=SeqID_155414
atgttggcttcgaagcccttctccgtcaagttccagcgtcttcgcctgatccactgccttgagtcatgtggcctgtttgacgaagcccaacttgagggtgtaggggttttggagaagcttccacccaccaagaggaagggtaagcttctccttgaaatagacaagggcaatggagagggtaaagaattgtgctctttggttgttgatattgttgtgagcctcctgaggtgtgtagccgcgggtttggctaaagaggatgcccattttaggaaggtgcttcagttggtggaggaagtaaacccttag

SEQ ID NO: 38637 - DNA, 306 bp, Glycine max
  Peptide Sequence Number=SeqID_155415
atgaatcttttagtagtgcgagtaagacaagcccaacggcaacaaggccaaggtcatcaagggcaacaacgcaatgaagaacaatttgaaccaattatcaggaatttattggagcaagctggttttcttgtcgttgaacaaattccttttttcccttttgataatcacttaatgatggaacttgttgagtgttggaggccagagtcccctcatttcacatatggtgaagctgtgactggcggtggtgttcataactggggtgaagtatgcaggagttgggagttattccaaattatcctaacataa

SEQ ID NO: 38638 - DNA, 372 bp, Glycine max
  Peptide Sequence Number=SeqID_155416
atggataaggaggccttgaggaaggagagaaaacgcttggagagtgagcgaattagggtttggtcgggcttggagatgagggaggattccgagggactcacggctgagtgcagcgacaaaccccttcttcctcatggaacgcaacaaaccctttcttcctccaaccctttaaacgccgcctatcgttacttaaaccattcaaatgcgtccaacccgattcagaccgaaccctggtatctcctgctccatgctcactacctcggagttggtcgttccctcgaagctggagcacctagcggaggagtttggctccctgcaggagccagtggagcagctaaagcacaagattctaaaggaagcgcaagagtctag

SEQ ID NO: 38639 - DNA, 294 bp, Glycine max
  Peptide Sequence Number=SeqID_155417
atggttggaaatgatgttgaagctctggggcattgtgaattgactatgaccctcatggttaaccacgaagctcatgaattgaccacaaccaagctgttatcatcatattatggtcgtcctgcatacacggttgtgggaaatgtacaatttaccatggctattgatgcaagctccattggagcttgtaggcctaggatcttcttcatcaatggattcctttgcttcttggaagatgaatggcagcggaatggagaaggaagagagagaggagacaccacttcaaggagaatatga

SEQ ID NO: 38640 - DNA, 258 bp, Glycine max
  Peptide Sequence Number=SeqID_155418
atggaaccagttcacaagtgccttcttacggagttaagcaaccttccttcacaccttaaaccaaatcctaagaaggaggatgtcaatgtggtgatgactagaagaaagaggattcaagaggactttgaggagaaggaagattctcctccaaaagttgtagatgacgtccttactaaagaggaccaagaaactaaggaaattgaggttcctactgagaaagaaggggacaaaatgaaggagatattgacatctccctag

SEQ ID NO: 38641 - DNA, 1997 bp, Glycine max
  Peptide Sequence Number=SeqID_155419
cgcctcttcggcgctcgccacccgaatcaggttgaccaccggtccgaacacttcctcacgcgtcaggttcagccgatcgtccggagttgatcaccagcgttggcggaatgtagaagccgttggcatccggcccggccgcgccgccgataagctcggcgtttttcgcccgggcgtcgtccaggtaggccgccaccttgtcgcggtgcgcgagcgacaccagcgggttgatttgcgcgccggtatccatccccggcccgaccgacagcgatttcaccgcctgttcgaaacctgccaccagctggtcataaatcggcgcttcaatataaattcgcgagctggcggcgcacacctgcccctgattgaggaagctgccgagcatcaggccttcgatcacctgctgcggatcggcatctttcagcacgatggccgggtttttaccgcccagttccagcgtcacgcgggtcaggcgatccgccgccgcgcgcgcgatgcttttgcccaccggcgtggagccggtaaagctgactttggcgatcagcggatgttcggtcagcgccttgccgcacacggtgccgcggccggtgaccacgttgaacacgcccggcggcacgccggcttcgctcgccagttcggcgatgcgcagcagggtgagcggggtggtttccgacggcttgatgacgatggagcagcctgcggccagcgccggcatcactttccacatgcctatcatcagtgggaagttccagggcacgatgccggcgaccacgccaatcggctctttacgggtataaacctgatatttggcgcccggcggcatcggaatggagacgtccagcgtctggccggtgattttggtcgccagcccggcggtgtaacgcatccagttcagggtgctgccgacttcgaaggcgcgggcgatgttgatggacttgccctgctccagggtttccagctgcgccagctcctcggcgtgctgctccaccagatcggcgaagcgcagcaggatgcgttctcgttctaccggcagacgctgcgcccagacgccttcgctgaaggctttgtgggcggactgcaccgccagcgcgacgtcttgctcgttggcgtcggcggtggtggcgatctgctgcccattggcggggttatacaccgccaggcggccttccgcggcggacgcgcgccactggccgtcgatatacagcccatgctgacgatcgagaaaacgcgacacgctatccagcacggctacggtattgtcagacatacatcctccgatcaggctcatcagggtaaaccgcggccggcgggcgctggccgggagggatcacgagctcagggtcgccagacgggtagcgaagccgaggaacagcaggccgatgaggccgttgccgagcttcgccaggcctttcttgtgattgaagaaatgcgccagcatcgcgccggagaagatcagcgtactcatgtagataaagctgacggcttcgaggatcagcgccagaatggtgaacgacagcccggtgctcagcgtcagcgatttgcgcagaatgctgtggccgccttcaatctgctgctgttgcgcctgcgccttctgcacgaaggtggcgtagaggatttttgcgccgaggaacagcaggtaaatcgcgccgagaaaacgcaccagggtaaacaggaacggcgtggtgcggatcagcgaagccacgccgatataggcgcagaagatcaggatcgcatcgccgatgaacacgccgagcgccgcggtgtagccggcgcgcacgccgcgcgatacgccggttttcatgaggaacggatgatgaaaaacgtaatcgacagcgccgacccacgctggctggcgatcgtcagccgcgataaacacgccgacggccgctttatctacgcggtgaaaaccaccggtgtgtattgctcgccttcttgcccgtcacgccagccgaaccggcaaaacgtggagctgttcgatgacgccgagcaggcggaggcggccg

SEQ ID NO: 38642 - DNA, 662 bp, Glycine max
  Peptide Sequence Number=SeqID_155420
ctttgctttacgggggcggcggtgcgcgccacgtcgggccggcgttaaaatacgccgttgcgggcgctaagataacgtggtggccatcacattccgtgggaacgatgaaaagctatcgacatattctggtactgattcacgatgagcgcgatgggctgccgttgctgcgtcaaacggtggcgatggtgcgcgggctgccgatcgccatcaccgtcggccaccttaacgccgactatgcggagctggagtacggcagcgatgcgctggtcaaagatcgccaggcgcaggaggtgatcgccgccaaggcgatgctgagccggttggtgagcgccgtcgatgcgccggttgcggtcaaggaaatcgtcaccatccggcgctttaaggacgtcaacgatttcattcatcaggccggcatcgatctggtggtggtcgggcaccaaaaccgcctcatcttgcccgcgaatagcgtgcgacaaagcggacttttcccacggctttgccgccttaaaggcgatagcatgcggatatcgcttgatcttgcctgggctatcggtaaaaatctgcggccgtatttttacaggagctttacgatgtttctcaaacggactcttttggcatgttctctggcgttgatatttcctgcactgccttcttacgctgag

SEQ ID NO: 38643 - DNA, 199 bp, Glycine max
  Peptide Sequence Number=SeqID_155421
atggcgaaaagagagagaggaagcagagaagaaatcagattggccgaaatcgaggtggaattgggcgtagctcctcttcttgttttttaccaccgaaggaataacggcgttaagctttggacgccttcgggtgtaggtgttgatgatatggtgttgctggttctcccagatgtccagagaagcggaagaggaatcagag

SEQ ID NO: 38644 - DNA, 390 bp, Glycine max
  Peptide Sequence Number=SeqID_155422
atgcagtccaaaatcaacgctttcttcaaatctactacctctgattcctcttccgcttctctggacatctgggagaaccagcaacaccatatcatcaacacctacacccgaaggcgtccaaagcttaacgccgttattccttcggtggtaaaaaacaagaagaggagctacgcccaattccacctcgatttcggccaatctgatttcctcttacgcgcatgttccacttgccgcttcaagttcactccccgactttcacaaatcttacacccaggggattcaattcagagttggaccaaagaaaatgttttccctccacccagcgtagaaacgggtcgaataattttggtatcggagaacgacctcacttctcaccgaaaaaaatgttga

SEQ ID NO: 38645 - DNA, 696 bp, Glycine max
  Peptide Sequence Number=SeqID_155423
atgatcactcttcaagtaaaagaatcgcttgattcacaccacaaacgttttccacaaataaacgttggtggcgactccgcgcatctttcctcctttggaaagcgaacccgtgagccttgccctcgctcgcccgcaaaagggcacgttgcgaaagtgaagatagacgctgacagcctcaacacatttctagagactccagtagtcctagaggagggggagacattacccacctactctaggtactacaggttacccacagaccatagaaagattgaggttgctttttgcatagcagggatggagttcattttgaatgctaagggccatccagggaggattctcaagaaggatttgactaccttggcccaggtgtggagtgttctctcttactctaacctggcccctacatctcacacatcagatcttactgtggatagagccaggttgatctttggcctggtctctcatatggacatgaacatcggtgctcttatctcaggacagatgacttccattacccagtctaactgttgtagattttggtttcctgctttgatcaccgccttatgtcgagcccgaagggttgtctctgacagcctcacatttgagcgcttgagcccggccattaacttggcctacatcaggaagtactgttggaacattgattatttaacagttgctttccaaggggactag

SEQ ID NO: 38646 - DNA, 353 bp, Glycine max
  Peptide Sequence Number=SeqID_155424
acacttgttagcattgccacacctcttggacttcagtttattcctcaagtaaaggagttgttggatgaggatttggttcgcaagagcttaaatccttgtgctttgttggtgcccaaaataggggttcccatgaaccctaggagaataaaggtcattcctgagtggcccactccaccaacaccactcattgagttggtaaggaaccatgttccttcatgggaagatgctcaggaaatgggttttcagaccttaccttacttcaacataccaaacacgactaatatatatgtttttgttcttgttacaggtgttgaggaaaaaagcccagagtttcaagaacctcgggatttgag

SEQ ID NO: 38647 - DNA, 648 bp, Glycine max
  Peptide Sequence Number=SeqID_155425
atgacatgcaaagacaaaatttggtcattctgcacctttatgtcatccagaggcggcgggcccgatgacatgcagagacaaaatttggtcattccgcacccctttgccattcagacacagtcgtgtccgatggcacgcagagacaaaatttggtcattctgcaccctttgtcatccagaggcggcgggcccgatgacatgcggagacaaaatttggtcattccgcacccctttgccattcagacacagtcatgtccgatggcacgcagagacaaaatttggtcattctgcacccttttgtcatccagaggcggcgggcccgatgacatgcggagacaaaatttggtcattccgcacccctttgccatttagacacagccgtgtccgatggcacgcagagacaaaaattggtcattctgcacccttttgtcatccagaggcggcgggcccgatgacatgcggagacaaaatttggtcattccgcacccctttgccattcagacacagccgtgtccgatggcgcgcagagacaaaaattggtcattctgcaccctttgtcatccagaggcgcgggcccgatgacacgcggaggtttacatcatcttcagcactcacaagatctgtcatactgacttttgagtcacgctga

SEQ ID NO: 38648 - DNA, 792 bp, Glycine max
  Peptide Sequence Number=SeqID_155426
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattggatatgcttaaactcagcgggtagccccgcctga

SEQ ID NO: 38649 - DNA, 768 bp, Glycine max
  Peptide Sequence Number=SeqID_155427
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccttgaagtcgatgaagctgtaggccaggtcgagcgaggaattggcgttcagcttccagttggcgccgatcgagtattgcatgcggtcgctgtccggcagggccgggtggcgcagctcggcgctgcgcacgggtgcctggtcatgggcgataccggcgcgcagcagcaggttctcgctgtatttgtagttggtgcccagcgaaacacggtaggtatctttccactgctggcggatgcgctcgtcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 38650 - DNA, 522 bp, Glycine max
  Peptide Sequence Number=SeqID_155428
ggtcaacggtttgtgcctgtctattccatccatcccttcgtggagttagggcgtgtgatgtgtcctttccgatgccctcggccgcatttcggaatcaaagagtcatggtgctttagttgtgggttagcagggataagttggactgcgctagtagttagggtgggtggctctcaaactgaaacacatgtggtagggtctctctttgtgagcataccaacccgagttggatcaatgaggatggaggatgggcatgacagagtttggcaagaatcatcccttcctttttcaaagacgacgagccgcccaccttcattacctaagatgaagaattctcacccatgctacgagtctgcggtcaagcgcaatctgagatccctcgtcgatagacatgaaccaggcgagtccgaatccctttctgttttgtcagctgatcttacgagctttcatagaaagcctatatcttatagcgcgtacaagaagaagtggtggacaatcttctctgcgctctttgacctaccatag

SEQ ID NO: 38651 - DNA, 435 bp, Glycine max
  Peptide Sequence Number=SeqID_155429
atgaccataaattgtctccgcatgtcatcgggctcgccgcctatggatgaccaaaaggtgcgtaatgaccataatttgtctccgcatgtcatcgggctcaccgcctctggattacaaaaggagcagaatgaccataatttgtctctgcgtgccaccgaacatgatcgttttggatggcaaaaggcgcaaaatgaccataatttgtctctgcgtgccatgggactcgatcgtctccggatggtgaaaaggtgtggaatgattataatttgtctccgcatgtcattgggctcgccggctctggatgacaaaaggcgcagaatgaccataaattgtctctgcgtggcatcagtcacgattgtctccgattgccgaaaacttgtgcgaaatgaccataatttgtctctgcatatgatggggctcaccgcctctggatga

SEQ ID NO: 38652 - DNA, 915 bp, Glycine max
  Peptide Sequence Number=SeqID_155430
atgagaggagcaccggtggaagaaagcttgtctcttttccttgtgagagatttcggcgtacaaagtttcaaggttatacaaagagtccataaggcgtgggaaagcccgttaaggaaagataaagaacttaggtgcattcgtaatggcatcatcggtggttatcatgaatggctgaaagttcgtacacgagggttagattggctttccaagttaaagattatcaacgaagagaactttgaagctccggaagaggatgaagaagtccgagctctaaaaacagaactaggaaaagcaagacttgccaaagaaaaattcaagttggtcgctacaaacgtccggaaagagtgtgccgggttacgagaagaaaatgcagctactgctagagcccttgaacaagaaaccaagagggctcgcaaggaagagcatggccatgacaaatttcgtggagctttgtggggtagcaacagtgagctcaagcttcgaagggaagagatagaccaatcacgagcacatagcatgttcttgaaagaggagttagctgcttgctcaaggcccaaaagaaacttgcctcagtgtttatgcgagacagagaccaacatgttcgctatcgtcagcaagtaccaagaagaactaaatctagccacggcccacgagcacaaagtggcggacgagtatgcccaagtgtacacggaaaaggaggctagaggaagggtgatcgacgcgttacatcaagaggcaacaatatggatggaccgatttgctcttaccttgaacgggagtcaagagcttccccgattgctagccaaggccaaagcaatggcagacacctactccgcccccgaggagatcccaagacttctcggctattgtcagcatatgatagatttaatggcccatataattagaaaccgctag

SEQ ID NO: 38653 - DNA, 756 bp, Glycine max
  Peptide Sequence Number=SeqID_155431
atggtagaagaatttgaagagatcctagggtgtcctctaggggggaggaaaccatacctcttcacaaggttctatccctcattagctagaatttccaagatagtccaaatcttggtgcaggaattagaccacaggaagcaagtcgaaaatggggtggttggaataccgagaaaatatttggaggcaaaagcaagaatcttggcaggtaaaggcgagtgggccccgttcatagatattctcgcactgttgattttcggaggagtcctctttccgaatgtggatgggttggtggacctggcagcgatcgacgtttttctcacctatcataaccacaaggaaagcccggttgtcgctatgctagccgacctatatgacaccttcgaccgaagatgtgaagagagcaatgcaaggattgtttgttgtactccagctctttatgtatggttagtttcacacctttttcgccaagaggtgaggcatgcttgcccgctagaaagtcatcgttcatgcacagagaaaggaggggcaaattgggaccaactcttagcaagcaaagaaggagcatctgtcaactggttccctcgatggaaggaaggaagaaccggagttcttatttcatgcggaggatttccaaatgttcccttgatggtgatgaggggttgcatcagctacaatcccattcttgcaataagacaacttggctaccctatgagaggggcgccactagaggatgggctcgcgcctgtcatttcatga

SEQ ID NO: 38654 - DNA, 399 bp, Glycine max
  Peptide Sequence Number=SeqID_155432
atgccacccaccaggcaccctctagacctggataagtctaatagggccttggggtttccaacgttgatcacgggcctctgccagtcattcggggttcccgtcatacctagtaaggtgatccggccgccgatcacccgagccttcattgagaagtattgcacgcctaggcaagcgcagggtgatgcaccacaagccgcagacgcaccgccgccacctcatcaggctgatcccgctgggtcattaggcatggagcggtatctacagcacttgcccagagattggctcaaggaccagacggaggaggcacctgcaggagctcccgacgatgcagaggatgcccgcatggatgaggagatgacagacttgctcagcttcttgggaggaagcggagccacgtga

SEQ ID NO: 38655 - DNA, 228 bp, Glycine max
  Peptide Sequence Number=SeqID_155433
atggcctcaaagaaagaagacgacagacatgctgggaaggaaaaaggaaggagatgtggcctaagtaggtacaacaaaagacattgggtcgctaaagccaatagttcggtgtccgggcaacagccaagccactcatctttggttgcagcttcggcggaagcctatgctttcagttcagttccattccttggttctccggttgattgccctgcccgcgtcacaccttaa

SEQ ID NO: 38656 - DNA, 870 bp, Glycine max
  Peptide Sequence Number=SeqID_155434
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaaactccacaattcttgctcttcaagattgtcaccttctaggtgacctgaataaggacttttggcataagacccaacaaagcataaattccacaaacaccctcagtagctcagaaggtgaaaaattgcacaatttgcttagtgctacattgaccaaccacgacacgtgcttaaacagccttcatgaaactacttcaagccctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38657 - DNA, 477 bp, Glycine max
  Peptide Sequence Number=SeqID_155435
atgccgatttacccctgcagaagtatcagttggtctgtgccgtccagacatagggatcgcgcccacaagacacccagtggacccggagaagtccaacagggccttggggtttccatctctggttacgggcctctatcatttctacagggtgtccgtactccccgacaagggatcgcgcccgcaggacaccttgtggacccaaagaagtccaacagggtcctggggcttccagctctgattatgggcctctgtcagttctacggagtgcccgtcacccccagcaaggtcatcatgcctcctactaacctagctttcatcaagaagaattgcgcccccaagcaggcagagggcgagacaccacaacagcctggggatggccagcaacaggcaacaaatgcaccaccgccacctccagagcccctcagctcatccacaaaaaggttagagtattgcctacgacacatggacgacaaatag

SEQ ID NO: 38658 - DNA, 586 bp, Glycine max
  Peptide Sequence Number=SeqID_155436
atggctgcggtacagctgataggtcagcgtttggccgatggggatcagcaagccgccgcccatgccctgcagggtgcgccagccgatcagcgcgccgatgctgtcggcgttgccggcgccgaaggtgcccagcatgaacagcgccagcgacagcaggaacacccgccgcccaccgatgcgctgcgccagccaggcgctgagcgggatcaccagcgtcaggccgagaatatagccgttgctgacccacgccagttggctgaccgacgcccgcatcgcctggccgatggcggggtaggcgacgttggcgataaacatattgatcagatcgacgaaaaagccgagcagatagacgattgccactttgctgcgataagacatggtgcctccgctggagaacgagctgggggtgtcactgctggcgcgcagcacccggcggctgtcgctgaccgacgccggcgaacgcttttaccagcgcagcctgcaactgctgcaggaggcggaaaacgtgctggacgacgtgcgccgcgatcaccacgggctgagcggcgtgctgcgcatcaccagtacgccggagtatggcgcgcag

SEQ ID NO: 38659 - DNA, 225 bp, Glycine max
  Peptide Sequence Number=SeqID_155437
atggccggcctcgctcagccgggtcaggccgagcagcagcagcgtcagcgccgcgcaggcgctcagcaaccctttgccgtcgagcggtttgcgcgccgtcgccgacgtttccgcgcgcagccaccgcgccgccagcgccagggccagggccgccagcggcaggttggcgaaaaacacccagcgccagtccagccgatcgacgagccagccgcccagcgccggtga

SEQ ID NO: 38660 - DNA, 612 bp, Glycine max
  Peptide Sequence Number=SeqID_155438
atggcatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccagtaaccgatacaggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactaaagaatttaatcaagcaagttgcacctaaagggatcccccctcttggaattcacgaatcacaaacg

SEQ ID NO: 38661 - DNA, 591 bp, Glycine max
  Peptide Sequence Number=SeqID_155439
atggtgcagcccaaaccaagtgctggcctaaaggggaaatctctccaacatgctctcactttcatgccttcttgcattaaaaaaaaatcaaaggcttgggtccctatgcctaagtcatgttttggcatctatcctaacttccgcaagctgtccacatatccaaaaatgagcataaaaaggtatcaatggaaggctagaaaccaaaggatagtgcacttacttgtatggggtggcaaggacactaaaattgaagcaaaaagcacacaatggtggcctagggtcagcaaaaaccagaatctcgtgagtgcttgcgtccttaaatgttttgatgataacaaagatgatgacaaaggtgatgacaaaaagctcaaaggtcaatcaaagaatgagttcaagatgttcaagatagaatcaagaacacttcaagactcaagaggaaagttgaagaacacttcaagattcaagaggaaagttaaattcaagaatcaagaatcaagattcaaggatcaagctttcaagactcaagattcaagaatcaagagaagacttaatcaagataagtatgaaaaggttttttcaaaaactgagtag

SEQ ID NO: 38662 - DNA, 1315 bp, Glycine max
  Peptide Sequence Number=SeqID_155440
atgggtcatagggccacccagaacagccaccatatttttctctcagagccaaacccaccattcccacccactactactgttcgatctgatagtttcagtttgaacgatagggccttgaaggttagtccaagcatccttctgatcatcataattctggctattgttttcttcatttctggtttgctgcaccttcttgttagattcctgtggagaccccaaactagagagcctgatgaattggacaatgtcaccgctctccaaggccaattgcagcaactctttcacctccatgatgctggggttgaccagtccttcattgacacactccctgtgttcctctacaaggccatcatagggctcaagaagtacccttttgactgtgccgtttgtttgtgtgagtttgagcctgaggacaagctaaggttgctaccaaaatgtagccacgcttttcacatggagtgtattgacacctggctcttgtctcactctacttgtcctctttgtagagccagcttgctccctgatcaattctctgcaaccaacgcatgttctcctattgttcttgtccttgaatctgggagtagtgagagctccagggaaatcgttcccgaaagagtgggtgcttctgctgctgttggaaggactagttcggttatgaccacagattctcgccttggttgccgtggagatagtgaatttggatcgacccgtgtggatttgatgaaatcaggtgagttgttaagtgaaattcctgatccaacagtgcctaatggtgtggaaaaagttgttactgtgaagctggggaagtttagaagtgtggatggtggaggtgaaggtggggaagggagtagtagtagtactagtaccaacaacgtggatgctagaaggtgtttctctatggggtcttttgcttatgtcatggatgagagttcttcattgcaagtacctataagaactccaatcaagaagcaatcaagtaagaagaagtctggtttgcctttgacaccagggcacaggcctgcaatgtcagaatgtgactgtgaatccagaagggatttcaagtttgcagggtttgatgcaacaactattatagttgaggatgatgctgctactagtactggggctacaacttcaagcacaacttgtaatgggaacagtgctgctgccattggaaggagcagaaaggagagcttttctatatcaaagatttggcttagggggaagaaggataagccaaattctgtggcggattcgtctagaagggctgtttcgtttcgattcccggcgaagtcgagtgttgttactgctgcttctg

SEQ ID NO: 38663 - DNA, 165 bp, Glycine max
  Peptide Sequence Number=SeqID_155441
tgggaaaatggaggagggagtgagttcgattatgatgacgaaaaccagagttgttatagtctagattcttctcaagctagggcgccatcttttgctagaaggactttgctttggctcacaggaggaagacagaataaggttgttcactctgcttccaacctctag

SEQ ID NO: 38664 - DNA, 654 bp, Glycine max
  Peptide Sequence Number=SeqID_155442
atggtcagaccgctgaggcgggtcatgtaccgtagcaccggcattgaatcccacgggtgtgcggcacgtggggcatgcggcgaccttaaggagccacgtgtcgacgcacctgcggtgaaacacgtgcccgcacgcagcaagctttcggcaccattgggcgttatggaatgcgtccaggcagacgacgcaattggagtcgggtcgggtctcggatccattggcgacacgaaagcgggggagcttgttgatttcgcgaggggggaggccgttggaggaggtgggttcggtggtaacggaggggcggaagcgaaggcggtggaaggcgccgccgaggaggaagaggttgaggaggaggaaggcagcgaagccgaggaagaggaagaagagggaggtgagaaggagcatgatgattggtttgaggaacagagaaaggagatagatagagcagaggaagaaaatagatttgaagagagcaagggcgtgaatgaaggagcaacctctgaaagtggaacacagatattaggatccaatccaacagagagagagagagagaaatctgtgggtagtgggttattcggttgcggattgtggattgtggaccttgaccgtcgctacgtcggtgcctctgtattctataatctatatcctttccat

SEQ ID NO: 38665 - DNA, 924 bp, Glycine max
  Peptide Sequence Number=SeqID_155443
atgacggaatcagggggcgtgtctgggtggtggtgtgattcccttaccccattgaaggtgatagtggagtcgctaaggattatggcgtggaacaaagtgatgttcgcatccatcatggtcctcaccaccctccctctgtccaccctgctaatctcccaatccatctacacccaccccctcacatcccaaatccagcacctcgaggccctcgcacgcttcacctccacacgcttcgagtcccgccacgtctggcaagaatcccgccacgaagccctctccctcctccgcatcaaggccctcttctccctcccctcctacctcctctccctcgccgccgccctcgcagccgtccactctaccctcctctccctccacaccaccccctccctccactccgccgccgccgccttccgcctccactccgcgcgcctcctcgccaccaccatcttcgtctacgccatcctcttcgccttctcccccctcccgcgcttcctcgccttcctctccccctcccccgccaccaggctcctcctactcgcctccgcctccgccctcgaggtctacctcatggccgtcatgagcgtcgccctcgtcgtctccgtcgccgaagagaggttcggctgggatgccattcgggttggatccgctctcatggagggaagccgggtccgtggttgggtcctgtcgggcctgttcgttttaggttcgagcctgatcgggtcaaagctggaacacttgatggacggtcaggattcgatcgcggttaaggataaagcgggtctgatagtttcttacggattgttagtgctgtggagttacgttgttatcactgtcttttactgtgactgtagaaaacgccatccaattagggaaccccaaccagatgatgatgaccacccacaacaacaactctctgtaatataa

SEQ ID NO: 38666 - DNA, 328 bp, Glycine max
  Peptide Sequence Number=SeqID_155444
gtggggatggagaaaagagcaagacgcaagcatagttgccaatagaacccgaggtcaagcatttcaagtcctggtagcttcaggaaaggaaggttcaaaagatgatgtggtcatggttgatcctgtggaagccaagagattggctgccaaacaaatggaaaaaattaaagcaaaagagaaactcaagagaagacgccaaattgaggcaattaacggagcatgggcaatgattggtctcacggctggcctagttattgaaggccaaactgggaaaagtattctgactcaggtgaaatttggaaatgcttctttttacatgttcttgtga

SEQ ID NO: 38667 - DNA, 1061 bp, Glycine max
  Peptide Sequence Number=SeqID_155445
gtggaatataccacactgagctggacgagtttaaggctgaattggagaggtgtaacttccataaacgcctcaccaatttagttgacagcagcatagacttggctttagtgaaggagttttatgccaacctttacagctctgaagacccttcaccaaaggaagtcagggttagaggccccctggtgaggattgatgcagacagcctcaacacattcttggagacgcctggctatcctaggaagattctcaagaaagatttgatgactcttgctcgggtgtggagtgttctctcatattccaacctggctcctacttcacacacctcagacctgacaatagatagagctaggctaatctttggcctagtctcccaaatggacatgaatgtgggagcccttatctctggccaaatcacatctatagcccagtctaactcttctagacttgggttccctgctctgatcaccaccctgtgtaaagccagaggggttaattctgacagcttggttttcgagtgcctgagcccggtcatcaacttggcctatatcaggaaaaactattggaatcctgatgatctagttgtttctatcaaaggggccaggcaggcaaagatgaggctaactgagcctccttccacatctacagctcctattccagcatgtacctcagcagctccttctgtcccagcttttacaggttttcagcatcttgaagccatgcttcagagcgtccatcgagggcagatcattctattacagagtttacaggtggtggcgcctccaggatctattccttcagtggagcaggaagatgaaggtcccacaacccaggtacctcagcatgtggaggatgggtcatctgaggccaccatcctagagccatttgttataggagaagaggcagaggagacacaggtgagacaggtagttgctgccactcccgagcgatcccttgaggctacttcagagccttctgcacaaggggaggatataccctcacctcagcctgcaacaaacccctccaatcctcttctagagatgccagaggacccgactacatcg

SEQ ID NO: 38668 - DNA, 495 bp, Glycine max
  Peptide Sequence Number=SeqID_155446
ggctttcccggtatcaaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagcttcggtgccgagtacctgattcccaagcccttcgacccgcgcctgatgctggtcgtggcaccggccgtggccaaggccgccgccgagtgcggcgtggcccagcgcccgatccaggacatggatgcctaccgcgagcacctcaagaccttcgtttaa

SEQ ID NO: 38669 - DNA, 243 bp, Glycine max
  Peptide Sequence Number=SeqID_155447
atgaaaaaggaagagggaaggaagatgaagaggagaatggactcaaaaaatccaaaggggagtgtggtggcaccgcatgctgcggagggggatgcacgacgaagggggaaggtggtggcattgggcaccacggagggggacgttggtggcgccatgcacctcacggaggtggaggtggagggtgagggaagaggagagggagagaggggattgtgtggcttggagaaagtgtatctggcatag

SEQ ID NO: 38670 - DNA, 2013 bp, Glycine max
  Peptide Sequence Number=SeqID_155448
atgcgacaggtcaccgaggttatcaacccggacgaggattatgtctggattcacgattaccacctcatgatactacccactttcctccggaagcggttccaccgcgtgaagctggggttcttcttgcacaacacgtttccctcctcggagatataccggactctgcccgtgcgcgaggacattctccgcgcgtttttgaactgcgacttgattgggttccatacattcgactatgcgcgccattttttgtcgtgttgtagtaggatgttggggctggattatgagtccaagaggggttacattggtttggattactacggtcgcaccgtgacggttaagatcctccccgcgggaattcacatggggctcttggagtcggtgttgtcgttgccgcagacggcgttaagggtgaaagaattaaaggaggagtatgaaggaaagattgtgatattgggagtggatgacatggacttgttcaaaggtattagtttaaagttcttagctttgggtaagcttctggaagtggatgagagtttacggggtcgtgtggtgttggttcagattctgaacgcggcgaggagcaaagggaaggacattcaggacgtgaagaacgagagcgaggccattgcgagggagataaatgagaaatattcacaaccgggttaccagcccattgtttacatcaatggaccaatctccacgcaggagaaggctgcgtattacgctgtttctgagtgttgcgttgtgaatgcggtgagggatgggatgaatttggtgccttatgagtacactgtttgtaggcaggggagtgttgcgttggacaaggctcttggcgttgaaggtgaggataagaaagctcctaagcagagcgttatcattgtgtctgagttcattgggtgttccccttcgctcagtggagccatcagggtgaatccgtggaacattgatgatgtcgctgaggctatgaattcggctgttacaatgtcggaggcagagaagcatctgcgccacgagaagcattacaagtacataagctctcatgatgtggcgtactgggctaggagttttgatcaggacttagatagagcttgtagggagcattactctaagaggtattggggtgttggattgggtttggggtttagaattgttgctttggatcctacctttaggaagctctctgtggatcacattgcctcagcatatagagatacacacagtcgattgatccttttggactacgatggcacaatgatgccgcaggcaacaataaacaagactccaagcagggaagttattgctgtcttgaattatttatgcagtgatcctgaaaacatggtgttcattgtgagcggcagggataaggattgcttgggcaagtggttttctccgtgtgagaaattgggtctctctgctgagcacggttacttcactaggtggagcaaggattctccttgggagacttgcggattggcgactgattttgaatggaaaatgattgcagaacctgtgatgtcgctttatacagaagcaactgatggttccttcattgaacataaggaaagcgcaatggtttggcaccatcaagaagcggatccttattttggatcatgccaagctaaagagcttcttgatcatctggagagtgtgcttgccaatgagccagtagtggttataagaggacaacatatagttgaagttaaacctcagggtgtgagcaagggtaaagtggtggaagaccttatctcaatcatgcgaagtaaggggaagtcaccagattttctactgtgcataggagatgatcgctcagatgaagatatgtttgaaagcattgctcgttcagcatctaatccagctcttcccaccataccaaaagtgtttgcttgcactgttggacagaaaccaagtatggctgaatactatttggatgatactagcgaagtaatgaagttacttgaaggacttgcaaccgcttcagcaccatctgcgtccatagcttctcaggaattgtga

SEQ ID NO: 38671 - DNA, 768 bp, Glycine max
  Peptide Sequence Number=SeqID_155449
atgcaagactggaatccccagctgtatcgtcagtttgaatctgagcgtacgcgtccggcacaggagttgctggcgcgtattcccgtcaacgaggtgcgctttgctacggacctgggatgtggcccgggcaacagcacggaactgctggcgcaggcctggccgcaggcgcacatcaccggcatcgatagctctgaggcgatgctggaacaggcgcggcaacgcctgccggactgtgattttcttcaggccgatatccgcagctggcagcctgagcagccgcaacaggtcatttatgccaacgcgtcactgcaatggctgaccgaccacgaaaccttgttgccgcatctggtaaaccagctggcaccgggcggtgcactggcggtgcaaatgccggataacctgcaggagccgtcgcatcgtctgatgcgtgaggtggccgccagctcacgctggcaggcgcatatttcgcctcaggcggcagagcgtaaacgcctgctgagcagcgattgctactatgatttattaggcgatgcaggctgtcaggtcgatatctggcgcaccacttactatcatccgatggcggatgcgcaggcgattatcagctggttgcgtgccaccgggctgcgtccgttccttgccgcgctggatgagcgcagcaggctgactttttacacgactatcatcaggcgctgctgctccgcttacccgacgcgcagtaatgggacaggttttgctgggcctttccgcgtttatttatggtggcggtga

SEQ ID NO: 38672 - DNA, 366 bp, Glycine max
  Peptide Sequence Number=SeqID_155450
atgaaaacctatcctgatctgaaagggattatcggtttcggctcgctcggtccgatcggtgccggtcaggcggttcagcagaagcgggcgaaaaataaaatcgcggttgtcggtattgcgatgccagcacaggctgcgccatacctgatgcgcggtgacattaagaaagtcctgctgtgggatccaaaagatgccggttacgccctggtttcggttgccgatcagctgctgcagggtaaagaagtcactaaagacctgagcattgaaggtctgggcaaagccgacgtcgatatggataagaaagtgattcgctttaataaaattctcgaagtaacgccagagaatgcgaaatcacttggcttctga

SEQ ID NO: 38673 - DNA, 1179 bp, Glycine max
  Peptide Sequence Number=SeqID_155451
atgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccatagaagtcgttgcatcacttacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacggaagtacctagaagacaaggcaaggggtatggcccaatcaaggagactgggtcccatttatggatgtgttagctttgctaattttcgggacctggcagcaatcgacgctttccttgcctaccaccatagcaaggaaagtctggtggtagctgtcttggcagatctatttgacacatttgaccgaaggtgcgaaaagagtagtgcacggatcatctgttgcttacccgccctctgtgtttggttggtttcgcacttgttccaacaagacacaagacatccatgtccgctcctgagccatcgctcgtgtactgaaaaggggagaatagattgggaccagcttttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagaattttgaagcaccggaagaggacgaagaa

SEQ ID NO: 38674 - DNA, 285 bp, Glycine max
  Peptide Sequence Number=SeqID_155452
atggcttctgtggatatctctgctatggtcaaatctaagatctttccgtacgccttgcggaaggcttgcatttggagaggtgacacggaccctccgttggtttgccaaagagaggggatcaaggcgaaactcgtgcatgatgcatatgccaaaggcacaactcggggattggcacgcagcgtgtttgctccgtgcccctattttagagacctacatgggagggagctaaaagggccttttagtgataattcccaaggtggtcatatctctcttgatggtctctag

SEQ ID NO: 38675 - DNA, 547 bp, Glycine max
  Peptide Sequence Number=SeqID_155453
cgcgctgagcgtgtccggcattaaaaccgccgacgtgcaggcgtcggagtccatcaccgccagcaccaaagtggtgatcgttacggctgacaaaatcacgctcgatgcgccggaggtggtctgcaccaacaaactcaccaccggcacgctggaagtgcaaaaaggcggggcgatgcgcgggaacatcgaacacagcggcggctccgccaaatatatcggcatgaaccgaggcaccggccgcacgctgacggacatcgagcatattcgccagtccgtggcggacatcctgatcacgccgcagggttcgcgcccgatgcgccgggcttatggctcattgctctctgagctgctcgaccagccgcagaacgatgcgctgcgcctgcagattatggccgcctgctacagcgcgattttggcgtgggagccacgcgtcaagctgaccggcatcgcttttaataccacctatgacggcaagatggtgatcgacatcaccggcacccgcaccgatgcccccggcgcgctgtcgctgtctgttcctgtgagctaa

SEQ ID NO: 38676 - DNA, 3105 bp, Glycine max
  Peptide Sequence Number=SeqID_155454
atgagagccggactaagcaccatccagcaaaccctaacgcccgaggcggcgagcgttctcaaccactcaatcgcggaggccggccggcgaaaccacggccaaaccactccgctccacgtggcggcgaccctcctcgcctctccctcgggcttcctccgccaagcctgcataaaatctcaccccaattcctctcaccctcttcagtgcagagccttggagctatgcttcagcgtggcgctggagcggttgcctacttctcagaacacgggctcttccatggagccgccaatctccaatgccttgatggcggccctgaagcgggcccaggcccaccagcgccgaggctacccggagcaacagcagcagccactccttgccgtgaaagtcgaactcgaacagttaatcatatccatcctcgacgatcccagcgtgagcagggtcatgagagaagccagtttttcaagccccgccgttaaagccaccatcgaacagtccctcaacgccgtccccgccaccgttaattccggattgggattccggccaagcgcggtggctccggtgaattccgccccggggcggaatttatatctgaacccgcggctacaacagcaggggagtgctgcacagcacaggggcgatgaagtgaaacgaattttggatattttgcataggacgaagaagaggaacccgatcttggtcggggaatcggagcccgaggccgcgatcaaagaagtgataaaaaaaattgagaacaaggaattgggagaagggggtttcgcgaatgctcacgtgattcatttggagaaggagcttccgagtgacaaggcgcagatacccgcgaggctgcaggagttgggggatttgattgagagcaggattgggaattctgggtgtggaggggttttcgttgacttgggtgacttgaagtggctggtggagcagcctgtggggttcggcgttggcggtggtttgggaaacatgcagcaactgaccctcgcggaggcgggcagggcggcggtagccgagatagggaggttggtgagcaagttcggtgagggtggcgctgggaggctttggttgttaggtactgctacttgtgagacttacttgaggtgtcaggtttatcatcctaccatggaaaatgattgggatcttcaggcagtgccaattacctccagagcacctctccctggaatctttcccaggcttgggaccaatggtattcttggtacttcgctcgagtctttgttgccgttaaagaccttgtccactacaacaatcccttcactgaggcgtgcttctgagaacatagatccttctgcagtatcaatttgttgcccacaatgtatgcagagctgcgagcaagaagtagcagaaatgttggaagaaactaagaaatcagatactgagctcaaatcagaggcagctaaaccgtcccttccacagtggttacagaatgctaaaactaataatgataacggcaaagtaatggatcaggctcagaaccaagaagtgaatgtgaagaagaggactaaagaaatacagaagaaatggcacgattcctgtttgagtttgcatcctaaatttcatcagctaaatgtgagcacagagacacttgttccaactcctttgtcaatgactggcctatacaatatgaatttactggggcgccaattccaacccaagatactgcggaataaaaatctcggaacctctttgcaattgagctcaaatccaacgccaatccacccaccagagcatgcggtgagcccaaagcaaatgcctgtaacaaccgacctggtccttgggcaaacaaagccagctgatgccgttccagaagaaacacacaaagaaggcattaatgacttcttgagctgcctctcttccgagtcacaagacaagttcgatgaattacagagcaaaaagctgattgatgcggactctttcaagaagctcttgaaaggcctgacagaaaaggtgtggtggcagcaggatgcagcatcagcagtggccagcacagtaacacaatgcaaactgggtaatggaaaaagacgctccaagggtgacacgtggttactgttcgtgggtcctgacagaattggcaagaagaaaatggcagcagctctttctgagctggcatctgggtccaacccaataataatacccctggcgcaacgccgtggggatgcaggagactctgatgcccctcatctccgtggaaaaacagcacttgatcgaatagcagaggccataagaaggaacccactttctgtcattgtgcttgaggacattgatgaagccaacatccttcttcgtgggagcataagaagagccatggaacaaggccggttcccggattcccacggccgtgaaatcagtcttggaaatgtcatgtttatcctcactgctaattggttgccggaggacttcaggtgcctctcaaacgagtctctactggatgaagaaaagcttgaaaatttagccaaaggagggtggcaattacgcatatcagcaggtaagagagcatcaaaacgaagacctagttggctatccgatgaagacaggtccttgaagcctcgtaaagaggtgaactcaggtgtatcgtttgatcttaacgaagctgctgctgatgcagcagaggacgacaggggagatggttccctcaattcaagtgacttcacagtggaacatgaagacaactatcatgatgtaggagggtcactctcagcagtaccacgtgagctgttggattctgtggacgatgccattgtcttcaagcccttgaatttcgatctccttcgccggaatttctcgtcatccatcgcaaagaggttctcctcggtggtcgggaatggggtgtcaattgaagtgcagggagaggctcttgacaagatcaccagtggagtgtggttaggccaaaccaccattgatgagtggatggacaaagtgttggttccttgtttccaccaactgaaaaagaatttgaattcaagcacccatgaccatgactcttccatgctgtttaggctcgaagatgatggctactccgatcgccggggctcccaagagtggctacctgctactgtgagagtggtgggagaatag

SEQ ID NO: 38677 - DNA, 216 bp, Glycine max
  Peptide Sequence Number=SeqID_155455
atgagaaatggccaccctccattgtctcatggcactgccacacccacgcaaaaaaatcccaaacatgggctttgttttgacgtgttagttgatggaactggggaacgggactatttttttttgggttctttgacttccaaacatgagaaatggctgccctcattgtctcacggcactgccacacgcatgcaaaaaatcccaaacatgggtacttga

SEQ ID NO: 38678 - DNA, 1824 bp, Glycine max
  Peptide Sequence Number=SeqID_155456
atggcaatttggagtgcctatagtgttccatcactttcacaagatgttgttttcattaggccagttctagttgcaagtcatggcgaggaggaaaagggggcagaaggcattgctgctgttgattttcgaggtcaccctgtggacaagacaaaaactggaggatggctagcagcagggctcatcttaggtactgaactggcagaaagaatatgtgtaatgggcataagcatgaacttagtgacctacttggttggagttttgaatctcccttcagctgattctgccaccatagttaccaatgtcatgggaactctcaacctgcttggccttcttggtggcttcatagctgatgccaaacttggcagatacgtaactgttgccatatctgcaatcatagctgctttgggggtgtgtttgttaactgtggctacaaccattcctagcatgaggcctcctgtgtgcagcagtgtcagaaaacaacaccatgaatgcattcaggccagtggcaaacaattggctttgctatttgcggcactttacacagtagcagtgggtggtggaggaataaaatccaatgtctcaggttttggatcagatcagtttgatacaacagaccccaaggaggaaagaaggatggtgtttttcttcaacaggttctacttcttcatcagcatagggtccttgttctctgtggtggtgctggtgtatgtgcaagacaacatagggagagggtggggttatggaatttcagcagggacaatggtgattgctgttgctgttttgctttgtggcacaccattctatagattcaagaggccacaaggaagccccttaacagttatatggagagtgctgtttttggcttggaagaagaggagtcttcctgatccttcacaaccctcctttctcaatggttatcttgaagctaaggtcccacatactcagaagttcaggttccttgacaaagctgcaatcctagatgagaactgctcaaaggaggaaaacagggaaaacccttggatagtttccacagtgactcaggttgaggaggttaaaatggtaatcaagctccttcctatttggtctacatgtatcctcttctggacaatctattctcaaatgaataccttcaccattgagcaagctacattcatgaatcgaaaagttgggtctctagttgtcccagcaggatctctatcagcttttctcatcattaccattctcctctttacttccctaaatgagaaactcactgtgcccttagctcggaaactgacccacaatgcccaagggctcacaagtctccagagggttggaattggactcgttttctccagcgttgccatggcagttgctgcaattgttgagaaagaaaggagggcgaatgcagtaaaaaataataccataagcgccttttggctggtccctcaattttttctggtgggtgctggggaagcatttgcctatgttggacaactagaatttttcattagggaggcaccagagagaatgaaatctatgagcactggacttttcctatctacactatcaatgggttattttgtcagtagcttattggtggcaattgtggacaaagcaagtaagaaaagatggctaaggagcaatctgaacaagggcaggttagattacttctattggttgctcgcagtgctaggactactgaatttcatactttttcttgtattagcaatgaggcatcagtacaaagttcagcacaacataaagcctaatgacgatgcagaaaaagagcttgtgagtgcaaatgatgtgaaagttggagttgatggaaaggaagaagcataa

SEQ ID NO: 38679 - DNA, 1224 bp, Glycine max
  Peptide Sequence Number=SeqID_155457
atgcccatctgggatgcagtggtggacttccatccccaaatttttatatggctgggtgataacatttatggagacttcaaacgccctttcaaaatatttggacaggaaaggactgttggaccgtggaagaatgttccacgatttgttccttcctctgagcaggaaatgaaggctggatatgaaaaagctaagtctaatcctggctatgctcgactccaacagaatgctaaggttattggtacatgggatgatcacgattatggattaaatgatgcagggaaagaatttcatggaaaaataaccaaccaaaagttgcttcttgatttcttggatgaacctcaagatagcccacggcggaaacaggctggtgtatatgcctcatatacgtatggtcctgtaggtagagatatcaagattgtcctcttagataccagatatcacagagaccctgtaggaagtgatggaaccattttggggaattcacaatggttgtggttggagacagagctcaagggtccaccaacagctcttaccataattggatcttctattcaggttatatcaaatctttcagctaccattcatccattgttcgcaatggaatcatggggtcgttttccaaaagaaagagatcgcctttttaaattaatcgctgatagtaagagggctggagtattttttattagtggagatgttcactttggggaaatcacgagatatgattgtgctttggactatccactatatgatttaacctcaagtggggttactcaatcagttgaggaggttgtcccacctttcttgcgttcttttgtgagatttgtggcatggttgaccccatctactatgagagttaaggacgaaaattgcagatacaaatcttgtatttatggtcagccaaactttggaactattgagatagattgggactctcacccagtgactctgaaattcaaagtcagggacaaggatagtgtcacagttacaggggttgatgtttcattaacggaattacaaccatcaaattcagagattttagacagggtaaaagcagagcataataattcaaagcattgcacccttgaagttagtctgccatggatttttacacttgcttcagactttgccgacttgaaagctgcaaaagaaagcacgattgatacgcatagatatgtacacagtcagcaaaagggagcatgtgttattatctcttctcctttgtag

SEQ ID NO: 38680 - DNA, 225 bp, Glycine max
  Peptide Sequence Number=SeqID_155458
atgtcgggtttattactgccactgttgcaatatttttcccaggttgttgctgataagcgccagtactcttcaacatcttccttgcacacgttgccaacagttatcaacattaaaggtgatttctcgtgtcctcgtcaaaagaaaaacttctgttttcaaaccacgatggaacttcactccgcggaatctgtaatacgagatgcccctctgaacgctgtaagataa

SEQ ID NO: 38681 - DNA, 819 bp, Glycine max
  Peptide Sequence Number=SeqID_155459
atgacaacgcctcttcctccactggtggcggcgatatctctcgttcatctcaacatcattattgtattccgcaacctctttgacgagaatcatatccttcatcctatcggcctcgatcttgagatcaagcatgagcttttccctaacggcgtcgatccactcgttgctgacgaggaactgtggctacgtaagttcttaagcgaagaaaaacacaagaagcatagggatatacttgaagaatacaaatcaaaagcagagtactatatttgctcatgtctcaacaaaaataatgatagcaataacgtggaacgaaccccagctggattaatctatgtccggcagtggaacaacatgcaatacgtttcaacagcagcatttctgctctcaatatactctgatttccttcaaaacacaaatcaaaagctaaattgccatggcggcacagtggaccatgaagaaattcttaattttgctaagtcacaggttgattacattttggggtccaacccaatgaacatgagctatttagttgggtatggccctaactaccctaaaagggtgcaccatagaggggcatccattgtgtcatacaaaaagaataaagggttcatagggtgtactcaagggtatgataattggtatggtagccaggcacctaatcctaatgttctggttggggctttggttggagggcctgatgggaaagacaattttgaggatcgaaggaacaattttatgcagactgaggcatgcacatataatactgcaccattagttggtgtttttgcaaagttcttgcatatagaaaaccaaaaactg

SEQ ID NO: 38682 - DNA, 1047 bp, Glycine max
  Peptide Sequence Number=SeqID_155460
atggaaccacataagaaacaccattttggaacctccaacatccccatgctagtacaacattgttgtcttattagcatcttcatcttcaccttcttcactgccaccaccacccaagcttttgattatgctgatgccctttcaaagagtcttctctactttgaagcacaacgctctgggaggataccctataatcagcgtgtcacttggcgtgaccattccggcctcactgatggcctagaagaaggggtggacttggtgggagggtattatgatgcaggggatcatgtgaaattcggtttaccaatggcattcaccatcacaatgctctcatggagtgccatagagtataggcaacaaattgaagatgcaggtgaactagaacacacgttggaggcaatcaaatggggcactgattatttcatcaaagctcacactagcccaaatgtcctatgggctgaggtgggtgatggtgacactgatcattattgttggcaacgtccagaggatatgacaacttcacggcgagcatttaagatagatgagaacaatcctggttcagatctggccggagagactgcagcagccatggcagctgcttccgttgtgttcaggaaaaccaatccacattactctcagttgcttctacaccatgccctgcagttgtttgagttcggagacaagtataggggaaattatgatgctagtgtcgaagtggtaaagaactactatgcgtcggtgagtggatatatggatgagctgttgtgggctgccacgtggctgtacaaggccactaacaacaaaatgtattttgagtatgttatttccaatgcacatacctttggtggtactggttggtccatttcagaattcagctgggacgtgaaatatgctggccttcaactcatggtctctaaggtcattcattcatggagtatgcacgaattaagacataaaaatgaaaaagtgtacccaagcacaaggccatgtgcagttagtgctttagctttgcaacacagagcaattaaagtgaagtgcagagagccttaa

SEQ ID NO: 38683 - DNA, 1794 bp, Glycine max
  Peptide Sequence Number=SeqID_155461
atggcagacattacccatctccctatggaacagcttcaggaccttgaatgctgcttagactctaatcctccttgggctgaagctatcctactagcatttcaaaattatatattgatgctgggaacaagtgtgatgattccatcatggattgttcatgccatgggaggaagtgacggtgacaaggcacgggtaatacagactctgctttttgtagctggcattaacacacttctccaaacgctttttggaaccagattgcctacagtcgttggaggaggttcatctgcgtatatatatccaattgcttatatcatcactgactcatcgttgcaacaaattagtgactctcatgaaggtgtacaccagttgaaatcggcagcacagaggattataccatcttcaatgtatttcattggtcagtattggttaggagcagttagaatgggagggggagttggtgtcaaagctttccaccatgtctctcagctgcaatcaagcgacacagtgtggtgggatgttaggatccagttgaaagatatggaacttgagtcccacattggaagtatgagattttattgtgagagatttatacaaacaatgcgagcaatacaaggagctttgattgtagcatcaagtattcagataatcttgggttacagccaagtctggggactcttttcgagatttttcagtccccttggcatggcacctgtagttggattggttggattaggattatttcaacgtggattccctgtgttgggggactgtgtagaaattggtataccaatgctgttgttagtaattggtttgtcacaatatctaaagcacgtgagaccatttagagatatccctatctttgaacgttttccagtgttgatttgtgtcccatttgtttggatctatgctgttatcttgaccgccagtggagcttaccgacacaagccagacataacacaacatagctgtcgaacagacagagcaaatctgatatcaactgccccatggttcatgttcccatatcctttccaatggggtccacctacattttctgttggccattcatttgccatgatgtcagcagttattgtctcaatggtggagtcaactggtgcatacatggcggcctctcggctagcaattgctactccacctcctgcatatgtattaagtcgaggcattggttggcaggggattggcgtcttacttgatggtctttatggaacagcgattggttccactatttctgtggaaaatgtgggactccttggactaacccgagttggaagtcgcagagttgttcagatttctgctggctttatgatattcttctctattttaggaaaatttggagccgtgtttgcttctatacccttcccaatatttgctgcactgtactgtattctctttggccttgtggcttcaattggaatatcatttcttcagttcacaaacatgaactccataagaaatcttattatcattggactcacacttttccttggaatatctgttcctcaatttttcaatcaatactggactccctcgcgacgtggccttgttcatactaatgctggatggttcaatgcattcttaaataccttattctcatcacctccaacagtgggtttgatagtggcagtgtttcttgacaacactctcgaggtagaaaggtcaaagaaagatcgagggatgccatggtgggtgaagtttagaacattcaaaggagataatagaaatgaagaattctatactttgccattcaatctcaatagattcttcccacctacttga

SEQ ID NO: 38684 - DNA, 276 bp, Glycine max
  Peptide Sequence Number=SeqID_155462
atgcaagatccaaatctcaaacccacactgctgtcattgttccttcgaatgtttggttatggtggacaaatattttgtgaatatgatgcacatagaaaatgtaaccgattgcgaattactattgtgccatacagagggatcccttatgatgaatttggaaggccgagagtagacgctgctgatattaaacacggccaccattggcctccgccacaacaccaccacaaccaccatactctggtgcttggacttgccgacgtgctacttctgcggtag

SEQ ID NO: 38685 - DNA, 134 bp, Glycine max
  Peptide Sequence Number=SeqID_155463
ctttggagtttcacggctcaactttacgtcaggatcaatcaatgcaattcaacccattacttgcgaggaatttagtcaagcctgtttggctccatgtgacatgtgacgacactgacgcaagaattatgatataa

SEQ ID NO: 38686 - DNA, 417 bp, Glycine max
  Peptide Sequence Number=SeqID_155464
atggatagtgctcacgtgatagtggaaaacaaaggtagcagtaccaacatatcctttaacctcagcaaagatctcaactacttagtcttatcatactctgatgaggaaaatttgaaggaagcagcaagcgtgtatgtgactatctctctccataatgaaacaaaaatcctgagcaaaaaggaagtaacatatgtatcaattattgccatcaaaatatatcatgttgatgatgataaggtaagtgtggaatcttcaatggagtcaaagtctaaatgttggtggtcattagtttcgtttaccaccaacatgtggacttctgactccatcgaagacttcacacttacttggttgataacatacgatcttttaggagcattgtcagtattctccaagctatactgctcatgggcaccataa

SEQ ID NO: 38687 - DNA, 246 bp, Glycine max
  Peptide Sequence Number=SeqID_155465
atgttgaaaccccaaggatacatcaaagcctgggccaccgatttcgaacaggctgaggctgatgaggctatggctcatgccactacaatcgagccccgaaacttacccagtcttaaggagggccttacgcgtgatgagatgtttgcccttctcactagtcccaaggagcgttttgctaaggaaatgcaattcaatatcatggcagtaatttctcctcctacgatcctctggcggtcgctcgcttga

SEQ ID NO: 38688 - DNA, 273 bp, Glycine max
  Peptide Sequence Number=SeqID_155466
atgggacagcagagccgagacagggcagaggagagagcacacgtggtggctcaacggcacaccctgggcgagagccgaagcagacgccgtcgtggtcatgaccgtgcacgccccgctgatgcgctcacccgtgctcgaccacctccgcattcacctacacgcgtagaggcgcacacacggcaacctcgcccgcgccagaccaccccagaccggcccccaccccaccaaaaaatccaacaacacccgaccagcggaacacgtgggatcctctag

SEQ ID NO: 38689 - DNA, 267 bp, Glycine max
  Peptide Sequence Number=SeqID_155467
atgaccagcggcgcgacgggatgccgagcggcggtcgaggtgacccgttcgaccgttcgttgttgcaccccgcggccgacgggcggaagtgggtggggtcgtgctgaagctcggggtgcgtcgacaccgggtagaagtgatccaactggaaccgagccagcacgcggcgtcctcggccttgcacttctcccggtacgcgtcgcgatccttgacgaactgacgcgtcgtcttccgttcccccgccaccgctacccctctcgtgcgtga

SEQ ID NO: 38690 - DNA, 417 bp, Glycine max
  Peptide Sequence Number=SeqID_155468
atgttcttggaaagcaccatcttagacttgcccgacatgaaaccagttgtctcgtgcccttactcactacttggagaaacccctattgatggtaggactgataccaatcctgaaggactcattgctgcatatggcaagtgggcttctattgtagctgctagattaaatgttggaggcctctcttgcaaggttcttgacaaggaggtgtttcaaaagcagatgttggagaaacttatatggatttgttccgttatgcttgttggagcacctcatggaggggttttagtaggtgtcgcggacaaggaattccgcactgaattgtccagccttataacagaactggcatcagcagcatcaagtgaaaaggggttaacatttgaagaagccatggaagagcgcttatgtgcatattcctga

SEQ ID NO: 38691 - DNA, 522 bp, Glycine max
  Peptide Sequence Number=SeqID_155469
atggttaaggaggagtgtaaggaggtaagtgtctcctccaagaggttagctaagaaggaaagacattttgaaataaagacaaatattaaagaaattccccttcttagacaacctccacattttctcctttgtaaaaagactcttgttagcattgccacatctcttaggcttgagtttattcctcaagtaaaggagttgttggatgagggtttggttcgcaagagattaaatccttgtgctttgttggtgcccaaaataggtattattaggcaccaaatcccaaaaataggtggtgtgatgaatgctttgggtggtgcaacactcttttgtaaaatcactcgtgcacccaacatcttcatgatttgtgtacatagggactcgttaggtaggaataatcaacatgaaaatacagaaaaaggggttcccatgaaccctaagagaataaaggtcattcctgagtggcccgctccaccaagtgtgttgaggaaaaaagcccagagtttcaagaacctcgggatttga

SEQ ID NO: 38692 - DNA, 624 bp, Glycine max
  Peptide Sequence Number=SeqID_155470
atgacaaacgctcatgaacgcaagaagcagcctgaggtggtgcgccgcaatctactcgattgcgcggcgaaacttgctgctgaacaaggggttgcagcactttccgtgcaggcggtggcggatgcggcgggagtgaccaagggcgggctgtttcaccattttccttccaagcaggtgctgctcgaagccgtcatgactgaccttctggcggcgctggacaacgagatcgatgctctcatctcacaggatcgtgaagcttctggaagctttacgcgggcctatgtaaacgcggttttctctgatcggggcagggattcgggtcggcaatgggcagcgatctccgtttcgatggtcggcgaaccgtcgcttcgacgtatgtggaacagctggatcgagggtcgtcttgtccgtcataaagaaacggatgacggggtggtactggagatggtgcggctggctgccgacggcatctggtttgccgatctgctggctgatggatggcaaagcgggtggcgacagggcggctctgagggcccggatgatcgcccagacgaagaaggatacgtgacgatgaataccgcggtcttcacttatggcgcgcttgtcgcagccattgtctgcgag

SEQ ID NO: 38693 - DNA, 303 bp, Glycine max
  Peptide Sequence Number=SeqID_155471
atgtcgggaatgatcaaacggggaatggcgggtgcctggatttttgcactcgccttcttttgcgcgatcctctcgctccatgcgtcgccggcgcaggcgggctatgcccatttcatcatggacgccaataccggcaaggttctggccgcccgcaatgccgatgtgctgaaccaccccgcctcgctcaccaagatgatgacgctttacctgacctttgaggcgctgcatgccggcaaacttcgctgggaccagaagataaccatgtccaagaatggggcatcggtcatcccctcgaagctctat

SEQ ID NO: 38694 - DNA, 1687 bp, Glycine max
  Peptide Sequence Number=SeqID_155472
cctgtatcagcgtctgatccagtccgatccgcacaaccctatcgatctcaagccaaccctggccagcagctggcaggccggcgccgacaatcgcagcctgactttcagcctgcgcccggacgccaggttcgccagcggcaatccgctgcggccggaagacgtgatcttctcgctttcacgggtggtaaaactcaatctggagccgtcgtttatcctgacgcagctgggttggaacgcgaagaacgtggagcaacacctgagcaaggtggatgaccaccaggtaaaaatcagctggagtgaaaacgtcagcccggccttcgtgctcagcctgctgtcggcgccggtatcgtcgatcgtcgacgccaaagaggcgctggcgcaccagcagggcgacgatctggggcaccaatggttgaacagccactccgccggcagcggcccttacaaaatccgcacctatgtgccgcacgaggttgtggtgctggacgccaacccaggctcgccggaaggggcgccgacgctgaaaaccatcctgatcaaaaacgtgcccgatccggccgcgcgccgtttgctgatcgagcagggcgatgccgatatcgcgcgcaacctgggggcagaccagatggcggccctgaagggcaagccgggcgtcaaaccgttggccattccttacgcctcgctttatttcctgcagttcaacgccaaggcgtcgccggcgctcggcaatccggcgttctgggaggcggcgcgctggctgttcgattaccaaggcatcgccgacgatctgctgaaagggcagttccagagccatcaggcattcctgccggacggttatctgggtgcgctcaaggatcagccgtacagcttcaatccacagaaagccaaagaaatactggccaaagcggggctcagcaacgtcagtttccgtctggacgtcaacaaccagccgccgtacctggatatcgcccaggcgctgcaggccagttttgcccagggcggcgtgaaggtggaactggtgccgggcatcagctcgcaggtctccaccaaggtgaaagcgcttaactacgatgcgacgctgacttcctgggggccggattatttcgaccctaacaccaacgccgcagccttcgcctacaacccggaagacggcagcaagacgctggcctggcgcgccaactggcagatcccggcgctgagcaagctgacgctggccgccaccgcggaaaacgacaccgccaaacgggtggccgactaccagcaactgcaaaaacaggtgcagcaaagctcgccgttcgtcatcggcctgcaggcgcgcagcctgattgcggtgcgcgacaacctcaagggctatgtgcagggcatcaaccctgacatggtggcgggcgatcatgccagcgaagccacctacgcacaggtgcggcatgagttggggttggatcagccgttgccggtgcagttttggcgttatctggtgcacctggcgcacggcgatttgggcatttcgcgcataaccgcccagccggtgttgagcgatttgctgcgtaccttcccggcgacggtggagctggccacctgcgccattatcctcggcgccctcggcggcattacgctggcgtttctggcggtgctcaaaccgggcagctggctggataacgcggcacgtctgctgtcgctgatcggttattcg

SEQ ID NO: 38695 - DNA, 1119 bp, Glycine max
  Peptide Sequence Number=SeqID_155473
atggctgcatcctccctattcaaacttctcctatcatcaatcatgctttgcactatactgcagccatacacacatgctcttagaaaggcaaagcattctcatggtccaagtccttcacttcgcgatcttgagtcagccacaaattcccattatgatttattggcctcagtcttaggaagccacgagaaagcaaaggaagcagtcatttactcgtacaataagcacatcaatggctttgctgcactacttgaagaggaagaggcgtcagagattgaaaaaaaggcaagtgtaatttctgttttcatgagcaaagagtataaattgcacactaccagatcatgggactttcttgggctggaaaaatatggaggaattcctgcagaatccgcttggtggaacggaaactttggcgaaaatacaatcattgctaattttgattcaggcgtttggcccgaacacacaagtttcaacgacaatggatacagtccagtgccatcaaagtggcgtgggaacggggtctgtcagattgaccattttagaccttcaaacaaaacattctgtaacaggaagttgattggagcaagagtcttcagtgaagcttacgaggcacaatatggcaaacttgatcccttaaaacgcactgcacgtgactttgttggccacggtacacataccctgtcaactgctgctggtaattttgctcctggtgcaaccttctttggcaatggcaatggcactgcaaagggtggatccccgaaggctcgtgttgcggcgtacaaagtgtgttggtctacaaatgatgctggtagctgccatgaagcagatattctacaagcatttgattatgctgtatacgatggtgttgatgtcatttctgcctctgtgggtggctccaatccttatattgaagctttcttcacagatggggtttccataggggcattccatgcagttactagaaatatagtcgtggtttgctctgctggcaatgatggaccagcacctagaactgtcacaaatgtggcaccctggtccttcacagttgctgctagtacaatagacagggattttctcagcaacatttctcttggtaacaaacattacctaaaggtaacatga

SEQ ID NO: 38696 - DNA, 749 bp, Glycine max
  Peptide Sequence Number=SeqID_155474
gttcagtagtggcgagggaggacgagaaatcgtattcccgggaggttgtaacagtgttaacgcgagattttctgcaaaaagcggattgcaaaaccgcctttggcgctattgaggagtcgctgttgctgacgcctgaacagcgcgcagcctcgttggcgtgcacattatcgcgccggccggatcacagcccggtatgggtattcggttacggttcgctgatgtggaatccggttttcgaatcggaagaagtgcggccagccatactgcagggctggcatcgggcgttctgcatgcgtttgaccgccgggcgcggcacgctgcatcagccggggcgcatgctggcgctgaaagagggcggccagaccaccggattggccttccgtctgccggaaagcacgctgcgcgaagagctggagttgctgtggaagcgcgagatgatcaccgattgctacgtgccgacctggtgtgagctgcagctggagggcggtgaggccgtcacggcgctggtgttcgtgatgaacccgcagcatccgttgtttgaagcagacaccagccaccaggtgatcgcgccattgatcgccagcgccagcggcccgctgggcaccaacgcgcaatacctgtttgcgctggataacgagctgaagcaccacggcatgcaggatgattgcatcggcgatctggtgcgttacgtgcagcaatggttgcagcagaaccgccccggcgctttcggggccgaggccacggcctga

SEQ ID NO: 38697 - DNA, 567 bp, Glycine max
  Peptide Sequence Number=SeqID_155475
atggatatcccacatatcataaatttttctaaaattggctcccaggatttgggatatattactgttgcagaaacacaaaaagacactccttttgaaataaagagagtttactggacttattatactcctcaggatgttataagaggaggtcatgcacataaagaacttcaacaagtgatatttgcaacctctggtgaaggaacctacatatggcaattctgcgtcattcttaaagacgcagaaattggaagtaactgtaatatcaattgtcagcccggtgttcagatctgggatggaattacaatagaagatgatgtttttattggccctaatgcaactttcacgaatgacctgtttccaaaatccaaaaataagcactttaaactggaacatacattgataaaaaaaggagcatccattggtgcaaacgcaaccatactggcgggtgtgacaattggagaaaattcgcttatcggagcagggagtgttgttaccaaaaacattcctgccaatgaaatatgggttggaaatccagcaaaatttttaaagaaaaatactcatgattaa

SEQ ID NO: 38698 - DNA, 517 bp, Glycine max
  Peptide Sequence Number=SeqID_155476
agtgtttgtggtcaatggcaagcaaagtggcggtacacttctagctgagccttatcctataccgggtgcaaatgtggatgtcagtcaggataaggatattgatgaacacgaatggtttgaaaaaggaggttccgacactaacaatagcaggaaacttgttgcttacatgactgtagcaagaacatatttaggaataaagcctgctccaattgtggctggattctcatccaggggtcccaatgcagtgcaaccattgatactcaagcctgacataattgcccctggtgtcaacatattggcggctaattcactagcggcaagtccatcaaatcaaccatcagatagacgtcgtgttcctttcaatatacaacagggaacttctatgtcttgccctcatgttgctggtgtcgtaggtcttctcaaaacacttcatcctgattggagtccagcagccattaaatcagccattatgactactgcatttcgcttaacggaattagcagatgtgacaaactga

SEQ ID NO: 38699 - DNA, 411 bp, Glycine max
  misc_feature (18)..(18): n is a, c, g, or t
  misc_feature (92)..(92): n is a, c, g, or t
  Peptide Sequence Number=SeqID_155477
atggaccctggacttgtntatgatatgagaacaagggattacttgaacttcatatgtgcccatgatcacaaccaatattttctcaaatactntcatagaagctcttacaattgtccaaagtcttacaacatcgaaaatctcaactatccttcgatcacagtagcaaatcgagggatgaaacctataagtgttactcgtacagttaccaatgtggggactccaaatagcacatatgttgtgaaagctaacgtacttgaaggatttaaggttcttgttcaaccaagttcattggctttcaagacaattggagaaaagaagagctttcgtgttattcttgagggaaccagttggcctagtcatggttttccagtatttgggaacttgtcttggacagatggtagaaactcttag

SEQ ID NO: 38700 - DNA, 3017 bp, Glycine max
  Peptide Sequence Number=SeqID_155478
cctccattactcccatcttttcacattttcttcttttgcctttgctgccatcactgctaatgaagttgcagaaaaccaagagatggaagcaagtgaaagtgctctacttgagtggagagagagtcttgacaaccaaagccaagcttctctgtcttcatggaccagtggtgtcagtccttgcaggtggaaaggaatcgtttgtgacgaatccatctctgtgaccgctataaatgttacaaatcttgggctacaaggtactcttcacactctcaacttctcatcctttcccaagctgctaactctggatattagtcacaacagttttagtggaactattcctcagcaaattgctaacttgtccagtgtttctcaattgataatgagtgctaataattttagtggtccaatccccatttccatgatgaagttggctagcttgtcaattctaaacttggaatacaataaactttctggctctattcctgaggagattggagaattccagaacttgaagagtctaatacttcaatggaatcaactttctggtaccattcctccaacaattggaaggttgtccaaccttgttagagttgacttaacagagaactcaatctctggtacaatccccacttcaattacaaacttgacaaatttagaactccttcagttctcaaacaatagactttctggctccattccatcctccataggagacttggtcaatttgactgtttttgaaatcgatgataatagaatttcaggttcaattccttccaatattggaaacttgacaaagctggtcagtatggtcattgccattaacatgatttctggatcaattcctacctccatcggaaacttggtcaatctacagttctttgtcctttatgagaacaatatctccggagttattccttccacctttggaaatttgacaaacctcgaggttttcagtgtctttaataacaaacttgaaggcagattaacaccagcattgaataacattaccaatttaaatatctttcgaccagccatcaatagtttcactggccccttgccacaacaaatttgccttggtgggctacttgaaagttttactgctgaaagtaattatttcacgggtccagttccaaaaagcctgaaaaattgttcccgtctttacagactcaaactaaatgaaaaccagttgaccggaaatatatcagatgtttttggtgtatatccagagttggactacgttgatctgagtagcaataacttttatggccacatttcaccaaactgggcaaagtgtcctaatctcacaagccttaagatgtccaacaacaatttatctggtggtatacccccagaactcggccaggcacccaacttacgagtactagtcttgtcttcaaatcatctaacaggaaaatttccaaaagaacttgggaacttgaccgctttgttggagttatcaataggcgacaatgaactttctggcaacattcctgccgaaatagcagcctggtccggcattacacgtctcgagcttgcagcaaataatttaggtggcccggttccaaaacaggtgggagagttgcgcaagttactttacttgaacttgagcaagaatgaattcacagaaagcattccatcagaatttagccaattgcaatctcttcaagatctcgatcttagttgtaatttgctaaatggagaaataccagcagcacttgcgagtatgcaaagattggaaacactaaacctctcacacaacaatctctcaggagccattcctgattttcagaatagcttgttaaatgttgacatatctaacaaccaattggagggctcaattcctagcattccagcctttcttaatgcttcatttgatgcattgaaaaataataaaggcctgtgtggaaaagcctccagtttggtgccttgccacaccccacctcatgataaaatgaaaagaaatgtcatcatgctggcattactcctttctttcggcgctctatttctattattattggtggttggaatttctttatgtatttactaccgaagagcaacaaaggccaaaaaggaggaggataaagaagaaaaaagtcaggatcattattccctttggatttatgatggaaaaatagagtataaagatatcattgaagccacagaggggtttgatgacaaatatctcgttggagaaggaggaactgcatctgtttataaggcaaaattacccgcaggacagattgttgctgtgaaaaaacttcatgctgcacccaacgaggaaacacccgattcaaaagctttttcaactgaggttaaagccttggccgaaatcaagcaccgtaacattgtgaagtcactaggatattgtttacatccacgtttttcctttttgatttatgagttcctagagggtggtagcttggataaagtactaaccgatgatacgcgtgcaacaatgtttgattgggaaaggagggtgaaggttgttaaaggtgtggcaagtgctttgtaccatatgcatcatggttgctttcctcctattgttcaccgtgacatatcaagtaagaatgttcttatagatttggattatgaagcccacatctctgacttcggaacagctaaaattctgaatcctgattcacaaaatataaccgcgtttgcaggcacatatgggtattctgcaccagagcttgcttatactatggaagtgaatgagaaatgtgatgtcttcagttttggagtgctttgtttggaaataataatgggaaagcatccaggggatctcatttcttcattgttttcatcatctgcgtctaatttgctattaatggatgtgttggaccagcgactacctcatccagtgaagccaattgttgaacaagtgatcttgattgcaaaattaacatttgcttgcttaagtgagaatccacgctttcgcccaagtatggaacaagtgcataacgagtttgtgatgccaaaatcatcttctttggatccactccccatgatcacacttg

SEQ ID NO: 38701 - DNA, 330 bp, Glycine max
  Peptide Sequence Number=SeqID_155479
atggctgctatctacacccctctgtatggtattgctatcagggagttgctacgtgcacccagcattattgctggggcacccaacaaacagcgaagtggcgaaaatgcccttccgggaaacacgtatccggaagagccttattccggaatcattccggaagactctgcttccgaaaaccttccggaagaaccttcttccggaagaagaaatattgtttccggaagtactcagacactatttccggaagaacgtcatccgaaatttttccggaagaagcttcttccagaagatatacttttacttccggaagaagggtcttccagaagttag

SEQ ID NO: 38702 - DNA, 984 bp, Glycine max
  Peptide Sequence Number=SeqID_155480
atggcaaaaaaacctgtgaaatactctctgacaatatgcgctgaattcgagttagataagcaggttgacgcgtttactgagtcagtgttcaaaggaaaccctgcagcagtgtgtttcttagaagagaagagggacaaaaagtggttgcaaggagtagctgcagagttcaatctatctgtgacatgttacttaactcgcatcaccgagtcccatggaacaacctcttatcctcgttttgatctcagatggttcactcctgttagtgagattaacctttgtggacatgcgaccttagctgctgcgcacacaatattttcatctggtttggtggacaccgatgttgtcgaatttgtggctatatctggaatattaactgccaaaaagatcccagcgatcaatatcactagtgcctcagacttgcaaaagggtgaagctcaggatgggttttatgttgaattgaatttccctgctgatcctgttgtagaattcaattttgatgagacttcacaaatttctggggcattgaacggtgcttccataattgatataaagaggacacaagatggaggcgacttagttgttgtggtcacttccggaagagttgtcgaggaactacaaccacaacttgatgcaatagttaaatgtcctggaagggggttaattgttacggggattgctcctccaggctcagaatttgacttctgtagtcgattcttctgcccaaaacttggagtcaatgaggatcctgtttgtgggggtgcacattgtgcattggcaccctactggagcaagaagctagggaagtgtgatttcaaagcttatcaggcatcagccagagggggagttctcaatgttcatcttgatgagcagaaccaaagggtgcttttgcgtgggaaggctgttaaagtgatggaagggccctgcgtctggtctcatcagttcaaatcaatgccaaattgggagaaaatgatctatggttattag

SEQ ID NO: 38703 - DNA, 1699 bp, Glycine max
  Peptide Sequence Number=SeqID_155481
atggcaacaacaaccatagaggagacaaaaaatgttgctatcatctttggggtcactggacttgttgggagagagttggctaggaggcttcttcttttagaaccttcttggaagaaggtttatggcatagctagaaaccccgaaacactaccaacccttattataagcccttgttaccatttcatctcttgcaatatgctgaaccctttggagactcagaagaagctgtcttgcttgcaagatgtgactcatatgttttgggtcacatgggccagccagttcccatcagagacacaagaaagttgtgagcagaacaaggccatgatgtgcaatgctttgaatactatgctctcagtagctaagaatctgaagcatgtttcccttcagacaggaaccaagcactatatatcactgcatcccccctttgatgaagagaagctccaattttactactaccatgaagagtttcccagaatgagcaaatcccttaatttctactatgccttagaagatttgctcatggagaaactgagtggtaaggtgtcttggtctgtgcataggcctggtttattgtttggtagttctgttaggtcattttataacttcatggggagcttgtgtgtttatggtgctatttgtaaacatttgaggctcccttttgtgtttggagggacaaggaagtgttgggaggagtcatatattgatggatcagatgcaagacttgtagctgatcaacatatttgggcagcaaaaaacagtgacatgatttccaccaatggccaagccttcaactcaatcaatggcccaagtttcacttggaaggagatttggcctattattgggaagaaattggaagtgcaagttcctcaagaaatgcttgtggagagcttttggttttcaaaagccatggctgggaaggaggatgtttgggaagagattgtggaggaaaatgggctggttcacacaagtgttgagaatttggccaattgggaatttttagatgcattgtttcgtttccctttgaaactcttggggagcagagataaagttgatggacttggttttggtgcaagattggcgttgttggaggttctccgaccaagagacacaacaacgacatgtgaaatacggggtacattcaagcattgggtggtaggcgacgatacctatacaccggagcaccttgaaggggacaaagtagtgccgattgaacttttaggagccccgtctagccatggagtgatgctggtatggacaaagtttcaagagctcccaatcaccctcttgaaacaagatatcacgccaatgattgttggattgggcaaccatccgtttccttgtgctgcgaaacccgacggtgagcggccatacaaagctagggagggcatcatgccgatggcactatgcttggtggagttataccaatactttgccaagtgtaggatgttgtaccatcgtttcggaaaatccccagtgaagcaccggagagctcgtgccagaactggctcagaaaaaccttgtcacgattggaaacaatggaatagggtatcccatggaggcgacacacttccatccaaaatctggcggccaagcttgcagttttgggaaatgggtagattggtaacaaagtccatgcagatgtcgtgtgaaaccttcttcggtgatggtaaaggctgtaacaacccgggcttcttagcag

SEQ ID NO: 38704 - DNA, 555 bp, Glycine max
  Peptide Sequence Number=SeqID_155482
atggtgaagagtgtgttctcaacaatgattggaagtgttacctccgtcaaggttgaaggtgaaggagtaaaagtgactgtgacgagtacaattagtcctgatctgtttgctgcgattattggacaaaccgtgaaagaaaattcgcataataaagacaagacacgagcatcaaatgcaaaccaggaagaaaataataataataacactgacgtgtcatatggtcagaacatattcaaaggtcatcgagtagaaggaaccataaacctacaagaattgattaaaaccaataaaatgaaacaactggaacttgtgcaaaatctgagaatcaaattcaaccacgaaaaaaaggatgatgatgatgatgaagcttcccaaaaggaaatcccaccaccaccaccaccaccaccaccggagccacaggaattccctgacccaattgatcctcccagtgttccttcttctcctagtgaatgtaattaccagttaccaacagcaaagaccattaatgtcagtagttcgtcaaaacgcatcataatgcgaggtcataataagtag

SEQ ID NO: 38705 - DNA, 765 bp, Glycine max
  Peptide Sequence Number=SeqID_155483
atggctaagaaaatctgtgaagtactatgtggtatgtttctcggtgaacttcaatggaaacctgcagcagtgtgtttcttagaagaggagagggatgaagagtggttgcaagctgttgccaccgagttcaatgtccctgttaaactttgtggccatgccacgttagcggctgcacacacactattttcgtatggtttggtgaatttcaatattattgagttttttactgcatctggggtactaactaccaaaaagatcccaccgatcaataactgtaccagtggctcaaacttgcaaaatggggtggctcgggatggattttatattgagttagatcttcctgctcaccctatcatagaattcaactgtgatgagtcttcacaaatttccggggcattgaatggtgcttccattgttgatataaagaggacactaattggagatgacatacttgttgttgtcacatctggagaaaatgtgacagaagtacagccacaatttgatgcaataagtaaatgtcctggaagggggatcattgtttcggggattgctcctccagggtccggatttgacttctatagtcgattcttctgcccgaaagatggagtcaatgaggatcatgtgtgtgggagtgcacattgtgccttggcatcctactggagcaagaagctggggaagtgtgatttcaatgcttatcagggtgtgttctggtttagtcctgttcctagcactgaagaatatgaagttgtgaactgtcttggttga

SEQ ID NO: 38706 - DNA, 345 bp, Glycine max
  Peptide Sequence Number=SeqID_155484
atggctatcaaaaactttgtggtggacgcattccctgagttaccattcaaagggaaccctgcggcagtgtgtttcttagaggaagaggaagagaggaaccaccactattctttcccaagccacgatttcgtgaatacgaatttgcggaaaaatatatatacctcagaggagtcggggaaggagagggagaagggttgggtgcaattggaaagtgaaggaggaaggttgggaaagagaggagtaggggaagggaataagaggaagagagaagatgttgggaggagaagctttgggggaagagtggactgttggattttcttagactttcttcccataaaggtttaa

SEQ ID NO: 38707 - DNA, 1215 bp, Glycine max
  Peptide Sequence Number=SeqID_155485
atgtccaaaggcaccagtctttacagaaatgagattaccatgttaccaaaacattgtatgccccattattggccaattcacaggattattgttatggcagttgcacctgttgagagtataacctcgctgagtagtgatctcttctatgacatattacgacgtcttgatggcccaacgctggctagtgcagcttgcacttgtgcatcattttcttccatctctaaagaagagagtttatgggaaaatgtgtgttcttctgtgtggccttcaaccaatagggaagatgtcaaaagtttaatatcttctatcggtggatacagaaaattctatgcagattgttttcctcttattgtaaacaaggaggtaggagagtatcaatggaacaacaatcttcagtaccctgatgattggactgaggccgaatattatggggacatgattgaatttgaaagcatctctccatcagattttgtttccattgtggatatcaggtttaaggagaaaccaatctgctccaaagttctatggggaattccgaatgcaaatggctatgatgagtggttctttaactgtcctttccggattgatcttctcagttgtgcagatagagatgataataatgatggtgtggttaccctttcagtatctgatggattgccaccaattacatccatggaaagggaaaagaaagatgggaaactatggcaggagcttcgtgatggtctcttgcttagttggatcatagtaaacaagaaaataaagcaatctgctaatcttgcaagctggagccctttagatggacaaaggcattggcctacagacaaggattttgtctttcgttttggatctgttctctctgccaagggcattcttccttctgaagcagtgcagtgcatcctcattatgaagtttagagtggttcacattgaagaagagggtgttcaaacaaatcttaaggcaacagagctgagtatgcagttggaagacatggaatgtgctcatgttaatgggaggaacagtttgcttattcttaaggaagcacttagctgccgaaggagcaacaattttagtgaagtacttgaatcctgtcttatgtactcaaaagtgcaaaataagttgaaagaggagaagattaaaaacgaaagtaggttggacacactttgcattttaagtggcattgttgctgtaatgacattttggtactatgttttgtga

SEQ ID NO: 38708 - DNA, 450 bp, Glycine max
  Peptide Sequence Number=SeqID_155486
atggaggccatgaaagagcaaatgatcacaatgatggaagccatgatgagtatgagaaaattggtggaggccaacatggctacagtcgttgtcacaagtactgccactgaggtggacccgactcacccatctggcctcaagcaagttcagagcaagcattccttccaaccatatggcttgcctcctaactatacaccacctaatgttgcacacgctctcgaggagaatgtcaacaactccactcccataaccattgagagccaacaaccccggtctggtcatgcaccagttcctcaacccatgggggaaacacatgaaataccccaggaccacgctctggccgacttagagccttacctcaaatatgccactgaggggcaagcatttggtggcatacccctgccaaacacctttggggaccctcagcatcgcccgcaatcacaactgtaa

SEQ ID NO: 38709 - DNA, 1020 bp, Glycine max
  Peptide Sequence Number=SeqID_155487
atggaatcaactcatgtaatatccattacaaatggagaagagaatgttgctccaacgaagaatgctaaaacattccaattttcactttcacttccacccgttttttcccgtcttagagaaaacaaattaatccagttctctcttttccccatcacttcctatctgaggcaaaagaaagacactaaaaaaattatccacagcatcaaagttggaatctcccttgtattgatttcactcctgtacttcgtggatcctctctatgagcaagttggagataatgctatatgggctatcatgactgttgttgtcacttttgaattttctgcgggagctacgctaggaaaaggtttaaatcgcggaatgggaaccatattaggaggtggactgggttgcatagccgcagttttggctcaaaacgttggcggaggaattggcaactcgattataattggtacttctgtatttatctttggaacaattgcgacatattgtcgcctattccctagtgtgaagaagagatacgattacggagtgatgatctttatcctcacttttaatttggttgtggtgtctggtgtgcgcattcaagatcagaaagtttggaaaatagcaagtgaacgtcttttaacaattgtcatgggtttcgttgtgtgcatttgtgtgagcttcttggtcttccccttgtgggccagcgatgaacttcatgattccactgtctctagattccaacaccttgccaatgcattacaaggctgcttggaggaatatgtcaaatttgctactgaaaaagaaaataagaaggctggtgctagcttcactgtttgcaagtcgctgttggactccaaatcaaaggatgagatgctggcaaatttcgcaaaatgggaaccatggcatggaaaatttggatttttctatccatgggagaagtacctaaagattggagaggttcttcgagaacttgctgcaattattcttgctctgggaggttgcctccaagcctcaactacggtagttaaataa

SEQ ID NO: 38710 - DNA, 1872 bp, Glycine max
  Peptide Sequence Number=SeqID_155488
atgactgcgccactagacactggccttcaaagcatgttgcaggctgcggtgcaatctgttcactggacttacagcctcttctggcaactttgtccacagcaagtgattctggtttggggtgatggttactacaatggagcaattaagacacggaagacggtgcaaccaatggaggtgagtgctgaggaggcttctctccaaagaagtcagcaacttagagaactttatgaatcattgtccgtcggagagacaaatccgccgactcgccggccttgtgctgccttgtcgccggaggacttaacagaatctgaatggttctatttgatgtgtgtctcattctcctttcctcctggtgttgggttgcctggaaaggcatatgccaggaggcagcatctatggctcactggtgcaaacgaggtggacagcaaaacattttcacgagctattctagccaagaccgtggtgtgcattcctttattggatggcgtcgttgaatttgggacaacagataaggttcaagaagatcttagcttcatccaacacgtgaagacttttttcatagaccatctcatccctctcaggccaaagcctgccctatcggagcactcaacctccaaccctacctcctccgaccacatccccacagtcatgtacaccatggtggacccacctgccgccaagtgcaacctaaatgatgacatggatgaggatattgaagaggaagaggaggaggaagaagaggacgaggtggaatccggttccgaagatgaaactggagacggtattgcctgccaaactttgagaccatcaacggtggcagagcccagcgagctgatgcagctggagatgccagaggacattcgactcgggtcgccgaacgatggatcaaacaacctggactcagactttcatttgcttgcggtgagccagggtggcaatgaggcaaggcaggctgagtcaactcgaaggtggagctcaagtcaagaacccatgcaagttcaactaccgacttcagaagacttgacccaagaggacactcactactctcaaacggtgtccaacatcctccaaaaccagaccacacggtggctcgcctcaccctcctccattggctacaacacatactccacgcattcggcattcgcaaaatggagcagccgcgccagccaccacttccacccggcggcggacggcaccagccagtggctcctcaagtacatcctcttcacggtcccgcacctccacgccaagaaccccggcgagagttctccccataccgcggcggacaccaagctccgcggcaaggggacgccgcaggacgagctcagtgcgaaccacgtgctggccgagcgccgccgccgcgagaagctgaatgagaggttcataatcctgcggtcgctggtccccttcgtgaccaaaatggacaaggcgtcgatattgggagacaccatcgagtacgtgaagcagttgcggcggaagatccaggagctcgaggcgcgtaaccgcttaacggaggagcgttccaagctcccagaggtagcagttcagaggacgagtagcagttcgagcaaggagcaacagaggagtggggtgacgatgatggaaaagaggaaggtgaggatcgtggaaggggtagcggcgaaggcaaaggcagtggaagttgaggccaccacgtcggtgcaagtttcgatcatagagagcgacgcgctgttggagattgagtgtcgtcacagagaagggttacttctggacgtgatgcagatgctgagggaggtgaggatagaggttataggggtgcagtcttcgcttaacaatggggtgttcgtggcggagttgagggctaaggtgaaggagcatgcaaacgggaagaag

SEQ ID NO: 38711 - DNA, 846 bp, Glycine max
  Peptide Sequence Number=SeqID_155489
atgaattacacgatcaaacatatatacactctagatgctagtcctaggaacaaagactatactttggtgaaggtgcctgtgattgtggttggttgcaagcttgacctgcgggatgaaaaccagctagtgagcttagagagtctcaccactcatataatgaaacatttcattgaagttgtcacctgtgttgagtgctctgcagctacactttatcaggggtgcggtttcattttgtttcttgatattgtgggaaattgtagacaaatgtggcctatgttgtcacaattgcagtggtggacacccctaaaacctctcaacattgtgggtgaaattgcagacgcaaacgtccctcaagttttttattttgcccaaaaagaagtactgcatccagtagatccattgtttgattataaaaggcatgctttaacagatccatgtgtgagggcattaagaagaatatttgttctttgtgatcatgacatggatggtgccctcaatgatgaagaactaaacgagtttctggttagatgcttcagtgcaccattgcagccttctgaaatagcagaagtcaaaacaattgtagagcagaaagtacctgaaggagtcaactctattggtcttacatttccagggtttatttatgtccataatatgtttctaaagaaagggcaaacagagacattgtgggctgttctaagaaagtttggatacgataatgatttaaaactctgggatgatttccttccagttccatctaagcaggcttctgatcaggtcgtgctttttttttctttcttggttttggctgtttatgaagttccattttggtcttcttgtttgatttag

SEQ ID NO: 38712 - DNA, 585 bp, Glycine max
  Peptide Sequence Number=SeqID_155490
atggctgctattcatgatgatggtcaagttggttttgaagaaggaatgctatggttaccctctcatgttctggacgaggcatgcgacactaaggtatgtttgaggaaccgccaccaaaagctccaaaaccatcagcaaatgcatcagaagcgtcatcataaatcacctggagaaccaaaatcacagtactcaaaatctgcgtatcaaaggccaaaacttgccaccaatggtggacctggaatgcgagctattttcttaggatccgggcatagatcatgtggcactggcgtatttttaccccaaagagcaggcacaaactttcaaccaagcaagaggccagcctgtgctcctatcctccttccagctcgagttgttcaagctctaaatcttaatgtgcaagcattaggtgtgctgatttcacccccgcaagttcagagatataacccgagatgcagagaagcatacaataataattcaacagaaaagaaaagtgatcagaaagatgcgtccaagcaatgtcgttttatttctcaaaacgaatgttcttctccagagatatttctcccaaaggaatggacttactag

SEQ ID NO: 38713 - DNA, 219 bp, Glycine max
  Peptide Sequence Number=SeqID_155491
atggccaagtgcattggacgtgccgtcaaaccacacaatctatttgtccctatcttgatcctctacttcctcctcgaacaaggtcatgatgtcctcatccaggaattatggatgcataggttgcagaacctgccaccgagcgatccgtctggtgagagcgggcttttcaaatatatacttaactgggtccatgatcgaggccgtatccaaataaaataa

SEQ ID NO: 38714 - DNA, 171 bp, Glycine max
  Peptide Sequence Number=SeqID_155492
atgaacgaagaacggacgaagaacagtgtaggaatcaatcacggaagcgattcggaagcgccttggcctcatgaagctgaaccccttcctttagccccctcatgcctatttataggaaatgaggggaggaggttgaacagtagcttacccaggcgagctcaccttgcctaa

SEQ ID NO: 38715 - DNA, 468 bp, Glycine max
  Peptide Sequence Number=SeqID_155493
atgtatggaataaatgttccaacaatgaatgctttctatgtaaatccatggaacgatgctccatataaggatgcagcagagaagactgatatgggctatatctctctgaacggatttctgtctcagacattacttgaaccacaacgtagcttggctaatttgattgacattggatataacggcaatcctactgcagcactccgtgtcactcatagaagatcagtagatcacaagaagcaaacaacagaaaaaaatgtgttccaatgctatgtttttggttctaaacatgctgggaaatctgctttgctgtattcattacctgggaaggtaactaggaaaattctcatattgcacgagatacctgaggatggactattgcaatttttgtcaaatcaggattgtttggctgcatgtgatgtagctgttttctgcgggacatgtattttttatattgcactggttgtttaa

SEQ ID NO: 38716 - DNA, 270 bp, Glycine max
  Peptide Sequence Number=SeqID_155494
atggcattaggggtcatagcagctcgcccaggtgagttgtcgcttcaacctgaagtgagccagaggctagcttgggcaagccaagtgtcgcaacctacccttcggtgggagggtgacacagggctcacgggtgcgtcttccaagaaaggaaaatgcgcggagtcgccaccaacgtttattcgaggaaaacgtcggaaaaaccagaaaaggtggtctacgaaaagtgtgaaaaggttcgggagttgtttttatgcacggggaaggtattag

SEQ ID NO: 38717 - DNA, 411 bp, Glycine max
  Peptide Sequence Number=SeqID_155495
atgattatgaggggccaagacatttatagtagccaagatgaagctactacttcaccttcctctagtggaagtgaagaagcaaaaagggaagaatatagtgaagaaatctacccccaagaagaaggacaacctttaatggttaaggaggagtgtaaggaggtaagtgtctcctccaagagattagctaagaaggaaagtcattttgcaataaagacaaacattaaaaaaacttcccctcttagacaatctccacatcttctcctttgtaaaaagacaattgttagcaccgccacacctattgggcttgaggttattcctcaagtaaaagagttgttggatgagggtttggttcgtaagagcttaaatccttgggctctgttggtgcccacaataggtattattaggcactga

SEQ ID NO: 38718 - DNA, 192 bp, Glycine max
  Peptide Sequence Number=SeqID_155496
gttactcaggcactgggagtattcacaacaccctcatttgagcattccagaactcagactgcacagagaaagaagcaacaccaccagcttcttcaccactctcttatttttgccttagttggggctgctatggcagttgccggtttgacagcttgtcgtgtgcgtgcagtgaagaagaatactactgcttaa

SEQ ID NO: 38719 - DNA, 843 bp, Glycine max
  Peptide Sequence Number=SeqID_155497
atgtcttactcaagtatctgtcaagggttgcaatcaagtgtcgaaccctggctcatggaaccacgtgtgctaaaactcaagctggctccaccagggtccaattccaacacttccacacactctccagtgactccaccacccaacaacacaaacaatgaacatggaaacaaaaaccactctgaacaaggtggctgcaacaactggagtttccttcaatcactctccaacatttctcattgcaaggagccacaaactgagaatgtctacgtccacccttctgttaagcgctcctcttcaatgctcagtgcaaagagcttggaactatgcaccgaaagtttaggctgcgaaactggtagcaatgccagtgataactctgatgacttgtctttattttcacttgaaagttgccctagtttaaggagcaacaacacttcagtaactaacaaaaattctgagtctagaagattgaaccgaggaagcaattttccacctcctttgacttcaatggggggggtcagagttaggtctcatcgtgaagatggtaagcttatcttggaagctgtaacttcctcttctccccaaccctattttcaagccgagcgcggtgacggaaggcttaggcttcgacttttcgagagtgtggcctcagcttatgaagatgaagccttgaaccaagaagaagatgctgatgtagaagaagatttggaagagtacgttggaaatgctgaggatgagattggtatgacaaagttagtgaggccaagcaggtgcaaggaaagtgggaaaagagtcatttttggcgatggatactttgagcatccccctctttctctttgtctctga

SEQ ID NO: 38720 - DNA, 653 bp, Glycine max
  Peptide Sequence Number=SeqID_155498
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaacagaaatggtgaggagaaatctgtcaccatttctgttgatgatggaattcgacctggcacaacagtgtctgatctaggaaggctcaaacctgtgttcaagaaagacggaagcaccactgctggtaattctagccaggtgaccgatggggcttcagctgttctgctgatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 38721 - DNA, 547 bp, Glycine max
  Peptide Sequence Number=SeqID_155499
atggcgagggtactagtcataaggacccttttatctagaatcttagatgagttgagttccctcaagttatggaaagaaaaactagaaagaaaagtaaaaggaaaagagagggtaaaaataaatcaagatgagagggaacaaataagggaagaagaaagaaggaaaataccaaaagagttaagaaaagaaaaacatgcctcctatagtagtcataactcttgcaagagcctaagtgaagaaattcgtgactattatgaaggaaggcatagatcacatcttagacctcactcccataggagagaaaatgaaagaaagcctcaaaaggctaatattaacctcccatacttccatgggaaggacaatgtagaggcttacttagattgggaaataagggtaaagcaaaaacgtaaaagaaagtctactttaaaatcatatggctctcactcttatccaaagaatgaccaaggtctaggcatcttaggggcagcaccttctaagcccaaagatgataaggggaagacaatagaaaagcaaccccctgaggcta

SEQ ID NO: 38722 - DNA, 250 bp, Glycine max
  Peptide Sequence Number=SeqID_155500
atgtttgccaccactttcaacactcaaccatctgcatataatctagcaccatcgagttcttgttatcgttcatcattacctactcaaatacgtgacaagagtcacgaagatgaggacgaggatgaggataacgacaataacaacgatgacgataatgatggtgaaggtgatgatgatgatgacaaaggtggtcatcatgtttctcaacaacaatggacaattacatgtgagcatcctagaacaagaggag

SEQ ID NO: 38723 - DNA, 552 bp, Glycine max
  Peptide Sequence Number=SeqID_155501
atggcaacaagtcaacaagaagatgctacagtatcaacaacaggggtacaccaaccaaacaaagaggtgcaattagcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcatgtgggggatatgatttgctggagaagaaattgttagaccagaaacgaaaaaggatacaagaggaagcattgttgagtgaaaatgcagcaagccttgatgaacccccatctccaataaaaagacatgttaagtggaagattgctcggaccagggctgttggcaatatgacatctgagtccgcacaggagattgcagataaaata

SEQ ID NO: 38724 - DNA, 267 bp, Glycine max
  Peptide Sequence Number=SeqID_155502
atggcacatcaccctcccttgttctctttgaacaacctagtggatgtaccctccactataactgatccacaagagatgtaccttctcttgttctcagtcaacaacccaagtagatgtaccctctactggtaccacaaaggatgtaccctccaatgtgttaagacaaagttctcaggcgggagaagagagacacaaaaagaattcaggcggttagtccttggcgaattctttttggcaaagggagaagggaatgaaaaagatgaatag

SEQ ID NO: 38725 - DNA, 513 bp, Glycine max
  Peptide Sequence Number=SeqID_155503
atggttgttacatgtatgacacctaccatttcagggacaacaattttggatgctgtgcaggcaactgtgggagcagaaacagaagttatatatgagaaatatccgtccgagaacaccatagaacgcaatgaattctcttttgcaattgtagctattggtgaagctccatatgccgagaccttgggtgacaattcagagcttacaatccccttaaatggagcagatatcataagcctagttgctgacagaatcccaactcttgttattctgatatctggaagacctttagtcttagagccattgctattggataagattgatgctcttgttgctgtttggttgccaggaagtgaaggagagggaatcacagatgttatctttggcagtcatggcttcaaaggtaaactaccagtgacttggttcagaagagttgaacagcttgatcagccagctgatgcagttaattcatgtgaaccattatttcctcttggttttgggctggcatataactaa

SEQ ID NO: 38726 - DNA, 1163 bp, Glycine max
  Peptide Sequence Number=SeqID_155504
atgggaaagttgtagaggaagttgggacaggtgtgaaggggttcaggttttgggatccggtttccaagaagatagtgatcaacagggatacaatgtttgatgagcaatccatgttactggaggtagttgagacaactgtgtcagtgtctgatggagcttcccctagctccatggagattcaagtggactttgagcaattgttggttattcttgagagggagtacaatattgtcaaagatagagatcttcgcaccattatactcgtccgatatgggtttgaagaattggctaaattggttgcctttgcacttctcattagtgctagagatccttctacctttctaaaggctatgaacaatcaggagaaagacaaatggatgggtgctatggtggaggagatggagtctttagagaagaaccagacgttggagctaggtaaaattcaaggcttgccagtagaaaagggatatgcacaacagaagggggttgattatgatgagactttctccccagttgtaagacacacttctatcaaggaggtgcaagccttggtagttagtcatgacttgcacttgaagcaaatggatgtgaagataacctttcttcatgatggtctagaggagcaaatttacatggaacgggcagaggggttcagtaaagacaagatcaacataagcaatgtgaagcctgtgagtactccattgacaaaacacttgagtcaatgtccgaagacagatgctgaggtggagtccaagtcaaaggttccttatgtcagtgcagttgattgcttgatgcatgctatcatgtgcactagaccggatttgacacttgatcaaggtgatccttcagttgtgggatatgtggattttgactatgttggtgatctggatggcaaaaggtctacaacaagatatgtctttactcttgcaggtgggcctgtttgttggaagtctattattcagtctcttgcgacaatgtcaacaactggagcaaagtatatggcggtagcagaggttagcaaggaagctgtgtggttagcgagactagcgaaggagctgggcattgagccagatggagtagagattgttgtgcatgactcattttataggaggacaaatgttggagcgaagcgtaagggccacctttgttggattaagaagcag

SEQ ID NO: 38727 - DNA, 321 bp, Glycine max
  Peptide Sequence Number=SeqID_155505
ccacatagagatctagcacgtgaagcagttcagaagtccttggttttgttgaaaaatggaaaagatcctagcaaaccttttcttccattgactaagaatgctaagaaaatccttgttgctggaacacacgccaatgatcttggatatcaatgtggaggttggactaaaacttggtatggaatgagtgggcagatcacagttgcctatagcccatctctgttctcgcctattctagtaggtcctcctgttttggcaagcatcttcgttctcgcctattacaaggaagaaatactagcaatagagattatactagtactctaa

SEQ ID NO: 38728 - DNA, 276 bp, Glycine max
  Peptide Sequence Number=SeqID_155506
atgaaatgctacaaatgcaagcagaatggacatttcaataggaatttcttaaagttgaagaaatctggtgaaagggcatttcactcaacaaatgtgatagagactaatgattactacagtgagagagatgtttactatagtgagggagatgttctctctagttcatgcaatcagttaacagatgcatggattcttgattctagatgtttttacaatatgactcccaataaggagtggttcaccacatacaagttaggtgcaaattgctatggatga

SEQ ID NO: 38729 - DNA, 372 bp, Glycine max
  Peptide Sequence Number=SeqID_155507
atgacattactgcaaaagcttctgcttctgtggctgcctgatgaaggtgcagttttgatcagcaaggcactggaaggaggtcacggccaattaattgaagttgatttgagcactaactcgatcacatggtcaggagctaagctggtggctgaagctgttgtgggaaaaccaggttttaagttgcttaacattaatgctaacttcatttctgatgaaggaattgatgagttgaaaaatatattcaaaaactcacctgatatgctgggtcctttggatgagaataatcctgatggagaagacactgatgaggaggctgaagaagatgctgatcatgatgaattggaatcaaaactgaagggccttgggatttag

SEQ ID NO: 38730 - DNA, 912 bp, Glycine max
  Peptide Sequence Number=SeqID_155508
atggcaacctctttctctccgacagcctctgtcggctccatcatcttccaaaaccctcccaaaggccttcttcttctctcccagcagcagcaacaacgctccttcgcctcttctgcaagctatgcaactctcaagctccctcgcgccttcgcactttctccaagacccctcctttccaaagggagaacaacacttgtgagggctgctactatcgaagaaattgaagccgaaaaagccgcaattgaaaaagatgctaaaaccaggatggataggactattgataatgtccgtacaaatttcagttccataaggacagggagagcaaacccatccatgcttgacaaaattcaggtggaatactatggaagcccagttagcttgaagagcatcgctcaaattagcactcctgatgccagttctcttttggtacagccatatgacaaatcaagcttgaaggctatagagaaagccatagttagctctgatcttggtatgactccaaataatgatggagaattgatacgactgagcatcccacagttgacatctgataggaggaaggaactatcaaagatagtggctaaacaagctgaagaagggaaggtggctttgaggaatataagaagagatgcattaaaagcttatgataaacttgagaaggagaaaaagctctccgaagataatgtgaaggatttgtcaagtgatttgcagaagctgacagatgagtatatgaagaaagttgacaccatcttcaaacagaaagaaaagaaactgagttcatttgcacatttagacaatggtgcttctgacttgactgtggtcatcaataacctgctggagatttacatgcttttgtggttgggaagggagatatgcaaacaagaagttataattgactataactacatctag

SEQ ID NO: 38731 - DNA, 141 bp, Glycine max
  Peptide Sequence Number=SeqID_155509
atgactgatgagatcagtactgatagattcaacaactcaattccaataaagcacagactccgaaagagcaataaccactgcaaaataacccaaaacactgcgagtagggcagctgcggcacgggatgcaaggtctatgtag

SEQ ID NO: 38732 - DNA, 1350 bp, Glycine max
  Peptide Sequence Number=SeqID_155510
acttgttgaagatttgaaatcaaagatacagaaggaagagtctgaagcaaatttgaatcttcagatgggaaaatgtgataaaaaatcagttgttgatgagaatgaagaaaaggaaaaccaagtgaatcaattgaatgttcttcaaccttccagggaaggttttatcccctacccttcgtctactcctgggttgatactaatgaaattgaagcaggccaaattgaatttaactaaaactactaatgaccttgctgacgtccgaacttctgttgaatcgcttaataagaggttagagaaggaaagaatctcacttaagaaaacatgtgagaggttagctcaaaatacttcaaagatatcttctcttgaggaagagctaaaccaaaccagattaaggctgcaaatagcaaaagatgctgaaattaaaggtgctctagatgaccctttagatattacaagagagctccagcgattgagttatgaggcaaagaatttcaaaagaatgggagaatctgcgaaatcaaaagttttgaggacaatgtctgagattgaacagacaaaaacgatgttaagaactactgagatcagattggttgcggccagaaaaatgaaagaagctgctagagctgtcgaagcttttgcccttgcagaaattaatgttgtatctaatcatgacagttcaccaggaaatcaggttactctttcatttgaaaagtatactgctttgacgtgcaaagctcgagattcagaggaacaatccaagaagagagttgcaagtgctatgcttgaagttgacgaaacaaatttgtcaaacatggacattttgaaaagggtagaagaagctacagaagaagttaaaaccagcaagaaggcccttgaagaagctctagaaagggtagaagctgcgaatagagacaaagtagcagttgaagaggctttaaggaattggcgatctgagggtcaaaaaagacgttcttctatacacaactctaccaagttcaaaaactgttgtttgtctcatcattggagagatcctcaattacttgatgtgaatggattgcatctggtaaatgatgaagcaaagccagtaaagccaaccctatcaataggacaaatacttagcaggaagctgcttcaaccacaaaaatttgaagccggagaaggaatctcgatgaaacagaatgtgtcactgggtcagatgtttggtaaacagaacaatgatcgaccaattgatagacaagttgagaaagaaactggccataagttgttttctaccaagagccagaaatttggatttgcacgattctcgcatattttgtcaaaacagaagaagaagccaaccctgaatttgag

SEQ ID NO: 38733 - DNA, 3645 bp, Glycine max
  Peptide Sequence Number=SeqID_155511
atggatagaaccagagaatccagaagatcatccatggccacctccaccaacggatttcccagacgcagacatcgaactattgctctcagagactcttccgaggaaggtgctgtggagttgagagaaggtgcgagtaagagaggaaggaatcgagatagggatagggattcggcgaacaggagcaagaggaggagaggctctcactcgcaaagcaccgaagagagcgtcggaaacgaacaagacgtcgacgttgtggacgttggcgtttctaagatccgttcccctaattatacgacatcgtcgttcgcctccgatcacaaccatcgccggagcttcacgccggcgaaacctccgtcgttcaagataacggatgagatgatcggcgtgaccgttccgagaaaggctcgttcagcatctgcgaaaaggtctcacgaaagttggatttccgcaagcagcggtggggaggagctgaatttccggcaacggtcgaattcccccggaggacagagtgttgaaccggcctcaccttcttcttcgaatgtttctcgtaggaagaagatgaaagagattgaacctgtttctaagccatcaaaatcgtcttcgtcagacctcgagattgagatagctgagcttctgtatggtttgaagacttcgaagagccacgagtcttctaaaaagtttgaagcaagcgtcagtccctctgatgatggtgagaagaagaaaatggaagacaacgacaattcttccacccttgttccaaataattcaactaaagagttaagcaggattccgattgagcaacatgctgatgtggattatcatgtttgtccatcattagaggcaccaaaagaggacattggggaagacagaatgaattcaagtgctgggtttggggatgcttcagcagatggaagatcggtttcccctactaaggaatcgccatcatgctccaagttggatgctgagaaaccatattcatcttcaaacagagtgatgtctgcttttccagaggccaaagcccaacgagtaggcaagtttgagatagatctgatggctcctcctcctatggggctgtccccagaagtggatgacttgtcaaggggtgatttcatatcagaaactaaagctttggcaccggatgtggaaatgaagaaggaagatagtgtcaaggtggaaagaccagttaagaaggagaaaactccagaagaaattgaagaggcaaaaatggtaacatttaaggagaagtttgatgtgctaaaacatgatttcgagaagcaaaacaatgccaatgacataaagacaaacaataaattggaagagcaggatgggaatagggaactagctactatatcatcaaatcccaaagaagagataaccgttcaatctacttcaatgcctttatcaacagctgaatcaggacggcagagcagtctctctcccattggacacaagccgcccttgcagccagtttcaaagacggacaaaaccacaggatcattgacactaaagcatgcgaattttgtcctctctcaacggcaacccaagagatgtgcaacccattattacattgcttgtaacatcttacaccagcagtgtacaaagatgaagccccctttgccagcagctattggctctggttctgtgtgtgacacaaagcacaataatgtcaactgtgtgccctatgcagaaagtatggcctttgggaagcaatctcaaaaacacttaccaattgtaaaccaaaatgcttcacaagagaaagggtgggctgcgaccagcattcctagtcttactgcagccaaaggttctaataatgtcaaaccaatggattcagctcatagggtgcagcttgtgctccagcaaggtccaaatcctggtccaactggtaatctagtgcatggtcctgctttcctctatcctccaggccagcatcaagcgtcagttacagcaacttctaatcaggcaggagctgtgaattcccctaacagcacttcctcatataataaatcccatagttcagttggcggatctcctggtacctcctcaactttgccagtagttgctcctggaataagctttagctacccaaatttttcagccaatggttcttctccatatatgacaatagttcacaataatgggtattcattccctttttcaacttctcttggagcaactgcagcaatcagaggcgcaagccctccacaagcaacacatgtgcttagtgggcctttctactcttctcaaatgttccatccacagcaacaccctcagtcacaagcactggttcaaccaagttatcttaatgcaagcacatcaagtagttcgtcatctcataaacagtcaccaggtgcacaagttaatggcagtaatattttgacctctacaactatggaactgcagtcacaaaagcgacagacttcactgtctcatcttcgcaagcatgagactgagatgggtggagggaatgcaccttcagttgctaatcgaacatcttactcacagaagaacgtgcatggccaaaactttacaattccagtgcaaccagtgaacttttcttttaagccatctgcaacatcggatattgttggcaatggtggatgttttggtgacaaacaacagcagcaacaggctttaaagggaggagtagagaatataccatctcaagcatttgcaatatcatttgctgcatttaatgggaccagtgttccttcaaaccttaacttctcatccatggcacagaatcctgtgatacttcaaagcctgcctgatatggcatggcaaggatatcaagctgcaagcattcctcagactactcagcaaaagacttgttcaataactgaagcaaagagtggaggaaattcttcacaccaagatgatgaaaagaaaatcactcatgctaagtcttccagcaatgggccaacgacccttgtttttgataattcatctaagaatcttaactttgtgctatctactacgaatggaaactggtctaatcacaccattccttcaactgcaataacaagtgtgccactctctagtaatgcttcaagttctcaacagccaccgcatttgcttcagcttccaaagcagcatgctatgcaacagcagcaagctgctatggcatctcgatataaagcatcatctgccaatagcactcctgctgcaaaatttgcaaacaatgcccccgttttctcacaaactccttctcaatgcagaagttctaaccaagcttctcactctaaggcctcgggtagaactacagattctcatgttcatcacacatctatcataacatcaaatgctccaaccctcaaaagtttttcccaggaacaagggagagttttgccaggtcatatgcaaatttcttttgggggaaattacataacgcccctgccaccccaagggcaaccactactcagtaacaaccagcctttgtgtacaacagctcaaggaactccatatagtggggccaatgcaaagtcaaatttggaaggaagtaaagctagttcgtcggtgaacgcatcacaactgcaacaaactgaaaattcagctgggagtggccaaaaatcttcaccagtttgtgggagaaatgtcccatcaatattgagttcatgccccagccacctatcagagctaaagtattag

SEQ ID NO: 38734 - DNA, 441 bp, Glycine max
  Peptide Sequence Number=SeqID_155512
atgcttatgaatgatataaaccttgagctgagagatgtaaatggttcagtgggggggatcaattattggacccaggtccaagtgagccacccaaatggaaagtatattctagaagggaggccaggtagtggggaaatgttgctgttgctgaagctatggaactacgggagtgggaaatttttgaaaatttattctgggcacgtgaatagagtatactgcataacttccacattttctgtgactaatgggagatatattgttagcggttctgaagatcgctgtgtttatatatgggatcttcaggcgaaaaatatgattcagaaacttgaaggccatacagatactgtaatatcggttacttgtcacccaaccgagaacaaaattgcctctgctggtctcgctggtgatagaactgtgagggtttgggtgcaggattcctga

SEQ ID NO: 38735 - DNA, 549 bp, Glycine max
  Peptide Sequence Number=SeqID_155513
atggggtatgagtatggtgctggaaatggcattggtctgagattccatttcaaaattggcggcgagaatgaacttgccgttgggggagaatttggcgaaggagacagcgggggccttatcttcgatgagggtcttcaggagattgccggttctggtgtcccaaatcttgcaggagccatcgtggctggcggagatgatgagggttccgtcgcggttgtagtggacggaggtgacgggcatggtgtggccctttatagtgtggacgcatttcccggtcttcacatcccaaaccttaatggtctcgtcgaaggaacccgagacaatgtagctggactgggggttgaagtttacgcagaaaacgacgtcgtcgtggccgcggaggatcttgacgcagtcgccgccggtggcgtcccagatgcggagggtgtggtcgtcggaggcggagcagatgtagtgggagtcggaggaccaggccaggtcggagatgccctcggagtggcccacgaggcggtggcagagggtgagggtggcggaggaccatatgattag

SEQ ID NO: 38736 - DNA, 594 bp, Glycine max
  Peptide Sequence Number=SeqID_155514
atgttcagtgccaaaaaagctgagcttcatcccccaaagacagtgctccaaatcaagcaagatgacaagttcttcagcaggcttctttccaaggaaagttccatgtccaaaccctctttcagaatggctgttgcagtcccttttgtttgggagtctcaacctggcacccccaagtacactttctctgaggacactctcccacccctcactcctccaccttcctattttgttaacttcatcaccaaaaaaaacaaaccactgaagaaacgctcaagatcaaatctcttcttagcactctttccaaaactaaatctcaagaagaaaaacattctctcaccctcttcaccttcctctccatcttctctatggtcaacctcagatcattcttccaaagtagttccaatggggaagcatggaagaaggcgctttctaagctttggttcatcttttgactttagaggagatgatgaagaagagagtgctagtgctagtgctactactacttcaactacttcaaaactttgctttggcatttctcgttctacaagcactttggctagtattggcttccgaggctcaagcaggaggtcatga

SEQ ID NO: 38737 - DNA, 300 bp, Glycine max
  Peptide Sequence Number=SeqID_155515
atggagataacaacgggtttgtcaatgtcctcccaaagcaccacaaagttgaagcaaagaagatttggtcttggacttccaggttttccaaattgcgggattttagaccaaacactcgtttctgtccagacttttattgcatggggcactcgaaaaaagtatgccaatggatctttgggttggagtcatgcacaaagcaggaaaatcatgagcccagatgaagttccaattgccttgctcattgaggtagctattatcaatcctgctttcggtgatgtgatttccttaaccgagaggtga

SEQ ID NO: 38738 - DNA, 132 bp, Glycine max
  Peptide Sequence Number=SeqID_155516
atggatgaacttagaagtggtttggtgtcaagctggaggaaggtcactcatccatgcggtaaactattgggagaatggcaggtttttgtccctactaatcgaagggtagtgatacaatcacatggaaggtga

SEQ ID NO: 38739 - DNA, 1497 bp, Glycine max
  Peptide Sequence Number=SeqID_155517
atgggaagaccatcctctaccatcgaaatccctcacgaacgccaccgacataacggccgccggacccctgactccgatatctccgacgactatcgccgtcgccgcagccctagctacgactcatacgaccgccacacggagcgccaccgccgctgttcggaatcgcccgagcacagaagccctaggcacaccaacggaactcacaacgacaacactctgcctaagaaattcggccgccgaaacggcgcgtatctggatcgcgaccgcggggattggcagcgttccgattccgagtcagacgaggagttgaagggtttgaactacgaggaattccgaaggctcaagaggcagaaaatgaggaaatcgctgaagcactgcatctggaacgtcacgcccagtcctccgaggcgcgataacgaagatccggaagattatagcaaacccgatgaaatttctgatcgagacgacggcgctgggaagatcgataaggagattaaagcaaaagcaaaagcaaaatcggaatcagaatctgattccgattctgaatctgagaaatctgtcagtagtgaatcagacggttcgcgttcgagaaagaagaaaaggaagagctctgctggttcttcgagaagatcgtatagcgagagtgaatcggaatcggaatcagagtctgaatctgaatctgaatctgaatcagaagaagaggaacgtagacgaagaaagagtaggaggaatagaagaaaaagaagtaacaggagcaggaagaagagaagatatagcgattcagatgagagagaagacagcgagagcgatgactctgatagcagtggcagaaagaagaagaaacgatcttcttcctcaaagtctcgatccaagcgtatcagaaggagcagaaagagaacaaatagaagccctgaaacagaaggcgagggttctgatttggaggaggagaatggttctggttctggtgatgctaagagtaaaacaaccgttgatgaggtgatgaagacggagattaacgcggaggctataaagttgaaggaattgtttgagtctcagaagaaacccgcattggataacgaacccgcggttgggccaatgccgttgcctagagccgagggacatatcagctatggtggagcgcttaggcccggtgaaggtgatgccattgcacagtatgttcaacaagggaagcgtattccgcgaagaggagaagtgggtctttctgcggaggagattcagaagtttgagagccttggttatgtgatgagtggtagtaggcatcagaggatgaatgccattcgtattaggaaagaaaaccaggtttatagtgctgaggataagcgcgctttggctatgtttaactatgaagagaaggctaaaagggagcacaaggttatggctgatttgcagcgcctcgtgcagcggcacattggccaggatgttggcccaactcatgatccttttgctgcaaaagcctctgatggtgctgatgcatga

SEQ ID NO: 38740 - DNA, 231 bp, Glycine max
  Peptide Sequence Number=SeqID_155518
atggagagcttcaagtacagcgattgtgagatgaatcgaaagggaatggagcacttacagattgaatgtccattcagggtaggaagacgtgaacgggttcggagctggactctactcgggtgggtgcctgaaaaagaaaaaaaaaattgcccggaagaattggatgggaatgagaacaaaaagaggaaagaattttgcaggaagaaaatgatgatgatgaaacttccgtag

SEQ ID NO: 38741 - DNA, 2193 bp, Glycine max
  Peptide Sequence Number=SeqID_155519
atgagagaggggctgagatcgcggacccgattggggacggcttctggtggtgaaggagttgatcacaagaaaacggttgctgtgaagagtgaggctgttgatttgggtgatgagggtttggaggtacagaagtcaacgattgagaagaagggtgaagttgaatgcggtgtgaaacaagaatgtggctttgatttgaatgtgagtccgagtgcagatgttgacttagctgaggatgggagcggtaagagttgtttaaatggtgggggtagcattctagtagctgaggaagataggaaggcaaagaagaaacacgactcaaacgatggagtattggttggtggtcgagtgttgcgccctaggtcaaagagtggggattgtaaaagactgtattatggagagaatgatgatgttgtttctggggataatggagagcatagtgggtgtgagagggtgaaagttaagaaggaacatgaagaagctgatgattttttggccgacagctgtgaaaaggaaataattaagccaaagaaggaaggggatggcaggaggaaattgaaacggaagcgtgggaggcctcccaagatagatttgaaaggggaagatgaaccaggtgatcagttgccacgtaagcgtggaagaccccccctggctggccgacaaaaccatctcgtgactgtggtgacacataatagaaaaggaaaggcgacccttcgaaaaggtaaaaaaggtttaactaagagcgatggtgctaaggtgaatgcaattggcgatacaaattcaaggaattctactgggggtgagttagaaaagaaggaggattctcttgtcaagaggaatgcagtaaagcaattagtgagggatcaaataaaggaacagctctcagctgcagggtggacagttgactttaggcccaggaatggcagagagtaccatgatgcagtgtatgttagtctggacggacatacacactggtcaatcaccttggcctacaaaaggctaaaagagtattatgaagctggtaatggtgaaggtaaggcatataagccaggcttcaaatttacaccaatagcagaagaggatttcaaaatgctaactaaggtaatgaacaagcaaagaaaaaaagggggaaagggtggaaagaaagttgatggagtcaatggtaaaaagaacaaagaaaagtcaggttatggtgcaggcatgggtaagtcaatgaagaggaaaatgaaaaggaaaacatcacctaacaggatgccagttgtgagggatcataagcgacagaaaacacaaaacaagaagcgatgtgctccgttggcacgcaatgccgaggagatagattcagaaactgagggatatgtactgtactgcggaaaacgaactttgcttgcctggatgattgattcgggcacagtccttcaaaatgggaaggttcattatatgccacacaaaagcaaaagtgcggtactggatggtgagattacaggaaatggcattcattgtgggtgctgcgataaaatctttacaatttcagactttgaacttcatgcaggaagcaaacttgctgatccacttaaaaatatatatgttggggaaggaacttcccttttacaatgcttgctagattcatggaataaacaagatgaatctgaacgtaaaggttttcattttgttgatgttgcgggtgaagatccaaatgatgatacatgtggggtctgtggagatggtggagacctgatatgttgtgatggttgcccatcaacattccatcaaggatgcttggatataaaaatcacagatcctgtattgaggcaaatgatgccaatactgatgattccagggatgtcttcttttgtggaaacagatgtcaagagacttgaaatgctcctaggtgttaaacatgaaatggaagatggatattcttggacttttatacgacggtcggatgtcggctttgatgcttctcagataaaacctcagatggttgaatgtaattctaagttggctgttgcagtatcaataatggatgagtgcttcatgccatatattgatcatagaagtgggatcaatctgatccacagtattctgtataatcgtggggttctcaaacaagagaatgtagagtacagactagctcctttaaggggactggaggaaggcttaggaggaaggcttaaaagcattaaagctttaaaatga

SEQ ID NO: 38742 - DNA, 165 bp, Glycine max
  Peptide Sequence Number=SeqID_155520
atggatgcctcagcacaggcgaccccaccaggggttgttctcatgtccaagttgttcctaagctcagctccaatcactccttctgcatcttctctcgtcgccgtatttgatggggtctttctccgcttgaggtctctctggcttttcctggctcatggtgtctaa

SEQ ID NO: 38743 - DNA, 354 bp, Glycine max
  Peptide Sequence Number=SeqID_155521
atgacctttgttccgttaaaatctatcttgcgaaaaaaagataaaaacaaattaaccaacgttcagttctcaaagaactatgtaagtctgatttcctcatcgcaattgaggaatacacttttcaagcatgaagttaaggttttaaaacaaaacgttgtgctttcacactctgacattagtgctcccatacagtatgacagactcaaagccaattgctcgagtctaaaactagatgagaagcctccaacatatggagtccatcatgcagttgggagaaggggaaaagaagtggaagagatgctcttgctattactctccaagatcatgcatatgttgaaaaaaaaaacaaagtaa

SEQ ID NO: 38744 - DNA, 465 bp, Glycine max
  Peptide Sequence Number=SeqID_155522
atgagtggcagagccatgatctcctgtttctctcctccttcaacaactccatgctctgcccccattccactctggcgccgaaaccacctcctccatgcaactcctccaccttcgctacacctcctctcgcggcggagccacctcgttgccggcggaaggagggtgtgggtgaatgtgaagtccgagaagaacttatccgaatcccccaagtacgaggatgatgtcgtggttcagaagaagaagaagcgtggtttggataacgtggaagaggaagcgaggtggtggcaagtgtttcccaaaagatgggtcattgtggttctctgcttctcagcttttcttctatgtaacatggatagggtaaatatgagcattgctatacttcctatgtctgcagagtacaactggaacccgagcactgtgggtttgatacagtcttctttcttttggggatacctcctcactcag

SEQ ID NO: 38745 - DNA, 1281 bp, Glycine max
  Peptide Sequence Number=SeqID_155523
atggcttgcgtttacaagaatcccgaagagcaaattgaagctcgtgtgaaggaccttctttctcgcatgactctgagggagaagattggtcagatgacccaaattgagcgcactgttgccacctcttctgccattagagatctctccattgggtttgaacttgttggaggttggaatgaatttgatgagagacccccattgagagtgtgtcttgaaaattgttacaggagcatactcagttctggtggcagtgcaccatttgaaaatgcactgtcgtctgattgggctgatatggtggatggctttcaaaaatcagctcttcagtcgcgactgggaatacctctcatctatgggattgatgcagttcatggtaataatagtgtctatggcactaccatatttcctcacaatattggccttggagctactagggacagcgatttagttcaaagaattggagctgctacagcacttgaagttaaagcttgcggaattcactataattttgctccgtgtgtggcggtcttgaatgatcctagatggggaagatgctatgagtgttatagcgaggatactgaaatagtcagaaagatgacttccattgtttcaggtttgcaaggccagcctccacaaggacatgaacatggatacccttttgtagctggaaggaacaatgtcattgcctgtgccaagcattttgttggagatggaggtacttacaaaggtgtgaatgagggaaatactatattatcttatgaagacttagagataatccacatggcaccttacttagactgcatttcccagggagtttcaaccattatggcctcctattctagctggaatggacgccaactccatgctgaccattttcttataactgaaatcttgaaagataagctaggttttaagggttttgtgatttctgactgggaaggacttgaccgactgtgcctgcctcatggatcagattatcggtactgcatctcctctgctgtcaatgcgggaattgacatggtgatggtggcttttagattcaaagttttcattgaagagttgacctccctagttgaatcaggggaagtacctatcagcagaattgatgatgctgttgagcgaattttgagagtaaagttcgctgctggtcttttcgaatttcctttaagtgacagatctttgttagatatagttggttgcaagttttatacccataggagtttcccacacatcatcaaaaagattatttctgtagttccttatggatggattactttgttttag

SEQ ID NO: 38746 - DNA, 315 bp, Glycine max
  Peptide Sequence Number=SeqID_155524
atggttcaaaaggcaatagatgaaggaagactggaattggaagagaaacccataaagatagatattgatttgttccatattgaagctaattatatcgagcccatccagatcatgatagaggttaaccgggctttagaagaattcgaaaaggaagaggaatcattttttgtgcctgttggggaatcgttggttgaatttctgtcaaagaagcaaaaggttgaaaaagaggtgatgttgtgtcctcgttatagtgttgtttttgacaaatctaccgctaaagctttcaaggcttcacaaattcaaaagaactactag

SEQ ID NO: 38747 - DNA, 651 bp, Glycine max
  Peptide Sequence Number=SeqID_155525
atgagcacggtgtactatccgcaaaccgatggccaaaccgaggtcatgaactgtgtattagagcaatacttgcggtcattcattcactcccagcaaaccagttggtatcgttacctggcacttgcagaatggtcatacaatacgtctctccactccaactccggcctcacaccattcgaagtgatatatggcaaatctcctccggccatacctcattacattccaggcatgacgacgaacaaagcagttgactccctggttcaaacgagacaacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38748 - DNA, 437 bp, Glycine max
  Peptide Sequence Number=SeqID_155526
atggccggaggagatttgccatatatcacttcgaatggtgtgaggccggagttggagtggagagacgtattgtatgaccattctgcaattcatgacctcggtttggccatcggtttgcggatagtacaccgtgctcatgcgcaaccgtgtgccggggagacgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 38749 - DNA, 510 bp, Glycine max
  Peptide Sequence Number=SeqID_155527
atgggttccactaattctaaatttgccatcatgcccaaaattcaggcagatgtcttgcttaattttgaaaaaaatgtagatttttatcactcttattattttttagcaggagttgaaggaaccaataaatatattgcacccaaagtaggggttactttattcgggctgctggatttgactgcaggattgaaatcgaaaaatatcaaggtttcggaaacaacttttgaaactgacgaatatactattttcgatttaatcagagagccttcagaaaatattgaagatcacttagtgactaatcagattcaggaagatttattgcgaatgctgcaatacctgcctcagaatcagcaagaggttattacgttaagattttttgatgggttgagctttaaagagattgcagatcacacggatatgagcattaacactacattgggacgtgtaaggtatgcgctgatcaacctgagaaaaatcatggaagagaataatattatccttaccagataa

SEQ ID NO: 38750 - DNA, 621 bp, Glycine max
  Peptide Sequence Number=SeqID_155528
atgtctttcgttgatctgtataattgtgttcctgtaactcaggatgctagcgctagcgcatatcaactgatggcttatttcctcctggataagaattttgcgaaactaacaaatctttttgataccggcagcggtgagatatttgacatctattctcacatgagaattgaattaatttcattcatcaaagactctcttagtgaggagaatcctgagctatgcgcaattttggatagggtcctaactaggagtatagttaagcaaatatatatgccaattatatatggtaaaacagctaatagcacaactaaggatcttatagtgagtctttgccaagatctcttgccaaaagaatgtactatactgtcggttctatgcttcaaattttggcaagaaaaatacagttttatgtattcgtttatccagctgatcagcctggtaggtcgggtatgctcttacctagatcgaccagtcttgtacagcacagaatattttagcacatcccaggattataaaaagatggaaaaacactcagttagagtcttcaactcttacttgaaaaaggcccataatgtcacactctcgtttccctcaaaagagcgggataagaggaaaagtggg

SEQ ID NO: 38751 - DNA, 336 bp, Glycine max
  Peptide Sequence Number=SeqID_155529
atgcgacttaagttaaagtatctccaagattcccctttgaatgaaggtttcgcacccactgtcaagtcttcgtctcatgagctccaccaccgtcacgctgccgttgcacgagattcccaggtctccgccatggccatcctcccatgtcacgctgaagttgccgtcacgtggtcgttgtcatcgcatttcgtgaagccatcatgtaacccacgtcgtcgcgctgctgccatcaattcctcaccgccgtcgcccaccccgccgtgtccacgccagctttgttttccatttttggctcacattctctgccagatttttaatcaagtacccacatcgtga

SEQ ID NO: 38752 - DNA, 765 bp, Glycine max
  Peptide Sequence Number=SeqID_155530
atggagaaaacgtcgatgatacaaataaatggcggtttaagatggaagctttgtctcagacggaaactgtctgagaaagtttctgtggttgatttgaatcggttgtgtgcacttggatctagtggattgagcctctgtaactcgctatctgactcagtgattgtggttatggagaccctttttgttgttgagcagcataagaaccaatactgcagcaggtccaagtcacagggccatgctcgatttgggggttctccttcaatgggctttagggatatcaattgcaggacttttgagtctgggaggactggtatattgccaactcctttgaaatctcatggttcacctaaaacaccacctaactctgataacaaaatggttgggaaagtaaaagttactcccaagagcaccccaattcccatcaatggtaaagcttgtagaaaagaggagagtgaagatgtccctaatggtgggggcgttttgctttctgaattgtgggctggacctacctactcaaactcaccacctcccagttccttaccaattcccaagttttccgtccggccgaagaggaccgtgtctcttgatcttcctggttcctcctcccctgggattgaaatgcgcctggtggctaagtctgcgccctcttcccctagcagggagcgtttggatctgccttttacaagggatctctttgatgataatgctgattctgctactaagaccctgtgtcgcattcttaatcttaacatcaatgatgactga

SEQ ID NO: 38753 - DNA, 261 bp, Glycine max
  Peptide Sequence Number=SeqID_155531
atggagcaaattgaatactcctttttttttgactcaaacatcaattggggaggtgcaatcacaataaaggaggggtggaggcgtttaagtaagcaacaagaggatgtgggttttggagttttgtgtgacatagacaaagagataaaccagagtgtggcgtgcaacttgattgagaaacggtatggagacagaacatggtcactagtaccagaattagaccccatctgctttaatatgggaattgaaaaacccttacattga

SEQ ID NO: 38754 - DNA, 1120 bp, Glycine max
  Peptide Sequence Number=SeqID_155532
atgggggattttgagggcataaatgctcgtgtgttagagtatctatactgtccccatgactttcacattgagttggatagatggacttctgacctgagatcctttgggtcggtgattgttatgtctggactgattgaaggacttcctgatgctgttgcaatcaggtgccttgcatgggttcccttctacctccatccaaagttagagcttgtctctcgtgcttggcgagcagttgtccgtggccctgaactatttaaagctcgacaggagcttggttcgtcagaggatttgttatgtgtctgtgcttttgaaccagagaacttatggcagttgtatgaccctctgcgagatctctggattactcttcctgttctaccctcaagaatcaggcacctttcacattttggtgctgtctccactgctggaaagttgtttgtaattggtggtggaagtgatgctgttgatcctttgacgggtgaccaagatggttgttttgcaacaaatgaagtctggtcgtatgaccctgtagtacggcaatggtccccccgtgcagcaatgctcgttccccgttctatgtttgcatgctgtgttatgaatggaaaaatagttgtggccgggggcttcactagctgcagaaagtcaatatctcaagcagaaatgtatgaccctgagaaagatgtttggattccaatgcctgatcttcatcgcacccataattcagcctgttcaggagtggtgattggaggaaaggtgcatgtactgcacaaggatatgtcaacggtgcaagttttagacaatgcaggtcagtggacggttgaggaatatgggtggctccatggtcaaatggcagttatcagggatgccctttatgtaataagctatggattaatcatcaagcaagacaaaaaaatgaggaaggttgtaggttcagcttccgagtttcgaaggagaattggatttgcaatgataggtttaggtgatgaattatatgtgattggaggtgtcattggccctgacaggtggaattgggacatcaagccactgtctgatgttgatgttcttacacttgcgagcgacagaccgacgtggcgccaagcagctccaatgacacggtgtggtg

SEQ ID NO: 38755 - DNA, 614 bp, Glycine max
  Peptide Sequence Number=SeqID_155533
gagaaatcaagcttcctaagcatcatccagctccttgtcccggaaacctttggaagaaattgtggacagttcctactatcccaaaatgcttaaatttagcttggagatgctgccaagatatcctccctatcaaatcaaacttggtgaagagaggtttagatgttgatcccatctgtcctagatgtgggcaatgtgcagaaactgtggtgcactctttactgctatgtgaagagtccaaaagagcatgtgcttgggcctgggtgacttggagtttgtggctaggatatgtgggtttctttggaccctttgttgagaggaatcgtatgtcaaaatggactaaaccacccaatgagtgcatcaaggctaatttggatgttgcagtaagaaggaacacaggttcggggcttggtgttatatatggggaccaatctggagagatggatttggaaggatccagttcgagtcagattgcaagagacttgttgatggttggaacgacgggaaagtctgaagcagaaggaataattgagccttcaggtgattcagctgatgaaccagaaggagaaccaactggagcagtcgaaggagttgttggtccattgccagctatttaa

SEQ ID NO: 38756 - DNA, 558 bp, Glycine max
  Peptide Sequence Number=SeqID_155534
atgggttggaaagcagctgagaaactcattaggcactggaaaattctcagaggagataatgttatgataacaaggggcaaagataagggtgagaccgggattataaagcgtgtcattcgctctcaaaatcgtgtcattgtagagagtaaaaacctggtaaagaagcatataaagcaagggcaaggtcatgaagggggcatctttacagtggaagccccactgcatgcctccaatgtgcaagttcttgacccagtgacaggcaagccttgcaaggttggagttaaatatcttgaagatggtactaaagtcagagtgtccagaggaataggaacctcagggtccatagtccctcgtcctgagattttaaagataagaactaccccaagacctgcagtccttgttgacaaaacatggccagagccaatagagaatcgagaaaaagtgagacggaaaatgaacttgaattatgagaaagttggtcctaaaaatactcctatgaatcttgtgctagagaagacttgcaatgctaaaacaggacggggcatgcctgaactttaa

SEQ ID NO: 38757 - DNA, 261 bp, Glycine max
  Peptide Sequence Number=SeqID_155535
atgtctttaattagaaaggctggcaatggaccaacaactccttcgactgctccagttggttctccttctggttcatcagctgaatcacctgaaggctcaattattccttctgcttcagactttccctcaggtgcaggatctaaaactgtgccatcaatagacggtggttcatctgatggaaacgctattaaagtcccctcccacttggtgctctatcttcttgcccttgtgtcttgtgtcttaaccttcaccaagttctga

SEQ ID NO: 38758 - DNA, 1080 bp, Glycine max
  Peptide Sequence Number=SeqID_155536
atgcaaaatctcaagctccaaaccatgaaagaaagttacttaccagagatgaatgaaatgtatcaaaaaattgctaataaacttcatcagcatgattctcttccccaacaaccaaagttagatcagattgataagctgagggcatataaatcgatgttggagcgtatgatggcactcctacagattcccaagaacaacattttgcctaatttcaaggaaaaactgggatcatacgagaagcagattataaatcttctcataaattcaaatagacccaggaaaggcatgaattcagtacaggcaggacatcatcccccaactcacatgtcttccatgcaacagccacaatcccaagttactcaagtacattctcatgaaaatcaaatgaactctcagttgcagtcaacaaatttacagggttctgtaccaaccatgcagcagaataatattgcaagcatgcagcacaattctttgtctggtgtatcaacaggacaacagaatatgatgaattcaatgcaacctggaactaatttagattctgttcatggaaattctgtgaactcccttcaacagattccaatgaactccctccaacaaaaccctgttagtacagctcaacagactaacattaattccttaccatcgcaaggtggggcaaatgtgattcaaccaaatgcccttcagtcaggttccagcgcacttcaacaccaactgaaacatcagcaggaacagcagatgctgcagagtcaacaactcaaacaacaatatcagcgacaacaactgatgcagaggcagctcctgcagcagcagcagcaactacaccatccaggaaagccacagctatcttcgcaattgcagacacatcaaatgcctcaacttcaccaaatgaatgatataaatgatataaaaatgcgacaaggaatgggtgttaagtcaggtgtctttcagcagcatcttacatcaggtcaacactcaacatattcccatcagcagctgaaacaagggagtgcatttcctgtttcttcaccccaactccttcaggctgcctctcctcagattcagcaacactcatctccccag

SEQ ID NO: 38759 - DNA, 699 bp, Glycine max
  Peptide Sequence Number=SeqID_155537
atgacagagaaacacataaatgcaagcacatacttgctgatgtttctggaagagttctttgagtctgatacaactgcttctgttgatcaagaacattttgttgttgaagtaaggaccctgacgcttgaattctttgctgcatatctctttgtgagggatttagctgctgcggcaaacccaattgctgttgcaactgtgcagactgagtgtgaatctgtggcattaattgctgttgtgaacccagtggttgtgactgctgtgaatgaggtaacaacaaatttgatgtactttgttgtgattgttgctgcattggaacctttggttgttgcaacatgtgtgcagagtgatgacttgtttgcatgtcagcattgccagattcatgtccaagcaaatgttgctgctgtaacccagggccattatttcccaattgttgatgtatatttgctgggttgttttgctgatttattaactgttgtctctgttgcagaaggttttgttgttgttgctgcatctgagattgaagctgcttctgcttcaaacgctgctgttggtaaagatattgcggtgaattctgtgggggaacaatctgctgccttcctggcatttgtctctgagaaccaggaaacatattctgttgagatgcaacattgttttgaacattttgagatagaagctgctgatgtggctggagctgactag

SEQ ID NO: 38760 - DNA, 330 bp, Glycine max
  Peptide Sequence Number=SeqID_155538
atgggacaagttttaggtcatacatggtggcaaactggcaccgaagttaagaattgtttgaaatactatttggaagaagggtggacccatgagaatcggttagacaagagaaagtgtgtgagggcacatgggagtatgttgggcagtggtgcttctagatctgacccaaaaatgcttagtagatcttctaatggcgatttcgatttgatcagagcaactttggcagcaaaaagtggcagttatgctcaatggaatcattgggagaaaaaaaaggcagcgagagcaaaaaaaatcttgaagatgtggcagttaagaaggcagcttcaatga

SEQ ID NO: 38761 - DNA, 300 bp, Glycine max
  Peptide Sequence Number=SeqID_155539
atggtggaacgaagcaaaagcagaagcagagtgcggctaatggcttgcaatggtttgcggtgttggttagtggtggggttcccgtcgttggctatcggtgccggagacgtctcgaggtctggagtggcaatgcgaaggagtggcgactctgacatcggggtccttgtcgatggtggctccggtggcgctgagtttccattgttgagtgctgtcggaggaggtggggtgttgtttgcaatttccaggtggaggagggaaggggttagggatagggttaatttgggaaagacaacaaaatga

SEQ ID NO: 38762 - DNA, 705 bp, Glycine max
  Peptide Sequence Number=SeqID_155540
atgttgtctgttgctttttctggtatttctccggttgtcattggagccgtctggtgtttcattgtggcattatgcttcaccatcatagctctcgtacattgcttatgttgctgctgctgccgcaagaaaaagcctaggacagattactctcgaaagacttatgcaatatcactcatctttctctcagtcttcttgatcatgacaatcattggagggggtttcctttacactggactggggaaattccaagctactgcacatgatgtatcagatattctggtcacaagagcaactacagtggttgatattattcaaaatgtaatagacaatcttcatgcgactaaggacatacaagtagctagtttctatcttccagacgatatcaagggagccattgaaaaggctgaaaaattttccactcaaactgattatattaagaaccaatcagaggaaacagcaagaatctcaatggaattcctgggcgctataagtgaaagtcttatcattgttggtactatgatgcttatcttggctgcggttggcttcgtaatctcaattttggggtggaaagtgatcgtttatattttacttttctttgggtggatcctcgtcacatgcacttttatattaagcggtatatctttagttgttcacaagcttttggttttggatcttggttacagtatgtctagatggaaatcttag

SEQ ID NO: 38763 - DNA, 158 bp, Glycine max
  Peptide Sequence Number=SeqID_155541
atgggttttcaaggatcaaagattcaaagttcggtagctgtaaatcacgtgaatggtgtcctatatttctcccacaatatcaatgttggttcccatgatgaagatggcttgaaacataatgcatacgggccaacccgtaagagagttgcacttttcat

SEQ ID NO: 38764 - DNA, 300 bp, Glycine max
  Peptide Sequence Number=SeqID_155542
atgaagattgatggaaaagctactaggagcactaaggaggtaaatgtacttcttcaagcaaaagaaggatccactagggatgtcctagatacaccacatctccaccaaaaatctcaaggcattggatatttgggccacaattcatatatatctttcattgaatcatttcctaaccaatgttttgatggttgtttgttagatctagaaacaaagtcaaaagaaagggcaaaatggtcattttcccaagatttcagacattcattcgcccaggctagcaaccaactcgcttgggctaattag

SEQ ID NO: 38765 - DNA, 552 bp, Glycine max
  Peptide Sequence Number=SeqID_155543
atgaaggctaatatggaggccattaagcaacaaatgacaacgatgatggaagcaatgatgagcatgagaaagatgatggaggataacaccgctacagttgttgctgtgagtactgctattgagatggacctaattcacctggccgatttcaatcaagtgaatcgtctagtctccgatgtagtatgtcaaggaggtgaggcaacaaaaaatgcatgtgggccttatcatgttcaggttcagagcaagcattccttcccatcatatgggttgcctcctaattatacaccgcccactgttgtatacacttctggtgagaatatcatcaattttgcacccgtactcattgagaatcaacaaccccaatttgatcatgttcatgtctctcaacccatgggggaaacacataaagttccccaagaccacactctggccgggtttggggtttatctagaatataccaatgaaaggcaggcattttctggcatccttgtgctgaatgctcctggaatatctcaatgtcacctagaatatcagaacccttgcattttgtaa

SEQ ID NO: 38766 - DNA, 435 bp, Glycine max
  Peptide Sequence Number=SeqID_155544
atgacatcattatcacaacaaggacagcaggaaggaaattattatgctcttgcttggaatttaacacactcagaggaggaagcaacaacaaggatccatttgagagtgattggagagtgtttgagtgattgtgagatgccaagaagaggaggagggatccaccttcctgtcactgggaagtgtactgtttccttagaacttgatagagcagggctagttgatgaggacacaactaagggcaaggaccatgaagcacttgaagggcccatgaccaaaggcatacttaaaaaggcccaacacagtgatgaggacacaactaagggcaaggaccatgaagcacttgaaaggcccatgaccagagacaaacttaaacaggcccaacatgtcatagagacaaggctggtcatttgtatagctgccattgatgatgattga

SEQ ID NO: 38767 - DNA, 516 bp, Glycine max
  Peptide Sequence Number=SeqID_155545
atgaaagagaggcctctaagtgacgcaaagaggaaccggcgggaagctcatgatagggggtgcagtgaccttgtcggatgtcccttgtgtgggaaactagagtggttaaataatttaagcatttatgaggggatgcttaagcactttaattcatccatggtcatgtacttgacgacgcccatgtttcatacattggatgttgtgtatgttcggggggggggggggtgcagtgaccttgtcagatgtcccttgtttggaaaactagagtggttaaagaatttaagcatttctaaggggatgcttaggcactttaattcatccatggtcatgtacttgacgacgcccacattcatacatcgaaaaattgattgcaataacataaatgagataagggaagagagaatgcaaacacagttttatactggttcagaaaattccgtgcctacgtccagtactcaaggacaacccatcccttatgttcagatgctttacaacaagagactcacagtctcttag

SEQ ID NO: 38768 - DNA, 1204 bp, Glycine max
  Peptide Sequence Number=SeqID_155546
gtttcaagaaattgtacctctcaatgcgggtaatattttgggcacagaagacaatggccctgccagaaagtggctagctcttattaggaagaccctgaatagtcttcctggaacaagcggggaatgccacactacttcaccgcttcctgaccctattgtagagttagatgctgattttgagggatcaatgaggcagaagacgacctctttcttacatcgccgatcgttccaatccttgagtcatagtatgagaatggacaatgagatgtcactaccccaagcatgccttgatcgtcgtctcagtgtctgtgatagaatgatgtttggtcacaggacaagtgattatgaccccagttatagatgggcttcctcggacgatgaaaacggccctagcgactccccagtcgtaacacattattcaccaatgacatatagatgttgtttctctatggaggatagagatagacagacagggaagtcaagatactgtttggttgctagtaagcaaatggttgggatatttctaacagtttgggtgaaaagtgatataagagatgatgttctcaatatgaaagtgtcttgtgttggcagaggattaatgggatatcttggaaacaaggaaggtgatgagctaaggagaaattcagatgtaatggagattctcagaaagacaaggtttccccgggttcaaggcatgggtgatgagagttctcctcagacaattctggatcatgatcgaataatttggctgggggatttaaattatcggatagccctttcttaccgtgcagcaaaggctcttgttgagatgcataattggaagctacatatagagcggagacaaggtcgggtctttgaaggatggaatgaagggaaaatatatttccctcccacatacaagtattcaaacaattcagatagatatgcaggtgatgagagacagtcaaaacaaaagagaagaactccagcatggtgtgatcgtatcttgtggtatggaagaggcctccgccaattatcgtatgttcgtggggagtcaagattctcggatcatagaccagtttatagcatgtttctggcagaagttgagtctattagccgtaaccgaataaagaaatgctctagttgctccagttcaaggattgaagtagaagagttgttgcctcattcacacggttacagttacactgatctgagtttcttctga

SEQ ID NO: 38769 - DNA, 600 bp, Glycine max
  Peptide Sequence Number=SeqID_155547
atggcttctctaaaatcagttctatctcttgactcaaattataactttgatgaactccaatgggtcgtccaaatccgtagaacccttgaagaagagcttgatgaagatgaggtacaagcatgcagcagcaaacaaagcctcaagcttgataatatcgttgaccaattgaccaagttggagcaaaggattcgagcatgccaccacaagttcttggatttcaacggggaaacttcggtgtggatgatgacagtcgatgcctcgttcttgcttgagttcctccaagtcttttattgtgccattcaagatggaacaaaagtagctagggggaagtcatatcataatgcaattttgagggatattgtaatgcttgagaatcaaataccaatgtttctgttgagaaatattctagagttcaaattctcatcactagaagctgttgatgacacgctgatgttggagtttataagtctgttcaaagaggtttctcctttcaagatgatggaggaatatccaaccattcaagtctcagagtgcacatctactagatttcctatatcacatgattgtccccaatatgttagaacgccaagatacaattga

SEQ ID NO: 38770 - DNA, 252 bp, Glycine max
  Peptide Sequence Number=SeqID_155548
atgagagatgagaactcgaagaaaagcaagctttcatggcccaaaacgttggtcatgaagtggttcaatattaagagcaaaaatgaggactttcaggcagatgatgtcctctacgcaggtgtcaatgaagagtggaggaacaactgttcacagagggatgaagacgctatcaagagaaccaaaacagagagagcaaagaagagacactcagatagaatgcggcgaggtaaaattgaccgtgatgcagctcag

SEQ ID NO: 38771 - DNA, 1008 bp, Glycine max
  Peptide Sequence Number=SeqID_155549
atggcagaggtccccacagaggccattgcctccctcgtccaatattatgaccagccgttgaggaaaccatacctcttcgcaggattctatccatctttagctagaatttctaagatagtccaaatctcggcgcaggaattagaccatagaaagcaagtcgaaaatggggtggttggagtaccgaggaaatgtttggaagcaaaagcaagaatcttggcaggtaaaggcgaacgggccccgttcatagacatcctcgcacttttgatcttcggaggagtcctctttccaaatgtggatgggttggtggacctagcggcgatcgatgcttttctcgcttttcgtgaccgcaaggaaagcctggttgtcactatcctagcctatttatatgacaccttcgaccgaagatgtgaaaagagcagtacaaggattgtttgctatactctggccctctacatatggttggttttgcaccttttccgccaagagaaagaaggaagaactagggttcttattttgtgcggaggatttccaaatgttcccttgatggggacaaggggttgcattagttacaatcccgttcttgctataagacaacttggctaccctatgagaggggcaccactagagggagagctcacacctattattgcacgaggtttcaataacaccaacgtggaggcgcttcagaaggtctgcaaggcatgggagatggtgcaaaagaaggacaaggaactcagaggtagtaacaacgggcccattggcggctaccataggtggttgaaagcccacatgcaaggtttggattggctcccgagtttgagaaccactaaaggggtggaagttagagcaccggaggaagacgaagaggtgcaggcccttagggcagaactcaagcaagcccaaacagtcaaagaaaggttcaaatcagcagctcttaagatccaaaaggagaatgccgaattgagagacataaatatagctaccactaaggccttggaacaagagacc

SEQ ID NO: 38772 - DNA, 1653 bp, Glycine max
  Peptide Sequence Number=SeqID_155550
ggtatgaggattgtacacactccagatgagtttgttgaatccttcttagctgcacaacgggaagcagctgcttcttttggcgtcaacacaatattgttggagaagtatattacacggccaagacacatagaagtccagatatttggggataagcatgggaatgttctgcatttgtatgagcgagattgcagtgttcagagaagacaccaaaaaataattgaagaagctccagctccaaacatttctgctgactttcgtgcacaattgggtgtagccgctgtttcagctgcaaaggcagttaattattacaatgctgggactgtggagtttatagttgatacagtctctgatgaattttactttatggagatgaatacacgtcttcaggttgagcatcctgttacagaaatgattgttggtcaggatcttgttgaatggcaaatccttgttgccaatggagaagctcttccattgagtcaatcacaagtacccttatcaggtcatgcttttgaagctcgaatctatgctgaaaatgttcaaaaagggtttcttccagcaactggagttctacaccattatcatgttccagtctcatctgcagtccgagtggagactggagttaaagaaggagacaaagttagcatgcactatgatcctatgattgctaagcttgtggtgtggggagaaaatcgtgctgctgccttggtcaaactcaaggatagtctgtcaaagtttcaggtatacttaaatttttgtattgcctgtgctatagtgaactgtgaagttatcatgattgtgattgagggtctgccaaccaatgtcaactttcttcaaaagcttgctaatcacagggcatttgcaaatggcaatgtggagactcattttattgataactacaaagaagacctctttgttgatgctaacaattcagtgtctgtgaaagaagcatatgaagctgctagacttaatgcatccctggtggccgcatgcctcattgaaaaagagcatttcatattggctagaaatccacctgggggcagcagcttgctccctatatggtattcttctccacctttcagaatccatcatcaagctaagcgtagaatggaacttgagtgggataatgaatatggtagtggtagctcaaagatcatgaagcttaccatcacttatcagcctgatgggagatacctaattgagacagaacaaaatggatctcctgttttagaagtgaaatcaacatatgtaaaagataactattttagagttgaagctgctggtgtaatcaatgatgttaatgtagctgtttattcaaaggatcaaataaggcatattcatatttggcaagggtcctgtcatcattatttcagagagaaactaggcctggagctgtctgaggatgaagaatcccaacataaacccaaagttgaaacatcagccaaccctcaagggacagttgtagcacccatggcaggcttggtagttaaggttctagtggagaacaagacaagagtggaggaaggacaacctgtgttagtattggaagcaatgaagatggaggcaccttcttctggctatgtgcatgggcttcaacttatggtgggtgaacaggtttcagatggcagtgttcttttcagtgtaaaggttcgttaa

SEQ ID NO: 38773 - DNA, 219 bp, Glycine max
  Peptide Sequence Number=SeqID_155551
atggttagaaccaaggatatagcaagacataacaatcaggcactggttcctgtgaatgagccactgtttgatgcactgcatcaattggcacgatatatgaccaagctgacagtaacagggtacagctacaagagaaaactaaaaagagaatacagtggctatctaacttatacaatcaataggagaatattgtaccatgaaccaaaagctacaccataa

SEQ ID NO: 38774 - DNA, 192 bp, Glycine max
  Peptide Sequence Number=SeqID_155552
atgggaaacaatagtctcatcaatgcagtaggcttacttccactaaaagcatgtacctactgtggtaaggataatcacacggtggaaaaatgttataggaaaaatggttttcctccaaattatacttttagaggaggaagaagtagccgaagaggctctggtaaagggagttctgataggagaggaagtaag

SEQ ID NO: 38775 - DNA, 228 bp, Glycine max
  Peptide Sequence Number=SeqID_155553
atgaaggaggtgcaaatgattcagtggctagtgtggaatgtcgcaacctaccttaggaagggagtgcgggcgaaaagccaaagaagacaactttgcgacgctaatgatcggttaagattgagctttacaaagaaaaagagattgccgatgatgaatggagaagatgaatgtgcacaaaaaaacaaagggggacccctaaggatacatagatcacattcaaatctttaa

SEQ ID NO: 38776 - DNA, 186 bp, Glycine max
  Peptide Sequence Number=SeqID_155554
atgactatagaaccaacatgtgctaagaaggttgtcttacaccaggtttatcagcagaactctacagctgtaaccccacatcatccaaaccctaacaagaccggaagaaggggaaagcaagaaagaaaacctattctgtgcctaacaaatgggcaaaatgaggaaaagaaggcagataaaaagtga

SEQ ID NO: 38777 - DNA, 198 bp, Glycine max
  Peptide Sequence Number=SeqID_155555
atgacatgcggagatacccaagtggttatccgtgcaaaggcacttctgttaatcctgacccgtgaagtcaggtggcaggcggaaataacccaagtggttatccatacacacacagttctgctaccccgacgtgtgagaagtcaggactcgacatcctttgcgctagtggtcggtcaggtaaagattcagctcaaatga

SEQ ID NO: 38778 - DNA, 609 bp, Glycine max
  Peptide Sequence Number=SeqID_155556
atggcaagagtagcaaaagtggttaagatctcggcacaagagttagaccgagtgaaaaaaaatagaaatggggaggttgggataccaaggaagctcttggaggagaaggcaaaagctttggtagatcaaggagagtggacttcattcattgatgttttagcattgttggtgtttgggattgttctctttccaaatgtagacgggctagtggatttagcggtgatcgatgcttttcttgcttatcaccacagcaaggaaagcctggtcattgctgttttggccgatgcctatgacacactcgacctaagatgcgaaaagagcagcacgagaattgtccattgtacaccacctctttatgtatggttggtctcccacgtttttcgtcatgaaaatatacttgtttgtcccttacaaggtcgtcacatgtgtgtcgagaaaggaaaagcaaattgggaggaactcttggcagtgaaggcaatgcaaaaatacttcagaaaatctgaaaagcatggaatgcggtggaaagaaaagataaggagcttaagggaagcagcaatggtgtcatcggcggctatcataaatggtggaaggctcagatgccagggataa

SEQ ID NO: 38779 - DNA, 669 bp, Glycine max
  Peptide Sequence Number=SeqID_155557
atgacgcgccagctggcgcgttacgacaaagagctgcgtacgtcgcatgtcgccatggcgcatgagctgcggtcgccgctcaacgccgccatggtgcgtctgcaggcgctgcttgatggcgtattcagcgctgactcacgtcagctcgccctgatcatggcgcagctcagttgtctgcaccggctgatcgatgagctgcatctgctgtcactggcggatgccggccagctcacactggagaaagtccgctgcaacccggccgatatcctgcgcgagcgcttacaatggatcaaaccgcagctggatgaagcgcgcatcagcaccggggtagcgctggctgaggagacattactgccggtcgatccgttccgactcggacaggttttcaccatcctgctggaaaacgccctgcgctacgccggaagcggcagccagctgcagctgcgcacgcgcaacaccgttgatcattacgaaatcatcgtgcaggacaacggcccgggcgttcctgcggcgtttctggcgttgatgtttgagcgctttgcgcgcggtgaggcgtcacgcgcccgccactcgggcggcagcgggctgggcctgtcgattgcgcgggcgatttgccaggcgcacggcggcacgattaatgccacgctgccggcaacgggaggcttgcag

SEQ ID NO: 38780 - DNA, 462 bp, Glycine max
  Peptide Sequence Number=SeqID_155558
atgacttctgaggcagctaaagaaattgctaacaagattgattccttggaggagcaggcctcacagagttcctttgtcgcccatggatgtcatgatgtactaattgttgccattgggggaccaaaacaccctagtcgttcccaagttcaatcacaggaactcgcacttccttctgagcttgaggttggtccttcagctactcatgtcagcacaaaggaaagttgtgttgatcctttcgagaatgatccagacacgggtgactcagagaaatgcgggttgtacgtcgaagaaaatcctccccgcctggttgcccttggaagactttatgaggggtcgacaacagttcatagcatccctttgcgccatgatcaagtcaaggttggtgttgaggaagttagagatgcatatgctcccattcctgtacccactaaaaaggttcagttagtgggggcaagcacttaa

SEQ ID NO: 38781 - DNA, 348 bp, Glycine max
  Peptide Sequence Number=SeqID_155559
atgtcaatccttaccctcggaagcaaaaaaggaaaagaaggagatttccaatctaagagaaagcaaaaagaaaagaaaggaaattcccaatcaaagagtgggagaaagcaaaaagaaaagaaaggaaattcccaatcaaagaatgggagaaatgtttcctctaaatggtcatttagaaacgaaatgctaaacatccaaaatctcatttgtggttatgagaaaatttcatcagcagattctccttcccagcacgttcgcattttagcgaagaaaacatcgagactatttctagtctcacaagttatccagaactacgtaggtctgagttcctcattggaggatacgtag

SEQ ID NO: 38782 - DNA, 340 bp, Glycine max
  Peptide Sequence Number=SeqID_155560
atgcacctcaactaagcaatgccaaaatcagctacctaacagattccctttctaattcctcatataatgacatgtctttcatttttgtgattgtagttgtacgtgatggaaaacccattggtctaaacgttgcttcaaattggttgtacgtttatccaagaggatttcgagacgttttgttatacactaaaaagaaatacaacaatcctttaatttatattacagaaaatggtataaatgagtatgatgattcatcattatcacttgaagaatctcttcttgatatttatagaatcgattatcattatcgtcatctcttttatcttcaagaagcaatcaa

SEQ ID NO: 38783 - DNA, 264 bp, Glycine max
  Peptide Sequence Number=SeqID_155561
atgtcccggaaccttacggattgtgcatcaatactttcttttgatttccggcatgtcccgaaacttcacaaattgcctaatgatgggtgccaagcacctcacaaggaccaaacaaaagttgcatgccaccaagcaaagatcctgccacctcctatatcgagaacaaattttgacaaagtacttgctagacaaagacccaccgtaagcaagtctgaccttgatgttcatgagcgattcacaaaggagttcggagaggaaggataa

SEQ ID NO: 38784 - DNA, 471 bp, Glycine max
  Peptide Sequence Number=SeqID_155562
atgcgagataagttaggtatttggtgtccgattggagatttggaagcttctctaagaactttgaaacttggtattaatgaggattctcagaacaagacaaagctagctgaattgctcaagtatgactcgagtaagagtggtgatgagatgaccagcctcaaggactatgttacgaggatgaaggaaggacagaatgacatctactacattactggtgaaagcaagaaagctgtcgagaattcccccttccttgaaaagcttaggaagaaggggtacgaggttctctacatggttgatgctattgatgagtatgttgttggtcagcttaaggaatttgagggaaaaaagttggtctctactaccaaggaaggcctaaaacaggtagtaatcccactttcccatgttcaaatgcttctcttggaagctgtagattctgctagttttgttgcctatattgattatgctgaatga

SEQ ID NO: 38785 - DNA, 288 bp, Glycine max
  Peptide Sequence Number=SeqID_155563
atggatccacaccaaagcctcagcgaagcaaaagtagcagcactccaccattacaataaaagcttccaaggtttctcagccatgattacaccagagcaagctagtcaacttgcagaatatgaatcagtattgtccgtatttgaaagcaaaatgaataaacttcacacaacacattcttgggattttcttggattagaaactatcagtaagaacaatcctaaagcactggacaccgcatccaatgtcattgttggtgaatatttgctcaagctcaatgagaactattga

SEQ ID NO: 38786 - DNA, 1173 bp, Glycine max
  Peptide Sequence Number=SeqID_155564
atggcagcgcaagctcgacaggtgttttatgtagaagatccatgcgactctagatgggcagtggttttgcaagggagaacaatttgtatcggtcacgatgttgatggattaacacttgatgtcactgacatgccatctttctccaaagatattccttcaactactgttgaacaagaagaggatgatgtatatgcaaatcgtactaatcatgacgagggtttatgggagaacattcgtatgacaagacaatccacgaggctcagaagtttgacgtctagatacttagatggcccacagctagttgtgaacgtgaatccgactacaggtagagggtcagagcctcataaagagaaatttcacagttatttaggggttgtcgcaagggaaaaagttcctattgtacacgcgaattggaatgttgtccccgacgatctaaagagcttaatatggaaagatattttgcccaaatttgatatccctgaaggtgaaaatgcaaaaaaaaaggtgatgtcaacagttgcagcaagatggaggcaatttaagtcttcattgacttcaaaatttgtctttgctgacaatgaaggtcagcaaatatctgatcctacagtcaagtatggccttgatccagaaacatgggcggaatttgcaaaaagccgcaaaacccctaattgccagggtatacgaaagaaggcccaggaaattcaaaaatttaatgactgcccacacgtactgtctcgtggggggtatgaactgcttgacaagaaacttatggaggagaagagcaagcgtggacatgaggaacatttgtgtactgaaagcccaacactcaacatcgacccaccatccccagttgtaagacacttgaagtggaagatcgcctgcaaaaagcggcatggccaaatgacgtctgaagtggcacaagaaattgcagacaaaattgacatactcaacacggcccttggccgacctgagcatccaggccatgttcgtgtcgcagggacaggtgtcacaataagccaatactttggccaagcctcacgtgcttctagcacatcgtcaccatcgatcaaccaacaacaattggcttatatcattggtggaattaaggatgacataagaaagcagctacaagatgagataagaaaggaggaacaggatgagataagaaaggag

SEQ ID NO: 38787 - DNA, 345 bp, Glycine max
  Peptide Sequence Number=SeqID_155565
atgaagaaaatatgcagtaatctccaaggcaaggacaatgcacctccacctccacctcagtggattgaggctaagtatttttctgatggaacaacattagacactgacaccatgacgacactacgcaagaaatggacaacctattttctagaagtcggaaaatggatgtcagtgtttgacatgttcctgcttgggtcgttcagtctgccgcaaccttctcatacattggtccaagaaatcatcggaaaagctcctcagcaatacgcagcaaaaggtggtccagatttcttttttgttatcaacatacaaatgctcggaagtcctatgtattcccttggaagatga

SEQ ID NO: 38788 - DNA, 369 bp, Glycine max
  Peptide Sequence Number=SeqID_155566
atgtgtttggatgagatcgataccgtcgcagagaatttccataggctcaccggagaactctccatccttctcgacatgttccctctccaagacctcaacctaaacgacgatgttagggaactcgttctcctcaacgagatcgtccctgaccaagcgcatctcgcttcaatcttcgagaaattggagattcgcgacgcgttgagctgcaaagtggagattgggagcctcgaggaagagattcacaaccgttgcgaagagcaaccgaaaacatatctcatcgcattaatcggcctcgtctgtttcacaaagtgcgttctctatggtgcatcaacgccgtcgcagaaaaccgtcactctacggtggaactag

SEQ ID NO: 38789 - DNA, 336 bp, Glycine max
  Peptide Sequence Number=SeqID_155567
atggcttgcactcacattccagtggaagattcacaagcgattctccctcaaatttcagctagcccgcatcaattagactttgcaccttgcgcttcgaggtcatacagtgctcaatggaatgccccgaggcttctccctgacaagcatacgttgcgttcaagtcgtatcatcagaaaatggaggttgaggaaacctaccccggggttatggctaccattgcattatcaagtagataagggagctctttgctgcaaaattccttctttggttggtgttttggttcgtgctaaagtggtgttcgtgattggaagtgcggtagacaggctctgtggttga

SEQ ID NO: 38790 - DNA, 396 bp, Glycine max
  Peptide Sequence Number=SeqID_155568
gatgatgatcttgatttgaatgcttcccctcaagcacttgacaaattgttgggtcatgtgcttgcttttaaggtcaggattcaatcaagattcaaaaatctagttgtacttaaatactcaaaagacctggatttgatcaatgctgttctggagatgctgcctgatagtgagacatgtttcaaaatagatccttccaatgttgattgcaatgatgctacgcatgctgaatgtcaatttctttctgccacagctgaccatgatccagttgcggggttacctttaacacccaaaaggcgaatgtcatctgatgaagccaatgatgagttagggagctctcaaatttcgccagcccagatattgtctaacaaattaacaagacattctcataggagctaa

SEQ ID NO: 38791 - DNA, 285 bp, Glycine max
  Peptide Sequence Number=SeqID_155569
atgaaacaggaaaaagaattaaataagtgtacaaaaatactactgcgcccctgtaagagttgtgttggtgaccttgaaaagagtgaagcaaagttaccatgttatcccatcactttcgtgcacacaaaaggggggtctgtttctaatttgatgccgccagatgcattaccgagtccagggatgtcgccaataggagaagtgattccccttgtgaagccgccagcagtagcagcgagcaagcagtcccgccagcagcaggagcgagatgctccacgtaggcattga

SEQ ID NO: 38792 - DNA, 930 bp, Glycine max
  Peptide Sequence Number=SeqID_155570
atggagcaaagtaaaaagaaccaaaatctaaaacaaggccaaagcccaaggataagtgggccagtgacgttgtggaagatattgtctcgcatcatcagtacccacgcgccaggactagcacgcgcctccccacgcgctactgggaaagcgcaatctcaagctggcgagccaggtatgaaggagcactcaagtgcgggaggtggccctccgtgtccagccactggatgctgctctttccgccgatgtggtccttcatgggacgttaaccagacccagaatccccctcaggtcgctgtggaacaccgtccgcgacacgaacagcgagatgtccggcctcatgttgaacagcgtccgggaaaactcccgcaccgccgcgggaacatccgctcccaccgacagcggcgcgaaaccgttcacccaggcctcgtagttcgcctccattgccgaaaacacctgctcgatctctccctgctcaaatcccccgtggtagtccttgtcattcaggaatctgagaaacttaatcaacaattagttaagaagttgggaggcgcctatgaggatgagtttggagaagaggtcggggcggcggatggaggccagcatgccgatcatggcggagatggagtggccgacgtagacgcagcgggggacgcggagggcgtcgaggatgttgaggaggtcgtcgacgtaggcgtcgagggtggtgtagcggcggtagtcgaagtggtcggggttgacgctgccggcgcagacgaggtcgtagagaatgacgctgtagttgcgggtgaagtaagggagcacgcgctgccacgcggattggtctgtgccgaagccgtgggccaggaaaaggtacttatcgccggaaccttccacgcggacgttcagggcgtcgagaatggaagtgcccatagggaatcttatctaacctaa

SEQ ID NO: 38793 - DNA, 552 bp, Glycine max
  Peptide Sequence Number=SeqID_155571
atgtccgttactgtggttccaaaagggatgaagtactcactcctttattaccattttgaagaccaaatgacaagcccaacgcttcatttgttagagataagggagcaacatgatgaacaacctaaatgctgcttgaagctcaaggaaaagcttgaagaagttttggcttttacatgcccaactcccttgagttgcatttgtattggttgttatcttggctgttgcatcttagtacatttgatatttgtattgcatcatacaacatcatgctgtctcataatcgattacaaaatagaattagttacttgttttccaactctcaatcctttctttcgtagtttctctgaggggtatttgactcctgtcgcaacctacccttcggtgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacagggaaggtgttag

SEQ ID NO: 38794 - DNA, 219 bp, Glycine max
  Peptide Sequence Number=SeqID_155572
atgtacaaagataagtggacccaaccttgtcccatgggctcaaaaatctaccctgaggttcatcagaaccctcgggccttcttcaacagttctaacccaatcttcttggagcctcttactcatggctatggcctcaaacagttattttcaacaactcaaggcactggtaatcgattaccagagacagattgcaaacgggcttttcaaaaagggttttga

SEQ ID NO: 38795 - DNA, 454 bp, Glycine max
  Peptide Sequence Number=SeqID_155573
agcttcaacattcaatttcaagcgttccgatatattacgggactcaatcggacatccgagtaaaaagttattgttgtttgaatttgctcagagcttcggtattccatttcgagcgtctcgatatattacgggactcattcagacatccgaagcttcggtattccatttcgagcgtctcgatatattacgagactcaatcagacatccgagtaaaaagttattgtcttttgaatttgctcagggcttcggtattccatttcgagcatttcgatacattacgggactcaatcagacatccgaagcttctacattcaatttcgagcttttcgatatattacaggactcaatcagacatctgagtaaaaagttattgtcgtttgaatttgctcagagcttcaacattcaatttcgagcttttcgatatatgacgggactcaatcagacatccgagtaa

SEQ ID NO: 38796 - DNA, 342 bp, Glycine max
  Peptide Sequence Number=SeqID_155574
atgtccagagcaacagttcttgcagcaagatgttctaaaattactctcaacggtgcaccaaggacaacctcccttattgatgcaacttttaccaaaaaagcatgtttttgctctgcacaacttctgaaacagaagctctctgtgcagcacgaagccgctaacaaacccttctgcttctaccctaaccttccctacccacaagcccacatgctcccttcttctccgacgaccttcatttctataccaggaaactctagtgaccagcccactccagcaaccccacatgagaatagcagtcatcccgcgatcccgttttggggtcggttggctgctccactctag

SEQ ID NO: 38797 - DNA, 237 bp, Glycine max
  Peptide Sequence Number=SeqID_155575
atgctgggtggtgggatgggaatgttagcagctttggatcatctagagaggataccaaataattgtatacgtggagatattggtgggacaccaattgagaagatgacaccaaagcaattatggtggtttggactttggacatgtacaaagaaggccattgaggcgccaatgaggagagtaaattgcatggtttttagtcctgtgaaaaggagagagggagaccaagaaggacattag

SEQ ID NO: 38798 - DNA, 684 bp, Glycine max
  Peptide Sequence Number=SeqID_155576
atggatccctctggcgatgttgcaagatccaagcgagggattcttttcttcgcgattgggattcagtttttttggagcagagaaagaccagaatcatgcgtcgtcgtcgtcgtcgtgatattgttggttgaagctcaacccgagccattgggtgaaggaggtattgttacaaaccacaacatgttaggaattcttcttcaccttgttttcaagaagaaaggaaagattaaatggttatcttgctatggagcatatggaggaggaggaatgacaaggaagattgatttcaacaatgacatcgtggagaaaaccatgcatgaacattcaagaaggggaaacatgggtctattagttgttcttcgttttgtagctacaacggattttgatcatgtagtgtttgaattaggttgtaaaatgaattgggaaaatattgttgttgagcgtagaaagattttagttactcatccatcctatggaataggatttgttaagaggcgagctaatggagttgctcatgagttggcaagggtggctccattgttccctagcctctactctgttgatcatgtgattccttgtactgagcatttaattcatggtgaaaatgacataattaaaagctcctacaaaatgttaaaaactaggggtattcacgggtatgggttacccacaaatccaaattga

SEQ ID NO: 38799 - DNA, 315 bp, Glycine max
  Peptide Sequence Number=SeqID_155577
gtcgactctagaggatcccacacccggaaaagtcctacagggccctggggtttccagctctggttacgggcctctatcagtcctatagggtgcccgtacccccccggcaagggatcgcgcctgcaagacacccagtggacccgaagaagtccaacagggtcttggagttgtcaagctctaattacgggtctctatcagttctacggagtacctgtaacctccagcaagggcatcaggccccctactgatcgagctttcatcaagaagtactgcgtccccaggcaggcgcagggcgaaacaccacagcagcattag

SEQ ID NO: 38800 - DNA, 577 bp, Glycine max
  Peptide Sequence Number=SeqID_155578
atggatgatgtgagattcaagtatggtattaggatatctttggttgttgcttggaaggctaggatgattgctagagcaataatggatagggatgttttgctagtgcaagatattagaaaaattgatgtcaacaaatggattttcattagtgatcaacaaaaggaggcatgggaagacaaaatgctacagttgaaggagatcaaacaagatgcttatgaatggcttattaaaactgttgacacaaatgcgtggtgtaagcatgctaaattagaaaaatatgttggtgaaatcatgcctaaaccaaagaagagattagacatggaaatagaacatactcgaaactggatcattgtgtattctgcacacaaaatagttgaggtcactcatgctttgaatggtgaaaaatttgttgtaaacctaattgataggacgaggtatagttggtattccatgttgccatgcagtggctgccgtaaggaaccacctgtttcaaatgatggggcaactgcagatgcaagcacaactgctaataggaaccaagttgatgagaatcaaaatgctactgtttccaaccaag

SEQ ID NO: 38801 - DNA, 204 bp, Glycine max
  Peptide Sequence Number=SeqID_155579
atggaccttttcagtggagctaatactaaggaggaggagccaacaaatttgaggtcaaaccctcttcaagggggagaagatgatgcaatcctccctaagaagagactagtcaccagagccattagcaagaggctccaagaggattgggctagagctgctgaagaaggccctagggttcttatgaacctcagggtagatttctga

SEQ ID NO: 38802 - DNA, 393 bp, Glycine max
  Peptide Sequence Number=SeqID_155580
atgtgtgccctatgtcctccaggaagaggaaatccacagtctccagacccctggagccctatgacaccaccagattcatctctgaggctgcctaggagagagaggaacattgtcctctacgtcacagaatacgacgagttccgtcgggagctggagaggcgatgctggcataaatccttgaccaggcagatggatgggcacatagatgtggccctggagctttctaagacatttttccaacatctgaccgttgggattttgaaaataacaacttttgatctcttgctaggcgagaatggcgcgctaagtgcaattccaaccaaagaaggaattgcgctgagcgccccgaggtgcgctaagcccaattccaaccagagagggaattgcgcttaa

SEQ ID NO: 38803 - DNA, 255 bp, Glycine max
  Peptide Sequence Number=SeqID_155581
atggtcgcactttggcagcgatttagcttctttttctcttcttccttcttcttttctcttctttctctccaatccttcacctatggatttcataacctccctctcagcccctcttcattcttatttatagaaaaacaaggcatttggggtcatgacagctcacctaggcgagctggttacttcaccatgaggttatttggtggcttaggtgagccagaggctagcctggccgagccaggggtcagaaaagtgtaa

SEQ ID NO: 38804 - DNA, 399 bp, Glycine max
  Peptide Sequence Number=SeqID_155582
atggggaacaaaagctcatcaacttcaaaggcacaatatagtagtaatagccagggagaaaaggttgcttcaacacaactacaatatgttgctgctccacacccgaggaaaatctccacaaataatccaaaggatgtgagtcaaacacaacaacatggtaagaagccactaggtaatgatgaagctttcaccacttacattaaagatgctagggttaaaatgaagagcaagtcaaacatcggtgtccaccatgaggatcggaacaacgttataccggtagatgtggctaatgaaaccaacaaggaatatgaaaaagaccatttttcagattttattcagaatgctaggaagaagttgaggactgtaacaagaaggagtagctccatcagaagagggtaa

SEQ ID NO: 38805 - DNA, 246 bp, Glycine max
  Peptide Sequence Number=SeqID_155583
atgcaatatgtgaatacacttaatccaaaggttcttatatataaaggggcaaggccaaccagagttgaatcgctaccatcaaggtcaaccatcacattttcagacacgaagcaaaggcgttgctcagaaaacacattttcaggtactaacctggagaggaagcgacgagggaacaagccacaaaaccaaatagggtttcaagttgtgaggtatcgagaagatgaaatgatgatgacgttgcagtag

SEQ ID NO: 38806 - DNA, 294 bp, Glycine max
  Peptide Sequence Number=SeqID_155584
gtacctgtcacctccagcaagggcatcaggccccctactaatcgagctttcatcaagaagtactgcgcctccaggcaggcgcagggcgaaacaccacaacatcctggggatggccgacagcgggcaacagacacaccgccatcacctctagagttcacctcagctcatccacaaaaaggtagcaagataccttggacacgcatgacatcccctttatccccagctgttcatggaggattgcctttagggtcaaaccctgacatatatcatgaccagccgttctacaagccttga

SEQ ID NO: 38807 - DNA, 156 bp, Glycine max
  Peptide Sequence Number=SeqID_155585
atggagatgacgaaatccatgatgtggatgagatggcatgatgcatgtgctagaaacatggtgggaagcatgggtgcatggatgatgccaattggcaatttcaaagacggaaagccactaagccagggaacttcatataaccaaacagccatctag

SEQ ID NO: 38808 - DNA, 243 bp, Glycine max
  Peptide Sequence Number=SeqID_155586
atggagaaagtaaaaaaggaagaagagatcaaaggatcgaggaagaagattagtaacgaagagattgaaacaaagggtgacacagtgagcaaaagggtgattcgtgagttcatagtatcgagtggtggtggtgacaatgaaagggctcaaaaacctgatgatgatccgttcgttttattgctcattggaaatttactgccactagagccacctgtttcttctaccttgttcggatcctcatga

SEQ ID NO: 38809 - DNA, 252 bp, Glycine max
  Peptide Sequence Number=SeqID_155587
atgcctcctgcatgcatctcgccagctggactggcgattccttcattgcacgcatctcgccggtgttgctggcagaaccctcgtgggttgcatctcgccgttgatgctggtggaatctacatcatgcatgctggatggatggcgcatgggcgacgtatggatgcatgggaagcaaaggtgagtctcaccaacaggaatgacggaataaggggaataaaagattcgccaacaggaatggcggaacacctttaa

SEQ ID NO: 38810 - DNA, 1276 bp, Glycine max
  Peptide Sequence Number=SeqID_155588
agggctgcactccctcgccttcagaggactacatgtactcgccatcagagggctgcatgccctcgccttcaaagaactacatgtcctcgccttcaaaggactacacgtcctcgccttcaaagggctacacgccctagccttcagaggactacatgccctcgccttcatagggcaacacgtccacgccttcggaggactacatgtcgtcgccttcagagggctacacgtcatcgtcttcagaggactacatgtcctagccttcagagggctgcatgtcctagccttcagagggctacatgccctcatattcaaagggctaaacgtcttaacctatagaggactacacgtccacgccatcagagggctgcacgtcctcaacttcagaggactacacgtcctcaccatcagagggctgcacgcccccacctttagaggactacacgtcctcgccttcaaagggctgcacggccttgccattagaggactacacgtcctcgccaacagagggctacacgccctagccttccaaggactacacatcctcgccttcagacaattacatgccctcaccttcagagggctacacgccctcactttcagggactacacgggactaaacatcctcgccataagaggactgcatgcccccacctttagaggactacacgtcctcgccttcaaagggctgcacggcctcgccattagaggactacacatcctcgccatcagagggctacacgccctagccttccaaggactacacgtcctcgccttcagacaactacatgtcctcgccttcagagggctacacgtcctcaccttcagagggctacacgccttcgccttcagaggacttcacgtcctcgccttcaaagagctacacgccctcgctctcagaggacaacatgccctcacctttagagggctacatgtcctcgccttcagaggactacacgtcctggcgttcagagggcgatatgtcctcgccttcagagggttacacgccctcgccttaagaggactacccgtcctcaccttcagaggacaacatgtcctcgcccctagagggctacacgccctcgccttcagaggactacacatcctcgccttcagaagactacaagtccttgccttcagaggactactcgtcctcgccgtcctcaccttcagaggactgcacgtcctcactttcagaggactacacgtcctcgccttcagagggctacatgccctcacctccagagggcaagacgccctcacttttagaggactacac

SEQ ID NO: 38811 - DNA, 1160 bp, Glycine max
  Peptide Sequence Number=SeqID_155589
aagaagctattgagttttgttcagagtacattgaaaaggcaaaacctgttgggcttcccaagtctcgacatgacaaaagagtgagagtccgtcatgaagctttagtcaaggaaagtaacctaaaaatgaccaagaataggatgttgaaagagcataacaagactttcctaaattggtttaaagatgcaatctttggttacaataatgcttcagaaacattaaggaagttaacagatagacctaaaagaaatgttataacttgggaaggatatgatatcaacaagtatttgttctacacgaaattacaagacgatgagagtacaatgcaaaacagtggggttagtctaagggctgaatctcaacactttactactgttcatgatgacaatcttcatgtagcttccatgcattactttagagtcattgatgaaatctgggagcttaattatgtaaaattcattgtttgtgatttcaagtatttgaagaaattcgcttatcagaatgagcctttcatcatggcagaacaagctaaatatgtgttttatgttcaagatccttgtaatgaaagatggtcagtggttctacatgaaaaaataattggtgttaatgttgaagatgatgattcaattacatcgcacttggctacaccacccaactcccctccttgtcctcttgaaccagtgattcatgtggatcctgccactgggaaagccgatggtcctcgtaaaaagaaattacgaatgtatttggggatcatcgctcgcgataaggtggatgttacaattgataattggaaacaagtccatgtagctcaaaaggatttgatttgggaggatattcaggctgaatttgatattcctgaagcatccgatttgagaacaaagaaaaaaatacttcaaacttatgacataagcaaagagaagtggaaccagttttgtcaaagtcgtagagacccgtcatgggaggatgttcgaaagaaggcacagaccattcagaaacaaaacactgcctttcacgtgttgtcctatgtgggttattattttctagaagaaaagtttatggaggacaagaaaaagaaacaattggaggaaatagcacaatttgggatcacgaacactatcattgatccttcatctgccattagacgacacatgaagtga

SEQ ID NO: 38812 - DNA, 231 bp, Glycine max
  Peptide Sequence Number=SeqID_155590
atgaacaaccttgttacacaagtaatggggaggttgtttgtggtgaatctggaaggaaagatctatagctgcaaacactgtcatacccatcttgcgctttacgatgacatctactccaggcatggttttaaattgcggtccgcaaccgcaacctcaagctattttgacactccgcaatcgaataatgatggcaattgcaaccgcattttccagcaattgaccgcaatgtaa

SEQ ID NO: 38813 - DNA, 460 bp, Glycine max
  Peptide Sequence Number=SeqID_155591
gtgggttccatttgacattgcaaggcctctgcttgacagaaaaccttatgttgtcttatcagattcttccattttacaaaatggagagtcatccctacctcaaattactgacgatgtaatgggaagggattttgatgatgttggccaagaagatgcaaatgatgttccaatgcttgatgaagaagaaatggttgattctgaatctgaatgctctgatgatgaacctgacctagaaaccacttcagatgatgatccagaaattgttgatgtcagcaaggttttgctagggataaagggatctcatgtgaaatacaaggatctgtgggttgtctttgatcctgagcagcggagttacttggagtcacgattgcggagatacaggaaggttgtgggtccagcgctatccgagagaatgggtgctttattggttcttttcgtggctcttcgtgttgctcattag

SEQ ID NO: 38814 - DNA, 132 bp, Glycine max
  Peptide Sequence Number=SeqID_155592
atggtggtggagaaggaaacatcgccaataccgtgtatcagtggatttcaatattgcaatcccatagttcaggtcgatggaatatggttgtacgataagtacaaggggaccttacttgtggcagttgcataa

SEQ ID NO: 38815 - DNA, 324 bp, Glycine max
  Peptide Sequence Number=SeqID_155593
atgctaaaatttatagcagtacaacttgttgacaacgaagacatgaaagtaaagcctttctcatcaacccgaccaaacaagcctgagtttacaacagagccaggcttacctaacaaagaactctgtccatttagtgaggatgaagacgaagttctacataatcaaacccaggaggacgatgatgaggaagaagtcgatcctgtttcaccaacacattcgtatcaccatgctacataccaccacacatgcaaaattttgaagaatctaattttcaagattttgaatatggtcatagcttggatcgcgaagaagtccaacatctag

SEQ ID NO: 38816 - DNA, 435 bp, Glycine max
  Peptide Sequence Number=SeqID_155594
atgcattgcatggcgcatgtgagagtcggagttaagccaagcagattcgacgaagtttatgatctctctgatgccgctggcgccgatgaaggctcgtggcgattcaaagtcttccatgccatgaattgcatcaaagacggtgcactgcgtgcggccagtgtggttggcgtgggactcagcggttcggcccaggtcgaggaggtagcggatggcgatgtcggcgaaggcgtcgagagccgaggcggtggcgccatggaaccccgcggcgtcacagagctacgccatggcgaggcgggtgacggcgcggccgaagtcgtcgggcgtggctcttgccccgtcattggtcatgagttgttgggatggaaaatttggatttctgcaagcggcattgtttggagtccattggggattgagtgtttcggggactgcaattaa

SEQ ID NO: 38817 - DNA, 210 bp, Glycine max
  Peptide Sequence Number=SeqID_155595
atgttaaatgtcatagatgaggatggtcataacctttcagagttgcatgggcccaatgaatcagattctttgccgttagattcatttgatcagctagccaatattgtgaaaattaggcaaaacaattctctcggatacgtcctgccacattgtatcattactactggggagcctcgcgttgctttgcgacacataggaatagagacctaa

SEQ ID NO: 38818 - DNA, 1470 bp, Glycine max
  Peptide Sequence Number=SeqID_155596
atgcagaaagcagggtacggtggcgatggaatatacaggtctctaaggccttgtttggttctcccaaatgaccccaacctctccctcgtctcattcctcttccaaagcgtttcctctttcccatccaaaatcgccctcgtcgattcccactcttcccaaacacttaccttggcgcacctcaaatcacaggtcgccaaacttgcccacggtttcctcaaactaggcataaacaaaaacgacgtcgtcctactgctcgctcccaacagcatccactaccctatatgcttcctcgctgccaccgccatcggcgccgtcgtctccaccgccaatcccatttacacagtcaacgaaatctcgaagcaagtcgacgactccaaccccaaactcctcatcaccgtcccagaattatgggacaaagtcaagaacctcaacctccccgccgtaattatcgatacggaaacagctcaaggactcgtgagtttcgaagctggcaacgaggtgtcgagaataacgagtcttgacgcggtgatggagatggctggaccggcgacggagctgccggagagcggcgtgaagcagggggacacggcggcgcttctgtactcctcgggaacgacggggttgagcaagggcgtggttctgacgcaccggaacttcatagcggcgtcggtgatgatcggaatggacgacgacctcgccggggagcaagacgacgtgtacctgtgcgttctgccgatgtttcacgtgttcgggctggcggtggtgacgtacgcggcgctgcggcgagggagcgcggtggtggtgatggagaggttcgagctggaggcgctgctgaaggctattgagaagcagagggtgacgaagctgtgggtggtgcctccgatcctgcttggtctggcgaaacagagcgtggttggaaactacgatctttcctcgttgaggcgtataggttcgggtgctgctcctctcgggaaagacttgatggaagagtgtggcaggcgttttcctcatgttgccatttgtcagggttatggtatgacagaaacttgtggcattgtttctgtggagaatccaagagtaggggttcgtcatactggctcaacgggaacgctagtttcaggagtcgaagctcaaatagtgagtgtggatacacagaagcctctccctcctagacagttgggagagatatgggtgcggggacctaacatgatgcaaggagatcttggatattttgatgaagatggacaactttatgtggttgaccgtatcaaagaactgatcaagtacaaaggtttccaggttgcaccagcagaacttgaagggcttctcgtttctcaccctgaaatactagaggctgttgttgtgccatatcctgatgatgaggctggtgaggttccaattgcctatgttgttcgctcacccaatagttcactgactgaagaagaaattcagaagtttattgctaagcag

SEQ ID NO: 38819 - DNA, 546 bp, Glycine max
  Peptide Sequence Number=SeqID_155597
atggaatcaccttccaacaaccccggtctccatacaactcctgatcaagctactaaggcttactttacgcaacaaactatgtttcgaatcaaggaccccaaagtgagccttgatttttattctcgtgtcttgggcacgtatttgcttaagagattggattttctggagatgaagttcagcctatactttatgggctacgaggatacgacaaaagctccaagtaatccagttgaaagaacggtttggaccttttctcagaaggctacaatggaactaacagataattggggtactgaaaatgatccagagttcaaagggtaccacaatggcaattctgaacctcttggctatggacacattggcatagctgttgatgacacatacaaggcatgtgaaagatttcagaatctgggagttgagtttgttacgaaaccagatgatggggaaataaaaggtttagcatttattaaggatcctgatggatactggattgaactctttgatctaaaaatattaggaggtgaacaagctgctgctcatgcttaa

SEQ ID NO: 38820 - DNA, 141 bp, Glycine max
  Peptide Sequence Number=SeqID_155598
atgacacgagagaaagagagtggatgtacgagaggcagtgagaacgacatcgtgagtggaggaactgcaacggagaagaagaggtgcacaacaacggagagagaggaagaggcacgaaagagacctataaaactaatttaa

SEQ ID NO: 38821 - DNA, 201 bp, Glycine max
  Peptide Sequence Number=SeqID_155599
atgcaggatcctgcagaggcagacaagttgatgaaaatccagagagagttggatgaaaccaaaatcatccttcataaaactattgatagtgtgctagctagaggggagaagctggatagtttagttgagaagagttctgatctgagtgccgcttcgcagttactaaagtgtggttacggtcacataattgagcatgcatga

SEQ ID NO: 38822 - DNA, 246 bp, Glycine max
  Peptide Sequence Number=SeqID_155600
atggtccgcacaaaaaaatctggtcaaataacgtctgaggcagtaaagaacattacagataggattgattccttggaggagcatgcctcccatagacgtcaggatgtactgcctattgccatcaggcgaccagaacaccctggtcatgtccatgctggtggagctagtgtcatgatcaaacaatactttggaccgacttcaaagagccctcgcacgtctgtgtccatggctcccgaagacttgtag

SEQ ID NO: 38823 - DNA, 486 bp, Glycine max
  Peptide Sequence Number=SeqID_155601
atgcaatcacaaggactcgcactgcttcctgagcctaaggttggtccttctactgctcgtgtcagcacaaaagaaagttgtgttgatcccttggggcaggacccaaacatgggtgacttacaaaaatgtaggttgtatgtcgatgaaaatcctccctgcttggttgcccttggaagagtttgtgaggcattgatcatcgtccacaacattcctttaggcaacgatcaagtcaaggttggtgttaaggaagtccgagatgttgatgcttacgtacctgtacccactcaagaggataaacagagatctgagggaccagcgaaacctgcagataggccggatcctgatgtgaatcccttatacctgatgacattgaccatcctacagtttttcctcaagcctttacatatgactgagacaagtatgcgagcagagaatgcctttgtgtatggattcctcgagtcacagtccatacaaaaatctgggtaa

SEQ ID NO: 38824 - DNA, 277 bp, Glycine max
  Peptide Sequence Number=SeqID_155602
ggaagcattttataaagcagacgtgaatctcgccattgcaaccagcgagatactgcagcaagaaatagtgcacctcacttcgtcttcttccacgggtctcgctgctacgactgacgacttccatgggcgtctcgctacctcgactggcggcatccaactggcagctgtctcgccattcatcctggcggcttcatccacgtgtcgccacgccagtgataccgccatgcaggctagcgggataggctggggtttacatagaaaaacagacccaacttga

SEQ ID NO: 38825 - DNA, 483 bp, Glycine max
  Peptide Sequence Number=SeqID_155603
atgactgaagaccaaatgctagctcatgtgactcagttccatgaagctcggcaaaagagaaaggctgaagaagaagaaattgttgttgttactatgaaagatgttgcctcaatccaagctgaagcatttgctaaagttgtggacgaaaccattgtatgtggggtcatcattgatcttaccaacactggtgtcatgaacgaaactcctaaagcatctaatgcaaccatagcttatgaagttgaacacaatgttatagaacctgcatccaagcagtcaataacttcaaatgaggctacttctagagacaagggcgaacctgatgttgtcattgtctactccaccaactcaggtcctactcctctgaactatgcacaacccaccactgctactagggatcaagtgcaagatatgatagggcaagtgataagcatcaaatttattgaattttcatatgcattttgtgatgtttatttggcattttag

SEQ ID NO: 38826 - DNA, 1548 bp, Glycine max
  Peptide Sequence Number=SeqID_155604
caatggcttctttgccaacacttctctcgttcgccgtcatcttcttcaccgtcgccctcttatacctccgccgcgtgttccgccgccgtcagttccgcctcccgccggggagccacggcctgccgttgatcggcgagacgctgcagctgatatcggcgtacaagagcgacaatccggagcctttcatcgacgagcgcgtggagcggtacggttcgatcttcacgacgcacgtgttcggcgagccgacggtgttctcggcggacccggaggtgaaccggttcattctgcagaacgaagggaagctgttggattgcagttatcccggttcgatatcgaacctgctcggaaaacactctcttctgttgatgaaaggtgctctccacaagagaatgcactctctcacaatgagcttcgccaactcctccatcatcaaggatcatcttcttcaccacatcgaccgcctcatctgcctcaacctcgatgcctggtccgacactgtctttctcatggatcaggcaaaaaagcatgtgattgcgatgtacgtaatgggaatgggggtggtgactcagattccatggttcggtacaatgagtccaatttccttgcacatgagcctttacatctcgttaacttaaatgaaaagataacatttgagttaacggtgaagcagttgatgagctttgacccagatgaatggactgagaatctaaggaaagagtatgttcttgtgattgaaggattcttcactctcccttttcctctcttctccaccacataccgcagagccatcaaggcaagaacaaaggtggcagaggcactagcgttggtagtgaggcagaggagaaaagagtatggtgaaaacaaagagaaaaagagtgacatgcttggggcactgttggcctccggcgaccacctttccgacgaggaaatagtggattttttgttggctttgctcgtcgccggttacgaaaccacctctaccataatgactcttgcgatcaagttcctcactgagactcctctggccttggcacagctcaagttggggtttactgaaccggtgaaccgtatggatgtggctgcatggaaccccaccctgcaccctgtctatgtccatgaccatgaccaccacaactccaccgaagagcatgaccaaatcagagcaaagagtcacccaggggcaccactggaatggacggattacaagtcaatggcatttactcaatgtgttgtgaatgagaccttgagagtggcaaacataattggtgggatatttaggagagcaacgacagacatcaacataaaaggttacactattcctaagggatggaaagtctttgcatcatttcgtgctgtacatctgaatcctgaacattacaaagatgcccggtccttcaatccctggagatggcagagtaactcatcagaaacagcaaatcctgggaatgtttatacaccatttggaggagggccaaggttgtgccctggctatgagctagccagagttgtactgtctgtcttccttcaccgcattgttacccgcttcag

SEQ ID NO: 38827 - DNA, 507 bp, Glycine max
  Peptide Sequence Number=SeqID_155605
atggttcttccggtagaacaatttattctaccagaagaaccttctcctggagaagctaccagaagaagttcttccggtaacctctccggaagaagattcttccggatgaacaatttgttttaccggaagaaccttcttccggaagcttctccggaagaaggttcttccgatagaataaattgttcatccggaccggaagaaagttctcccggtagaataaattgttcatccgaaagaaccttcttccggatgaacaaattgttctaccagaagaaccttctttcggaagctttccagaagaaggttcttccggtagaatacaaattgttcttccgcaagaaggttcttccggaaagcttccggaagaaggttcttccggaaagttttcggaaaaaaggttctttcggtagagcacaaattgttcttccggaagaaggttcttccgaaaaaacacaaattgttcttccagaagaaggttcttccggaagaagaaattatcttttttaa

SEQ ID NO: 38828 - DNA, 2421 bp, Glycine max
  Peptide Sequence Number=SeqID_155606
atgagaatcacgttggagccgagctcggagccaagcccaagcccaagcccaagccgttcccaaactccgaaagaagaagtcgaatgggtcccacttcccaagcaccctctcttcaccgcacacggcggagccaccaccgccgccgcttcccggaacctcctggcctgggacggagcctcgcgcctctacttctgggactcaaacaaacgctgcctccaccgcctctctctccgtctcggcgaccccgatccctcttccgttctcgccgcttccccctctaaggtgttgcaatcggacgcggtgctcgatttcgatgtccgcaaaatctccatcaacaggaaaggaacagcgatactccttttcggttccgagactctctctgttatgtacctctacggacgcgcctctaagaaggacgtgaacttgatttgcaggactattactattggttctcagacatattgcactggtggcaatgatattcgtgtgttacaagcattatggcacccttacagtgatactcatttgggaatcctttcttctgactctgttttccgacttttcaacctggctgtggatcctttgcaacctgagcaagaatattatttacagcctgttgagcctggtagaactagaaaggcctcatcattgtgtccagttgatttttcttttggaggagaccacttatgggaccggttcagtgtttttattttgttcagtaatggggctatctatgtactttgcccagttgttccatttggaagtctcttcaaatgtgagtctctggtagaaatatacaatgatgctcacacatttggaaaaatatcagccaactctgttgcggcaagtaattcaaagttggccatctcctggttagaagcagcttttcctgagttacagaaccaagaaactaaaggagacagcttgtctttgctaaaagctcattcttatgctttatttgatgcatctcttgtcttgcagggacctctgcgaagagtaggtcaggatgggaatgaagattcagttggtcgtagtgcagaatgtgaaggtcgtgctgttagttttctctacaatttagtcagcaaagattctattttggtgactgcctggagtggtgggcagttacagatagatgctctagccgatgagatccaacctgtctggagtgttggtagtccacctcgtcttcgtgttgattctcatgaccaaattctcggccttgctatgatttgtgagtcaattgccagcagcagtttgtggaagcttgatcataatgcctggttgggtaatccaccccctttgctgagactggctattgttgatttggctctgccacgaaaagcagaaagtggttataatatttcattgttcattgatacgcttatgccagaaagaatatattcccttcatgacggagggattgactcaatagttttacattttcttccatttacaagtcagacaaatggcaaggatgatacgatgaaaacaccatctgtgcaccctgttctaaatacttgccagagtggattcacctcagaaccttcactttgtggctttgtgtcattatcagattcatttggatattcatggattgtaactattacactttctctagagtgtgttgtgcttgagatgaaaagctggaacctcttgcttccagtaagcattgatatggagaagaaacccatttcatcagagggggaatcaaaagggagagatataccaacaataattagcaaggaactacttagtggacccagggaggtacttgttcctcaggcctctccaagtttacgttccgttgcagctgattcaattgaaggccgatcaacattacatcagtatttcaagctgtttcatgaaacttatgtggagtatgcacataaggtgtacctggagctcaagcatcacgcacctcagttgaagaaaatcattaatgaccaacattctcgaataggtgatgcacaacagaaacttttgaaagttgacgagaaagaggctatattacagaaaaggatagatcgtgcaattcaaatgcacaattctttggaagagcgcttgcaacaattaaggaacttaccttgcgtgcacaaaaaaccactgtccagagcagagcgaaagtttaaatctgagcttgatcactttaaggaagttgagttggatgctttgcattcttctgttgatgcggtaagtgcaaggctgagaaggcacttgcaagcttcgaaagctaatcaccaacagcaaaaaacaccagggaagaaaagttatgcaggagatgatcagatgtccttgctcaaatcatcgcttgaaaaactttcacttttaaatactgaaaattcaaagaaagttgaacttgtggagtcttcattgagaaacaaagaaagaagcagtagagaaccaagcctgcctatgccatga

SEQ ID NO: 38829 - DNA, 429 bp, Glycine max
  Peptide Sequence Number=SeqID_155607
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagagaaagacccaaaaagactataagagaggttatcaaaaaggatctcgaaattaatggtttggatcgaagtatgacatgcgggtgcacggctctttcttactttggacatcagaacaaaaacatatcatggagatcttcatcaaatccttatccctttataatcaaacgaataatcactcttttcattggcttcacactcccacaaaaccctttattagcataa

SEQ ID NO: 38830 - DNA, 747 bp, Glycine max
  Peptide Sequence Number=SeqID_155608
atggagttacagctattaggaggagaaagaatacttttgaggattttgaagagttggaaagtactattttttgctggcaagaggcttttccaaaattacctagatataaattggagtggtttaatgaatctgttattgctgaggatattagaaaggctgtattctctatgggtaattttaaagccccgggaattgattgtctccaagcagttttataaaggtaattgggagattgtggggaaggaattttgtaaggttctttgggatggggaggttcttgacaaatttcaaccatcaagaaggattagacatattttatgtagaccattcacctgcctgtttcattttgcgaagaaattgatcaacactgtcgaaattttgtctgggggatactacaaatgcaaaaagattccactggctaaactggatttcgtttgttttcctaaacgtgatggtgaacttggtctaagaaaggttggccttatgaatcaagcattgcttatgaagtgcgaaaatgatactctccctgttattgattcgaggagaagtgaatcgaatttatggagaggtattgtgaatggttgggattccttgaagacaaatttaaagtggaaggtgggaaatggaagggctacaaaattgtggaaaaattggtggatctggaagaattttaagtcaaaagataagaccataaagacaacttcatgtggtgaggttatatgggactgtaagagtgtgtttggatag

SEQ ID NO: 38831 - DNA, 455 bp, Glycine max
  Peptide Sequence Number=SeqID_155609
gtgtttatagtttgtgtgatggaccaaggctttcgcatggaccttatttggggatcacgaccatgtgctctgttttgtctctgatgtttgtgtcgttcaaagcagtttacatcttcagtgtttcgggtattgatcgaagtgggtatgttcgtgccaccgaaatagctctgttcgtgtgttcttgtgcgttggccgtggggcatgttgtggtggcctacagaacaagttgcagggaaagaagaaagcttttggtctacaaaattgatattgaagctcctaagatcacggccttcaatgttgtcatgatgccattccaattggcaccttgcaagttgaagatttcagcttgcaaaaatgggtatcctagagctacagctattcatcatattatgtccttgcgtgcgtcaagggatgctacggtttatccaaaggatgccagtaaccttgacacctaa

SEQ ID NO: 38832 - DNA, 698 bp, Glycine max
  Peptide Sequence Number=SeqID_155610
gactacacgtcatcgccttcagaagactagacgtcctcaccttacgaggacaacacgatcttaccttaagaggactacacgtcctcacctttagagggctagacatcctcgccttcagaggactgcacgtcctcgccttcagaggactacacctccttaccttcagaggactacacctccttaccttcagagggctacacgccctcgacttcagaggacaacacgtcctcgccttcatagggctagacaccctcgccttcgtagggctacaccccctcgacttcagaggactgcacgtcctcaccttcagagggctaaacatcctcgcctccagaggactgcaagtcatcgccttcagaggactacacgtccttgccttcagaggactacatttcgtcgcattcagagggcaacatgcccttgccttcagaagactacatgtcctcgacttcagagggctacacgccctcactttcagaggactacacttcctggccttcagagggctacagaccattaacttcagaggactacacatctttgcctttagaggggttgacgccctcccctttagaggactgcacgtcctcgccttcagtgggctacatgccctcgccttcagatggcttgaagccctcgccttgccttcagagggctacacgcccacgccttcagacggctacatgcactcgccttaa

SEQ ID NO: 38833 - DNA, 354 bp, Glycine max
  Peptide Sequence Number=SeqID_155611
atgtccaatggggatattcccattaccagacctgaagcagagtggacaaatgatgatctagccattatgaagcttaacactaaagcaatatatactctgacatgcactgaagatgtcagactaaggaaagttgggactctgactagacattatgaaagcttcatcatgaaagataaagagtctgtggaagacatgtttggaagacttcaagttcttctaaacaatctagaagctcttggacaaacatactccaagactcagataaacttaaaggtgttggatagctttcccaaggtgtgggaacccaaggccacatccatccaagaagcaagagatttgaaaaatcttgcatga

SEQ ID NO: 38834 - DNA, 156 bp, Glycine max
  Peptide Sequence Number=SeqID_155612
atggtcacaagggatgactcaaatagtgagaagagtagcggttcagataatgaacaagctaacatctgcctcatgctagatacagacgataaggtcaagacgataaagagttttacaaagatagtgaaaatctcaagtgggttgcttgaggactag

SEQ ID NO: 38835 - DNA, 300 bp, Glycine max
  Peptide Sequence Number=SeqID_155613
atgcaagtggctggcctaacaaatcaccatattatcaattgcatcagattcaaggagtctacctccaatgcaaaagcaataggaaaagagagctccctcaactccaaggtcaaagagaaagcaaacgaggaaccaaccgaggtagttgtaaggggggatgagttgattgtggagtgtacaaaattgatacagagatacgatgaaggaagtaagaaacgaaacaaagagggggaatataatggagtgaaacctgaatggaggatggaggataacagttgcaatgaaatccttttcttctaa

SEQ ID NO: 38836 - DNA, 189 bp, Glycine max
  Peptide Sequence Number=SeqID_155614
atggcatacggcacaccagatgatgcgtgtcaaaagggatcattctcatctctaagggatgctgattgctcaacggcttctttgtcagaccctatgtatagggaaaaaaactgggttgtgagtaataaaacattaaaacctgttggacaagataactgggttgtgagtcataaagcctatcttggataa

SEQ ID NO: 38837 - DNA, 1869 bp, Glycine max
  Peptide Sequence Number=SeqID_155615
atggtgtccgacgccagcaagaagaaggccgcacagaagaaggccgccgccgccgccaagagaggtggcaaagctgccgccgctgccgttatggccgccacctcttccaaagccgccgacaaggtcgccaacggaatcgccgatattcagatttcggatcggacctgcaccggcgtcctctgttcgcatcctctctccagagatattcgaatagagtctctatccgtcacattccatggacatgatctcattgttgattctgaattggagctgaattatggaaggcgttatggcttactcggattaaatggttgtggaaaatctacactgcttacagccatcggttgtcgggaacttccaattcccgaccacatggacatatatcatctaaccagggagattgatgcctctgatatgtctgcattggaagctgtcataagctgtgacgaagaaagattgaaattggagaaagaagcagaagctttagctgcacaggatgatggaggtggtgaatcccttgaacgcatttatgaacgattggatgccctagatgcagccactgcagaaaagcgtgctgctgaaatcttacatggtcttggctttgacaagcaaatgcaggcaaagaagacacgtgatttttccggtggctggagaatgaggattgcattagcgcgagctctatttatgaacccaaccattcttctacttgatgaaccaaccaatcaccttggtatactctctgccctggaaagagttcctcttgtttttgtaaataatttttatatgtcttatgcattagttggttggggtgatttggaagcttgtgtgtggctggaggagagtttgaagaagtttgaacgtattctggttgtgatttcacactctcaggactttcttaatggtgtctgcacaaatattatccacatgcaaagcaaaaaactgaagctctacactggtaattatgatcaatatgttcagacacgttctgagctagaagagaaccagatgaaacagtacaagtgggagcaggagcagattgcctcaatgaaggaatacattgcccgatttggccatggttcggctaaactagctcgccaggcacagagtaaggagaaaacactggcaaaaatggaacgtggtggacttgcagagaaggtggtcagagacaaagttttggtatttcgttttactgatgttgggaaacttccccctccagttctccagtttgttgaggtgtcatttggttatactcctgataatctcatctacaagaacattgactttggggttgatttagattctcgggttgcgctggttgggcccaatggtgctgggaagagtacactactgaagctaatgacaggtgacttgatgcctagtgatggcatggtccgacgtcataatcatcttcgaattgcacaatatcaccagcatttggccgaaaagctagacatggaaatgtctgctctccagtttatgattaaagaataccctggaaacgaggaagagaagatgagggcggcgattgggaagtttgggctgtcaggtaaagcgcaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggacggtggcttggtgcttgtcagccatgattttaggctcataaatcaggtggcgcatgagatatgggtatgtgctaatcaatctgtgaccagatgggagggtgacattatggaattcaaggcgcatctaaagtcgaaggcgggtttatctgactga

SEQ ID NO: 38838 - DNA, 411 bp, Glycine max
  Peptide Sequence Number=SeqID_155616
atggcggagcttaatgtaagaagcagcagcagcaaaaggagggttttaggtggtattttgaagttgaagggtgtgttggaaaagctacaaaagagtatcttatttcgcagaaataataaatcaagttgttcctattgtggagaatatgattatgaagaaggagatcataacacagtgtgtgtgcaagaaggacattttgcagtgattgctgagcatgaagaggagatcacaaagagattcttggtgccattgagctgtttaaacaactcaacattcttgagtctattggagaaagcagcacaagagtatggctttgatcaacatggtgcactaaccattccttgcaggccaagtgaacttgagaggttgttattggcacagcaatggaaagaaagagggagattcttctga

SEQ ID NO: 38839 - DNA, 465 bp, Glycine max
  Peptide Sequence Number=SeqID_155617
atggctcttccatctgctgatgaaaaacttttggatacctgctacctgacttatgtgaagttacaattgcaaagaaggagattatccaccgtttcctctgccctggctgagactgcagcgtcaatggcagtagctgtaactgtcgttggtgcagcagctacccttcttgtaaagagatccaaaacttctgagtcatcacagcaatatgccagtgtgccactaaaaaatccaccttgtttttccgtgcaagagcatgaaaatctttggaaggcttctcctgttcaaattcaattcaaagcatgtgaagattgtggaggttctggtatatgttctgaatgcaaaggtgaaggattcgttcttaggaaacgttccgatgaaagtgctgagaaggcaagagtgcaagctaagaacatggcaacccgattcacagcggggtactatgttgttacatctcttttcccctag

SEQ ID NO: 38840 - DNA, 2421 bp, Glycine max
  Peptide Sequence Number=SeqID_155618
atgtctcaccaagccgaatcctccgactcgaaatcttggaagaaggatttttccactgcgattcttgaacggaagaaatcgccgaatcggttagtcgtggacgaagcggttaacgatgacaattcggtggttgccatgcaccctcaaacgttggaaaaactccaactttttcggggagacaccatcctcatcaaggggaagaaacggaaggacacggtttgcatagctcttgcagacgataattgtgaagaatcgaagataagaatgaataaagttgttaggtcgaatttgagggttcgtcttggagatgttgtttctgtgcatgcgtgccctgatgtcaagtatgggaagcgcgtccacattcttcccattgatgataccatcgaaggtgtcactggcaatctctttgatgcttacttgaaaccatatttcttggaggcttatcgtcctgtcagacaaggggatttatttcttgtccgaggaggaatgagaggagtagagttcaaagtcattgaaactgatcctggggagtattgtgtggttgctccagacactgaaatattctgtgagggggaacctgtgaaaagagaggacgaagaaaggctagatgaggttggctatgatgatgtgggcggtgtcaggaagcaaatggcacagattcgtgagttggtagagcttccactgagacacccacaactttttaaatcaattggtgtgaaaccacccaaaggaattttgctgtatggacccccaggctctggtaagacattgatagctagagctgttgctaatgaaactggagcattcttcttttgtattaatggcccagaaattatgtctaaactggctggagagagtgaaagtaatctcaggaaggcatttgaagaagctgaaaagaatgctccctccatcatctttattgatgagattgattctattgcacccaagcgggagaagacacatggtgaagtcgaaaggagaattgtttcacagcttttgactcttatggatggattgaaatctcgtgctcatgttattgttattggagctacaaatcgaccaaatagcattgaccctgcattgagaaggtttggtagatttgatagggaaattgatattggtgttcctgatgaagttggaagacttgaagtccttcgcgtacataccaaaaacatgaagctttcagataatgttgatctagagagaattgcaaaagatactcatggatatgttggtgctgaccttgctgccctttgcactgaagctgctctacaatgcatcagggagaagatggatgtcattgatttggaagatgagagtattgatgctgaagtactgaattctatggcagtttcaaatgagcatttccatattgctttgggaacaagcaatccatctgctttacgagaaactgttgttgaggtgcctaatgtcagctgggaggatattggaggccttgagaatgtcaagcgtgagctgcaagagactgttcaatatcctgtggagcacccagaaaaatttgagaagtttggtatgtcaccgtcaaaaggggttctcttctatggtcctccaggatgtggaaaaactttgttggccaaagcaattgctaatgaatgtcaagctaacttcatcagtgtgaagggcccagaattgctcactatgtggtttggtgaaagtgaagccaatgttcgagaaatttttgacaaggccagacaatcagctccatgtgtcctcttctttgatgagcttgactccattgctactcagagaggaagtagtggtggagatgctggtggagctgctgatagagttctgaatcaacttctgactgaaatggatggcatgaacgccaaaaagactgtgttcataattggggccaccaacagacctgatatcattgactcagcacttcttcggcctggtcgtctagatcaactgatctacattcctcttcctgatcaggagtcccgttatcaaatcttcaaggcctgcatgaaaaagtcacctgtctcaaaagatgttaatttgggagcactagctgagtatactaaaggctttagcggtgctgatataactgagatatgccaaagagcatgcaaatatgctattagagaaaacatagaaaaggacatagagcatgagaggaagagaagagaaaaccccgaggctatggatgaagacatggagggggaagatgtttcagagatcaaggcggctcattttgaagagtcaatgaagtatgcgcgtaggagtgttagtgatgctgatatacgcaaataccaagcatttgctcagactttacagcaatccaggggctttggaagtgactttaattttcctgcagctgtgagtaggaccgcaggatctgaaccctttgcaacttctgctggtggagctgatgaagatgatctctatagttag

SEQ ID NO: 38841 - DNA, 624 bp, Glycine max
  Peptide Sequence Number=SeqID_155619
atggctgatattgagggttctccaggaagctccatgcatggagtaactggaagggaacaaaccttcatagcctcagtggcttcccctatggtccctacagacaccacagcaaatttcgctttgccagtagattctgagcacaaggcaaaaattttcaagcttttttccttagccaaccctcacatgagaaccttccacttgtcttggatatccttcttcacttgctttgtctcgaccttcgcggcggcgccacttgtccccatcattcgcgacaaccttaacctcaccaaaggcgacatcgggaacgccggcgttgcctctgtctccggcagcatcttctccaggctcacaatgggcgcggtttgtgacctacttggaccgcgttacggctgtgccttcctcatcatgctctctgcaccaaccgtgttctgcatgtcttttgtgaatgatgctgctggttacatagcagtgaggttcatgatagggttttcgttggccacttttgtttcatgccagtattggatgagtactatgtttaatagtaagattatagggcttgtgaatgggactgctgcagggtgggggaacatgggtggtggggccactcagctcataatgcctatg

SEQ ID NO: 38842 - DNA, 156 bp, Glycine max
  Peptide Sequence Number=SeqID_155620
atgcgcaaagagccaatgagattcccaacggctgccaaggattatgcattaaacaaaggtgtatttgacgtaatgcatttcgccgcgtatgccaaaaagaacccatggtatatctcaaagataaataatgggtggcaacttgcacatgatcattga

SEQ ID NO: 38843 - DNA, 249 bp, Glycine max
  Peptide Sequence Number=SeqID_155621
tcatttctaacgacaacaacgaggaagaggtagaagcggtggcaagcggtggcgtagactcgttggacttggagagatcgaggtactgtgagattgcgagaggaaggagactcaagagatgccgagactcaggagggtttctaaaatggcttgaaatggcgccgtttcgagttgcatggagaaaaaagaagaagaaaggattagtaacccgattcgggttgatgagtcaccagtttgactgcaaactcg

SEQ ID NO: 38844 - DNA, 201 bp, Glycine max
  Peptide Sequence Number=SeqID_155622
atgggtatcctgaaaaaagaagagaagattgagattgcaagggctgctatggaggctgagatttgtgaaagtggaatctgtggaaatatcccgtccacgtcaccatcgggaatcgaacgagaaatgtgctcactcgctcgactgcgtcaacctgcgctactcgcgcttagaacggttcaatcaattagtaataatatttaa

SEQ ID NO: 38845 - DNA, 378 bp, Glycine max
  Peptide Sequence Number=SeqID_155623
atggccctttcttgttccaaagtttcaagcttttctctctcacccgttgtgggtggtggtgatgtttttaaaaatctcactttttcttccttttctttgagtttttctaataagcgtgttggtggaatcaagaacttgagggtgcgtgctgctgcttcaaacgcaccagctccactcgctggggtcatatttgaaccctttcaagagctaaagaaggattatcttgctgtcccaattgcacacaatgtttccttggctcgtcagaactatgctgatgagtccgaatctgcaatcaacgagcagatcaagtatgagctaaagatccattttttaacagctgaaaatgagaatagcacatgctttgtgcgccttttttaa

SEQ ID NO: 38846 - DNA, 570 bp, Glycine max
  Peptide Sequence Number=SeqID_155624
atggccaggcatttgacgatttatgaaagagtcaattataaagaatattacaaaggtgctgcatatggaacttctttttggttgatggttgctacttgcaagtacggagctagttctcattacttaagttgtagggctgaatggctgatcaagtttggcattgtgcatgtttgtaaatgttgcctccttagattaactgcatcaagtttatatgcattaaagaccaagctactctttcttcaggatgaagtaactgtggcgggatttgaagttccaaaatctcctgattctagttataacaatgtctaccctggaaatgaagatgaggcaagggatccacctatggtcccttcacatttacagcatactttgctaaattatcctgctaatagagacactgcaggaactgttccattgcctcagaatgtgattctaaatcatctttacatcgagaatagagaatcaccaagatctgtggtggcgttgggattcactcatcgtttccactctaaatatgttacagtcgtgctttacaaaccagtccaaagaaggggaaatacaagcatttag

SEQ ID NO: 38847 - DNA, 111 bp, Glycine max
  Peptide Sequence Number=SeqID_155625
atgaaggttaacatagatggagtttttcattttcagttcaagggatcaacagtccactcagaagaaaacctggccctaaatccttacttcattagcagtcacaccacatag

SEQ ID NO: 38848 - DNA, 825 bp, Glycine max
  Peptide Sequence Number=SeqID_155626
atggaacaactgactaatcaccacaatgaagatgttcacatagaagatcagattgatctatcttccgtagtcaggagactacaggctcaggtctccaagatgcaaaaacaccacgctaaagaaatcgttacccttcggcatgagaatgctcacctccaggaggcacataggtcacaaaaaccagaggctaacctgccgagaggagaagaggccgaatcaaccacggcgactcttcctcccaagtggaagaacttgactattgataagtacgatggggtagacccttcattggttcacacagctacctccaaactttgtggtctcgttcaacactctgcaatggctatgcaccacttgataacgaaattacgactaggaccttttgtcaatatcttatgcaaaaaacctacatccaacctcgatgagctacgaacaagggtggccaagtatatgcagatggaggagttggctgataccgtgttgaccaagaaagataatgacaagcccaactctactgtcaacattttgaccatgcctaagagagttaacaccccaccaaaggcaaaccactcaaagcattgtcggtgccattgtaaccgtggccactttatggaggagtgtagtgcattgaaagagaagataggagagctaattaagcttgaccacctgaaaaattcatccacaggctgtagttgtacaggcccgagggaagaaacaaacccgaatctagttggggaagaggtcgagaacatgcaggacggccagaaaggcaaaggagccgaagccgatccaaggagaaagaagagagacccctcaaccaactga

SEQ ID NO: 38849 - DNA, 348 bp, Glycine max
  Peptide Sequence Number=SeqID_155627
atgtcatcaaccaccgttcactgcacactgggctttgtctatgccaccactgtggcccttgaggatgtcatatcaagcttctccaacaccgaccacgccaaatctgaacaacaaagtttggtgcttgcatgggtgtcgttaacagccatagtcggagaagaggagttgttatctggtggcgtcgaggttgatgcatttgctcatatctgggtaatgtcggaggtggcggcgcacggaggaggttggtggtgctcacggtcagaggtggggatgatgatgatcagcaatagtgcaattgaagagagtggtgataaaatgtggagagtgcaccgtaatattatgaaatga

SEQ ID NO: 38850 - DNA, 387 bp, Glycine max
  Peptide Sequence Number=SeqID_155628
atggatatttatagaaaacaaccttggagagtagacaaattcacccaggtgagtttgttgcttattggtgaaggcatctactcgcccaggcattactttgccgaagcccaaaataacaaagcactacaggtggatttggacctgattgagcaagtacgagtggatgtgatcatcatgaccaaagcctacaagtggcatatgacccaacacttcaactctaaactagccccttggcagtttaaggaaggggacctagtgtggacaattctctcccgagtaaccctcttggctaaggttgaacttgaagattcacgaacagttccctcccacataccgtccttggttaaggttgaagacaaagattacgaacagttccctcccgagtaa

SEQ ID NO: 38851 - DNA, 147 bp, Glycine max
  Peptide Sequence Number=SeqID_155629
atgaggcacgggagtggtgttggggttattctcgaaggaccatggtacaatccttacattttggattcaaagccacatgcaattaggccgaatacgaagaactctttgcagggtccggtgtcgaagcgactccaagatcgccgttga

SEQ ID NO: 38852 - DNA, 201 bp, Glycine max
  Peptide Sequence Number=SeqID_155630
atgcatctttgtgaggtagcaaacctcagggtcttcatcatcaacaaggatgtttatgtaagggagttggtattgatagatgtaatctcgaaggatgatgttgccccttcaccccagaggctagtgaccctaattgaggagccacttcccgaagaggtcgaggatgttgagggtggaaaggaggtggggcctagggattga

SEQ ID NO: 38853 - DNA, 141 bp, Glycine max
  Peptide Sequence Number=SeqID_155631
atggttcccaagggcagactagggcagtctcgaagggaaccaaaactggaaaaagaaatatacatgtatgaagaccctaaatctctatccttatctaacagcaaaaacctctgtaaggtacatgattcctatttgttgtga

SEQ ID NO: 38854 - DNA, 138 bp, Glycine max
  Peptide Sequence Number=SeqID_155632
atgggggaccgcgttacaaacttccttgaccttccgacccctgaacaggtgtcaacccctatacatgatcttacgactttgcagatgagccccgaagttgtcgcttgcttgcaggacactagtgtcatggaaggatag

SEQ ID NO: 38855 - DNA, 775 bp, Glycine max
  Peptide Sequence Number=SeqID_155633
atggcagtggcagcgatttgtgcttcggcggtagcagttccagcgataacattgaacgatgcgcaattcgagaatgcctctctgtacattgatgatcttgaggggaatgtcaatgaggagcaattgcttgatctggatcaaaccagacaatcttctcttggatacgcttatgttaacttggtccacattcaagatgttgcgaatgccatggaacataaccttggcatgtcaatggacaacaaggcattacatgacacttttgctgcctttcattttgtactctctagtaaggtagtcatcgattacaataatcaatcaaaaggggttcaaagaaaagaagaaagaaaggcagagttgaaagccagatttgagctggaaataataagaaaatatgagaaattacaaggtgctaatttgtacttgaaaaaccttgacgataacgtcaacgatgaaaaactgaaggagctattttctaagttgggaacaataacatcttgcaaggtgatgcttgaatcatataggcatatcaaaggctatactttggttgtcttttctactcctgaggatgaaagatatggtttaatacaacaactcttgccaggcatgcgtcctggcggttactccaaatttcattatgtcgtaccacctatagagacagggtcctcatgggcaaagggtgggtacttgaagagttggaaatctccaacaagtgcagcaaaaccagatgctacatccttaactccaaccaaccaagggtttagatacatgggaaatg

SEQ ID NO: 38856 - DNA, 2265 bp, Glycine max
  Peptide Sequence Number=SeqID_155634
atgggcgaggtggggaagatactgtacatagtggtggtcgaggactccgaaaagaaagagtcctttcgctactcgcgtcccgttctgcagagcacgctccagctcatgggatgcaaagcgcgtcacgccttcaagagatggctgagagaaaaacttggtgtgaatgggaaaaacgtgaataagaaaggtgtacctgatgatgctgaattagaggcagagactacgtataacatcagaatttttctaaaacattattctgactgtttttcattttcctcttatcagatcagccaaagagtttttgaacaaacaaggaaagagaattctactgatattttgaagctggaagtagaggctttatcaggttttgatgctttcaagaagaattttgtgaagaaagatggtaggagtgtaccatttgagttgtacaaaaggcgcacatctgcatttgttcggagagaaacttttctagatattgcctgtgatgctctggcagagtacaagtatgtgggtcctaaccagagagcagacttggtattagcctgcaggatccgtgaaaggaaagagtcggtgacagtgttactatgtggcactagtggctgcggcaaatctacattgtctgcattgctgggaagtaggttgggaatcacgacagtggtatcgaccgattctattcggcacatgatgagaagttttgctaatgagaaagaaaaccccttgttgtgggcttctacgtaccatgcaggggagtgtttggaccctgttgctgttgcagaagcaaaggctagaaggaaagcaaaaaagctggctggtgtgtcacattcagtttccaaggaagatgtaactgagggtcacaattctagcaaatctgatgttaggacgttggagatgagctctggtcctactgaactgctaagtccaaaacagatggctattgaaggattcaaggcacagagtgagatggtgattgacagtcttgataggttaatcactgcatgggaagaacgaaaagagtctgttgtcgtggagggagttcatttgagcctcaactttgttatggggctcatgaagaaacatccttcaattataccatttatgatacacattacaaatgaggataaacacttggaaagatttgctgtacgtgcaaagtatatgactctggacccagctaaaaacaagtatgtgaagtatatcagaaacatcagaacaatccaggaatatctctgcaagcgtgctgaaaaacatttagttccccaaataaacaataccaatgttgacaagagtgtagcagccattcatgcaacggtgttcagctgtcttcgaaggcgtgaggttggggaacaactatatgatcctgttagaaatactgtgactgttgtttatgaggaatatagaaatcaatgtgcagccaattctttgagctcgaaaggaatgtttcaactgatccaaagaaaaggttcttcaaggaatctgatggctcttgttaatgatgatggatctgtggcaaaggcttggcctgttaatttagttgactgtaatgggaagcctgtatggtgccatggacctgagaatggagttggacatccaatgtatggtcccttaagaattggaaaggcagaacctgtcaatcttcagtttggtttttatgggatcagtgcatggccaagtgatggtggcactagtcgtgctggaagtgttgatgagtctagagctgatgggactgatactggtagtagatatgtatcctcttgctgtagctcgccaaggatgtcggatgttgctgcaaaggagctcaaggaagatttctcagtgcatggtagtgatgaagagattgacgatcaaccagaggtgggcagtgatgaggattttagtgatgatggcggcaaacatgcccttgaagaggtaggatcagttgatgaggaatcaacaaaatccgacgaagagtatgatgatcttgcgatgcaagacgtgctggaaactggatattggtcagatgatgaagagtataggatcagggtagatggtgtttccggtgaacttggaactaaaatgcatggggggtacaagtatcgtcggaacctggatattttccttagaagtagaagcgagttggcagagccactatgttcttattcttctttgctcgtggaaaagaatgagaggaaatccaaattaagaacacgttctcttagtattcctgcattaggaaagcatcgttcagcagtgaatgatcccatcctttctggtgctcctcagaggtag

SEQ ID NO: 38857 - DNA, 186 bp, Glycine max
  Peptide Sequence Number=SeqID_155635
atggcaacacgtgggaggccagagagcctctctcttgttgacaactgtggtaactattttgtcggttttatcgttttacaagtaccgtttagcacggatgaagtctgtaatacacatgtaacgccacggaagagcattagaagaggtgggatgaccaccgagttcgtgattgcaggtttaatttga

SEQ ID NO: 38858 - DNA, 171 bp, Glycine max
  Peptide Sequence Number=SeqID_155636
atggtgcgggacttagttgcatggttgcagagcatggaggcagagttgggtccttttgtgacttggctcccccatgcccctggagtatgtggaaatatggctttggagactattggagtattaggaataaaggtagttaagcccttattacggaggcaattgttgggttag

SEQ ID NO: 38859 - DNA, 396 bp, Glycine max
  Peptide Sequence Number=SeqID_155637
atgccgatgcaacaatgccaagcacccatgcttgctcctcaccttgccaccaacagcaagcaccacgtgcctcatgtgttgtcctctgtcttcaaccagctcagttacgctcgtgccgttgtttcccgcgacaacctcttaagtgttgttgttcattatggtcatgcaatggctcctcatgacaagcttttggaaaatagagacatgacactgtttaagatgggagttgagtcatatgggtctgccatggtcgcacgcaagcgccaaccaggtgcttttgcactatggacaactgctaaacaaaaaatgttaggaattaggaaccaagctctaaacgtgccactcagaacatgcaccaacaacccaaatgcaggagcaacccacccaagcacttga

SEQ ID NO: 38860 - DNA, 372 bp, Glycine max
  Peptide Sequence Number=SeqID_155638
atgggtcttaagcgagacagatgttgtttggaatatgaacttgtgcaagtgcacaacaatacaaaattgagggaaattccttttgttatggtgtttgaattgtatgataaggtgctaggagcatgttccttgacaaaagaccttgaggttctagcatttggtgatcaaaccactatcagagagaagggaatcaatttgagtggtggacagaagcaaatagtgcaaatagcccgtgccctataccatggttgtgatatatatctgtttgatgatcccttcagtgcattggatgctcatacaagatcccatctctttaagattatattgtttacagctatagcctcacaggattggactctactgttatgctga

SEQ ID NO: 38861 - DNA, 264 bp, Glycine max
  Peptide Sequence Number=SeqID_155639
atgggttgccacccaattttggaccctttgatggacactgaattcacatcaccaactccacccacattggtgatcaaaactaggttgaagtatgagtggccattgattgtgaaccttatttctcccctttttcacacaaggaaccctgccatcatcaccaaaatgttttcacaatgtagtgttgcattgcaaccattccctgctatagaaactacatcaccagagggttattgtgtcgtgtgtcttacccataatcatgcttaa

SEQ ID NO: 38862 - DNA, 237 bp, Glycine max
  Peptide Sequence Number=SeqID_155640
atggtgttgaccacacaggccattgtggtggaaaaacctaagcccaaggaacctgtagctggtgccccacaaggccttaccggagagaaatataccgatgatttcgttcgtttctgtgccaagaaagtaatacaccatgaattgctccagcattttcaacatcagtcaatctacatgcaagcagacgatgtgaatcctccctccatcagatttgagaaaataatgggtactcgttga

SEQ ID NO: 38863 - DNA, 618 bp, Glycine max
  Peptide Sequence Number=SeqID_155641
atgattctaccatattcggtcacgagccaaaaattcaagctcaggttatgcaaagatcttcctagtttgaaatttgaatgcaaaaagaacgtgaacatcttccttcatgctgaactttctttggttaaactaagcaaaaagctagccatggcttctgagacacctatcactcttaaagccatcaacacaaagctaccatctttgaaagcaaagaaggatcgccacaccaaggtgaatgggagagaacgtcgtgttcttttgccacctttatgtgctgctcgcgtcttccaactcacttatgagttaggttacaagactcatggggagaccatagaatggcttctacgccaggcagaaccttccattatcgccgccactggcactgggatattaccttcttccatggttgtatctgcatcaacatcaaccccatcattgtgtgaggatgaaagcactattggtatgcatacaaatccaatggttgtgtcaacaaacagtgagatcgagtcaaaaaaggaatttctaccattggatcttgattcgttggcaaactttgatgtggagttttctgctaatgaggtggcaatcctacaatcattgatcacaaagttgggttga

SEQ ID NO: 38864 - DNA, 1020 bp, Glycine max
  Peptide Sequence Number=SeqID_155642
atgccatcaatcattgaagacatgtgctctagcccctacaacaactcaggggatatgaggataatgaagagaggcatctatcgggcagagatagatgaatcccaaattgaattgggaaaacaaatgcaagctcaatcacttaagattgagatactcatgagagctcaagctcaagtccccattactacacctcaattcccaacctgtgataaatgtgaaattgtgcatgggctaagagaatgcactattaatgacaagctagttgcattcatggatgagatcaactttactagatccaatcctgaggaggaagtgaatgttttgagtgcaaagagtggacaacatatgattaagctaaagaagaggaagaaagccactccaccaccaaaaagggaggctcttactaaagaaggccaagaggcaaacaaagagggtgagaaggagttagtgacacctcttcaggcaattgctcaaatgtcaaagtacgttgaagagtgctctgtattaacggaaagttggcagactttgctaattggtctcaacaaagagtgctctattgtagttttaagaaagttgccacctaagcttaaagatctagggagtattccagtctcttgtactattggctacttgcaagaggatgaagaaatcccaattattttgggacgacccttccattacacaagaggggttttgattgatcttcaacaagaaacaataatatggaggctaggtgatgagcaagaagtgtttaaagtgtttaatccagaaattaattcatcctcctctcctatatgtaattttgtgcaagcctccaacaagatgaagactattgtggctaagcctcacccaagtgtggggaaggaagaccctccaaggaaaaaagtcattccaaaagaccatggatggagtaagaaaaagggagatggcatcaccattcaatctcttggctatggagtggatgattatactaaaagatcagtgcaaaaaaggaaaatcaccctcttcaagggtggttga

SEQ ID NO: 38865 - DNA, 396 bp, Glycine max
  Peptide Sequence Number=SeqID_155643
atggcattgcgttccgctatcaccctaataatcatcttcatactttcttccttcgatgtcgtcggaattcaaatcatctccaaatctaagctggagaagtacgagaagaactccaattccgacgacaatctcaattgtaccaccaaaatcatactcaacatggctgttcccagtggctcagtaaataaatcacattcacattacgctcctcattgtgttcctagtggcggagaggcgtcgattgttgcggaattggtggaagtggaggaaaattcaagcaggaaaatgcagacattgcgtattgctcctgtcaaaacggtcaacaaaacttctgcatatgccttactgcgagatgaagagggtcatattatcgagtacactcaagtggccttctaa

SEQ ID NO: 38866 - DNA, 471 bp, Glycine max
  Peptide Sequence Number=SeqID_155644
atggcttctgagacacctatcactcttaaagccatcaacacaaagctaccatctttgaaagcaaagaaggatcgccacaccaaggtgaatgggagagaacgccgtgttcttttgccacctttatgtgctgctcgcgtcttccaactcactcatgagttaggttacaagactcatggggagaccatagaatggcttctacgccaggcagaaccttccattatcgccgccactggcactgggatattaccttcttccatggttgtatctgcatcaacatcaaccccatcattgtgtgaggatgaaagcactattggtatgcatacaaatccaatggttgtgtcaacagacaatgagatcgagtcaaaaaaggaatttctaccattggatcttgattcgttggcaaactttgatgtggagttttctgctaatgaggtggcaatcctgcaatcattgatcacaaagttgggttga

SEQ ID NO: 38867 - DNA, 1812 bp, Glycine max
  Peptide Sequence Number=SeqID_155645
atgatgatgaatcttcctaaagagacaaggaaggttccttttgttatagttgttgtattaataaacttcattgtgggacccagactaattttttgtcagaagagtggtggtggtggtggtggccttgagataatcgctcaagaagtatatcgtagtatgtccaattatacatccgtgttcaagagtgcaataaaaaaagaattgggttattgcatagttgatgtggacgctgattggaatggagcattcaatttcaccaaagatcttacctttttgaccatttgtgcccaacaactgaagggagatattacacaacgaatgtgcacagaagcagaaatacaagcttatggccaaagttttgctagtgggaagtcaggaaccagatctagctttttgaagcccaacataaattgtaatttgagctcatgggttaatggttgtgaacccggatggggttgcaaagctaatcaaaaagtagacattggtagtcacaagaagggcatacctatcagatccgttgattgccaaccttgttgtgaaggcttcttttgccctcatggtctcacttgcatgatcccttgcccattaggctcttattgtccacgtgcacaactcaataaaactagtggagtatgtgaaccatatcgttatcagcttcctcctggaaagcctaaccatacttgtggtggggcagatatttgggcagatattcagagtagtagtgaggtgttctgttcagcagggtattattgtagaacaggttctactactcaggagcggtgtttcaagttggcatcttgcgagcctaagtcatcaaatcaaaatattactgcatatggtgtcttagtttttgctggcttgtgttttttgcttattatcatatacaattgttctgaccaagttcttgcaactcgagaaaaaagacaagcaaaatcaagagaaagagctgctcaaagtgtgcgagaatcacaagcacgtgaaaaatggaaatctgcaaaagacaccgctaaaaagcatgcagtaggactacaatcacaattatcacgtacattttctcgcaaaacttcaaagaatccagatttgaaaggttttggttctaaacattcggattctactttaccacctgttggtacatcaaagggaaagaaaaaggacaaaaacaatctctcaaaaataataaatgacattgaggaaaatcctaataattcagaagggtttaatgttcagataggagataaaaatgtcaaaaaacaagcaccaaggggcaagcaattacacactcaaagtagagtttcagcagtcatgggtccatctggggccggcaagacaacatttctttctgctttaactggaaaagcaactggatgtcacacaactgggcaagttcttgtaaatggtaaagaatcttctatcagatcatacaagaaaatcataggttttgtgccacaagatgatattgtgcatggcaatttgacagtggaggaaaatctatggtttagtgctagatgcagactctctgctgatctaccaaaagaagagaaggtgttagtggttgaaagagtcattgagtcattaggtctacaagcaataagggattctttagttgggacagtggagaaacgaggaatctctggaggtcaaaggaaaagagtaaatgtaggattggaaatggttatggaaccttcccttttaattttggatgaacccacttctggtttggatagctcatcttctcaattactacttagagcacttagacgtgaagctcttgagggagtaaacatatgtatggtccttcaccaaccgaggtga

SEQ ID NO: 38868 - DNA, 252 bp, Glycine max
  Peptide Sequence Number=SeqID_155646
atggctcaacctccaccgtgtgagaggactcttagggagatggctgcacctgatttcacttatgaaagcttgtgcattcaatatcctgatgagggtgttccatatgttctcaagactagactaatacatttgctgcccaagtttcatggtcttgcaggacatgccggaaaaccaaaaaatattgatgcacaatacgtaagtttccgtgacacaccggaaatcaaatggaagcatcgttgcataattaagtga

SEQ ID NO: 38869 - DNA, 225 bp, Glycine max
  Peptide Sequence Number=SeqID_155647
atgggaaggctgaagcaaaggatccctgagttcccaaaggtccaaaaagaagataaaacaaggtcgaaacactttcgaatagcatccgtgatcgattcctacaccgtttgtcgttcgttcttcgatctttcttcattcgttcttcgttcttcgtccgaagaatcaaacaaggttgcttcaaaggacaagcattgcttcaagataaatacaaggttgcttcaataa

SEQ ID NO: 38870 - DNA, 297 bp, Glycine max
  Peptide Sequence Number=SeqID_155648
atgtcaaatcataaaagcactgagtcagtactgaagaaccttgaggtccagaatcccaaggaggaatgcaaagttgtgatggcaaggagtaaaaggtttgtggaggctgaggatgaggatagtgttgtgcataagaagaaaattgcggacaaaaaaggtactgatggcaagaaaaataaggtgagaggtgaaagtaatcaagaaaaagaggaacaaataatggtcaagaataaagaattgaaggaccaagaaaaagaaaaagaagtagaaaaagaaatagaaaatgaaaaaaaatga

SEQ ID NO: 38871 - DNA, 762 bp, Glycine max
  Peptide Sequence Number=SeqID_155649
atgagaaaaaatggcactgaagttcagaaaagaactctccagttgaaagacatgtctggccgaagtgttgagttaactctatggggaaatttttgcattgtagaaggacaaaggttgcaaactatttgtgatgctggggaatttccagttttggctacaaaagctgtcagattaaatgatttcaatgggaagtatgtcgagactatagccactagtcagctatatgtggaggctgattttcctgaggcttgtacactgaaaagatggtttaaaaatgaagagaagagtgtcccaactctctctatttccagagaactatctaatctggatgagaagttagggacttcagagaagcctgattggatatctgtctttgtagttgtttcacacattaaggttgataacttctgttacccagggtgccttctcaagataggggatagacaatgtaaggtctataagggtacaacgacaaataatctgaatgttgcaatcaagcatgtagaagcaaggattcatgatgatgacaaaggtgatgaacaaaaagctcaaagatcaaagagcaactcaagtgaatcaaagaacatctcaagtgaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaagaaaagactcaatcaaaataagtattaa

SEQ ID NO: 38872 - DNA, 249 bp, Glycine max
  Peptide Sequence Number=SeqID_155650
atgtcgagctctattatgttgttctacaatgttattgaagctggtaaagtatatctaatttccaagggaagcataaagccagctcagaagaattttaatcaccttcacaatgatcaagagctgacccttgatgtggcatcaattatacaaccattccttgatgataatgactcaattacatcacagacatttaattatcacccattagtgaaattgaaagtttggaaaacaacagcattgtggatgtga

SEQ ID NO: 38873 - DNA, 403 bp, Glycine max
  Peptide Sequence Number=SeqID_155651
atatatcgataatattttagaccgaaggatcctttcggaaaggaatgtggaactttatcattctgaatttgacgagtttaaaatagaattggagaagcgaaaccttcacaaatgtctcgccaaccttcaggaaggaagcatagatgtggcagtggttaaggaattctatgcctatttctatagtctagcagatcaagctcctaaatgtgctataataagaggccatttaatcaagatagatgcagacaatttaaatgagttcctccatactctagtgttattagaggagggggaatctttaccaacttattctagattttgcagactaagatctgatcccagagagatggaggctagtttgtgcattctgggcaagggctttattctaaacacggagggctaa

SEQ ID NO: 38874 - DNA, 405 bp, Glycine max
  Peptide Sequence Number=SeqID_155652
atgggctcagagattcaacattcaatttcgagagtctcgatatattacgggactcaatcagacatccgagaaaaaagttattgtcgtttgaatttgctcagagattcaacattcaatttcgagcgtctcgatatattacgggactcaatcagacatccgagtaaaaagttattgtcgtttgaattggctcataggttcaacattcaaattcgagcgtctcgatatattacgggactcaatcagacatccgaaggttcaacattcaatttcgagcgtctcgatatgttacgggactcaatcagacatccgagtaaaaagatattgtcgtttgaattggctcagaggttcaacattcaatttcgagcgtctcgatatattacgggactcaatcagacatccgagtaa

SEQ ID NO: 38875 - DNA, 276 bp, Glycine max
  Peptide Sequence Number=SeqID_155653
atggaatttccccctgagctagaaaggatggtcgctcaagaagaccgagagatgaagcctcaccaagaagaaacgaaagtcgtaaacttaggtgttggcgaagaaaagaaagaggtaaaggtgggtacgggcatcacaacaccaatccgagatgaattggtagtcttgctgtggaactaccaagacatcttcgcttggtcataccaagatatgcctggtttgaaccctgacaatgtgcaacatcgtttacctctactgatttactctaattgttaa

SEQ ID NO: 38876 - DNA, 354 bp, Glycine max
  Peptide Sequence Number=SeqID_155654
atgagtgttaagcatctcaatttgatcaccaaaggttcgtatgttgacaaacaattgtccccagacgaaattaggggtacaactgatattggactcttctaccatggagacatgtcctatgcgctcactagttacttggattctgattatgctacagatttggatggaagaagatctacgattgggtacacattcacatttggcaactctcttgaaaaggctatcattttttcaatagtctcaaggatcaagtccatcatgagaggactaagcacattgacatcaaataccacttcatccatactaaatagagggtcgaagttcataaatttgatacaagggagaatcagctaa

SEQ ID NO: 38877 - DNA, 342 bp, Glycine max
  Peptide Sequence Number=SeqID_155655
atgaaaaatggagatccatccaagcggggtacagtggtggtcttgctgcaagacatgttagaagtggtcaccgatatgatggtgaatgaaatccgcgaattggcagaacttcatcaaagtagtaaggataccggacagcaagtttttgctggtacagaggcaaagcctgctatactattccctcctgtggttacagcacaatgggaggaacagattagacgtctttatctactcttgactgtcaaggaaactgccgctgaagttccaacaaacagtgaagtacgcagaagggtttcattctttaccaattcattgttcatggatatgccacgtgctcctcga

SEQ ID NO: 38878 - DNA, 666 bp, Glycine max
  Peptide Sequence Number=SeqID_155656
atggaaggttctgtccttgaacgtcttgattttgggaagatgggatacgggtgcaagcattatagaagaagatgcaggattagagcaccatgttgcaatgagctctacttttgccgtcattgtcataacgaggcaacgagcatgctgagcaacccttttgatcggcacgaactcgtccgccaggacgttcaacatgttgtttgttcagtttgtgacacagagcagccagttgctcaagtttgcacaaattgtggtgtcagaatgggagaatatttctgcaatatctgcaaattcttcgatgatgatcttgtgattgttaatcttattgttttctatttgatgctgagcattggttacacattaagcagaccgggaaaaaacagtttcattgtgatgattgtgggatttgtagacttggtggtcgtgagaattattcccactgcatatctttttgactcattgaaagacattgctgttatgaaatgtggtcacacaatgcatagtgaatgctacctagagatgctaaagcgtgacaagtattgttgtcccatatgctccaagtcggtgatggacatgtctagggcatggaagagaattgatgaagagattgaagcaactgtcatgcctgatgattatcggtacagaaaggtagagttttactcttag

SEQ ID NO: 38879 - DNA, 534 bp, Glycine max
  Peptide Sequence Number=SeqID_155657
atgggttgtgggaagtccaaacatgatgttgcttcaggaaacaccgtcctccagcgcaagaaatccggtgtgagcagccaggaaaatgggacagaaaccaaagacacaaacaacaacaatgttgttgacaatgtgagctcagaggtacaagtggaacagaaggggagtgaaagtgtcaaagagtctgatgttgaagttaaggatgatctagtagttaatgatgtcaaaagtgaagctgagaaaacaaatgtgcaagagaaggagaaacttgagggtggagaggaacggtctgagtcagagaaatctgaagatgagaaagatgattcattgaaggagaatgaacagaagatcaatgatgctgaaactgttgaggctacagaagagaaaatgccagcagaaaatgaaaaagaggatgccagtgtgaagaaagaagaagacataaaagacacaaaaacttcaatctctgaaggtgaagaaaaggatttgaaagctgaggagggacaacagagaatccaacaaccagcgaagatgtga

SEQ ID NO: 38880 - DNA, 1602 bp, Glycine max
  Peptide Sequence Number=SeqID_155658
atgaatgcccagcccgtcgcggcaccggcaccgcatccttttaccctgcgcctcgcgctggggctggtgggggtgctgatcgccgcgctgacctccggattaaatgatcgcgtcaccgacatcgcgctggccgatattcgtgccgcagtcggcattagctacgatgacggcagctggattatctcggcctatcaggcagcggaagtcgccgcgatgatgattgcaccgtggttcgccgtcaccttttcgctgcgccgcttcgcgctggcggtgtcggccggtttcatggtgtgcggtgtcctgctgccctttatgcccacggctccgctgtttattgcgctgcgcgtggtgcagggactgtttggcggcgccctgccgccgctgctgatgacggtggcgctgcgctttctgccaccgccgatcaaactttatgggctgagtgcttacgccctcaccgccacgtttggcccgaatctggcggcgtcgctggcggcgttctggaccgatgacgtcagctggatgtttgtgttctggcaagtggtgccggccatgctgatcgccatgctgctgatcggctggggtctgccgcaggatccgctgcgcactgagcgatttaaacagattgacctgttcggcatgctgagcggctgctcgggcatggcgctgctgattctggcgctgacgcagggtgagcgtctcgactggctcagctcgccgctgtttgtcgccctattattcagcgcgctggcgttgctgattgtgttctttattaatgaatggtttcacccgctgccgctgtttaagttgcagatgctgcgccggcgtaatttgtcgcacggtttgctggcgctggcgggtgtactgattctggcgctgtccggttcggcgctgccgtcggcctattttggtcaggtggaggggtttcgcacgctgcagttcgcgccgctggcgttgaccatcggcctgccacagctgctgattgcaccgctggtcgccagcctgctgaatatccgctggattgactgccgctgggtgctgagcgccggtgtgctgctgctggcgaccgcctgcctgctcggcatgcagattaccaccgactgggcgcggcaaaacttctggctgatgcaggtcttgcaggcgtttggtcagccgatggtgattctgccggtgctgatgagcgccaccagcgtggtcgcgccgccggaaggaccgttcgcctccgccatgttcaataccgtacgcggctttgccagcatcgccgccagcacgctggtggagtggtttatcagccatcgcgagcagtttcactccagcgtgctggtcgatcaggctgccagtcgcagctggctgatgaccgcagcggatagccagcaggccagcagcagcctgccgctgttggccgacggcagcgccagcagcgcgaccaatctcagcggcttcgccaccctgctgaagcatcaggcgatggtgctgagcctgagcgatgcgtatctgatgctgatcgctttcgctgtcgggctgttagtgctgacgctgtgcctggcgaaacgcgtctggccaccgcaaaccctggttcaacctgttaccaaaactccggaataa

SEQ ID NO: 38881 - DNA, 3216 bp, Glycine max
  Peptide Sequence Number=SeqID_155659
atggcgagaccttccaagccacactcatcttccgaggaagcgctctccaatgcttccagttcgtccgaggaagaggagcaagtcaacgagcagatcaatgaagaggaagacgaggaggagctcgaggcggtggcgcgccccgccagttccgatgacgatgaagtcgccggcgacaatccgccggactctgatgaagatcccgcggccgatgatgatcaggatggggataatgttaatcccgaaattagcaagcgagagaagactcgattaaaagaaatgcagaaaatgaagaaacagaagattctggagatactggatgcacagaatgcggccattgacgctgacatgaacaatagaggaaaggggcgtctgaagtatctcttgcagcagactgagttgtttgctcattttgcaaaaggggatcaatcttcttctcaaaagaagtcaaggggaaggggtcgccatgcatccaatttcactgaggaagaagaagatgaagaatacctaaaaggagaagaagatggtctagcaaacacacgtctggtgacacaaccatcatgtatccaagggaaaatgagggattaccaactggctggactaaactggctcatacgattgtatgagaatggaataaatggaattctggctgatgaaatggggcttggtaaaacattgcaaactatatccttattaggttatctgcacgagttcagaggaatcaaaggtcctcatatggtggttgctccaaaatctactcttggaaattggatgaatgagattcggcgcttttgtcctattcttcgtgcaattaagtttcttggcaaccctgatgaaaggagacatatcagagatgaattgttggttgccgggaagtttgatgtttgtgtcacaagttttgaaatggcaatcaaggagaagtctgctttgcgtcgatttagttggcgctacataattattgatgaagctcatcgaatcaagaatgagaattccttgctgtccaaaacaatgaggctctacagtacaaactatcgtctccttattactggcacaccacttcagaataatcttcatgaactctggtctcttctcaactttcttctgcccgaaatttttagttctgctgaaacttttgatgaatggtttcaaatctctggtgaaaatgaccaacaggaggttgttcaacaattacacaaggtcctccgcccatttctccttcgaaggttgaagtcagatgttgagaaagggttgccaccgaaaaaggaaactattcttaaggtaggcatgtcccaaatgcagaaacagtattatagagcactacttcagaaggatcttgaggttgtaaatgctggtggtgaacggaagcgcctcctgaacatagctatgcaactacgcaaatgttgtaatcatccatatcttttccaaggtgctgaacctggtcctcccttcactacaggagatcatctaattgaaaatgctggtaaaatggttcttttggataagttacttcctaaattgaaagagcgcgattctagggtccttatattttcacagatgactaggctactagacatactcgaagattatttagtgtttcgtggatatcaatattgccgcattgatggaaatactggtggggatgatcgagatgcttccattgatgctttcaacaaaccaggaagtgagaaatttgtcttcttgttatcaactcgtgctggaggtcttggtattaatcttgctactgctgatgttgtcattctgtacgatagtgactggaacccacaagttgacttgcaggctcaggatcgtgctcataggattggtcaaaagaaagaagttcaagttttccgtttttgtactgagtatacaatagaagagaaagtcattgaaagggcctacaaaaagcttgcacttgatgctctggtgattcagcaagggcgattggctgagcagaagacggtaaataaagatgagttgcttcaaatggttagatttggggctgaaatggttttcagttccaaggatagtacaattacagatgaggatattgatagaattattgctaaaggagaggaggcaactgccgagcttgatgccaaaatgaagaaatttactgaagatgccatcaaatttaagatggatgacaagttactaatactgatactttcttttgtagctgctgaattatatgattttgatgatgagaaggatgaaaacagatttgatataaaaaaaattgtgagcgagaactggattgaaccaccaaaaagggagcggaaacgcaattactcggagtctgaatacttcaagcaaacaatgcgccaaggtggtcctaccaaaccaaaagagccccgtattcctaggatgccccagttgcatgatttccagtttttcaacacacaaagattgagtgagctgtatgaaaaggaagtacgctatctcatgcaaacacaccagaagaatcagataaaggattcaatagatgttgatgaaccggaagaggtgggagatccattgactgctgaagagttggaagaaaaggagcgcttgctagaagagggattttcttcatggacccggagggattttaatactttcattagggcctgcgaaaaatatggccgaaatgatataaaaggtattgcttctgagatggaaggaaaaactgaggaggaagttgaaagatatgcaaaggtcttcaaagaaagatacaaggaattaaatgattatgacagaattattaaaaacattgaaaggggggaggcaagaatttctcggaaagatgagatcatgaaggctattggaaagaagttggaccgctacaagaatccgtggctagagttgaagatacagtatgggcaaaacaaagggaagttgtacaacgaagaatgtgacagattcatgatatgcatggtgcacaaacttggctatgggaactgggatgagttaaaggcagcatttcgaacatcacccttgtttcgatttgattggtttgtcaaatctcgcacaactcaagaactggctaggaggtgtgacaccctcattcgactggtagaaaaggaaaaccaagaatacgatgagagggagagacaagctcgcaaagagaagaaacttgctaaaagcatgaccccatcaaagcgtgctttggcaagacagacagagagtccatcttctttgaagaagcgcaagcagttaaccatggacgattatgcaagcacg

SEQ ID NO: 38882 - DNA, 1002 bp, Glycine max
  Peptide Sequence Number=SeqID_155660
atggtgatttacatctggactggctatgtgccagtgtgccaaaattctgttaatcctttggaaatggtattaaatcttcctccagacaaggagcctctggactggaacactaggatgaaaatagcagctggagctgcaaagggattggaatatttgcatgacaaggcaaatccgccagtgatatatagagacttaaaatcgtccaacatcctcctagacgagggttatcatcccaagttatcagattttgggctggcaaaacttggtccagttggtgacaagactcatgtatccacacgagtaatgggaacatatggttattgtgccccagaatatgctatgactggtcaactaactctgaaatctgatgtctatagtttcggtgttgtcttccttgaactcattactgggcgcaaggctattgataatacgcgtgcacatggagagcataatcttgttgcatgggcacggccgcttttcaaagaccgtaggaagttccccaaaatggctgaccctctacttcaaggccgttacccgatgcgaggactgtaccaagcacttgcagttgctgcaatgtgtctgcaggaacaagctgctacaaggcctcttattggagatgtggtgactgctctcacatatctggcctcacagacatacgaaccaaatgcagccaatcaatccaacagggttggcccatcaacccctaggatcagggatgacagaaggagcatggcagacggtgtggacagccctgaccgccggctcggctccccttccacccacagaaactcacccgacttcaggaagagagacagcagggatccgagtgccgcgaccgagttaggcaggattgacatcggtggggggtcagggagaaaatggggattggatgataatgaaaggcaggagtcccagagagacagccctgtaaatactgcaagaaccagagagactccatggaaccgcgacctggacagagagcgcgcggttgcagaggcaaaa

SEQ ID NO: 38883 - DNA, 309 bp, Glycine max
  Peptide Sequence Number=SeqID_155661
atggaacgcataacaaaattggcatcacaaaaagctgtggtgatcttcagcaagagctcgtgtgggatgagccatgcaattaagaggctgttctacgagcaaggtgtgggccccgcaatctatgagcttgatgaggacacaagagggaaggaaatggaatgggctctgatgagactcgggtgcaacccttctgtgccagcagtgttcgttggtggcaagtttgtgggttcagccaacacggtcatgacccttcacctcaatggctcactcaagaaaatgctcagagatgctggtgctctatggctttag

SEQ ID NO: 38884 - DNA, 1119 bp, Glycine max
  Peptide Sequence Number=SeqID_155662
atgttcgggttctctcgcaggcacatgaaacttggcagtagattgaaggtccaactttctgacaccaccctgggaactagaagtcccatcaggcaccataagcgaaatgtaaactccaatggtgatagagttacagggacaagtggtcattctgagaaaatgctttcatctgctgcacctgatatgcatacttgtacatcaggtagctccgagaactggatggtgttgtcaatttcaggggataagcctactcctagatcctatcatgctgcagctgtcattcaaaataagatgatagtggttggtggtgaatccgggagtggattgttagacgacgtgcaggtgctaaattttgacagattttcgtggaccatggcatcgtctaagctttacttgtcaccaagcagtcttccactaaagcttccagcttgcaaggggcattgtttggtttcttgggggggaaaggcactcctcattggagggaaaacagacccagcaagtgacaaaatttctgtatgggcatttgatacagatacagagtgctggtcacccatggaagcaaagggagacataccggttgctcgcagtggtcacactgttgttatggctaactctgttttaatattgtttggaggagaagatgtaaaaaggaggaaactgaatgatctacatatgtttgatctcaaatccttgtcatggcttccacttcactacacgggagcagcaccttgtcctagattcaaccatgtggcagctctttatgatggtaaaattctatttatatttggaggagcatcaaaatccaggaccttgaatgacttgtattcacttgactttgaaacaatggcatggtcaagaataaaaatacgtggtttccatccatcaccaagagctggttgctgtggtgttttatgtggcactaaatggtatattacaggaggtggaagcaagaaaaaacgacatggggagactttggtatatgatgttgtaaaaagtgaatggtctgtggcaataacatcacctccatcttctattactaccaaccagggacttgggcataacggggtgcctaagtccgactcggtggagtacttaagtggcttggttctcccctcttga

SEQ ID NO: 38885 - DNA, 1464 bp, Glycine max
  Peptide Sequence Number=SeqID_155663
atggaaggcattccaagtaaagctagaaatttaccaatgaatttgttattagggaggctctatcgaatttctagacatagccgagctgctgttgctatttacaaagaatgtctaagacattgtccttatgttcttgaggctatcacagctttagcagaacttgggtctactgcaaaggacatcatttcattgattcctcagactctgaatagaagtggtagagctccatttgatcacactgactcaagtcgttggcttcaacgctatgttgaagctcaatgttgcatggcttcaaatgattataaaggtggattggaactctttgcagatcttttacagcgcttccctaataatatacacataatacttgagatggcaaaggttgaagctattattggaaagaatgaagaggccattatgaattttgaaaaggcccgatcaattgatccatacatcgtaacatatatggatgagtatgcaatgcttctaaagctaaaatctgattatccaaagctgaataagttagtgcatgatttattgaatattgatcctgcaagaccagaggtttttgtagctttgtctgttttatgggaaaggaaagatgagaaaaaagcattacaatatgctgagcagagtgttcggatcgatgagaggcacataccagggtatataatgaagggaaatttattattgacgatgaaacgggcagaagcagctgttcctgccttcagagcagctcaagaattgagacctgatattcgctcatatcaaggtttggtccatacatatttggctctctctaaaatcaaagaggctttatatgcttcgagagaagcaatgaaagcaatgcctcagtcagcaaaagctttaaaattagtaggtgatgtgcatgccagtaattctagtggcagggaaaaggctaaaaaattctacgagtctgcactaagactggaacctggttaccttggagctgcactagctttggctgagctccatgttatcgagggccgaaatggagatgctgtgtctctgcttgagcgatatcttaaagactgggctgatgattctcttcatgtaaaacttgcacaagtttttgcagccactaacatgctgcaggaggctttgtcacattatcaggctgcattaaggttgatctctatccttattgttgaggatatccatgtgatgttaaacccccagaatgaagcagcaaaacggggtttagagcgattagagaagcaaatgaagggagtggatcctgatgcacctgaagaagatgaagacaatgatgttgaagatgcagatggagatcaagacgagactgaacttcttttaatgttgcacggcattagcagtagggttggtgccctacaatctgggctcaagtttggcttaactgctgctagagttcacatcagaaaaacaaagcatttcacactgttgcatctggtggtcaaaccctga

SEQ ID NO: 38886 - DNA, 246 bp, Glycine max
  Peptide Sequence Number=SeqID_155664
atgcaggggcaaactttgacggagcggagagtggaatcgtcggaaagcatgaatctttttatgaaatcggtttttggtgatgatgcggatgaggtcgggggtggaggcgcctttggagaggaggaagttgagtttggggaggataattttgcgggagttgtaggagaggaagtaagggtatgtttgaatgatgcggcggatttgggagtcggagaagccgtgggatttgaagagggagaggattga

SEQ ID NO: 38887 - DNA, 879 bp, Glycine max
  Peptide Sequence Number=SeqID_155665
atggccaaagaagatcagaaattttccataggaatcgaccttgatacaacgtattcatgtgttggattgtggctggagcaacacaatagagtagaaataatccacaaccaacaaggccacaaaaccacaccttttgttgctttcacagacagtaatcagagattgatcggtgatgctgctaaggatcaggctgtcatcaacccagaaaacactgtctttgatgcaaagaggttaattggtaggaaatacagtgatccaactattcaaaaagagaaaatattgtggccattcaaggttgttgctggtatcaatgacaaacccatgattgttgttaagtacaagggtcaggagaagcatctctgtgctgaggaaatatcatatatggtcctcacaaagatgctgaagattgcagaggtttatttggaaacacatgtgaagaatgttgttgtaaccgtacctgcttatttcaatgactcacagccaaaagccaccaagcatgacggtgccattgctggcctcaatgttatgaggataattaatgaacctactgcagcagctatagcatatggacttgacaagagggctaattgtgtcggagagctacccggaaaaagtcaccttggtagagaggacgttgacagcagaaaggggaattactttgtagcggacttcaaaaagaagaacaaagtggacattagtgggtacccaagagccttaaggaggttgaggactgcatgtgagagggcaaaaagaatactctcatttgaagttgctaccaacattgatttagacgcccgggttcctcttgaactggacaatcaacaactgcaaaattatattgataagaaagttgaacatatgcagatatgtgaagattaa

SEQ ID NO: 38888 - DNA, 1646 bp, Glycine max
  Peptide Sequence Number=SeqID_155666
gcctcccgctcaagcacgactattccgctccctcccctctctcctctcccgaaatcaagctctccgaaacagccccaccgatcacccgcctcctccgtaatcgtaaaccacaaaatataaaacaagacgacgtcgtgttcgaatattccgattccgaacctgaaagcgacggcgagtatgaagccttcgacttttcgggagacgagaatgtgggcgaaggcgaggaagagactccgagcgtgaaggagaagggggtgccggcggtgatgcggtgtttcgaccgggcgaagatatacgtgaagtcgggggacggtgggaacggcgtggtggcgttccggcgggagaagtacgtgccgatgggagggccttcggggggcgacggagggaggggaggcgacgtgtacgtggaggtcgacggggcgatgaattcgctgctgccgtttcggaacagcgtgcatttccgggcagggaggggaggccacgggcaggggagcatgcagagtggggcaaagggggaggatctggtggtgaaggtgccacctggaacggttgttcgaatgagtggcgaggataacgtgctgttggagatggtgtatccgggacagaaagggttgctgttgccaggtggtagaggaggcagagggaatgcttcattcaagtcagggactaataaggtccccaagattgccgagaatggggaagagggtcctgaaatgtggttggagttagaactcaagctggttgcggatgttggtatagttggtgctccgaatgcagggaaaagtacacttttgagtgttgttagtgctgcaaagccggctgttgctaattatccttttacaacactgcttccgaatctcggtgttgtttcctttgactatgattcaaccatggttgtggcagaccttccgggtctacttgaaggggcacatcgaggttttggtttaggccatgagtttctacggcacactgaaaggtgttctgctctggtacatgttgttgatggttcatcacagcagccagatctcgagtttgacgcagttcgtctagagctgaagctatttaatcctgaacttgctgagaagccttatgtagttgcttttaacaaaatggatcttccagaagcatatgaaaactgggaatccttcaaagaaaagttgcaatctcgtgggatcacaccattttgtatgagtgctgtcaaaagggaaggtactcatgaagttatctgtgctgcttatgagcttttgcgtaaaagtaaagaagacaaggaggaatatgaagatggaagagatatggtaaacttgaaccatgtcgctgctgcagtaaagaagcagcggagtgcatccattagtgattttgagatttttcatgacagcgattcaaatatttggcatgtagttggatctggattgcaacgatttatacagatgacgaattggcggtacattgattcggagagaagattccaacatgttcttgaggcttgtggtgtgtacaagtctctcatgaaacttggtgtaaaggaaggggacacggtaattgttggagagatgaagatgatatggcatgactcctctgacaatcctggtgcatctaggatgaagaaaatatccacagattcatttaaatgggctgaatggaagtaa

SEQ ID NO: 38889 - DNA, 969 bp, Glycine max
  Peptide Sequence Number=SeqID_155667
atgtcaacctcaagaacctctgatgcttccctcaaaggatatgagtccaaccaaacccaaatgaatctgtccctccttcaacgtaacatgtctccttctggcgagagaagaggccgaggaaaacaagcagaacctggaaggtttctcggagtaagaaggcgcccttggggtagatatgctgctgaaatcagaaaccctttaactaaagaaagacattggcttggaacatttgacactgctcaagaagcagctcttgcttatgacagagctgctctgtccatgaaaggatgccaagcaagaaccaacttcatatattccaaagacaccaataccaacattttccacaatgctctcactcctatgaatactcaacctctcttgccaccttcacataacactcacaacacacaaccaaccaatcaaagtggcctatctcaccaccttggtgctatctcttcccacattgaaaacccttctgacatgagtgcatatgggtcacctcaggatgataatttcttcttctccaatgattctaactcgggctatcttgaatgcatagttcaggataactgcttcaggaagagcaatgccagtgcttcaagtcatgaccttacgattggccacgttaactcaaactccatgcatgttcagccacattttgacaccactcaagaagccttgaacatgcaaacaacagtgacttcaaactatgcagatatttcttaccctagtcaaggattatggaacaatcagcaatcatgggattgcagttccaatgaactagcagctatgtttaaaaatccatcaagggctgaggaagggtacatgtgcatgaatgcattaatgtatcccttcactgatagttcaagctacggttttatgactcaggctgaggctgtttcttcaactaccttttctccatcacttcctccctttggggatgctgatttgggatactcacccttttga

SEQ ID NO: 38890 - DNA, 312 bp, Glycine max
  Peptide Sequence Number=SeqID_155668
atggttacgttcagggtgcgtaagattcacgccattctgtgtttgatttcatcttccttcgattatgatttttacgaggtagtggtcgggagggctctcccaacggaagcagatcagcatccgaagatctaccgaatgaagctctgggccaccaacgaggttcgcgccaagtctaagttctggtattttttgaggaagctgaagaaggtgaagaagagcaatggtcaagttcttgctatcaacgagaatttcgatgttggtttgagttgttttttgcttgatgttgatagtagcattgtggagtgtatctga

SEQ ID NO: 38891 - DNA, 261 bp, Glycine max
  Peptide Sequence Number=SeqID_155669
atgattccgaaggtttctccgatgagcgaggatgagaagaacagagaaatcggaatcgccactgacaacccttattatgtcacctttcaaggcgtcgctaaccactttcctcctcaacatcaacacccacaagctccctccgctaattattaccaacgacaaggataccacgttgttccagtttatgccgttgctgaaggaaggcctgtgagagaacgtcgtcttccttgctgtggacttgttctgggtttttatttttaa

SEQ ID NO: 38892 - DNA, 804 bp, Glycine max
  Peptide Sequence Number=SeqID_155670
tcggccatcagccgccaggtcagcgcgctggagcaggatgtcggcgtcaagctgtttcatcgccacgcccgcggtcttattcttaccgaacagggcgaactgctctatcgcaccgctcacgatgtgctgctgaagctcgaaacggtgaagatgcaactcaccgaaacgacggaaaagccgagcggcaagctgcgcgtcacgacgacggtgggcctcggtcagggctggctgacggacaaggtgcaggaattcctgcagctctatccggaaatgtcgatccagctcatcctcgacaatgaggagctggatgtgaacatgcgccacgcagattgcgccattcgcctgcgccagccccagcaatcggacctcatccagcgcaagctgttcacggtgcacatgcacgtctatgccgcgccgtcttacatcaatcgccatggcgagccccagtcggttgaggatctggacaaccaccgcatcatctcgtttggcgaacccgcgccgaactacctgctagatgtcaactggctggaaaatgccgggcggtcttccgacaatacccgcaccccccatctgcagatcaacagccagacctcgatcaagcgcgcatgcctgctgggaataggtatcgcctgcttgccggattacattgtcggccgggaccccggcctcatccagttatcgctcgcggccgacattccgtcattcgacacctatttctgctatccggacgagatgaaaaatgctgcaaagctgaaggccttccgcgactttatcgtcgccaaggcgcgcaattggaatttctga

SEQ ID NO: 38893 - DNA, 204 bp, Glycine max
  Peptide Sequence Number=SeqID_155671
gccaaacgcaaggaactccaggagaaggccgctaactcgatccagaaactggttgatgaaaaagggagggaaggcctgaaggcctttagcgcatctcaagctatagcagatgaggcaaaggttatggagaatgctgaccaggtcttaactaaagagatggcctccttgaaaaagctgtacggggatttagtcaagaatctgtag

SEQ ID NO: 38894 - DNA, 306 bp, Glycine max
  Peptide Sequence Number=SeqID_155672
atgaccggccttcttgatgagtcaatctcttactttctcataagggtggacccttgggtactagtacctattgcctttagagggatgcatgccctcaccttcagagggctacatgtcttcgccttcagagggttgcacgccctcaccttcagagggctacatgccttcgccttcagaaggctgcacgcccttgcctttagagggctgcacgccctcgccttcaaagggctacacgccctcgccttcagaggactacacgtcctcaccttcagaggactacacgtcctcgcctttagaggactacac

SEQ ID NO: 38895 - DNA, 339 bp, Glycine max
  Peptide Sequence Number=SeqID_155673
atgtttcagaaggaaatgagccaaaaaaactcaaaatgggggggaaaagatcaattcagggggtgttctttaacattgggcccatctaggcccatcaggaagcttcaacatgaagcaaccagctcgtctaggcgagcatgttgcttctggaggaagcctccagctcgcctgggcaagctgggcagcaacctccttccccattttttctataaatggatgtgggagagtgaggggaaagggttcaacacccttggtattcagatttcacttaaaattagtgaggagaagaagaaagaaggagaaaatcaaggttggggcgcttccataatgcttcagtga

SEQ ID NO: 38896 - DNA, 417 bp, Glycine max
  Peptide Sequence Number=SeqID_155674
atggatttcttttctgatgagagttttgaatgcattgaagcattgcagaactcaaatctcattccatttatgtcttttaacctgcctgtgtattctgaattggtaaaagctttttattctaaccttgaaattcaagagagtaccttgatttctgaggtctttgggataaagacggtcattgaccaatccctcttctatgatttgacccaattgtctagcgaaggtgtaccatttgaaggtgcactggatgatgattggaaatttgatttttttgtacatgatgtcctccggttggtttgcaccaaccaagcggaaatgaccggaagactgcttgccggttcattggctcttgaaagccgcatccttcattatctaattattcgtatcctactccctagatcttcaaacattgcatag

SEQ ID NO: 38897 - DNA, 693 bp, Glycine max
  Peptide Sequence Number=SeqID_155675
atgcagaactatcaacatgcaaagagatctgattctgcaaaagccaggatcaacagaaaacgtattatgcagcagaagcgacatggtcatgctcagtcatcttcacaaccaacacttaactgcacttcagaatataatatgactgtttctgattcatcagaaagtgaaaattctgaatccacacaaggattgactcccttcgaggattgtcaatctccaactaatcagcctgtaatcaacactgaaggatattttgatcttggtgatcaactcatccaatgtagatattgtaatgcacaaatgtggtatggtgaaagaatatcaaaaaataagaattgtcagaatccaaggttcagtttatgttgtggagatgacaaagttgaattgccattattacaaaatccaccccaatatctccaacaacttctatttcatgatgatacaattgatagtaaaaattatcaacataacttacgagcatacaacatgatgtttgcctttacttctgctagaattaagctagataaaacaattaataattcaagaggacctcttgcaatcagaatacagggccaaccatgccatagaataggcagtctattaccaatgcctgggaaaaaccccaaatttgcacagctatatatctttgacacagaaaatgaagtgcaaaatagaattaatgtcatgaggtag

SEQ ID NO: 38898 - DNA, 217 bp, Glycine max
  Peptide Sequence Number=SeqID_155676
ctacaccctaaatgacaacctgccgcctttaaaagcaatacaacagggaatcaaacattttgacaaatcaaactttcaacttacaggcggtcttggagtggatattcagcgatttacgctcgaccttcgctatgaacgaggattttctgacctcaacaaatcttttaaatccaaaccacaggcattttctattggattgggttactttatcttctaa

SEQ ID NO: 38899 - DNA, 382 bp, Glycine max
  Peptide Sequence Number=SeqID_155677
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgatggctgggcacgggggtcccagttcccgaacccgtctgctgtcggtggactgctcgagctgcttccgcggctagagcgggtcgacgcgtgcctgtcgggggacggattgggaacgggtccttcggg

SEQ ID NO: 38900 - DNA, 992 bp, Glycine max
  Peptide Sequence Number=SeqID_155678
ccgctacccgtcgccaggcgcacgtcgtcggcgtcgtcttgaccctcgaggaagttggtttcgccgatgaagtcggcgaccgcccggttcagcggcgcctcgtagatgtcgctgggtgtgccgacctgcagcaccttgcccttgctcatcaccgcgatgcggtcggacatggtcagcgcttcctcctggtcatgggtgacgaagataaaggtgatcccggtctcgtgctgcaggcgcttcagctcgatctgcatttccttgcgcagcttcaggtccagcgccgacagcgactcgtcgagcagcagcaccttgggccggctggccagcgcgcggaccagggcgatgcgttgctgctggccaccggacaactggtcggcgcggcgcttgccgacctccggcagcttcaccaggtcgagcatgcggctcacggtggcgtcgatctcgctgcgcgggcggccctgcatctccaggccgaagccgatgttctcggcgacgctcatgtgcgggaacagcgcataactctggaacaccgtgttgaccgggcggcggaacggcggcaggccttccatgcgttcgccatagaggcggatgctgccggagctgggttgttcgaaaccggcgatgaggcggaggagggtggtcttgccgcagccggaagggccgaggagggtgaagaattcgccggtgttgatcgtcaggctgacattgtcgacggcggtgaagtcgccgaagcggcgggtcacgttgcggatctcgagcaaggggggcgtcactcgtctggagaggcagtaaggtcagcgggcggagccggctgcccgcccgtttcctcgagtcttcgatgttccttcgcccgtcctttccgtatcgggagcctgcccgatgagccatgccgtttcccgcttgcgccaggagcgcctggcgcgcagctcgaaacccttcgtcgcgcgcggttcgcgcatgacacgctgcgaaggctgtgtgggatcctctag

SEQ ID NO: 38901 - DNA, 639 bp, Glycine max
  Peptide Sequence Number=SeqID_155679
atgaaagagcacacgcttatcggatttgaactattgagaaattcccatttaaaagtctttgagttaggtgctgttatttctttacagcatcacgaacgatgggacggaaatggatatccttatggattaacaaaagaagaaattactccagaagctcgtatagtccaagttgcagatgtctttgaggcactaacacacgatagatgttaccgcccagcttggcctgttgaaaaggcgattgaatatatgcgtgatatgaaagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38902 - DNA, 663 bp, Glycine max
  Peptide Sequence Number=SeqID_155680
atgaccctctttagatcgttctgtaatattccagtgtttgccgcaaggaatgacgtcgtagctcctgcagaagggagcaccttgctatcacgccctgagtttatagacgatgtctttattagagaggatctatacatggtatcttatctaaccaatccgggtaaggggccttcttattgggatcccccgaagaactccgcagtacaactagccgcagcgatcactgccggctcaaggatctattgtccttgctataccacagaagagtcagatggcaataagaaggtctataagtacaagggaccgggtagaaatgttataactccagaatggtataaagaacagtacgccgacccttcccgaagtctgataaagaaggtaacttatcaatttcgacccaattggaaagaactctcggttaaaaacaaagagagtacaaccactcttagaactctcagtaactccaagagaatacctttctttaatgaaaaaggtaaatatatccatcacttgatattgcgaaaggagtataacgaggcaatagtcatgatatttgattctaggcaattcatgaatgttggatgggttgtttgcatggaaaattctttctttcctaattataaggatcaattagttctttgccaaatgataagagatgtttaa

SEQ ID NO: 38903 - DNA, 144 bp, Glycine max
  Peptide Sequence Number=SeqID_155681
atggaatcgagagctccaagtgggccatttttgctgggttacggtgcccaactgcgcgctaacctagaccccacaaagggtgttggtcgattaagacagcaggacggtggtcatggaagtcgaaatccgctaaggagtgtgtaa

SEQ ID NO: 38904 - DNA, 405 bp, Glycine max
  Peptide Sequence Number=SeqID_155682
atggctgaaaagacaaagaaaaaactggaggaagctgctcagtccggaagcactgagggcgtcattgacccttcatcttccatcagacgacacgtgaagtggaagatggcctgcaccaagaaaactaggcagatgacgtttgaggcaacaaaggaaattgctgagaagattgattctttggaggagaaggcttcacagggttcgtttgtcccctatggatgtcagtatatcctgactgctgccattgggcgacaagaacaccctggtcgtgtgcgtgatgctagagccggtgtgaccataaagcaatactttggatcagctccacgaacctcccacagttctttctccatagctcctgaagaactcgaacagctgactcaacaaatcagggaccagctgggagga

SEQ ID NO: 38905 - DNA, 267 bp, Glycine max
  Peptide Sequence Number=SeqID_155683
atggccgccaatcaggcccgccgccaggttacccagcgcactcgcgcagaaccacagccccatcatctggccgcgcattctttccggcgccagcagcgtcatggtcgccagaccaatcgggctcaggcagagctcacccagcgtcagcatcagaatgctgcccaccagccagaacggcgacacgccttccccgccgttgctcagcacgttttcggccgccagcatcatcaggccaaatgcccgccgcggcacacaggatgccgatga

SEQ ID NO: 38906 - DNA, 204 bp, Glycine max
  Peptide Sequence Number=SeqID_155684
atggctgcaagtgacattgctattctcaaagatagagcccacgtaccaacaaagaaaagtcttctggaacttacatcgcaagatgctttgttggcacagaacaagttattgtccaagcaattggaagcattgactgaaacactaagttgcacggtgtgccatctgtggtggagctcacaattttggctgctatatccccaatga

SEQ ID NO: 38907 - DNA, 921 bp, Glycine max
  Peptide Sequence Number=SeqID_155685
ggctttcccggtatcaacagggaccaccaggatttatttattctgcgaagtgatcttccgtcacagtggcttctgtttctatcagctgtccctcctgttcagctactgacgtggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacgactcggccatcttggtcaggcccaggttgatcgcgtcggccaggatcgtggtcagcaacaggttcttgtccttggccaggtcgcccgatttcaggtgcgcgaagtgacgggtaaagcctgtccactcgtccacttccagcagcagttcggtgatcttgacgtgcggcaggatcatggccgtctggtcgatcaacgcctgcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 38908 - DNA, 144 bp, Glycine max
  Peptide Sequence Number=SeqID_155686
atggaagcaggacgcaggcaaactagtgagcacgatagggcacaacgggcaaaacaagtccctcatgaacccgtgaccacaaaccactacaatgatgatgatggtggacaaagcgcagcgacgagggttgtggacagagcgtga

SEQ ID NO: 38909 - DNA, 272 bp, Glycine max
  Peptide Sequence Number=SeqID_155687
gtatgccgcctaccaggcaccctctggactcaaataagtccaacagggccctgggatttccagctttgatcacaggactctgccaggcgttcgaagtccccgtcgcacctagtaaggtgattcggcgacccatcactcgagcttttattaagaagtattgcacgcagagacaggcacagggtggcgaccctcaggccccagatgcaccgcctccacctcctcaggctgacccagcaggcggccaaccacagggcgcacgtgcagacccatga

SEQ ID NO: 38910 - DNA, 204 bp, Glycine max
  Peptide Sequence Number=SeqID_155688
atgacaaataatgaacataaaactgaaaagaacacgaatctgggggatctcctagtcatgtggctccactccctcccaagaagccgaacaaatctgacatctcctcatcctcgtgggcctcatctggcttgccgggagtttatgcgggtgcctctacagcctgggcctcaggccaatctccgggccatgcgacctctgccttga

SEQ ID NO: 38911 - DNA, 945 bp, Glycine max
  Peptide Sequence Number=SeqID_155689
atgggtgatgccggcgcgcagctcggccggggcgttggccagcgcgctctgcacgatgggcgcgccgcagtagtgggtgacgccctcggcgcggatcatgtcgaacacggtcttggggtcgaacttgcgcaggcagacgttgacgccggcgcgcgccgccacggtccaggcgaagcaccagccgttgcagtggaacagcggcaacgtccacaggtagaccgggtgcttgggcatgtcccattcgaggatgttgctgacggcgttcaggtacgcgccgcggtagtggtagaccacgcccttgggatcgccggtggtgcccgaggtgtagttcagcgcgatcgcgtcccattcgtcggccggcgggcgccagtcgaaggtggcgggggcggcggccaggaaggcctcgtagtcggtggcgccgggcagggtggccggggcgccgtccaggtcgtgcaccgagatcactttcaggtgcgggaattcggcgcgggcgcgctgcgcgacctcggcgtattcggtgtcgacgatcagcgcgcgggcctcgccgtggcccagcatgaacagcacgctgggcgtgtccaggcgggtgttgagggtgttgagcacggcgcccagcatcggcacgccgaaatgcgcctcgaccatggcggggatgttcggcagcatcaccgccaccgtgtcgccgcgctggatgccggcggcggccagcgcgccggccaggcgttgcgcgcgttcgtaggtctgggcccaggtacggcgcacggcgccgtgcaccacggccaggcggttgccatagacctgcgcggcgcgggcgatgaagtcgaccggggtcaggggctcatagttggcgtcacggcgtgccaggccgtggtcgaacgtgctgctcatgcttgtctcctgtggggcgcgggggcgcccggatatgcttttatgcgggaaacttga

SEQ ID NO: 38912 - DNA, 186 bp, Glycine max
  Peptide Sequence Number=SeqID_155690
atggccggtgtcggtccttatatggccccgactgatatctttcagccgacattgggcaatttcttttacaaacgctggccgataatgttcttttatttacggacggctaggtttttccgtgcgagctcaaccgagggttcgttccgaccgacactggcatgttgttcttctcatttaggaggctaa

SEQ ID NO: 38913 - DNA, 393 bp, Glycine max
  Peptide Sequence Number=SeqID_155691
atgcttacagatcacctgatccataagctcctccaagcttccctactccgacatcaatggtggaaaggacagtggtgcttacctcgacggccgatgctgacgatgctccctcgacggtggacactggttcgtggttcgtggctcctcttcacggcaacacgtctcctcttcacggtggttcgtggttcgtggctgctcgtgctttgtagcgcaaggaagaagaagaatgactctggggaagaaggtaatagcgcgaggaagaagacgaatggctctatgcgaggaagaagaaaagaaactgttgggtgcgacgagagagagagtagcgggagagagagagtcacacgtttttttaaaaaaataacccaaggacataaaagacttttcatctaa

SEQ ID NO: 38914 - DNA, 363 bp, Glycine max
  Peptide Sequence Number=SeqID_155692
atgacttcttacctttatctactattttcacagaatcaagaaattattgcaatcaaggctccaaaagctagttgcatcgaggtccctgatcctgatgaggacgaccgcaagtttgaggatgatagtgccaaacggatgaaattaatggatccatcatggaatagtgatcccatcagaaagaggggtgtgggattattagaaagccaacatgatgaaaaaaatccttctgagcgtttcagtttgcaaggttcacaagcatttggaattcaagaaattactcccacgggttttgaaatggaagatgactattggtttcaatcagatcctggagtgagccaaacagaattgtggggaaatgagtag

SEQ ID NO: 38915 - DNA, 210 bp, Glycine max
  Peptide Sequence Number=SeqID_155693
atgtttatcactaatctactttctctttttggcgggagaaatataaaacatgttaaaggaaaagatgatgaattagatccttctgaaggcaagacttgtagtagtatcagaattttctggtttacgcgtcttgcaattgcattatccttgtttgtccacgacaatccccatacagtttccatcgttcctgtggggcgagttaaagattga

SEQ ID NO: 38916 - DNA, 891 bp, Glycine max
  Peptide Sequence Number=SeqID_155694
atggattcttctccttcaccagacataaacatcccagagcagtggttagaggccacagagtccattgcaaacagttcaatgcctcctattactcttatatgtggtgccaagaattgtgcgaagacaaccttctcccgctatctcctaaatgtcctcttgaacaaatacaccaaagtagcttatctggatactgatgttggccaacccgagtttactcctcctgcttttctgtcactaaccattgttcataaagtaacttcagatttgacagttccatgcctgaaaacaccggagagtgacttggatgatatatatcatctgtgttggatctttgtattcaattgtgcaagtgtgagccaattcaggtgccttttctttggtgatgtttcttgtaagagagatccatcaacatacttaagttatgtatttgccatatataattattaccgaaaggagtattgcatctcagataagggagaatatcctcataagatcgaagttcctcttatcgtgaatactcctggttgggtgaaagttaagataagcatatccagtgaaaaaaagaatttacctgctggagaattttggtcagatggggaacatgatgaaacaattaacttaattgagataaattcagctcatcaggactcgttaactagatcggtgcttgttcagatagatgcacgcctactgcgtgatttacgaatattgacttatttcaaacagtgcttttctagtgattcaaatatttctacaatcaaggaacttgcacatgccttagcctctcattgtccttatgaggttcccattgcaagcataaagattcaacaccttcattgtgagaacttaaagttgcatgcatctaacccttcccaagcaccacaagagtag

SEQ ID NO: 38917 - DNA, 183 bp, Glycine max
  Peptide Sequence Number=SeqID_155695
atggaggatcatttgactgaaatacttttggaaatttcagatttaaaaaggattgtgaggggcattgacacagtaaaaggtgtgctctatgtcattactcctgtgccacatagttctctggaaagagtcaacctcttgctacagggttctgttgggccacaagaacttaaccagttagtataa

SEQ ID NO: 38918 - DNA, 222 bp, Glycine max
  Peptide Sequence Number=SeqID_155696
atgactagcagagaccaagtttggtcattctgcacccttgtatcatccagaggcggcgggcccgatgatacgcggaaatacccgagtgacagaacgcttgatagcatgcataggctgacacagtcttctgcaccttttgttcctccgggaacaacaagtcatttacatgcggaaatttcatggtcacccgcaactctcgtcaaccgagaggagcgaaattag

SEQ ID NO: 38919 - DNA, 1770 bp, Glycine max
  Peptide Sequence Number=SeqID_155697
atggggaagttcacacactttgtgatctatgtgttgcttgaatgggtgctgatattcatactcttccttgatggttttcttgcatttttggccaatgagtttgccaggttctttgaattgcacatcccttgctggctgtgcaccaggtttgatcatgttatggttcacagaaatcctgatttctattacaacgagtctgtgtgcgaggctcacaagaaggacatgtcgtctttggcattttgtcataaccacaagaagctctctgacataaggaagatgtgtgaggggtgcctgctttcatttgcaaccgagaaggaatcggattgcgacacctacaagtcccttgtggggattttgcataaggacttggagtgctttgttcaggatgaccaaccaattcagttgagtttgaaggatgatgggttcatgcaggttgatagaagcaacaaccaaaagtgttcatgctgtggagagccattgaaaatgaagtcttctaattctaatgtgaaagtgaagcactcgtcatcatttgtgcgagccccaactccttcaccgagagcttttccattttcaacaccaataagtttggaacctaatggtccagagttgcctcacatcaggtacaaagaactcaagtttatggcagatccggagcttcaagaggatgagtttggcttcaatgttaatagcccgaatgttaaatcaagcggagacaccaaatctacctctttgcctctattgggagaagtagaagacttgaatgatgagtccagcaaattcaccccaacttttacaaggggaaataagttctttggaatcccgctcaccgattctgcaaacaacagtcccagatggacctacaggattaacaagaaatcaccactggaaaagacagaatttgcctctgactctaatgatgtaaatccccaaactgattttgatgatgccatcttaaacaatttgaagaggcaagttcgtttggatcgcaaatcactcatggctttgtacatggagctggatgaagaaagaagtgcttcagctgttgctgccaacaatgcaatggccatgatcacccggttacaggccgagaaggcagcggtgcaaatggaggctttgcagtatcagagaatgatggaggaacaggctgagtatgatgaagaagccctccaagcatctaatgatatgcttatcaaacgagaggaagatctcagagctttagaagctgaattggagatttttagaaaacaatatggaagcttagcagaagaaaacacttttagtagggaatctaactcatctcttggttacaatagctcttcattcaagctcaatgaaggtgaaggtaatggagaaaaaggcctcaattctactcaagttgaatcacctcaggaagaaaatgaaggggtaagacacaatgaatcagtcagagattttaaagcagagaaaacatatcttcttggccggatgaagaaaaaagaaaatagaacacccttagcagaaagtggaatttattccttactgtctagctctgacagtgttaataatttagacagtgagacaggaaaaggaggtgaaacctttctaccaaaagaactgtctttccttgctgaaagggtgaaggctctggaaggcaacagtgggttcttagagcttgtttccaataacgacgagaaagatagtgaaggaaccaaaattttgacagagatatcacagaatctagagaaactcagtcaccttgttatgacctcctttgagatagagaatgcatga

SEQ ID NO: 38920 - DNA, 516 bp, Glycine max
  Peptide Sequence Number=SeqID_155698
atgcgagcacagacggtgatgacacagtggtgcacaagagcagcagcgtgtgggcaattgaggatgagcactaacactaacactcccaaacacgacgatatcgacgccattttcaaacaaaagcgctttcttcgaacgcaggtcagaaaaaccctcaagtccatcgatccctccctcaaatcccaccaagataacaccgttcaagacatagttttgggagctccgtggttcagatccagtcgcaggttgtgcgcgtacataagctgcgctgctcttcgcgaagtcgacacttcaaaaatcttgtcacagattttgcaacataatagtactactgatggaaaaaaactttatgtgccacgcgtggaggataagaatagtcacatgcgtatgcttcacatatcgcgaattgatgatctcattgcaaactcaatggacatactagagcctactccggttgatgctgatggaaatgcgcgtgaagatggtacacttgccttgcccctcttttctttttag

SEQ ID NO: 38921 - DNA, 354 bp, Glycine max
  Peptide Sequence Number=SeqID_155699
atgcaggcaaatgatccagttgatttgttccttttacctggactggcatttgacagatctggaagacgtttaggtcgtggtggaggttactatgataccttcctgaagaattaccaagaccttgcaaagacgcgtaattggaagcaacccttgcttgttgcactgtcatattctgaacaaatactggatgaaggagtaataccaatgacttcatctgatcttccagttgatgctctggtatctccagaaggtgtgattcccatcagtacaactgccttaaacagtgaacaattccagcatggatctctgacactggcagtggacttcacagctgatcctgaacacttacaatag

SEQ ID NO: 38922 - DNA, 414 bp, Glycine max
  Peptide Sequence Number=SeqID_155700
atgaaattcactaaaaaaaccaaacacattgaaagtaaaccctacagtgtatataattgccgaacaccacagactcaaacagttgataatacaagttggaattgtgactgtttggtgggaagacaacataagtcagaggttggcagtggcggtggtggtggaggagaggaccttggagcagtcgtcctcgtcggcggcggaggcggaggaggaggaggaggagcagtcctttctcttgcggggggtggcggtgaggtcggtgagggtggagtgatcggcggaggaggggtgggggaagggaggggggaaatggggcattccgggccaaatctcggcgagagagtaagcgggggagaatgtggagtcagtgatgagaggaggatccattggaagatagaatcattcaatggatga

SEQ ID NO: 38923 - DNA, 456 bp, Glycine max
  Peptide Sequence Number=SeqID_155701
agcgctgttcaagtgtcctccacatggagtatggagctatgtatcatgattgcaagactgcggacccagaaggcaatcctccattcttcccttttttgggagacccatgactgttattgtatagcactgttcatgtgtcctccaccttcgagtggggagctatgtttcacgattgccaaaagcgctgttcatgtgtcctccaccttcgagtggggagctatgtttcatgatttcaaaaatgcggaccgtcaatttggagctatgtttcatgattgcctaagtgcggaccctcaaggcaatcctccattctccccctttttcggagccccaagaatgttattgcctagagttgttcatgtgtcctccaccttcgagtttggagctatgtttaacgattgcctaagtgcggaccctcaaggcaatcctccattctccccctttttcggagacccatga

SEQ ID NO: 38924 - DNA, 1142 bp, Glycine max
  Peptide Sequence Number=SeqID_155702
gggagtggaaagaaactgaagccatgatagacgcagatagaaggttggctacttctgccatctcacagggacgggcaacactgcttcacgtagcagcagaagcaaatcagttgcacttcgtaaaggagcttgtgaaactactgagcgatgaagacttggaattacaagaccgcaaaggcaacactgctttctgtttagccgcagcatcgggaaatgtgagaattgttaaagtaatggcccgaagaaatagcaggttgccaactatcaggcgtggggatggactcaccccacttcacatggctgctttgcagggaaaaaataaaatggcatggcatctctaccatgataccgttcaaacattcaatgatgcagattgggatgcattgttcttcttttgtctcaagactgatatttacggtaagagtccaactttggccctccaacttgtcaagtgtctctgggagacacttctttctctagatggcacagagatgcagactattataaaagtcataagtgaaccatctcaggtaatatttattgccacagaagttggaaattttgaggttttggcagagctggatgaggataaaaacaatttactgcactatgctgcaaaattatcaccaccgagcaaacttaacttgttgcctggacctgttcttcagatgaagttcgagttgatgtggtatgaggaggtgaagaagatcatgcaaccttgtttcatagagatgagaaattccaatggtaaaactcctcgagaattattcactgaagagcatttagagttagtgacaaaagcagagtcttggatgaaaagcatgataaattcctgtataactatttcaacggtcactgctacactagtgttggctacagcattcagcattaagcgtgaggataaccataaacccaccattactcgtgacttcatgttatatattggaattgcaatgatatcttcatccatctccagtctgattttcttgtctatccttatcacatcaccttgtgtagaggaagactttttgaagtcactgctgcggaagatatggtggggactgcctattaataatggaatatcttctgtttccatatgggtcactcgtcaacataaacccacgctattggttacccagtaa

SEQ ID NO: 38925 - DNA, 261 bp, Glycine max
  Peptide Sequence Number=SeqID_155703
atggatgctgatgctgatatcagtgcaaatgttactgctaatgaaaatgctaggaatgctggtttgtgcaaaaagttgggagtttgtgtttttttatggatgctaggaatgctggagtttgggcaaaaggttgcaatgaaaactcctgcggttatgagtgtagaaacaagcatgcacctaatagatgtgctatttgtccatgactctgcggctaatcccctctatccgaagaatctagccgtcaacgcccttacaatgtaa

SEQ ID NO: 38926 - DNA, 1059 bp, Glycine max
  Peptide Sequence Number=SeqID_155704
atgaatgaaaacaaagaagagacaagaagcatggtagcaatttcgctttacagagggaaccttcaccgagtaccggacgtgcctcgtcgatggccaatgccagcccccaaaatcactctcaaagacttcaaatcccttctcgctcgtcgctccaaggcactctcgcgccttcaaaaccctaactctacccctctccccaacggttcccaacccgaaccacctcccaccgttaccgttaatcacggcgaaggcccctccatcaccgtcgcccgagaagacggagatcgcaacgaaacgccgctcgtcgccgttagttccgccaagaaaccgctcgctggatctgattcggagaaacctcagctcgattccaagattgatgaggcttcggagaaaaaaacatctgacggtgtcgccgctccggaggaagaacagactgagccggtcgctgagaatgaggatctgcttaacgaaaagaagaaaaggaaaaaagaaattgaggagaagttgcatgggttgaatgataataaacataacctggtgttggttttgaagcagatattgaatgcggaggaggagttgaagagacgaaatagtatgcaagtagttgcgatgcgtggtccctcggttccacttcaaggggatggaacaaatgatactggttcaatgattaggcatatgcccccaaggttgggatccgagggaaatcttgttgctgctgatgtggatggtggtggtgaaggggatgattttgctaaccatacaatgcattctcgccatgtgcttcggacaagtagcatgtctccttcttcagagtccactcttcggagaacccctagcattagcattcaacagaatgtgatttcacatccttctcgagcaaatatgggggctgctggtagtccatcacgctttgctctctcaggtcatcagggaaatcccatgaacctaccttcagtgtctgtgtcaggaactagttacattgcatcatccccttccccagcagcatctggtggcacttctgttttcagagacgcccggcagccaagtccatggaagtag

SEQ ID NO: 38927 - DNA, 993 bp, Glycine max
  Peptide Sequence Number=SeqID_155705
atggcgaggtctccttcttgtgaaaaaatcaatgtcaaaaggggtttgtggactacagaagaagatacaaagaagcttgcatttggctccaagcatggatctgggctcaagaggtgtggaaggagttgtaggattaggtggactaactatcccaggcctgatcttaaagacgacaacttcacaacccaagaagaagatctaatcattaagcttcatgcagccataggtagcaggtggtctataatagcccaacaacttcctgggagaacagacactgatgtaaagaactattggaactcaaagctgaaaaagaagctctctcaattggggattgaccctgtcacccacaagcccttctctaaactcattgctgactatggaaacattgggggttgccagaaaccaagtactcgaattgcttcaatcaataaggacttcaagaatgcaatgatgctaaaatcagaatcccatcaaaccctgccagagggatttattacaaacatcaatgaccaaccaaagccaccacccaaaatggaaaccactggaaacaactttttgttcaatagaactcatggtgatgacctctcaatgaatcttgaccagttccaagccatatcaatgaaatcgggtgcctcgaattgcatagacttcgagaatgagatcatgccagtgtctatgttcggggaagattgcttttcaaaaacttcatcaccatctactccttctacttgttccactacagcttttagttggaacgacttccttttggaagatgcttttacaccacttgctaaccaagaacaagacttggtgagtcaaatagaggatctgacttggaataagatagaggtcaagtcactgcaagcctcaggtagtgacttacaattttcctcagcatctgacatttcattcatggaagccatgcttgatcaagaaaatgagatgttcctaagttttcctcaccttatggaggaaccatccaagttgaattaa

SEQ ID NO: 38928 - DNA, 444 bp, Glycine max
  Peptide Sequence Number=SeqID_155706
atggaggctgcacgagttcagtaccaagtccgggatcgaagagttattttccaccttgatggtaccctaacatcaagtgttggacctgagtgtgtagagttgatctctatcaaacataatctgcatgttctgaagcgtgatgtcgtgacatccggattaacttataaccacacaagtgttatgtccataaatacaccaagcatatccaagttgcaatggcatccatttactgttacttctaatagtaatttggagccaaacaacctaagtgttaagttgttattaaaggtgaaggaacttggagcaagaagctctattagcttctttcaactccttccccaatgcaagcacaatggtagccttgatagcatccaaaataactttctcaaacataaatatgtgaaggaacttggagaaatggcatccatttactgttacttctaa

SEQ ID NO: 38929 - DNA, 282 bp, Glycine max
  Peptide Sequence Number=SeqID_155707
atgcttcccgcgagtcacgcgtcgccctcccgccgaagggtaggttgcaacaataacaaagataatgacaaaaagctcaaacgtcaagaacacttcattttgccatcatcgtcattgttcatggcacagtgcaaccctaaggtgtgttcgtcagttagttgtttcataggttttagacgcagtctttgctcctggagtgggttcgctgccattgtgcttgcaatggggaaggagttgaaagaagctgatagagcttcttgctccaagttccttcacctttaa

SEQ ID NO: 38930 - DNA, 1269 bp, Glycine max
  Peptide Sequence Number=SeqID_155708
atgggcaccgtgttatctcaaaagggtcatctgattaccttctttagtaagccatttacccccgaactccttcaagcttccacttatgtgcgagaactctttgccattactgctgcaatcaagaaatggcaacaatatcttctgggtcaccactttaccattcttacaaaccatcgtagtctgaaagaaataatgacacaagtgatccaaacgttggaacaacaaacctatctggctaggcttatagggtatgactactatattcaatactgctcaggcaaattgaatggcaccgcagatgccttatccagggacttaatcctgaaaggtggtcgcatttggttactcacggagtcttcgtttattcctaccttgctcacagagtatcactcatcccccatagggggccacataggtacaactaagactctggctcgccttagtgagaatttcacctggccaggaatgcgcaaggatgtaaaaagttttatggctaagtgtttggattgtcaacatacgaagtatgagactaagaagatggcagggttactatgtcatttactggttccatttcggccatgggaggacctctcccttgatttcattgtaggcttgtcacctttttgtggttataccgcaatcttggtagtagtagatcggttttcgaaaggaattcacctgggcatgctaccaacccaccatacctctcattctgtcgccatcctattcatggatatcatgggcaagattcacggaaagccccgtagcttagactcggaccaagatcccctgttcattagtcgtttctggcaagagttgtttcggctcagtggaactacctttaaaatgagctttgcgtaccatccgcagacagatagacaaacagaggtgctcaatcgtgtcattaagcaatatcttcgagtcttcattcataagaaaccttcttcctgggagaaattcttgaactgggtggaatggtcttataatacctcgatacattcggggtcaggaatattgccatacgagctgacctttggcaagaaaccatcgactatcccacaatacattaccgggacctccaatcttgaagcagttgatgattttctgaaaaacaagaaggagttaatggggaagatatgtttgagggcaacatgttacattgaggctaaggaggttattgtgaggaaaagggagttggagaagaaggaagccgtctcgagcgtgacatcatattcacccatagaatttcttaagccaaagttgagctag

SEQ ID NO: 38931 - DNA, 321 bp, Glycine max
  Peptide Sequence Number=SeqID_155709
atggttgccgctactagcgctgtcgctaaggtgaacccgatgctcccatctggcctcaagcaaatgaatcatccaacctcaaatatggtaggcaaagatttgggaagtacggacgaccccatgatgtgtaaattcaaaacgagcacgccttcccatcatatggcttgcctcccaactatacaccacccaatgtggcatacactctcaatgaaaatctcaataactccactccgatactcattgagaaccaataacctcatcaggcacatatctctcaaaccatgggggagacacatgaattccccaccacaatctagctga

SEQ ID NO: 38932 - DNA, 1962 bp, Glycine max
  Peptide Sequence Number=SeqID_155710
atgatgaaacgaaagctagaaaccttggtgtggctaacacgaaaacgatcgattcagtttctaatcggtgtttttttcctgtacctcgtactcgttacactcgaaatcccgtttgttttcaaaaccgacttcgcaagcgtgaccaccacgcgccccccgaggctccgaagcgaggaggattcgctacgtaaagagtcccctgcgcgtcctttcaaaacggtttccaacgccgactcgccgagtcaactcgctcaccgccccaacagcagtgtcatttccgcgctggtgctaaacgacgccgcgttcgactcccacgtaaacgacgggtcgtctgaactctacaagcaagtgaagcacgcgcgcgaggttggacggagtctatgggaacacctcgaatctggaaagccgctaacacgaaccgttgccgagaaccggcccggttcgtgtcccggttcggtttcgctttccggttcggatgttgttgacgtctcgggcgtcgtgccgttaccgtgtgggctcacattggggtcccacataacggtcgttgggaagccgttggcggcgaagcccgatttcgagccgaagataacggtggtgacggagaacgagcccgtgatggtgtcgcaattcgtggtggagttgcaggggctgaagaccgttgacggtgaagagcctcctagggtttttcatttcaacccgaggttgaagggggattggagtggtaaacctgtgattgaactcaacacgtgttaccgcatgcagtggggttctgctcttagatgtgacggttggaaatctaaggccgatgatgataccgttgataggatggtgaagtgtgagaagtggattcgggatgatgaagatcacttggaggggtctaaggcgacgtggtggttgaatagactgatagggcgcacgaagaaagtaactgttgactggccattcccgttttctgaggggaagctttttgttcttactgttagtgctgggctggaggggtatcgtgtttctgttgatgggaggcatgtgacctcttttccttatggcactggttttactcttgaggatgccaccgggctttcgttgactggagacattgatgtccactctgtatttgcggcatctttgccttcatcgcatcccagttttgccccacagcggcatcttgaattttccactaggtggcgtactcagccacttcctgagtctggcgtcgaattgttcattggtgtcctctcggctggaaaccattttgctgagcgtatggctgtgaggaagtcatggatgcaacataggctcgtcaaatctggagcagtggttgctcgtttctttgtggcactgcatgcaagacaagaaattaatgcagagttgaagaaggaagccgaattttttggtgatattgttattgtgccttatttggataactatgaccttgttgtgttgaaaacagtagccatatgtgaatatggggtacatacagtttctgctaagtatgtcatgaaaggtgatgatgacacttttgttagagtggatgctgttatcgatgaagcaaggaaggttccagatggttcaagcttttatattgggaacataaattactaccacaaacccttgcgctatgggaaatgggcagtgacatatgcagagtggccagaagaggattacccaccctatgctaatggcccgggttatattttgtcatcagatattgcacgctatatcgtatctgaattcgatatgcgtaaattaaggttgttcaagatggaagatgtgagtatgggaatgtgggtggagcaattcaacagctcaaaaccagtacactactcgcatagcttgaagttctgccagtttggttgcatagaagattattacaccgcccattaccaatcgcctaggcagatgatgtgcctgtgggataaactgcaaaggaattcaaggcctcaatgctgcaacatgagatga

SEQ ID NO: 38933 - DNA, 1242 bp, Glycine max
  Peptide Sequence Number=SeqID_155711
gagaagcttttcacaagtaaaaacagaacggaggcatctgttgggaagaaggtgaaaatagacatgctccctgaaatcgagaaagttcacaagagaaaggagaagttgctgaaaaaacaacacagacaagctcttcttcttgataatttcttgggtgttgatgggattgcccctgggcgttcacttcgtgatagaaaacctctaacttttgacgtcgctgtcattgcagatgattacgatcgatccatcaatgaagcaattaagataaccaaacggaaaccaccatccccagaacttatacccaggagagaagcaggagcaaaacctgaagctttaaccaatggtaaatggagtggtccttcacatgaccctcaagacctgaattttggcatgccatctccaaaatcacctgactccgatgatatggaggaagagaatcaaactgacatgttggacttggatcgaagcaatcggcgaagacagaagcctaaacggtattcagagaaagactttgttgaagcactgtcggataatgaggctgactatgacagcgatgatgatattgttggagaagccgtgtatgatgaagagtatctccagaaacgtaagcagagaaggaaggcttctagtagctctggctctgaaggagatgaagaatatcattgggatgaagataatgttgaagacgaagaagaagattccttgagtgtcagtgaggatagtgacaagccccgtaaattcaagcgactggcaggccgtactaggagggaaactaaagtcaggtctgtgggtgagattcaatcaggtctaagacgtagtaagagggcaaaaactaaaagccgtataaattaccgaaggtacgagatatctgattcagagacagagttcattaaatctgacaagtccaatgcatcagacgatcactcagatcctactgagaatggggagtatatgatggaaagtgaagactccgacggcaatgacgaggaagaacaagaaaccaaagcagttgagcccgttacttaccctgcagaagaaaataaccaatctcctgctgtagaggagaatgaacaaaaccaaaacctgcctcctgaaaaatctagtagtccaggtcaggaggaagttgagggcaccgcaaagcgacgtttccttgatttgaatgagcttgcccctagctcaggttttgatgatggtccaaatacaacaacactgaaagatgaaggcggcaatgatgataattga

SEQ ID NO: 38934 - DNA, 519 bp, Glycine max
  Peptide Sequence Number=SeqID_155712
atgtcccaaggatctccccctcaagacaccaccgaaccctcgccggaatccgattcgcgtaaggagcaaacaaccgccacaaccaccaccaccgccgttaccgctgccgtagatgctggtgctcctcccgcccccactcggagtcgcccctcccgcgcctgcactattcgcgcggcggcgcgcctcctctcggcgtcgcagccggcgaggccgaaggccgccaggagggagccccgccgcgaggggtcgccgtcatcgccgccgccgccgccgcagctgcagcaatgcagcaagatcgtgacgccgctggtggaaccgcccccggcggcgcagttgccgcgctacaacctccggtccatgtgggaattggcttcaatactcaattttttgaatctgtttaggcctcttttgaatatttcagtagaattttcggctgaagagtttgagacggctttgctcaccccaaatgacacattgggcgatatacatgtgcctttgctaaaggttggtgctttttga

SEQ ID NO: 38935 - DNA, 471 bp, Glycine max
  Peptide Sequence Number=SeqID_155713
atgcctaggccattcatgtgcaagatccccaagcttcctctcaaagaagaatctccacactgcaatggaaatgtgaagcatcacacatccttaggcaaagaaactctgaaagtctatgtccttaacaaaagcaaccatcaagagaaggaatcctattatgaacaacaacaagccagagaaggaatcagaggtgtcaatcagaagctgatcatagggtgttgtcccttgaagcttgcttgcggtctcggatctgtggccaagcacaaagatctctttggagtagaatatcatcaaagctccacaagtaagagctattgtggaatgaagaacacacataagggtatatatagaagaaaccatttatccgaattcacttcaaaggcctttaattgctttcttacttttaactcaatggagcctttgccctctaaaccaacaatggtagttgaaattccaatcacttctttctag

SEQ ID NO: 38936 - DNA, 564 bp, Glycine max
  Peptide Sequence Number=SeqID_155714
atgggagacatttcaaagatgaaagatatttataagaggtggactgagtatcttgacagcacgcgatcaaggcatttcaatgacaactgtcatctctactccatgaaaaattcttggtgggaacaagagatacacccttacaatcaatatgaagaagaaaaaactcctactcttgaaagtgtgtttgtggaattcacggcataccatgctacctctacagccaatcaaaactcaatgcaaaaccaggaaattcaggttggcaagagctactccatggaaaattatcagtgggagcaagagttacaaccctacaaccaatatgaagaagaaagaacttctaatctggataatttgttgatgaaagacaaggaagtcactgaatctactcaaagagcatttaaaagtctagaaattcaagttggtaagctagcagaagaagtgactaaatttgtggccagaagagaagaaaattttgtagaggttgaaactcatgaggaaagccttgaagaagagcatgattcaaaagaaaaagatgaagataaaagtgaggagaaatcacaataa

SEQ ID NO: 38937 - DNA, 573 bp, Glycine max
  Peptide Sequence Number=SeqID_155715
atgaagacccctgacgaagcaatggacttaattgaaagcatgactgctagttgcaaatgtacaatttgtggtggagctcatgaatatggatgttgtatccctaatgaagaacaaattgcacatgaaagacagtggcaaaatcaccctggtaaccaattcaacagagaccagggtggttcatctacaaggccacaacaacagatgccaagtctctatgaccgaaccattaagatggaagagactctagctcaatttatgcaggtttctatgtctaaccaaatgagcatagagtctgccataaagaatctggaggtccaagtgggacagctcgcaaaacagttggcagataggtcgtcaagcaactttagtgctaacactgagaagaatccaatggaagaatgtaaagctgtcatgacaaggagcataatggcaacccatgtggatgaaagaaaacttgagaagaagataggggaacataaacaacaactggcagctgagccgacacttaaaccggttgatgatttagttgaacttgaagaaattgttgaggaagcagaaggtgatgaagaatga

SEQ ID NO: 38938 - DNA, 279 bp, Glycine max
  Peptide Sequence Number=SeqID_155716
atgatggacatgagaatgacgatgatggacacaatgccagcacccacatcgacgcgaggtgacgacaatggcacaaagagaaacacaaaggtttggctacaaagagagtggagaaacatcgaagttagccaccagagacgctacaatggctctcgtcatcgatggtggtggcggaatgaaggcgtacattatccccatgagccaaagttcctcgacctcaaaattgaaattgctcttcatgcacacacacacactctgcgtttgctagccatgcactag

SEQ ID NO: 38939 - DNA, 492 bp, Glycine max
  Peptide Sequence Number=SeqID_155717
atgcaagctaatcaaggagagatggaaccatcattccatcaattccatgataaatcattaagtgaagctcttgaccacttctacgcttatacacccacaaagaagagtcttcttgagctcacatctcatgacacattactagctcaaaacaagatcttagccaagcaaattgagacccttacggagaccttgaacaagtttcctcaacagttgtatgcagtgcaacctcctccttctttaaccatgcaagttgggggatgcaacatttgtggcagggcccttgagtcaagaatctgcatgactcaagatgatgcatctaaagaaggaagctatatggccaatccaaactatcaagggttccatcaaggaggacttataggatacaatcaggggggaaatttatctcaaggccaaggctggagatcccatccttgggataacttcaaaaaagatcaagtggtccatctatctgacctcccaatcaagggttaa

SEQ ID NO: 38940 - DNA, 227 bp, Glycine max
  Peptide Sequence Number=SeqID_155718
atgcagaacaaaaatatacgcacaacaagattagacacagaacatgacaggttagacggagaagaagagacactttttggaaccccacaagcttacctcgaaccatacaacgacaatggcagcgacattggtagtcgcgaaaagaagacgtactcggaggctagtattacggtagagacgatgaagactggtgttgcggaggttggtgttgcagtagagacaatgag

SEQ ID NO: 38941 - DNA, 147 bp, Glycine max
  Peptide Sequence Number=SeqID_155719
atgacgaatagcaagaaaaggtccatgacaatgacgataaattggctgaaacttaaaggcactggaatgaccaaactcaaagacgacactgatggacatgagaatgacgatgatgaacacaatggcaccgacatcgacgcgaggtga

SEQ ID NO: 38942 - DNA, 855 bp, Glycine max
  Peptide Sequence Number=SeqID_155720
atgaagccaactccattcgttcaacttgttgagtgtctttggaacaagcttcttgaacaagattacgatgaaacagagatgaggactttcataagtgtaccatcacaaataacatttgatgctacacaagttggaaattttcaatttgtagctgcacttatgaggtcttaccctgatttattatgggaagtggatgacaaaaaccgaagcataattcacattgctgttatacatcggcattctagcatctatagtctaatacacgaactaggctccttcaaggatttcatagcaacttttgaagacgatgaaggaaacaacattttgcactatgctgctaagttgacacctcctgataaacttggcttaatttctggagcagctcttcagatgacacatgaattattatggttcaaggaggtgaaagagttaatgctgctattagatgtagagaagaaaaatgctaaaggaaaaactccacgtgaaatatttgctgaggagcacaaagaattattgacaaaggcagagtcatggacaaagagcacatctattagctgcatgcttgtttctacactcataaccgcaggagttttcactgcaacattcatgctacctggtggcatccataaaaaaacacaaactcccaactttttgcacaaaccagcattcctagcattttcattatcagtagcatttgcactgatatcagcatcagcatccatactaatgttcctgtctatactaatttcaagctatgcagaggaagaatgtttcaagttgctccctaaaaggttactaattggaatggtggcacaaattatctccatcacaaacatgatgttgtatgctggataa

SEQ ID NO: 38943 - DNA, 333 bp, Glycine max
  Peptide Sequence Number=SeqID_155721
atgaacgacaacgatttttgcaaaaattgtcatcattggcgtgttcattttttcacttcagtctgttcgatcactcactcgctgaccctcatggttgccctcactcactcaccctttactcatcctcatggttgtcctcacacactcaccctctacccgtgctcggctagcattgccattgagaagttgatcgatgttagcaatgggagggtcaagaatttcggaggtttggtggaagacattctcgatcatgcccctacagtcaacccaatcgatggaccccacaagaaccttgtccctgaccattgccctctacttaatcttcttcaatag

SEQ ID NO: 38944 - DNA, 204 bp, Glycine max
  Peptide Sequence Number=SeqID_155722
atgatgacctattggcccacagagaaagcgccaaagctacgaagtataattgagtttacacccccacctgcacagtccgaaaaagcctccattacagatgtattccaattaccaaacgctttttgggtttccactgtctgtggaaaaactgaagattatgaagataaacaaagtggtgtcacttccttcagcggcagctcttaa

SEQ ID NO: 38945 - DNA, 1275 bp, Glycine max
  Peptide Sequence Number=SeqID_155723
atgttgtgcatatttttctacaaagtggtatcagagcaaggttgtttcgctctggttttcacgattataatgacaaccgtgaaatatgagatttcgttgctggattacaacaccagattttcgctaaggcaggttaagatgcaagccgttcttgcacagatggatttggatgaggccttacagggtttcgacaagataccttcgtcctggacgccagaggagaaacaatgtaaggatcgtaaagcaacgagtcaaattcatcttcatctgtcaaatcagattctgcaagatgttatgaagatgaagtccgctgctgctctatggctgaaattagagcaattgtgtatgattaaaagtcttaccaacaaattgcatttgaaacatctctattctcatcgtatgtctgaaggtctctctttgtctaaccacttaccagttttcaaggaaattgttgctgatttggagactatggaagtcaaatatgacgaagaggatttggggcttattttgttgtgtttattgcctcaatcttataccacttttagggatacaatattatacagtcgtgatacactgactctggaagaggaatatgaggcattgttctctaaggagaagatgaaacatcttcttggtgactcggagactcaaccagagggtcttgttgctagagggagaaaccaagagagaacttctgcgagaaatgagaataaatactgcaaatactgcaagagaaaggggcacgccataactgactgttataagctgcagaacaagaataaggcaactacagaaccaaagggaaagcaacaaacaaacttcggtcaagtcagtgttgctgaagatagttgtagtgatggagaacttcttacagtttctgatgatcattccaaatctagtcaggagtggattcttgattctggctggacgtttcataaggattggttttcaacatatgaaactatgtccaatggtactgctttgatgggaaataatgcttcttgtaaaattgcaggtcctggtatagtcaggattaagatgttcgatggcgttgttagaacacttggaaatgtgaagcatgttccagatttgaagagaaatctcatatcactaggtacccttgattctaaagggcacaagtatactggtgaaggtggagttttgaaggtgagcaaaggagctcttatattaattgttgagaaatacccaagtcctacatcggctgcctcactccttggaatgcagcttatatatctgttggacaacttcatttaa

SEQ ID NO: 38946 - DNA, 219 bp, Glycine max
  Peptide Sequence Number=SeqID_155724
atgaaaagatcaaacattgtccctcccattgttatagagcataagcctcaagattctctaagaaaaattcaaaagaagaagatttcaactgctttagaggaaaaattgatgcaaaaattggaagaaatggaaagtccgcttagcgtgccagacaagcccagtgtgcaatacatgcttaacgcgaaaaagacccacgaagaagtccaaagacgcgcttag

SEQ ID NO: 38947 - DNA, 306 bp, Glycine max
  Peptide Sequence Number=SeqID_155725
atgtctctctctactctccggcgctctcagtattctcactctttgccgccccctttagggttcccagaaagttggactggtgatgttagggcttcgcacatattgataaatcacgaaggctctagaaggaaggatctagaagcctacattatcaagagcacaaccagagaaaatgcgatttctcaactccaagctctccgcaatgacttcgttttaggcaaggccacttttgaggacattgcctttcgcttctccaattgcagctccaccaagcacggtggtgatctcggtcagtcgaaaaattaa

SEQ ID NO: 38948 - DNA, 489 bp, Glycine max
  Peptide Sequence Number=SeqID_155726
atggcgggaacgggaagaggaagcgattcgcagaaacaactgttgagcctcatccgcgatttcgcggcggagaaatctcaaggagaacgaagagtggtgaatctgagaaagcaaatcgagaagcttacatcggagctgagcgaggccaatgcggagctcgaaaatgcgaagcgctacaaagaactagtcgaacaggatcttagaggcttcgaagttcaattgatgttgactgaatcttccgttcaaacgctagcggcgagagtatctctaattcaaggccacatctctgccgtcgaatctgatttcgaaactctcaggggagcaattcttccacaacattcttcatatgaatggcaagataaggtgattagtttttgctttgattcggttccttctcatagtgcattcactttgcttgaacaacaagaagcagattgtattttctgctactcaattgagtggcctcctaccattagtctcatttattaa

SEQ ID NO: 38949 - DNA, 1164 bp, Glycine max
  Peptide Sequence Number=SeqID_155727
atgtcagcagaccaagaatgttcatcagaagcgcgcgggcttactcttccctcttccaatttctgcaagaccctgggaagatctatcactagatttcataggggtctacctccaagtcgcggccattcaatagtgctggtcatcgtcgaccgtttttcaaaaggggtccacctcgggtctctccctgcacagcacacagccttcgaagttgcccaattgttcatggaaatctgcggcaagattcacggcccacctcgcagccatgtctccgacagagacccactgttccttagccgcttctggcgagaattgttcaagctcagcggcacgacactcaagatgagcacggcgtatcatcctcaaacggacggccagacagaagttatgaaccgcgtcattgagcagtacctacgggcgttcgttcaccggaaaccgacaacctggcggcgctttttgatgtgggccgaatggtcctacaacacctcctcacactcagccaccggaatgtccccttacgagatcacctttgggaagaagccacctcactttccccaatacttagcaggtgtctcaaacgtggaggcagtggacacgtggatatccactcgcgacgccatgattgaattcttgaccaaaaaattgactaaagctcagctccgaatgaaggagatcgccgataagcaaagaagggatgtgcaattcgatgaaggagacttagtacttgtcaagcttcgtccacgtcgtcagtcaacggcttcagaaggccaatattcaaagttagcaaagaaaatttatggcccctttcgtgtacttcaacgtattggacccgtggcttataaactcgaactacctccagaatcacgaatccatcctgtttaccattgttccctactcagaccctatcatccttcacaagtcacccagaccaggcccactcccttacccaaggacgctgaggacaatcagcccattatctcccctcttgcgatactagacactaaatggaacggctccgacgatgacaaacagctccttgttttggtccagtgggcaggcctcttaccggaagacaccacttgggaaccatggacacttttgcagaccacttacaaccttgaggacaaggttgttttgcatgcgcaggggaatgatacagctgagaat

SEQ ID NO: 38950 - DNA, 399 bp, Glycine max
  Peptide Sequence Number=SeqID_155728
atgtacgcgtcggttcagcaaaggggacttggtgttgaagaaagtttcccaagctctgaaagacaacagagggaagtgagccctgaactacgaatggtctttcgttgtaaaaagggctttctctggagggaccctggtgctcaccgacatggatggcaaggagctaccttcacccgtgaactccgacgttgtcaagcggtactacgcttaggatctggggcaattgaggaagtcactacatggattcctgtcctctttaatttctcatcgcagtcttttaaaagaaaagaacatgggattgaggttccggtcctcactttgtgtttcaagctatgtccagaatttgataaacctaagcctttttactcagtccatgggatgccccaagcgcttaactaa

SEQ ID NO: 38951 - DNA, 204 bp, Glycine max
  Peptide Sequence Number=SeqID_155729
atggatgagattgttttaaaagatattctggcaggggcacttttgcacgtaaagtgcatgcatggcccaagcaaaccgccagtgagattggcgagttcgttgtcggtgaaggaatcgtcactgggaatgacgatatccacatgcaaggggaactgccagtttgactggcgagttccactaggattcaacttttcagctttgtaa

SEQ ID NO: 38952 - DNA, 411 bp, Glycine max
  Peptide Sequence Number=SeqID_155730
atgtctgtatcaggaggcagaggaagccaggaggaggagaagaagccttctgatcaaggagcacatattaatctcaaagtcaagggccagaattattacattttcgtgttgagcccatggtttcctctctgctctgttctgagcaacagggttaaggatggcaatgaggttttctttaggattaaaagaagcactcagctcaagaaactgatgaacgcatactgtgatcgtcaatctgtagattttaactcaattgctttcttgtttgatggaaggagactccgagcagaacagacccctgatgagctagagatggaggatggtgatgagatagatgcaatgctgcaccaaaccggaggtggacataagtttcttcaaatgtatgatgatcatcttcatcaaaatgcttga

SEQ ID NO: 38953 - DNA, 237 bp, Glycine max
  Peptide Sequence Number=SeqID_155731
atgggtttgcgtggttggtggctatgcgttggtgaaaaacatattagcaacaacaatggatttttcaaagtggttattacggtggagggtgtcatcacaagagtagtcataatagccatagaagatgaaatgaggaggccaccaatgaggaggactgattctttggtggtggttggtagttggagaaagggacggtgggttacggctagaaagggaagggaaagtatgtatttttaa

SEQ ID NO: 38954 - DNA, 429 bp, Glycine max
  Peptide Sequence Number=SeqID_155732
atggaagaattagctttgtacgggaaccaagttcaagctgagacaacctcgacaaagaaggaggtggacaagccaatcttttacaacgcaaaggaggaagggggaagggatcaactgcctagagaacctcgatatgcacactatacccccctcaatgtgagtagatctcacatcctagatcaagccttggccatcgaaaccttggtaatgtcgaagagagctaatactccacctaaggattttgttcacatgcaagatcaagataaaggaagagaacgagatcaagaccataaccatcattcactaaccaaaaggtccaaagaaaaagaagagaagcccctcaaccatcctaggcatatcatcaacacaattgcaaggggatttgttagagaatgtgcaacaatattggcttgcaagagacatctctaa

SEQ ID NO: 38955 - DNA, 243 bp, Glycine max
  Peptide Sequence Number=SeqID_155733
atgaactggagggactgtcggagtccacacggggtcattgtcaacaaaccagatgaatatcaggcgatcattgtcgacagccaaagcaacaacaagtccaacgtgctcgaagccttcatcgattacgacttctcccacatggcaacgacatctgcattacgagttaaggacatgctggaggttaatggtggtggctatggatatgcagaagaagaagaggaagaacaagagagacaaggataa

SEQ ID NO: 38956 - DNA, 426 bp, Glycine max
  Peptide Sequence Number=SeqID_155734
atggctccgaagaagctcgctacaaagagttctaggatggacaccaccaaagaaggctccagcgccgcccaagagtttgacgcacaccggttccggagcgtcgagcatcaacaacacttcgaggccatcaagggatggcattgggcacctctcgcgacctccatggccaagtttgacccagacatagtcctggaattttatgccaacacttggcccaccgaggagggagtccgggacatgcggtcgtgggtgagatttcagtggattccctttgacgcagatgctctcaaccagtttttgggccacccgctgatgttggaagagggtcagcagtgcgagaaggcggatgcggatcatgtgcaccagcatgaccactctgatccaaatatggatgacgttgctgctcagaaacatcctacccaatga

SEQ ID NO: 38957 - DNA, 156 bp, Glycine max
  Peptide Sequence Number=SeqID_155735
atgtctaatctctggaaagaggccataaatgaaatagtttatatggacctcaggttgaatggtgggacgacaaagggattgttgaataaatgggagactattggggttagggaggacaaaggagatgaaaaggtgagcataaagaaggtggagtga

SEQ ID NO: 38958 - DNA, 1683 bp, Glycine max
  Peptide Sequence Number=SeqID_155736
atgaagtttgaattggatgctcttgaaaagaatgggacatggataataatggatctaccagaggatgtaaggccaattggcaacaagtgggtttacaaagtgaaatacagagtagatggatctatagaaagatataaagctaggttggtggccaagggttacaatcaagtggaaggtctagacttctttgatacattttcaccagtggctaaactcaccacagtcaggaccctgctggctctagcttctatttacagttggcatttacatcaactggatgtaaacaatgccttcttacatggagacttacatgaggatgtctacatggttgttccacaaggtgtcaaatgttccaaacccaatcaagtttgcaaactgctcaagtctttgtatggcctcaaacaatatcatggtaggttgcggcaattggcgactccactgggacttttcattctagtaaacatgggatcaaatcaaacacctcggctcaagaaaaggttctatcaagtcaaaatcaagagcttagaggatgctagtttactaaagttagggcaattgatgggtcaacttcaacgacaagccttccgcaaagcctatggtgccctctgggaggaaggaagccatatctcttctcggggttctaccccctccatggctagagttgccaaggtagtgaaaatctcggcacaagagttggatcgggtaaagcaaaaccggaatggggtagtcggagtaccaatgaggtgtttggaggagaaggcaaaggccttggcaaatcaaggcgaatgggcttcttttattgacatcttggtgcttttgatcttcggagttgtcctctttccaaatgtgaaagggttagtggacctagcagcgattgacattttcctcgcctttcatcatggcaaagaaagcccagtcgtcgccattttggcaaacatgtatgacacgcccatatgtctgctacaaggtcactacttgtgcatcgagaaaggaaaggcaaattgggaccaactcttggctagcatggagggggcatccattaattggttccctcgttggaaggaaggaaaaatcgggaatctatgctcgtgtgaaggatttccaaatgttcccttgatgggaacaaggggttgtattaattataatctcgtcctcgccatcagacagcttggctaccccatgagaggagcgccatcggaggaaagcatcgcgcctttcatcgcacggggtttcagtgaccctaatgcaggggtacttcaaggagttcacaaggcatgggatgtggtgcaaaggaaggacaaagagcttaggggaagtagtaatgggatcatcagcgactatcttaagccgaagctccagaagagagtgaggaggtacctaaaggcagagcttgaaagagcccgggcagtcaaaaagaagttcaagtcaacggccatcaaagtccaaagagagtacgatgaactaagggacgtcaatatggccaccatcgaagccttggaacaagaaaccaagaggatgagtacaccaagatatcagcggaaagggaagcatgggaaagcattcacctttactttgaatggaagtcaagagctttcccaacttctagctaaggccaaagcaatggcggacgtgtacagacccctgaagaaattcacaggctcctcaactattgccaacacatga

SEQ ID NO: 38959 - DNA, 321 bp, Glycine max
  Peptide Sequence Number=SeqID_155737
atgcctcataaaatgtatgtatgttgcattaggtggcaaaaataccttatcaatttaggagatggccccgagaaagcttccatcaaagacgtccaagaaggacacctccagagaaggctccagcgttgccccacagagacaactaatggtcatccgcacctttgtcatctagagacgacaagtccgatgacacgcagagacaaatatggtcatctgttcttttcgtcgaagactcaatgtctatcaaccgagactactttagtctcaccttgtcatccaaagacaatcgagtccgatgacacgtggagacaactcatatga

SEQ ID NO: 38960 - DNA, 636 bp, Glycine max
  Peptide Sequence Number=SeqID_155738
atgactacaccactaagctctactcctcctcttgagttaacacctttgcgttctacgtcgaagaagactagaaaagcaacacggctcaaatcattggctatcagacccatcgagatggagagaccagtggttcatccaaatcctaccattgggaaagctgatggtccccacagaaagaaattaaggacgcattttgggatcgttgctcgagacaagcaccctggtcgtgtctgtgctgctggagctggtgtgacaatcaggcaatactttggaatagcttcagcatgttcccgcacatctacgttgatcagtccaaagaagctgcatcaaataacaaaaaatattaaggagcaattgacacaaaatatcagggacgagctggagcaatcgatcactgaaaaaggagtcgtaccgcctcttgagcttgaggttggtccttctgctgcacgtgtcaacacaaagggaagtcatgtcaacccctcaagagtttatgagggggtcgacaactatccacaacgtccctttgggcatatgcctattgagaaagttcataaactcttccaagggaaaccagggaacgcctctatgtatggactccttgagccacagtccatacagagatttgggcaatcgtag

SEQ ID NO: 38961 - DNA, 375 bp, Glycine max
  Peptide Sequence Number=SeqID_155739
atgcggcatcatcggagactcagatgtgaagaggagagtgcgccatttcgagagtcagagtggactaatttctatgcagagtctgtctctggcgagtgcgatttcgaaggcgcaaataagctccttcagggtgtcggcttcttcgaggagcttgagctccgccttgattacccagtcattgatttgaatggggatgcattgcattctcggaatcgcaatgcactaaaatgggaagaaaatttaggaattaaaaatgattgcagggggcggactttcctgtttttggtaggcttattccatttcatggcatgggtggttaactttggcaacgttcaggatgttttgggtaacataacagcatctgggttcaattaa

SEQ ID NO: 38962 - DNA, 1074 bp, Glycine max
  Peptide Sequence Number=SeqID_155740
atggaaggtcgccggaggataacgctacatgaacaaatgtcagcttccgataacagccgagcccgagagctagccggcttgacccttgacgacgtgttagggaaccagaagaagttttcatcaacgccacccagccaacaacttcccaagagccgaaccctacttgacatcatcaaagaagacgagagcaacaagaaggaccgcagatcttggaaagccttcaaggacaagcttcggctgaagcgcgcaggctcagcttggacatcgtcaattcatatcccgacctcggatgtccctatccctaacccgaatagccgaaccttcacccagtttggtcgccgcaactcggtccgatccccgactcagactcagactcactccgactcggacatgtcaactccctacaatgctcaccaagtcgaagacctcgaccccgccgacgacgactccggttctccgaccaccgggcctcccgccgtccgcccccaattcagccgccacggctccacccgctttgccggcgacgcctccggcgacaacaccgccggcacgctccggccgcagctctcgcggcggaactccaccaacatttcgtcggagccctacaagcggggccgcgtggtgacgttccgggacagctttgacgacgaagaggccgacggcgaggacggcaagaagcccggggaggggagggcgctgtcggcgagggaggcggtggcagcgcaggaggcggcggaggcggcggcgcaggaagcggaggcggcggagcaggcgccggtgacgatgtccctgatggacttgctggaggaaactgacagggagatggggctcgaaggatcgaggtatatattgagtgatgatgaggactttgatgaggatgaagacgaagatgatgatggcggagagggttctatggagcacacttgctgtgtttgcatggtgaagcataaggctgctgcttttataccttgtggccacactttctgcaggatgtgctcaagggagcttatggttagtaggggaaattgccctctctgcaacaatttcattttggagattcttgacattttctga

SEQ ID NO: 38963 - DNA, 159 bp, Glycine max
  Peptide Sequence Number=SeqID_155741
atgcctcccttagacagagaggacagagatgacgtcgaaggggtagccaacgatgtacatgataacttcaaagcggccaacgcaccgtgggggttgagaagtggcctccgagggtggaagaaaggtggtgtggagctagaagagaagaggagatggtga

SEQ ID NO: 38964 - DNA, 849 bp, Glycine max
  Peptide Sequence Number=SeqID_155742
atggcaaggaaactgacgaaagcgcagaagaagatagcatacgatgcgaagctgtgcaagcttctggacaattacacccaaattcttgtggtggctgcggacaacgtcggatccaaccagcttcagaacattcgacacggtctacgtggcgactcggtgattctcatgggaaagaacaccatgatgaagcgcagtattaagatccacgcccagaacaccggcgacaccaccatcctcaaccttattccccttctagtcggtaacgtggggttgattttcaccaaaggtgacgtcaaggaggttaaggaagtggtttccaagtacaaggtggcagctcctgctcgtgtaggtttagttgcacctattgatgttattgttcccccaggcaacacagggctggatccctctcagacctctttctttcaggtgcttaacatccctaccaagattaataagggtactgtggaaattgtcacccctgtagaactcattatgaagggagacaaggttggctcttccgaagccgtattgctttccaagcttgcgataaggcctttctcatatgggcttgctgttgtttctgtttatgacaatggttcagtttttagccccgaggttcttgatctcactgaagatgacctcgttgtcaagtttgcagagggtgtctgtatggtgtcttcactttcattggctatctcgtacccatccattgcagctgctccacacatgtttgtcaattcctataagaacatcctggctgttgcagtggcaacagaatattcgttccccgaggcagacaaggttaaggagtacttgaaggtattgtctctaatgggcattgaacattga

SEQ ID NO: 38965 - DNA, 369 bp, Glycine max
  Peptide Sequence Number=SeqID_155743
atggggtacgaagtgggagctcccgctcgtgtaggtttggttgcagctattgatgttgttgttcccccaggcaacacagggctggattcctcgcagacctctttctttcaggtgtttaacatccctaccaagattaataagggtactgtgcaaatcatcacccatgcagaacttattaagaagggagacaaggttggctcctctgaagctgcattgcttttcaagcttgggataaggcccttctgttatggccttgttgttgtttctgtttatgacaatggttcagtttttatccccaagaacgtccaagctgttgcagtgcaacagcatattcattcccccaggcagacaaagttaaggagtacttga

SEQ ID NO: 38966 - DNA, 225 bp, Glycine max
  Peptide Sequence Number=SeqID_155744
atgcgtaccagtgtggatttgcttgatcctgatggctgccaactttacggaaacactgtagatgagagatcaaccgcaaaagttcgaatgcaactttctttgactgacaaattaggagtagcagttcaccaaatccttttccaaacaaccggttttgtcaaaggttgttttctccctaatagtacatcgatgcctatggatccaaaggctcatgtacaaagttaa

SEQ ID NO: 38967 - DNA, 313 bp, Glycine max
  Peptide Sequence Number=SeqID_155745
ctcttgcggatttataattgagaaagaagagcttaaaggggcagcaaataagggaaggttccttgtaactccttccaaattaaagcagcgtgcttatctcgtttttcttctgaaacgagggaaaaaagataaaaacagcagaatagagccaccttatggggcagttcttgcggctttaccactcactcagggtgttaaatgcacgaggtcattggcagaggctagtagcaatttgaatgcatgtagattgcggaaacccagtgagcaagaaacagttactgtgctgtgctgcttagtatatttcaaatattaa

SEQ ID NO: 38968 - DNA, 717 bp, Glycine max
  Peptide Sequence Number=SeqID_155746
atgagaatctcagcttgtacactgttgtggtctcttctaaagcaggagaaagttgctcaggttctgttgactctgccttactcattctctcagctgggaatggtttcaggcatcatattccaagtgttctatggcttgcttgggagttatactgcttatttaattagcattctgtacattgagtacagaagccggaaagagaaagagaatgtcagcttcaaaaaccatgtcatccagtggtttgaagtgttggaaggcttactgggtccatactggaaagctattgggttggccttcaactgcacttttctcctctttggatctgtcatccagctcatagcttgtgcaagtaatatatactacataaatgaccacttggacaagaggacttggacctacatatttggagcttgctgtgccaccacagtgttcatcccatcattccacaactacaggatatggtccttccttggtcttggcatgaccacctacactgcttggtatttgaccattgcagccattgctcatggccaggttgaaaatgtgaagcattcggccccaaacaagatggttttgtatttcacaggcgccaccaacatactctacactttcggcgggcacgccgtcacagtgacaggcatcaaagataattggagaatttcactgcacggtccctttcctttcttcaattgcagctttatcctgcattcattctaa

SEQ ID NO: 38969 - DNA, 507 bp, Glycine max
  Peptide Sequence Number=SeqID_155747
gatatacggagaaccattcctggcaatttacggcctttgatgacaaacattccagcatcttctttgtatagcgtgaggtctggatctcatcatggccgaacaattagtgtttcaggctctcctcatgccacaagcagtaatgctagttccgaactgagtgtaaaccaaaatggcatttgtttagatagcagtgaggtagatgatgatattggcagtgagagatgtggtcaatcccctgccagtgtacggggcagccatagcggatttgcttatggagctaaccatgcttgtactaatgtaaagcttcttggaagtgaatcaagtgatgtaacctcattggcgtggattttttatagcaaagcgccaaagcgtgtgtttactgtttggtgtttgctaaccaattgctgcaacaatttccggaaactagccagaacaattgctgcattcaaactagcgagtaatggacccaccagcattggtgcctgttactgctggcataggctttaa

SEQ ID NO: 38970 - DNA, 885 bp, Glycine max
  Peptide Sequence Number=SeqID_155748
atgccccgcaaactcctcctgtgcctggccgctgcggccgcgctcagtgcctgcaaaggcgaagacacgccggcgcccgcgccggccaccgacaccgccgctgccaagccggcggcccatgcgttctcccccgagatcaacgccggcgacttcgccgagatggtcaagacgctggcttcggatgaattcgaaggccgcgccccgggcagcaagggcgaggaactgacggtcaactacatccgcgaccagatgcagcgcatcggcctgcagcccggcaacggtgacagctggttccaggatgtgccgatgaccgagaccacggccgacgcgtcgaccgtgctgaagatcacccagggcggcaagaccaccgagctgaagttcggcaccgacatggtggtgggtacccgtaccggccaggccgaggtgaaggtcgatgccagcgacctggtgttcgtcggctacggcgtcgatgcgccggagcagaagtggaatgactatgccggccaggattggaagggtaagacggtcgtgatgttcgtcaacgacccgggcttccatgtcgatgacgcgaagctgttcgacggcaagcgcatgacctactacggccgctggacctacaagttcgaggaggcagcgcgcaagggcgccgctgccgcgctgatcgtgcacgacactgccggtgcctcctatggctgggacgtggtgaagaactcctgggccgggccgcagtacgacctgccggcgaaggatgacccggatgcccgcattccggtgcagggctggctgagcgccgacgccgccaggcgctgtttgccggtgccggcctggacctggcgcaggcttacaaggatgcgagcaagcgcggcttcaagccggtgccgctga

SEQ ID NO: 38971 - DNA, 621 bp, Glycine max
  Peptide Sequence Number=SeqID_155749
atgtcgttttgttcgagctgcgagcgttttgaaacaacggttattggttctgtgtgtgaggtgaacgagaaacaaactcggttaggtttttcggttggggtttttgagggatttagggttcgtgtggtttggattttggggatgaatcggagtttcagggctcaggaatcgcaaatgcacgctgcgttgaagcagagggagcagcaatttgggggtttgaggacttcggtgatgaaggagaaggaggaagagctcgcattgtttctggagatgaagaagcgcgagaaggagcgcaatgatcttcttcttaacagctccgaggagttcgatgcagctcttgtgtctaatgggggtgctaatcccatttttaatatttcgtcttctacgccggctcctgtgcggaagactggtgttgatgattttctcaattcggagaatgataagaatgactatgactggcttctaactcctcctggtactcccctttttccttctttggaaatggaaagtcgaaagactgttatgagtcggcttggtactccaaccacacgtcctgtagcattaaaatccaggaaaacttcttttgttggaaatatcattattgttatgcagtttgcatga

SEQ ID NO: 38972 - DNA, 195 bp, Glycine max
  Peptide Sequence Number=SeqID_155750
atggcgagtagcagcagcaacactccgaaggaaagcgtggttgacgatcggggaaggcgtcgaacctcttgtggctattgcagatcctctcgtgacaatagcatctctcatggcatgtgggcacatagccttacagtggatgactaccaaggtcagtgcaatttgttctttgcttatgcttcacattctgcttag

SEQ ID NO: 38973 - DNA, 525 bp, Glycine max
  Peptide Sequence Number=SeqID_155751
atgaacccaaggaacgttggtcccttgtgttcagtgttcaaccaagaagaccttctcttgaaaacagtcaccaggagtaggtctcttgaaaagctttttataagaatggaggaagaggaagaaaatagaatagcacaaggtaagtttgagtacatgagttactacttactactatccattatgatgcaatcctaccctgcaagggcattggatagaaaacttcaagtagattgggccagagatgcaagagaaggccctagggttcttatgagccttagggtagatttcggctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 38974 - DNA, 1154 bp, Glycine max
  misc_feature (64)..(64): n is a, c, g, or t
  Peptide Sequence Number=SeqID_155752
cgcggcaatttcgtggcgcttggcccggcactgtcgcgccgcccgctgcccatcgtcatcgggncggtggaaacctcggcgcgctcttcttcaccgaagctgatgccgctgccggatgcgccgcaggacgtcgaagacctgatctttacgccggacccggaagaattcacgcgtcccgcagttcgtcgcacaccgccggctccgcgtccaacaacggatattctggctgaattgtcccggtctactcccgcgaccgtcggtccagcgccggagcagtcgccacgtgcgggccagccggaaataacgccggaagagcgcgacgaaaagatttcagcggttctcgtcgaaattctcgatgaccctcaatccgcctatcgtaccgacgccgtgctttatcaggatttcctggtgcgcgcccgcatgcgccgcattcccggcacgccgatgacgctggcggagttccgccggcaggtggcgattgcccgttcaggcgttgatgccgcaatggcggcaagcgaaggctgggagaaggcgctggaattgtcgatgtcggtttccgatgacctgcagggcgtttttctgctgctcgtcaaggcagcgctcggcgaggaaccttgcccgtccgatgcccgaattgcccgcgcctacggcacccattccgcccgccgcgcgcggcgtctccttagttatttcgaggagaaggagcttgtggtggtgcatgccgatttctccggcaagcgtatcgtggcatttcccgatctcgacgcaaaaaccgcgcccggcgatgcggatgcggctgaggatgatgcaaggctggcggcggagtcatgcgatgcgaccgttgacagggacgagcgtcgacatcagtttgtattggaacgatgtgggagagttgcgccgcagtccacccgctgcgttcgaattccggcgaagcgacaaattccgcaagatgccgttgccgtctcatggaagagggcaaccgcgccagaaagcgttgcggaagatatcgatcgcttcccggaagcgctcgtcccttgcgcccgagcagaacaacatacgccccgcttcgatgagatcgttcatctcaagcagcacttcaccatatttttgaaagagcgccagatcgacttcgggatggctgagccttccttgaa

SEQ ID NO: 38975 - DNA, 567 bp, Glycine max
  Peptide Sequence Number=SeqID_155753
atgagggaggcacaagaaataccccaccataatctagccaacttcgagccttgcctcggatacgccactgaggggcaagcagttggtgttgtacccctaccaaacactttggagggccctcagttttgcccacaaccacaacccttgcattttgctgcagggaaagtccctcctgctatggcgaaaaaagggaaattggatcatatagaggagaggctcagggccgttgaaggaggcggagattatatctttgctgacatggaagatttgtgcctagtacctgacgtggtcattcctctaaagttcaaggtaacggacatcgataaatacaaggggaaaacttgccccaagaatcacctgaaggtgtactacaggaaaatgggagcatatgaaaaggatgaaaaattattgatgcatttcttccaagaaagtcttactggggcagccgtcacctggtacactaatttggaaccttcccaagtccattcttggaaggacctaatggttgccttcattaggcagtatcagtacaattctgatatggctccaaatagaatgcagctatag

SEQ ID NO: 38976 - DNA, 288 bp, Glycine max
  Peptide Sequence Number=SeqID_155754
atggtcattccccagttcaaggtgccggactttgacaagtacaaggggactacttgccccaagaaccatctaaagatgtattgtcggaagatgggggcatacgtaaaagatgagaaactgctgatacatttcatccaagaaagtcttactagggcagctgtcacttggtatactaacttggaaccttcccaagtccattcctggaaggacctaatagttgccttcgttagacaatatcggtacaattctaatatggctccggataggatgcaactacaaagcgtatga

SEQ ID NO: 38977 - DNA, 231 bp, Glycine max
  Peptide Sequence Number=SeqID_155755
atgggggagacacatgaaattccccaccataatctagccgagttcgagctttgtctcggatatgccactaaagggcaagcagttggtgatatacccctgcaaaacactttggagggctctcaatatcacccacaaccacacctcttgcattccacagcgggtaaaatccctcttattatgaaagaaatgggagaagttggatcatctagaggaaaagctcagggtcgttga

SEQ ID NO: 38978 - DNA, 204 bp, Glycine max
  Peptide Sequence Number=SeqID_155756
atggacaatcaaatggatgttgacactagaagacatggggctgaaaatcccaccaattctgcaccaatagcaagaggtggtggtggagcacaacataatgaacggccaacagctacaacacctcaccctaacaatcatcctaaaaacaatgtaaagaagaggatgactaatgcaaatggtcctcgtaaaatttccattttatag

SEQ ID NO: 38979 - DNA, 971 bp, Glycine max
  Peptide Sequence Number=SeqID_155757
aaaattcacaagggctatggaatggagttcctcaaaatgaagatctttccaatgtgttcaatgatgaaacaaccccagtgaaagcttgtggggactttgcatacaatgtcaataatagtgggatatatctgtgtacatctatctaccctccccaggttccactaggttggagcctcatgcattgggtcaccgttaatttctattattattgttattcctgcatccttcttttatatgcaatgctatccttaattcaaataaggtggatttcagagttacaaaaggaatcagacaaatgtttgaagagttctgaccaaattaagagaaggcggatgctacaattcaatactcaagatgggggtcatttcctctccaatgaacatatgtcttcagcatatttgaaagggaaggaggagtcaaatgaggatgttttccctgaattatcacattgggtttctggggcatcaggaagtgcatctgcttccaattatgaggaccttgagtcagctgaagggtggctagcagattgctttaaggatgctgaaatgcaattatgtcccgatgatttgaatttttctggggcagatgctgttcaaattgatgttgcagatctgtgcaacttcccacctgcgtgtgaacaaaatgtgcttcagcatcatgtcacccaaactcccaaaaatattgtcttcaaaggaggaaaatcatttatagaaacaccgacaaagctagctgcttctgtggcctatccatttaccttcattaaaccctgtggtgcccatggagatgtcactctgaaggaaataaatcagcgcattctgtctccaccacctcctttgaagtcccaacaaagtatggaagatccatcagcttacccaaaatcagcattttctgggaagcctgtagttggaaaaacaaaaattcacattgaagggggaaaaggtagcatcaccattatgagaaccaaaggctaa

SEQ ID NO: 38980 - DNA, 225 bp, Glycine max
  Peptide Sequence Number=SeqID_155758
atgggtgaagtagaggaggtacaagagaagatgaaggccgacatggaggccatgaaagagcaaatggccacgatgatggaggccatgatgatcatgaagaagataatggaagccagtgcggttgcagttgccgctaccagcactgttgctaaggtggttcttggcataaaatggatgaatgggatggtaaaacgtaggttaagtggtggctggacagaaatatag

SEQ ID NO: 38981 - DNA, 453 bp, Glycine max
  Peptide Sequence Number=SeqID_155759
atggcatccttcagccagatgcagtcccagtttcagtctcagatgcaatcacagggacttgcactacctccggagccaaaggttggtccctcaggtgctcgtgtcaacacaaaggagagttgtgttaacccctcaaggaacgatccagagacgggtgactcgaacaaatgtgggttgtacattgaagaaaattcttcccgcttggttgcccaaggaatactttatgagggatccacagcggttcacaacatccctttgttgcatggccaagtgaaggttggtgttaaagaggttaaagatgcagaggctctcgttcttgtacccactaacgaggcagctgtgtctccagcaaaacctccaaaaagcccggatcatgaggttgatgatcccctatatctaatgacattgaccatcccacaactgtttttgaagcctctccaggcatctgactga

SEQ ID NO: 38982 - DNA, 396 bp, Glycine max
  Peptide Sequence Number=SeqID_155760
atgaccttggctgccttggccaatctacgacaagcagacgatgaatccctcagaaagttcattggcaaatttgggcgcacagtcgtccagatccgaaatctcaaccctgagataaagttgcattccatgcttctcgcactacaccctagcaagttcgtagatagtttgtgcaaaaaactacctggtagcatggatgagccgcacgaacgagccaagggttacatccagatagaagaaatgtccaaattctggaatgaagtctaccaagtcaaacaaaagtgtgaaaggtgcaaagcaaacaccaagacctacttgcacaagtcagacaagaggcacaagctagacaagtgccaacctctctccaaaaggcccggtatgagcgttagatacccttga

SEQ ID NO: 38983 - DNA, 249 bp, Glycine max
  Peptide Sequence Number=SeqID_155761
atgagacctactggtggcgtactgcacactgaatcgttcgatgagggtgtcgaagctatctatggatcttggaaggcgtccaaatgctcgtctggatctgttgtctcatcataccgctcgaggttaagtgatttccaccccaagggtatgtctacctccataacgcggtcgataaaaggatgtcaatggacagtctgtgttgttggacgatgcatgagagagactcagatcgtctgcagtgttgcttga

SEQ ID NO: 38984 - DNA, 693 bp, Glycine max
  Peptide Sequence Number=SeqID_155762
atgctacataaagcaaaaggtaacggccaagactttattagtgaaattgcaacaattggaagaatacatcatcaaaatgtagtacaaccaattggatattgtgctgaaggctcaaaacgtgcccttgtttatgaattcatgcccaatggatctcttgacaaatttatttttaccaaagatggaagtacacatttaacatatgacgaaatatttaatatagcaattggagtagctcgtgggattgcttatctccatcatgggtgcgagatgcaaattttgcattttgatatcaaaccccataacatccttcttgatgaaacattcaccccaaaggtctctgactttggattggcaaaactatatccaatagataatagcattgtgactatgacagcggcaagagggacaattgggtatatggctccagaattattttataaaaatattggaggaatatcccacaaggttgatgtttatagctttgggatgcttttgatagagatgacaatggaaatgcttgaaggagacattgaaagtctgaaaatacctccaaagccttctctatatccacatgagacaatggaaaatgatcaaagcatctactctagtcaaacaatgtcaacagacttcattatttcttctagttattccaaggaaattgtgactaatcctttggtagaggatgctatttga

SEQ ID NO: 38985 - DNA, 1220 bp, Glycine max
  Peptide Sequence Number=SeqID_155763
tggtattatccgcggcgctttacacagtctgaacggaactatgcaggggttgttgcctgcacggccgcgtagttgcgcggcttgccatgacaggggaagaaaggaaatgatgaataaaaaagccacgctggcactgctggttgcagcggtattaatcaccggctgtgcatcgcgcacggcaccgatccagaacgtcagccagacggtcgcacagagctacagcgatcagcagatgcagcgggctatcgtggaagctggcgcggccaatcactgggtgatctcaccggcgggtccgggcgtgatgaatggtctgctggcagaacgcggccacacggcgaatatccgtattacctatactgctaacagctaccgcattgattacgtcagcagcaccaatctgaaagcaggcagtggccagattcaccgtaactacaaccgctggattcagaacctgaaccagggcatccagacccaactcggcgacatccgcgtgaggcggatgactggaatagagagcagggaagggatgccgcgcagcgaaaatctgaccatccctgaggctgaagaaagaatgcagcgctgggcgcaacacgcgccggtactggatgcctgcctggctatcgccaaacctcagtttttaccgatgatgacggcccgtcgtctcagccccggcagccgcgctgccgttgagtgcggccttgcgctgctggcccgacagtcggttgacgccgtggtgtttaccagccgccatggcgaactggaacgcaatctgcgtattctgcgtacgcttgcggacggccagccgctatcccccaccgacttcgcgatgtcggtgcacaactcggcggtcggcagcctgaccatcgccgcacgtcagccattagtgtcatcgtcaatttctgccggcatcgacagcttccagcagggcctgcttgaggtcagcacgctgcatcaggccggttaccggcaggtgctgctggtggattttgacgggctggtgcccgactactaccgtccgtggctgccggagatcgatacctttaatgcaccctacgcggttgcgctgctgctgcgcgccggcgaagcgtggcgctgtacggcgaccgccgcccgcgctcagcccgatgcgctgccgcagagcctgcagtttctgcatgctatgctgagcgaaacggcggatttcaccctggccggcgagcgtcatcagtggcgctgggagc

SEQ ID NO: 38986 - DNA, 288 bp, Glycine max
  Peptide Sequence Number=SeqID_155764
atgggccaaccggcaccgttcccgcagggaccgtttgtgctggcggcggcgctgcgctgtccggtgctgctgatgttcgcgctgcgccagcagggcaaactgcgcgtgcactgcgaggcgtttgccgatcctttaccgctgccgcgcaatgggcgacagcaggcgctgcaggcggcagtcgatcgctacgctgcgcgcctgcagcatcatgccctgctggcaccgctggactggtttaacttttacgatttctgggctctgcccgaagaggagcaacgcgatgcgtga

SEQ ID NO: 38987 - DNA, 561 bp, Glycine max
  Peptide Sequence Number=SeqID_155765
atgggcgtggtgtggcacggcaactatttccgctacttcgaagtggcgcgtgaagcgctgctgcgcagtatcaactacagctatgcagagatgagtgccagcggctacgtctggccggtggtcgatacccgggttaaataccgcctgccgctgcgctgtgaagaggccattcgtgttgaagccagcatcagcgaatatgaaaaccggctgcgcatcgattatgtcatccgtaacgctgccgggcaggtgaccaccaaagcgcacacgctgcaggtggcggtcagcgccagcacgcaggagatcgtttgggggtgtcatcatgattcgtctggtctgcctgctgctgacgctgctcagcgccagcgccagcgcggtgacgctggaacagctacagcagcgctttgccagccagccggtgattcgcgccagctttgttcaggtgcgcagcatcgctggcatggcacagccgctggtgtcgcgcggccagctgttgattgctcagcagcaggggctgtggtggcaccaggcgacaccgttcccgatgacgctgattctggatga

SEQ ID NO: 38988 - DNA, 330 bp, Glycine max
  Peptide Sequence Number=SeqID_155766
gaaattcaccgtccagaaattccttctaatgtttatctcataactccttttactgatataatctctggcctcgcaccacgccatactttagtggatattgttggtgtcattgctgatctgatcgatgttaagacagttaatccccctgacaggatgacagtcaggctcagggataacagtaactgcgacattctaataactgtttgggaggactatgctattcagctacatgatgctattgacaaaaaccttctgcttcaggaaccattggttgttatgttgaccttaggtaaaatcaaggatgctacaggtgtgtctggtgttggttag

SEQ ID NO: 38989 - DNA, 557 bp, Glycine max
  Peptide Sequence Number=SeqID_155767
atggataggttcactctcactctgaatgggagtcaagagcttccaaggttgttagccagagcaaaggcaatggccgacactcattgtcatcatcaaaaagtaatcatagcaaccaaaaacaacgaacgtgctttacagcacccttaccgaacgcgcgctagagctagaatcatgagcgaggtagaggaagttcaggaacaaatgaaggacgacatggagtccatgaaggaccaaatggccgccatgatggaggccatgttgagtatgaagaaaataatggaaagcaatgcggctgcagtttccactactagcgccacagctgagatggatcctacccatccatctagcataaatcaaatgaatcatccagtcccgaacatggtaggacagggaggagaagcattgagaagtataggtggtccccatgttgtgcaaagtaagaattctttcccactatacggcttgcctcccaactacgcgccacccaatgttgtacatgtgtcggatgagaacaccgaccacttcgctcttgttctctttgaaagccagcaacccca

SEQ ID NO: 38990 - DNA, 361 bp, Glycine max
  Peptide Sequence Number=SeqID_155768
atggggcaggttgtttcagttatcattgccttaatgttatttatgtcgcctatattttatcctattactgctgttccagaacaatatcgtatgctgatttatattaatccgttaacgtttattgtcgaagctttacgtgatgtcgtcctgtacggaaaattattcagtcttgaaggctatgcactctattggggtatcagtattgtgctgtacgtattagctataacttggttcaaaaagcgcctgggagccttactggggtatcggggggctaagggtagggagtttgtcgctctggattccgttaatttcgagattagaaaagtgaaacagtcggtattattggtgtcaatggttcccg

SEQ ID NO: 38991 - DNA, 288 bp, Glycine max
  Peptide Sequence Number=SeqID_155769
atgcaagtgggatcagcaactttcattatcagagtaatcaagcacagcggtatctgtagtggcaacagcaaaattctgcaagttgcaagtcgtttccaggatgtcaagacatctcacgtgacatcagctttctgctccccctgtctccatgctcttactgctgtgaagcagttcactgcagcatcttctagtcttttccaggatgtcaagacatctcacgtgacatcagctttctgctccccctgtctccatgctctagctacagcatcttctatcagctactcgtag

SEQ ID NO: 38992 - DNA, 218 bp, Glycine max
  Peptide Sequence Number=SeqID_155770
ttcgtacacgagggtttgattggctctccaagttaaagattatcaacgaagagaacttcgaagctccggaagaggatgaagaaacgtccggaaagagtgtgtcgggttacgagaagaaaatgcagctaccgcaagagcccttgaacaagaaaccaagagggctcgcaaggaagagcatggccaggaaaaatttcgtggagctttgtggggcagcaaca

SEQ ID NO: 38993 - DNA, 150 bp, Glycine max
  Peptide Sequence Number=SeqID_155771
atgactctattttgcacacgacttcctatcgaatcaaaggtcaaacgtggggtgggatatcgccagtcgagaacgaccttgaatggcaatctgaaaggaagaaacaccaaaaatgggttttgctttgccggtagtcccttaccttgctga

SEQ ID NO: 38994 - DNA, 306 bp, Glycine max
  Peptide Sequence Number=SeqID_155772
gccattgcatatccaacagccttacaccttaaggagtcaatcaagttcaaattctaccctaataggatttatcaaaggtttccaatcattaactttcataaaaggaaaggtgtggaacccgaagaagtagatatggcaacgaaggccaaagtggagttccaacaatactttgagctttttaaagaaatgttttcacctcctgagcctaaaattctaccctcgaaggaaaacacttccatgattggtgtttcttcaccacaaggtgaacctccaaagactcctccacctcctcttgagatgtcaatg

SEQ ID NO: 38995 - DNA, 1509 bp, Glycine max
  Peptide Sequence Number=SeqID_155773
atggccaaagatgttgaagaggaactgaaggaagaagatgatgaaggagatcgttactatgggaagaatcgtatgggccgtagtgagcccaatgggctgctgtctaaatctcaaaatgggtctaacctgatccacaaagattttacccgctttaattcgggtgggtacgctccaagtcagaaaacgggttctaccgggtcaaatacaattcccacgtcctcaatgaattcaacaggacgaaaaggggaaaatgaccgtcgtacactgtcgtcggaacggtggaagggagttcgcggcgttcagagtgatgaaataactgaacgaagagccaaggggttgtgttttaagtgtggagggaagtaccatcccacgctccacaagtgtcctgaacgagcaatgcgtgttctgattttaggagaaggggaagagctgaacgaggaaggggaaattgtttctcttgaagccactgaaacggaaggagagggagaggagacagatgcggaatgcaatctgattggagtgatgggtagcatgggggagtataatacaatgaagatttgtggaaaaattgctagtattgatgtgatggttttaattgacagtggagctagccataatttcatctccccagaaatcactacagcattagggttatctgtgacccctatggcagctaagaacatcaagctaggtgatggtcataaggttctttcaaagggaatatgtgaaggagttcaaattgatttggggacccaagtttttcatgtggatgcgttggtgttagagctgggaggtttagacgtggtgctgggagtgtcttggttgagcactttggggaaagtggtgatggattggaaggatctatcaatgcagtttacgcacgagggaagaatggtaaacttacaagctcagggccgtatacaggaaaagcagagctgcttacactcttttttagaggataagcatagaaggggaggtgaaggttggtggtggactcagcaggaagagagggatattgctcaagcagttggacagatggaattgaccaaattactaagtcaattttctgaagtatttcaggaaaaaattactctacccccagaaagaagtcaggtgcatcagattaagttaattcctgagcatggaccggtcaatgtaaggccttacagatatcctcatcaccagaaaaaagaaattgaaaagcaggtgacggagttgctagctgcaggagttattaggaccagcatgagcacgttttcgagcccggttatcttagtcaaaaagaaggatgggtcctggaggatgtgtgtggactatagagccttaaacaaagccactgttccagataagtatcctattccaattgtggacgagttattggatgaattgtatggagcaactattttttctaaaatagatttaaaggctggatatcatcagattcgtgttcataaggatgatattcataaaactgcttttaggactcataatggacactatgagtacctt

SEQ ID NO: 38996 - DNA, 276 bp, Glycine max
  Peptide Sequence Number=SeqID_155774
atggcttcctatggtggtgagcttcttcttgactcaacttctcctggaagtgagcgtctcctctcaactcttcttcttctccattccgctgccattaaaattcaagaagcaaaggacaacattgatgaagaggacccaaggcctacaagctccaatggagctacatcatgtgggtattgcaaaggaggattggtgccatcccttaaagaatttgagtcaagaaacaaggggccaaccaccttaagagctattagactaagaagcactccaaattga

SEQ ID NO: 38997 - DNA, 423 bp, Glycine max
  Peptide Sequence Number=SeqID_155775
atgatatataacgttattaggattgcaaataagtcccactcagatgattttatcaaaagcatttggaatgaatgtgcactctccaaggtggttgctttattatgggaattagctcaagatcaaccaccaactcttgataatgtggaaagtatagatgttatactgaggaaaaaagttgtaactgatgttgacctcaaagcattagtatcatataaagcttttcatgcagaatctatctggaagcttggtgatttacaagtgacttgtggaactattggtctttctacagcaacagtaaaacttgttaatattgatggtagcacacatgttgcttgttctattggtataggagcagtggattcaacttacaaggccattaatctcattgtgaagtcatcaaacataacatacatcacaatttaa

SEQ ID NO: 38998 - DNA, 258 bp, Glycine max
  Peptide Sequence Number=SeqID_155776
atgtatagaccaaagcaagatacattgatcatttatagatcaaatagtggatgggacattttgtgctttgtcaagaagcaaaagtggatagggttctttgaagtgaatgaaccaatctacccaaggctagtgagagacttctttgaagctattgtggtggatagaaacaacttcaccctgaaggccttgatctcagaaaaactcctagcagaccttttaggaattcctgctaatagtttaaggctctatgaatactag

SEQ ID NO: 38999 - DNA, 678 bp, Glycine max
  Peptide Sequence Number=SeqID_155777
atggctaagcgcatgaacaattctggaagaaggatgagttgtataaaggcgttgagcgaaagccaactcgctaagcgcaccgtcttcaccttcaggctaagcgaagtttttggctgtggagagactgagagagagctgagcttgaagaggaagccatcttgcggagctttggatgagattttgagagattgtgaggaagcttccctgctatggagagctaaatcctcagttggttcttcctatgggaatggtgaaaccatttcagaacttgaaacaagattcatccatatagtaaatcacttgcttggtcttggaaaaacgtttgaagatgatgagttaaacatcaagattctcaactgtcttacaagaacttgggaatcgaaaatcacaatgatcaaggaatccaaggacttggcatctatgtggatggaagctctcttcggaaaatttcttgaatatgaacatgggttgattcgacaatctcatgtggaagatacaaaaaagaaaaggaaagggattgaactcaaggttagttccacaaaggaagatcacaaagaaagctctagtgatgataaagatgtagagaatttgagcttgatgacaatgcatcaacatcctttgattcttctagtgaagaagaacttgcaggatgaatccttaaccattgaagaaactgag

SEQ ID NO: 39000 - DNA, 427 bp, Glycine max
  Peptide Sequence Number=SeqID_155778
atgaccggccctctccatgagtcgatctcttgctttctcataagggtggacccttgggtactagtacctatcaccttcagaggactacacgtcctcgcctccagaggactacatgtcctcgtcttcagaggactacacgtcctcgccatcagaggactacacgtccttgccttcagagggctacacgccctcaccatcagaggactacacgtcctcgccttcgtagggctacacgccctcaccttccgaggactacatgtcctcaccttcagaggactacacatcctcgccttcagaggacaacacatcctcgccttcagaggacaacacatcctcagcttatgcattcaatatcctgatgagggtgttccatatgttctcaagactggactaatacatttgctgccaaagtttcatggtcttaaag

SEQ ID NO: 39001 - DNA, 189 bp, Glycine max
  Peptide Sequence Number=SeqID_155779
aaaacaaattgttcccttctactttgtctgccagtgacaaagcaatggacccaccgtaatatctcatcacctcaacgtgataccagaccaacgtgggagcttgctgcttcaagaggtggttcgcggcttgctgtgtgggagtggagtcggcggggagaaactcttggaagatggaggaggggtgcgtga

SEQ ID NO: 39002 - DNA, 258 bp, Glycine max
  Peptide Sequence Number=SeqID_155780
atggcaagttcaacatgctttcaacaaatttctttacaaataactatcatgaagcagaaacctaacaaaactacccatcatatctcccaaaacccaatacccacaaaaatcaaagatgcgcttcacgactccgaaaatgcattcctttcacgatttggagcagaaatggctaccaaaggttggagctttgttggtgcttcaatggtggaggaagaagaagagaatggcaacgtgagagagagaggaaaaggcttctga

SEQ ID NO: 39003 - DNA, 521 bp, Glycine max
  Peptide Sequence Number=SeqID_155781
atgaggaggaggggctgtgaggttcatggaagtagtagtgttggtgaggggatgatgacacaatcttggggccaaagaaagagtgtcttggggagctttcagcagggtgttcacgaagttggttcaggcattgagataataaccgtctttgttgtggttgtgggtgctggaggaatgatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 39004 - DNA, 2121 bp, Glycine max
  Peptide Sequence Number=SeqID_155782
atgtcccactcccaccagcacccacaaccacaacaaagacggttattatctcaatgcctgaaccaacttcgtgaacaccctgctgaaagctccttctcatcttctcaaacacattacaaaaccaaaatccccttatgtcttattcactccgaaacaacgtcaactacatcaaccccaagacactctttctttggccccaagattgtgtcatcatcccctcaccaacactactacttccatgaacctcacagcccctcctcctcattcccttgtaattgttttaatgtctcttcgaggcgttggagtgccttcaagcttggttgcacctccatggaccctcaagtagaattctcatcatcacttcactctgcctctgagatcattaggaaaaagaaaattactgggcggcaaaagagagaggaacttgaaaaggaggtcgctatgcttcaaaagttgttggaccaagaagaaaagtttcatgagattttggagatggtgcatagtagaccaaatgggtcatcgatatcaattcccaattttcttccacccaagatgagagaactcttaggagagctagtcatggttgagggtgagatagctagacttgaatcccaaataagcgaactccaagctgatttgaaacatgaacaagaaatcaccaaggaatcaaagcctaaaacgtggaatcaagggaacttgagcaattctaacaatcacttatcaacttctccggttccaaatcctagtcctattcgcagaaatgttcaagaaaggatggcatttgaaaccaaggcgttgcatttcataagcaaagctataaagggcgattacaatctcaatgacttcagttataatgacaagacaggttttgttaagacttctgtcgaaccgaaagaaagtaagttccaagaagatgtgaaatttcatgaaaaacttccaagaaaaaatgggatggtgaagcctccttcacctatgcgtgacccccgccatccatcacccaagtttcgggaacgcaatccagagatgtacttggatctcccaactagatcactacttgatccacttttgtcagaagagaatgatctcaagtggcaacccaacaagctatctgagagcatcatgaagtgtttgaatttcatttatgtgagactactcagaacatcaagagcaatggaattggagaaatcagggccaatttcaaggtctgtgcactcttccttaagctcaagaagcttcagggtggacattggatcaaacccaaaaccaagcctcttgttgcaaaaggaatcaaggcagcaagacccatatggtatctttaacacagaagagtccattccaagggacattggtccttataagaacttggtcatattcacctctagctctatggatcccaagttcatctcaagtccatcctctataccattactaaggaagttaaggatcttgatgagcaatcttcaaacagttgacttgaaaagccttacaaaccaacagaaattagcattctggatcaatgtgtgcaatgcttgcatcatgcatggatttatccaatatggagtgccatctaccccagaaaaattacttgcattgatgaacaaggcaactctcaacgtaggaggcaacataataaacgctcaagcaatagagcatttcatattgaggaaacgagatatttctaatgtgaaagaggtacagcgaaagggtgaatgggaggagaaagaatcgtttgtccgtgaactttatggacttgagtttaatgatcctaatgtcacatttgctctgtgttgtggaactcgttcttctccagctgtgaggatatacacagcagatggtgttacagctgaattggagaaatcaaagctagactatctacaggcttcaattctggcaactagcaccaaaagaataggattcccagagctccttctcagaaacatgcttgatttttctgtggacacagactcactggtggagtgggtatgcagccagttacctacatctgggactctaaggaaatcaatggtggattgctttagaagccacagtaatgtgaagccttctaccattgttgaaaagataccctatgactatgaattccagtatttgttaacaatataa

SEQ ID NO: 39005 - DNA, 106 bp, Glycine max
  Peptide Sequence Number=SeqID_155783
tatagtacaaagctacaacaaaagtgcaaatcttgaagaagctgactactggaatagccacctaatcaccgtagaccgtaggcttgaaaggctagtctcacaataa

SEQ ID NO: 39006 - DNA, 387 bp, Glycine max
  Peptide Sequence Number=SeqID_155784
atgtaccctattttgggagaattcggaccctcactcactcactgtccaaacctcgccctctcacctctcctcttctggtacctgcatgagcctcaccccctcgctcatgtgcctccacctcgacgacgagtggttcacgtcgctagtgcaaagtttgaggttcgacacagtttattgctcgcggtgctgttaaggttcacgaaggaccctttctcacaggtgcgagcctcagcgctggaagggcttgttggtttctacaagtgcggcagagtcgagagacatcatgttcttgttggcaaaaccctcgtctctcgtacccagggaacaaaggtcatgctgaactcatttactcgcgagctcaacttgttaatccgaaaattgagttga

SEQ ID NO: 39007 - DNA, 993 bp, Glycine max
  Peptide Sequence Number=SeqID_155785
atggcaaccaaaacctccactccaagttctcaatccccaaaactctctcgtctccgccctcaatacattcccaaccacatccccgactcctcctacgtctgcatcttggacaccaccctccgcgacggcgaacaatccccgggagccaccatgacagcaaaggagaagctcgacatcgcacggcagctggtgaagctgggcgtgcacatcctccagcccggcttcccttctgcgtcgaacagtgacttcatggccgtcaaaatgatagcacaagaggttggcaatgctgttggtgatgatggttatgtgcctgtcattgctggcttctgtcggtgcgttgagaaggacatttctactgcatgggaggctgtgaagtatgctaagaggccacggctttgtacttccatagctacgagccctattcacatggagcacaagctgagaaagagtaaagatcaggtgattcagattgccagggatatggtcgagtttgcacggagtttgggttgcaatgatattcagttcggtgctgaagatgctactagttctaagacagttgttaaaaaccgtcttagagtacggagcggtggcaattttgtaataaaggagaaaactgttgtctttaacgtcgtacattctaaggcggttatagacgaccgccttagaatgtctttcggtggcaaacttgtaattatgaggaagaagaacactcttactttacttcttaccccgtgcaccctctcctccgttttcgcggtttcttcgaaacaaaaacccccaaacagcacagacaagaagaactcaaattttggacattgttatcgacgtcacttctttacaaagtcacagagaaagtttctagcaaaccaaacagcacagacaaagtcataccgagggcacttaagcttttccttttgtgagtgttacttgaaggttcgtgctgttctggagagagctacaggaggagttgagaaggctttacttggcgtttga

SEQ ID NO: 39008 - DNA, 1660 bp, Glycine max
  Peptide Sequence Number=SeqID_155786
tctcaaggaactaatggctcaaactatccagacaccggagcaacagaagtatctcacacgtttaatgggatatgattttatcatacaatatcgctttggccactccaatgtggtcacagatgccttatcttgtacctttgaccattccaagggaatggtcctcacttttttaatgccatatttcatttttatagatgaactaaaaggagagctagctgataaccccgagtttaatgctctacgacaaggcttacaagagaacccaaccaatcgtcctactctaacttacagtgatgggttggtcttacaaaatggtcgcatttggctgcccaacaaactgaacttcatcaggcttttgttgcataaattccactccacacccacaggcagtcatatgggtgtcacaaaagctttggccaaactacatgacaaattcacctggaattctattcgacaggacgttcatgattttgttgcacagtgcctcaactgtcgatacaccaaatatgtgaccaggaaaccagcaggattgtatctccactaccttttcctactcagccataggagaacttatcactcaattttcattgtcgaattaccgatatataaaggaaacaccacaatactggtggttgtatatcgattctccaaaggtattcatttgggccttcttccatctcaatatattgcctatcaagttgccactcttttcctggacatagtttccaagcttcgcggcatgcctcggagcttagtcttcgacagagaacccttgtttattagtaagttctggcaagaactgtttaagctatctggcacaaagttacacttaagcttgacttatcatcctcaatctaatggtcaaactgaggttatgaaccgcataattgagcaatttatgcgtgcctttgttcatcatcgcccatcgccatggggtaagttcttaccttgggtcgagtggtcgtataatacttccaaaaatactagcactggaacctccccatttgaggactcacatatccaccttgtctttcattgctcactcctcaagccattctggcatgatgcaagaactgaacccagcccacttccattacctggaaaggacttcgacaactatcctctcatcacccctctaactatcctcaatactcgttgggtagacacaaacaatggacctcgtttacatgtgctagtgcaaagggccagtttaccagttgacgacacatcttgggaacattgggcttcattaaaggagaaatatcaccttgaggacaaggtgatttttgaagggattaggagtgatagaccagtcaacatgcatgaagcccagcatggaaggcctcagaggaagactcttgaagagttccctacaaaggaacaatatgaagctcatattagtgctgttgtagaacctgagacccctgtagagaaacataataacacaggattatggtacttggtgtataagcacatggtatcaaatatggatgaaaacaattccgagtcactaattgatggggcagacaaaaaagagtcagggtttgatgggagcagaacaagaggagcttccttctcttatgaaagtacacccgtgactgatcaagagatgaaatttaaggaccatgtcgtagctgatccagaagttgcacgccaatag

SEQ ID NO: 39009 - DNA, 186 bp, Glycine max
  Peptide Sequence Number=SeqID_155787
atggaaaaagtctcctttgtactgggagctcttctaaagcatgaaaatgaacaaaagaagaagataggtcatgcatgcaaagaaaaagatcttagcttgtcaaagttgagtgttgaagtggctaaagagaggattcaggaagggtgtggcaaggaattgttagccccttcccccattggtgactag

SEQ ID NO: 39010 - DNA, 495 bp, Glycine max
  Peptide Sequence Number=SeqID_155788
atgaagcttggagagacttgtaaaagaataattgagttgaatggatctagagagaggcgagaagacttacatgaagaggcgatcatatatactttcataaagagatcagatagagaatttctctatgaaattcttggagtagttattgaagtcggggcaacaacagtgaacatagccgacactgtaggtatagtaatgccattggagttaggaaaattaattgttgatataaaagacaataccccaggaattgcgaatgttattatttcgactcattgtcataatgatcttgggcttgctactgctaacaccatcgagggtgctcgtacaggtgcacggcaattagaagtaaccattaatgggattggtgaaagggctggaaatgcgtcgttagaagaggtatatgctattggacacaaccttgtacttactggaaaaacagagttccaccatgatttttcaaagcattcaaagacggttttgaatcgtctttga

SEQ ID NO: 39011 - DNA, 1323 bp, Glycine max
  Peptide Sequence Number=SeqID_155789
atgagcagcttaaggcccgaattgcatgttgcgcagcaacttcggcgcgacaaattgaggatccaaaacagttcccaacaacaacacttgcaagagttccccaacaacctagaacagttgtcgttacaaccagggttcaacttggatcttcttcaagtaagaagcgttcgaaatggcaacatgcttgatgaagcactttattcatcggaaatgatcacttttccaaaccctttatctgctcctagaaaccctttggagtgtcaagagcttatgatggttcagtatggttcaacttcgttccctcattcatcatccccaaaggagcaacaatgtgaaccacgcaacttgggtgctagttggatgctgaattgtaacaacagcagcagcagcaacaacaacaacagcaacaactccctttactcttctgagctcaataacaatgtttctagtgaaatggccaatagagaaattcagaagcagtttggtgaaatgcaataccctccttcttcatcttcttcgtctccaatttaccataatgccttgcaggacatggcttatggcgtttggggagggaataatcatcatggtgaatctgtgcttcattatggaaacaacgagttacgcattgggggtgctaatttatggacacataataataataatattccattgggtttcaagaagattaataatgatgaacagttacatgacaggaatcatactcatcagggtctatcattgtcgctctcatcaaattcacaacaacaacaatccaagccttgttttgatgaagggtctgttgtgaaatcaccctcctcgaccatgaagctgaatgcgctttcaaacaacaacaacaacactgtttatcgaaatgttggccctctcggtcctttcactggttacgccacgattttgaagagttcaaggttcttgaggccgtgccaacagctgttagatgaatggtgctgtcaatctggttcaaaatttgcaaagagagggatttgtgatgttccagagtgggtctctcgagatgtcagttctgcttctacttgtgctactgctcttaatgttgatgaaagtgctgcaaaaggtggtggcaattcgggtgcttcatcctctgtgttgtattgttcaatcgaaaacaacaacaacaacaataataataataataataataataataataataataatagcgctgatggcggagccgcgagtagcttttgtctttcttctcgaccagagtgccaaaagaacaaggcaaaactattgtacatgcaagaggagtgtgtttttggtatatggcttaatgtctgccagtga

SEQ ID NO: 39012 - DNA, 834 bp, Glycine max
  Peptide Sequence Number=SeqID_155790
atgcagatggttgttcaatcattcgagtcggtggcaggtcttagtttggctaccccgtacgtctccttggctctcaagtcagtgtcaaaacacttcaggtgcctaaaaaatgcaatctcagatcaactgaagcttacatgtgaagtcttgggagaggacttttcaataccaaccacaagtactggtagtaaatttgacaacaacatggccaggctaaggtaccccacggacactgataaacacatgttggctacccaaacgggtctatcacgaaaccaggtatcaaattggttcataaatgctcgagtccgcgtgtggaagccaatggttgaggaaatacacatgctcgaaacaaaaggcgtgacaacagaagcccgccaacaccaccaaacctctagtaaaaatgaccagttagcttctgcttctgaaggcagcaacaaccagcccaaatctgataaccaacctgctcacaggttcggtggcgcccatgcatcacattcacatgcaatccctgaaaagcaattccagtgtttggaaatggggtcatcctcttctgcatgcaacgaggaacaaattggaatggaagaagaccaatggaatcaagagaagaggtcaaaactggactgccagattactactacaacaccaagcatggatgggactgtgatggggtttatgccgtaccgaagaagtggacttgagggtcttggatcagtgtcactcactttgggtcttaggcatggtgttgaaggtgtgcaacaacaacaattgcaacaagaggaggagcttaggcgtcaatttggagggcatatgatctatgactttgtgggctag

SEQ ID NO: 39013 - DNA, 582 bp, Glycine max
  Peptide Sequence Number=SeqID_155791
atggccagacggaagtcctcaatagggtcattgaacaatacttgcactcattctttcatgatcatcctaatcaatggttcaagtttcttcccctggcagaatggtcccatgatacatccgtgcattatggcacaagattttctcccttcgaagtcatttatgcatttgactctccaacgcaggctgcttaaatctcagaatgtgatgaagactcaagctgatgctcaccattgggatgtccaattagacgtcggtgactgggtgtacgttaaactccgaccttatcaccagacctctctgcagccttcttactccaaactctcaaagaggtacaacgggccttaccttgtagaagcgtgtgtcgtcccagtcgcgtatcaactacatttgcctcctggctccaagatacaccctatttttcatgtttcactcctgaaaccacatcaagggcccattacttctgacacctcccctctccctcctctaagtacaaacaatcatccaattgtccgtcctttgcagttcttggattggaagatagacactgcttccactccaccaacccaacaagttttagtttaa

SEQ ID NO: 39014 - DNA, 285 bp, Glycine max
  Peptide Sequence Number=SeqID_155792
atgcagcgatactattctgcatcagcaagggagttggcacgattagtaggaagaaataaggcacatgagcacaagcctcaagtttttccattagataaaaacagtaaaatcactagcaacacgaagaaagggttcagggatcaggataaactcacctttcaaattttgaagccgcaagcaagctgcccttcgtccacttctgttcgacagggcttagtgatgatgggtcacaaacttctcgtcgtgggtgaagagtgggtgaagagtggaaagggatgctggtaa

SEQ ID NO: 39015 - DNA, 1094 bp, Glycine max
  Peptide Sequence Number=SeqID_155793
atgctgggaaccggtacacagataatgtcttggggagaaacatcttgcctgagaggaaggtagagctctatcacactgagctagatgattttaagactgaattggagaggcgtaatttccataaacgcctcaccaatttggttgatgggagcatagacttggctttggtgaaggagttctatgcaaacttatacagctctgagggcccttcaccaaagcaatccagagtcagaggccatttagtgaagattgatgctgacagtctcaacacattcctagagacacctgtggtattggcagagggccgagggttcatcttgaacactgagggccatcctgggaagattctcaggaaggatttgactactctaactaggatgacttctatagcccaatctaacatttctagaattgggtttcctgctctgatcactgcactatgtagagccagaggggttgtctctaacagccttacttttgagcgcctgagcccggtcattaactgggcctacatcaggaagaactattggaatcctgaggatctaacagtttctatccgaggggctaggagggcgagggcgaggccagttgagcttccttccacttctgtaattcctactctagcatccacttcagcagcttcttctgtcccaactcagacagattctcagcgctttgaagccatgcttcagagcattcatcagggacaaatcactttattacaaagatctattccttcagttgagcagttcagggagatggtagcctggcccaggacccaaccttctcttcacaaggaagatgaaggtcccacagcccaggtaccacagcatgtggaggatgagtcatctgaggccaccatcccagagccatttgttataggggaggaggcagagcctcctgcaccagtggtggacctaccctcacctcagtgtacaacagacccctccactcctattgtacagacaccagaggacccgaccacaccagacctggctatggacacttctcctccagctactcctgtacttcatctgacaaatgagaaggatgttcagacacacgatacccaggaccagtcacaggaattctaa

SEQ ID NO: 39016 - DNA, 543 bp, Glycine max
  Peptide Sequence Number=SeqID_155794
atgcccatatacagtcttcctgacaccatttcaatgattgcacaaactaaggtttcccttgaaaggattgcatcatttcttcgtctagatgagtggaagactgatgtagtagagaagcttccacagggtagttctgataaggcaattgaattagtagatggaaatttctcttggtatttatcttccccttatccaacattgaaaaacgtaaatctcacagtttttcatggtatgagggttgttgtatgtggtaatgttgggtcaggcaagtccagtttactttcttgtataataggggaagtaccaaagatatctgggaccctgaagatatgtggtacaaaggcttatgtttatgaatcaccatggatacagagtggcaagatagaagacaacatattatttggtaaagagatggatagggaaaagtatgatgaggtgctagaagcatgttccttgacaaaagaccttgaggttctaccatttggtgatcagaccactatcggagagaagcgaatcaatttgagtggtggacagaagcaaaga

SEQ ID NO: 39017 - DNA, 266 bp, Glycine max
  Peptide Sequence Number=SeqID_155795
gcgcagaagacgacgttagtctctgcgtgctattaggcttttcgacttatagacagcaaaaactttatacggataaccactcgggtatttccgcccgtcagcgtgactcaaaagtcaatatgacagatcttgtgagcgcggaagatgacgctttttgtcttacagacagcaaaaagaatgtttatacggatgaccactcgggtatttccgcccgtcagcgggacttaaatgtcagtattacagatcttgtgagcgcggaagatgac

SEQ ID NO: 39018 - DNA, 548 bp, Glycine max
  Peptide Sequence Number=SeqID_155796
gactacacgtcctcgccttcaatgtactatgcgtcctcgtcttcagaggactacacgtcctcgccttcagagggctacacgcccttgccttcagaggactacacatcctcgccttcagaggactacacgtcctcgccttcagtgggctacacgtccttgccttcagagggctacacgtcctcgccttcagagggctacacgccctcaccttcagaggactacacgtcctcatctttagagggctgcacgccatcgccttcagaaggttgcacaccctcggctttaaagggcgacacgtcctcaacttcggagggatgcacgccccctcgcctttaaagggctacgcgcccacttgggccttccagattcttcctccaaaaggctattgcttctggaggaagcaaccttgctcgcctgggcgagatgagctcgcctgggcgagctggggaaggggttcagccttcttggcacttctgattctctcgaaatggctgaggaaaattgtttccgtgaagaaaatccaagccgaggcgcttcctcttcaactg

SEQ ID NO: 39019 - DNA, 288 bp, Glycine max
  Peptide Sequence Number=SeqID_155797
atgacgtttgtttgtcctttgaatgagggaaggtacgctactgaaggttgtcattatcatgcgtgttcacagaaacattgctttgtgacatatgagaagaagtatggtggtaacatcctcatgggtagcgatgatccttctccattggagcttgtaggcctaggatccttttcatcaatgtattcctttgcttctgggaagatgaatggcagcagaatggagaaggaagagagagaggagatgccacttcaaggagaagatgagtctagaagaagctcgccaccatag

SEQ ID NO: 39020 - DNA, 753 bp, Glycine max
  Peptide Sequence Number=SeqID_155798
atgaacgtttttgatattcagcatataaaaacttattcttcttatgtgtcacaatgtgaaggcttctatggctatgattacattcacagtgataatttaaccagaacggttactgcttataaattccgaactgatgctcaatgttcacaatctacccatcagggtatgaatcagatcaatttcaatcctcagcagaccggaacttatacctttaaattctggcagggaacgaacagctggatcaccaaaaccatcgtaatattcggtcagaaaattatctggaaagaagatcagaagcttacctgggatgattttaaaagtccggtgagcagaaaaagcaataaagatgtggttgcctatacccattgtggttgggaatattccgttgtcacttcctccaaccctgcatctcctgtgaaaattgaagttctaactattttcaataaagataagtcgtggaaagatgttaaaaggatcaatgattatgtgttactccacgagcaaaagcattttgatattgctgaactatatgccagaaagcttcggaaagaagtaatggaaaacattaaaaccgcaggtgattaccagaaaaaattcaaagctatttatgacagggtgttgcatgaatacagagatttccagattgcttatgacaaagaaacacaaaatggaatgaataaggaaaagcaagctgaatataatgccagtataacggaacatttagaccaattaaatagctataaaaagtcttga

SEQ ID NO: 39021 - DNA, 620 bp, Glycine max
  Peptide Sequence Number=SeqID_155799
gactacaagtactcgcctttagagggcagcacgccctcgccttgagagggctacatcccctcgccttcagaggactacacgtcctcaccttcaaaggactacacgtcctaacctttagagggctacacgccctcgcctttagaggactagacgtcctcgcctacagaggactgcatgcccttgccttcatagggctacacgccctcgccttcagagggctacatgccctcgccttcagaggactatacgtcctcgccttcagaggactgcacgtccaaaccttcagagggctacacgccctcaccttcaaaggactacacgtcctcgcctttagaggctgcacaccctcgcttttagagggctacatcccctcgccttcagaggactacacgttctcaccttcagaggactacacgtcctcaccttcagagggctacgcgtcctcgccttcagagggctacacgccttctccttcagagggctacatgtcgtcacctccagaggactacacgacctcaccttcagaggactacacatcctcaccttcagaggactactatgactggagcgttgcctacatcccgtggccggccagcaagcgaccaagtccaaagccaagg

SEQ ID NO: 39022 - DNA, 495 bp, Glycine max
  Peptide Sequence Number=SeqID_155800
atggaagggtcagtggacctagcagcgattgacgctttcctcgcctttcatcatggcaaggaaagcccggtcgtcgccattttggcccatgaaggaagaatcaggattctatcttcatgcgaaggatgtccaaatgttcccttgatgggaacaaggggttgtattaattataatcccgtcctcaccgtaagacagcttggctaccccatgagaggagtgtcatcagacgaaagcatcacgcctttcatcacacggggtttcagtgaccacaacgcgagggacagagagcttaggggaagcagtaatgggatcatcggcggctatcataagtggctgagagtctggacacaaggattggattggctcccaaatctaaagactgtgagagacaatgaggttaaagcttcggaagaaagtgatgaggtacaagccctaaaggcaaagcttgaaagagcccgggtagtcaaagagaagttcaagtccatagccatcaaa

SEQ ID NO: 39023 - DNA, 447 bp, Glycine max
  Peptide Sequence Number=SeqID_155801
atgcctcagattttctttctcaatgggcccaatgccaatctttacggcatggatcgccacggtacttacggcagcgacagtttcgccagcatcggcgagcgctgtcagcagcgcgccgacgcgcacggcctcaggctgcagtttcgtcagagcaaccatgaaggggtgctggtggactggattcaggaagcgcgccagcaggcggacgggctgatcatcaatgccgccggattatcgtaccgatcagtaccgattctggatgcgctgctgatgtttgatggcccgatcatcgaagcacacatgagcaatatctggcagcgcgagtcgtttcgtcatcagtcgctggtgtcgaaagccgccaccggcgtgatcgccgggctgggcgcgctgggttatgaactggctatcgatgcgctggcgacgctgctacaggagccaagcgcatga

SEQ ID NO: 39024 - DNA, 177 bp, Glycine max
  Peptide Sequence Number=SeqID_155802
atgaagaaggagaatgagatgaaaaaggagaccagcagaagtggtaacaaccttcacaatttacaacaaaagaacttgaaaccaacgacaatgatgactgagagtgatgacgacaacaacaacaacaacaagaggctagggcttgagaggtttgggcacaaaagaaagaccgtgtga

SEQ ID NO: 39025 - DNA, 1245 bp, Glycine max
  Peptide Sequence Number=SeqID_155803
atggggtcggaccaagcgccctcctttgaaaagaggttctatcatgtcaaagtcaagaaactagaactagccagcatgcgagaactaggacagcgaatggatcaattggcatcgaccatagaagagttcgaaggaatctttggatgcccgctaggagaaaggaagccataccttttttccgggttctatccttctatggcaagaatagcaaaagtggtcacaatctcagaacaagagctagatcgattgaagcaaaatagaaatggggtagttgggataccaaggaagtgcttggagaagaagacaaaagctttgataaatcaaggggagtggacctcgttcattgacatattagcattgttggtgtttgggaccatactatttccaaatgtagatggcctagtggacttagcagtgatcggcacctttctcgcttatcatcacagcaaggaaatctcagtcatcgctattttaggggatgcatatgatacgtttgacctgtctgtctgccctctacaaggtcatcgcatgtgcaccaaaaagggaaaagcaaattgggaagaactcttggcagatatggcaggactgttatgctcgggtgaaggattcccaaacatccccttgatgggaatgaggggtatcgatgaagccaatgcgaagatacttcaaagaattcataaagcgtggaatacagtggaaaggaaagataaggagcttaagggaagtagcaatggcgtcatcgacggctatcacaagtggttgaagtcttggacgcaagggataacttggctcctaaagctaaaaggcctaagtgggaaagaagctaaagtccctgaggaaagcgaagaagtgcaagctttgaaagaggaactcgaaaaaatgagagtggtcaaggagaagctaaagatgacagtcactagggtcaggaaaaagtgtgatgagctgagagatgtcaacatgactacggttgaagcattagagtgggaaacaaaaagggcccaaaaggaagaatggagcaggaacaagttccgaggggctctatggggcagcaacaacgagctcaagcttagaagggccgagagggacgagttaaggatggaaagcatggtgttaaaggataagttaaaggcctgtcaaagggcgaagaggagtttgacggaacaactgagcaaaatggaagagaatatgttgacaattattgatcaatataaggaaaaggtgaacctagctgctagtcatgggtag

SEQ ID NO: 39026 - DNA, 4509 bp, Glycine max
  Peptide Sequence Number=SeqID_155804
atggcagaccacaccacaaggaagacaaccattgacagattagaggatgcaatcactcgtctatctaacagccacgccaccctattagacaaacacagtgacctcgttgacaagtattcagagatctccgggaaggttgattcaattcttgatcacctccacttacgctctccagtacgcgaccacgccggtatcaacacccaagtccaccaacgcaacacaatcaaactagatattccaaggtttgacggccgtgaccccatgggctggatcttcaagatctcacagcttttcgaataccaacatacaccggaagaagaaaggatcattgtggcctccttctatctcgacggagctgcattgagctggtatcaatggatgtttcgaaatgggtttataacatcctggtcaggcttcttacaagctttggaatcacggtttacgctagcctattatgaagacccgaaaggagcacttttcaagttaacccagcgtggcacggtaaatgagtacctaaccgagtttgaacggttagctaaccgcgtgatcggtttacctcctcctttcctgttaagctgctttgtttcagggctagctcaagatatacgtcgggaagtgttagcacttcaacccatctcactaccgcaggctatggctcttgcaaaactgcaagaagataagctacgggatcgtcgacaaacccctctccgttcccacaatacccagccaaccccataccttccccctcccagaaaaccgcattccacatatgtccagcgaactcccgacgagatggctctccggcgtgaaaaagggttgtgttacaactgcgatgagaagtggagttcaactcaccgctgcaagggacgcgtgctcttgttcatagccgataaccctccactcacgacagaagaaaacctccccaacctcccttcaccaccatcaccagatcaagaaccagaaaacctcctcgaatatgaccctccattagacttaaaccctcctcacgtaagcctccatgccctttcaggccttccctcctccgaaaccttccgccttgaaggcatcatcaaccacacccccctcaccatactcatagacagtggaagtacccataacttcctacaaccccgtatagcccactttcttcacctcaaagcccaaaatacaaaccccctccgcgtcttggtaggaaatggttcagtccttgactgcaaccaagtctgccccgacaccaccttatccctccagggccacaaattcacggtgacattccacttactctcaatcagtggagcagatgcagttttgggcatagagtggttacgacagtttgggcctgtaactactgattacaccgcattctctatgaagtttacccacttgggtcggcccatcgagctaaaagcggacatttctactggaccaaagccaataacagcacctcaagtaaaacgtctaatccaaaccgggtccgcatcagctttattccatttaaacctcattcaaaacccacaacccgacccaaatcttcttcttcctcacccgatacctgcaatccagtgccttcttaaccgtttccacctcttattccaaacttcatcctcccttccccctccacgaaacatcgtccaccacattaaccttttacccaacataaatcccattaacgtaaggccatatcgatacccgcagtttcagaaatcagagatagaaaggcaggtatcggagctcctctctgtaggattaatacaacccagcatgagtccatattcttcaccagtgctcctcgtgaagaagaaagatggcacctggagaatgtgtgttgacttccgtgccctcaactcagtcaccatacgcgatcaatttccgataccgacgatagatgaattattagatgagctgggacacgctgcttggttctcaaagttagatctcaggcaagggtttcatcagattctcatgcatggcccaaacgtcgagaagacggccttcagaacacatcaagggcactacgaatatcgcgtaatgccctttggtctgtgtaacgccccctccaccttccaggccgccatgaactccctgctagcatcgttccttcgaaagttcgcaacagtgttctttgatgacattttagtgtacagcccaaccttatcttctcacttggaacacctcgaggtcatcttccacaccctacttcaaggtcaatatcacctgaagagatcaaagtgcctcctcgcccaaactcaaatcgaatacctcggtcacatcgtatcaggcaagggagtcgaacctgagtcctccaagcttcaagccatagtccaatggcccacgccattatcacccaaagaactcagatcctttctgggccttactgggttttacagaaaattcatccagaattacgccaagctcgcggccccccttacgtcactcttggccaaggatgcattcgaatggtctttgaatgcgcaatctgcatttgaaacattaaaaaaagctatgactaatgctcccgtgcttgcattacccgatttcgatgagccatttgcgctagaaaccgatgcttccggcaccggcatgggcgccgtcctgatgcagaagggccatccacttgcattttttagcaaacaattcgggccccgtatgattcatgcatccacatacgtgagggaactccacgcgatagttgcaacagtacgaaagtggcgccaataccttttgggccaatctttcaccatttttaccgatcataaaagcctccgtgagctaatgtcacaggtggtacaaacccctgaacaacactattacctttccaagcttttgggcttcgactacacgatccagtataagctgggatcgtccaacgccgtcgccgacgccttgtctcgatcaacaccaagttcttccggcgaactcctcttattatcagtgcctaactttgacttcatggacgacttgcgacgcactctccactctagtcaggcatttcgggcactactttccaaggtacaagaccaccctcagaatcaccctgattatcgtattcaccaaggactgctcctgtttaagaatcgtatctggttaaacgatgacaacccctctatacccgctcttctgctcgagtttcacgcaactccattaggtggacacttgggcgtggctaaaacaacccacagattggaatcaagtttcttctgggcctccctgccaaaggataccgagcgcttcatcaaggaatgcgctgtctgtcaacaaaccaaggctgatacccagcgtcccgccggcctccttcaacccattccgccacctaccggagtttgggaagacatttccatggacttcattacccaactaccgccatctcacggctacacagcaatccttgttgttgtagatagatactccaagggaacccaccttggagccttacctacaaaccactcagccttcaaggtagcatctctcttcatcgatattgtttgtaagcatcacgggtttccaaagagcatcatctccgatagagaccccctcttcctcagctctttctggcgagaactcttccggttaagcgggatgcgtctccgtatgagtacagcgtatcaccctcaaactgacgagcaaaccgaagttatgaacaggatcttggaacaatacctcagggccttcgtccacgcgcaaccggccacctggtatcgctacctcaccttggtagaatggtgctacaacacatctctacattcaagctctgggttaacaccatttgaagttatctatggtaaaccacctccagcattacctcaataccttcagggtgcaaccgcaaatgaagctgtggactcgatcttgtcttcacgacaggagattcatcagaaactacataaacgactccataaggcacaagaaaccatgaaaagaatggcagatattaagcgtcgtgacgtccattttaccatcggacaatgggtttacatcaagttacggccattccggcaacgttccgtcaccggcaatatccaccctaagctatcaaaaagatactttggaccttttcgtgtcactgagcgcgtgggaaaggtctcttatcgactagagttacccaaggaagcacggatccatcccgtcttccattgctcgttgctccgagaacaccacggcccacctccatctccaacggacacctctcctctacagttcatggctcagaaaccagttgctcgtcctctctgtatcttggattcaaaactagacacatcatcacaacccccgacacgccttgtgttggtccagtgggagggacaacccctagaagataccacatgggagacttggtcagagatccgcgatcttcatcaccttgaggacaaggtgcatttcacgggcgagggtattgatagccttcacgattcaaaagctaacactgcgaacagcgtaacactagaacatgcagaggcaagacccaaacgaacaaactccaagcccagttacttgaaagattacgtgttgtaa

SEQ ID NO: 39027 - DNA, 285 bp, Glycine max
  Peptide Sequence Number=SeqID_155805
atggagagggagatgataacaatgatagtggacacattaccagtgttatactataagaagatgatgggttacatgccttcgagctttgcatatatggtatttgcaggtgaaaggattgaagtgagcctaagaaggggcaaactcgattacgccgcatcaacaagtgctagaaataggaggaccataaaaggtggagctaagaaaaaggagcgagatgcctatgcagtaactgtagctcccacatggccaaggtccaaacaaacccctcacaaccctacttactaa

SEQ ID NO: 39028 - DNA, 756 bp, Glycine max
  Peptide Sequence Number=SeqID_155806
atgtctcatgaagttgaggacgagagcgagtttaactatgatgtaaagagtgagataggaccatttaattggggacacattaaacccgaatggagtctatgcaaaattggatccatgcaatcgccaattgatctgttgaatgagagggttcaaatagtatcccatttgggaactctccagatgaactaccaaccatccaatgcaactctgaagaataggggccatgatatcaagctgggatggcttgcgggcacaagctttctacaaattaatggaactgagtatgtacttaaacagttccattggcattctccctctgaacacaccatagatggcagaaggttggatctagagttacacatggtgcacgaaactccatcaggacaaactgcagtgattggaatattgtataaggctggaagaagaccagatcctttcttgtcactgttaacgaaccacttaaaggccatttctaatagtacgggagcagaaagagaagtgggtgtaatggatccaaggctggttaaaataggcacaagcacaacactgtattacagatatattggttcgctcactactcctccatgcactgagaatattgcttggaccatgcttaaaaaggtgaaatccgtttcaaaagagcaaatcagattacttcgagatgccgttcatgatgattttgatgctaatgcaagaccattgcagccaataaacaaccgcttagtgcagctaaataagccgaaagatcatcgttaa

SEQ ID NO: 39029 - DNA, 244 bp, Glycine max
  Peptide Sequence Number=SeqID_155807
ggatcgcgcccgcaagacaccagtggacccgaagaagtccaacagggtcctagggtttccagctctgattacgggtctctgtcagttctacggagtgcccgtcgcccccagcaagttcatcaagccccctattaaccgggctttcatcaagaagtactgcgccccaggcaagcgcagggcaagacaccacagcagcctagggatggccgacagcgggcaacaaacgcactgtcaccacctctag

SEQ ID NO: 39030 - DNA, 528 bp, Glycine max
  Peptide Sequence Number=SeqID_155808
atggaaaagcttgctaagcaggttttgttttgcagtttattaactgcacttgttttgctaccattcccggtaataatgtctcatttagttgaggacgagagcgagtttaattatgatgttaagagtaagagaggaccatataactggggaaacattaaacccgaatggagtatatgcaaaaatggatccatgcagtcaccgattaatctgttgaataagagggttcaaatagcaccccatttgggaaaacttcatatcaactaccaaccatccaatgcaactcttaggaataggggtcataatataatgctggaatggcttgctggcacaagctatctacaaattaatgaaactcagtatgtacttaagcaattccattggcattctccctctgagcacaccatagatggcagaaggtttgatctggagttacacatggtgcatgaagcttcatccggagaaattgcagtgattggaatgttgtataaggctggaagaccagaccctttattgtcattggtaaattaa

SEQ ID NO: 39031 - DNA, 384 bp, Glycine max
  Peptide Sequence Number=SeqID_155809
atgcctgaagatatacccattgcaagacttgagacaaaatggactcaagatgacttcatggaactcaacacaaaagcaagatccactctaacacacactctaacaaggaacaaatacaaaaaaatttgtaggctaaaaacatccaaagaagtttgggactcgttatgtgttagctatgaaggaatagaagatgtcatactaagaaaagatgccactctgatgagacactctaggagattgcaaatcatctacctcgcaagaattctactgcccttaaccatggagaaacaagctccaaaagagaagaaaagaagtgctccaccaaagctctcaaagtttaaatggttgaatctaaagcatcagaagatagctttggtggattaa

SEQ ID NO: 39032 - DNA, 312 bp, Glycine max
  Peptide Sequence Number=SeqID_155810
atgagtaacgaaaaggctccttcatcagcttcttcgagtagctacgagttgagcaaaggcatcaatggcctcgacaaggttattcttcgcgacgcacgtggtagctccgctgaggtgtacttgtacggtgctcacgtgacttcatggaagaatgaccatgccgaggaattgctttttctcagtagtaagttggccgattttcctcctttgcatgtcaagatgaaggggggaagggaggatctgataaactttagatcagatctcagtgaggttgtgaaatatcagttctcactaaaaacgttcataggttaa

SEQ ID NO: 39033 - DNA, 1725 bp, Glycine max
  Peptide Sequence Number=SeqID_155811
atggcaactgagaatccaattagaatctctgaagctgggagtaaatggccgtttcatggtcgtggaaaggatgtggtacccaacagcagtggcagtgcacctccaagcatggaaggctcatttctggccatagaaagcttgttatcccagaacaccacctggaatgcgagcttgggatctctgaacagagatatgcaaaaagatgatagtggtaaagggtctttatatttgtcacgaggaactcttgcaacacacaaggaggagtctgaggattattcaacccaacagatgtatgataatgagttagacaaagctattggaaaatggcatagacaggatgtggcttcaacatcatctcagcacacacatttagtaatggaagattttccccataacatgtcacctgtatataataagtttcttggagtggtggatgaactaattggcatagatactggttccagttcttctcatggtcctcctgtcactacagtggatgctgtaaaacctaccataggtgcagatgatataagactgtcatcaactgttgattcccctgccccagtcacaagttcatcatctctaaattccactggaagcatgggttttaatgacttacatgttacaattgtagaatcacaattaagggctctcagtgtatctaatctaccaaattcagaaagtcggagttatgaagataaatgggagaacagcttccagaataatttgatgcaacaccagctacaaaactatccatgtgaagtgcctagcaccaattctcaaagtgaaaaatgcacatatgttggtatggagcagtttcttcacaatcccagcaagttctcctctgatgtacagcctgcttcgggtatatattctctgcaatatgtaggtgcatacccatttagtcccacagctgttcctccatatattgctgcataccctcctcatggttctgtaccacttgttgacggggctactggttctagttttactccccaagcaccaggggtttcttctactgcaggaaacaattcacacggagctgaaatgatgcatgcaatcaagttttttggacaatttggatttcctctgcagccttcttttggtgatcctattttcatgcaatatcatcaacaaccttttgcggagggatatggtgtatctggtcatctgctggctcctagagccagtgttggtggccaaattggtgggctaatacaccctggttattttggacacccttcaaatttgggtttcgtaccccagtatccaagttctccactttctagaccagttttatcaggatacccagaaagtagaaatggagttaaaatctggcaaaggagggcgagccctggtgcagcggtaaagttgtgccttggtgacttgttggtcatgggttcgaatccgaaaacagcctttttgcatatgcaaggcactgctcagcatgggagctgttttatacagcagaagttggaaagctgctgtgttaaagagaaggagttagtgttcaaagaggttcttccacatacttcaaaattaatgactgatgtatttggaaactatgtaatccaaaagtatggaagtcctgagcagagaaaggaacttgcaaatcgacttctttgtcagataccgcctttaggtctgcagatgtatggctgttgtgtagtccaaaaggggattgatgaagcagtgtcaacatgggatttggtgattgtggtgtag

SEQ ID NO: 39034 - DNA, 2721 bp, Glycine max
  Peptide Sequence Number=SeqID_155812
atgagcggattggaaatatggcgtattgagaattttaatccagttcccatccctcagtcatcttatggaaagtttttcactggggactcctatgtgatcttgaagacaactgcttcaaaaagtggtgctcttcgtcatgatatccattattggcttggtaaagacaccagtcaggatgaagctggtgctgcagccatcaagacagtcgagttggatgcatctttaggaggacgggctgttcagtatcgtgaagtacaaggtcatgaaactgaaaagttcctctcttatttcaaaccatgtatcatacctcaagaaggtggagctgcctcaggttttaaacatgttgaggctgaagaacataagacacggttgtttgtgtgcaaagggaaacatgtagtgcatgtcaaagaggcaaaaagggctaaagcattggaagttgtacagtatgtcaaggatacctaccatgatgggaaatgtgagatagcttctattgaggatggaaagttgatggctgattctgaaagtggagaattctggggttgctttgggggctttgctcctcttccacggagaacagtcagtgatgatgacaagcctgctgattctcatcctccaaagctactttgtgttgacaaggggaaggcagaacctattgaaaccgattctttgacaaaggaatttctggacacaaacaaatgttatattctagattgtgggttggaagtttttgcatggatgggaagaaacacatctcttgatgaaagaaaaagtgcaagtgtagcagcagatgagttaatcaggggcactggtcgaccaaagtcccatataattcgtgtaattgaaggatttgaaacagtaatgttcaagtccaagtttgattcttggcctcaggcaagtgatgcaccaatgtctgaagaaggtcgtggcaaggtagcaggctgtcattatgttcctctaattctgtctcttttgggtaactttctagcacttctaaaacgtcaaggattggatgtcaagggtctcgtgaaatctgagcccaaacaagaagaacctcaaccccacatagattgcacaggacatttgcaggaaaagattcttcttccagccactgatcagtcaaaattttataatggagattgctacatctttcaatattcatatcctggagaagataaggaagagcatcttataggaacatggattggaaagactagtgttgaggaagagagagcttcagctctttcactagcaagcaagatggttgagtcaatgaagtttcttccttcccaagctcgtatctatgaaggcagtgaaccaattcaatttcatgccatcctgcaaagctgtattgtttttaagggtggacttagtgatggatacaagaattacattgcggagaaggaaattccagatgagacatacaatgaggatggtgttgcattattccgcatccagggcactggaccagacaatatgcaagctatacaagttgaaccagttgcttcctccttgaattccacttattgctacatacttcatagcggacccactgtttttatttggtctggaggtttagcaacttcagatgaccaggagcttgttgagagaatgctggatttgattaagaatatcccagtcaaaagatcacgagggatgctgaaaatgatcctcacttattttcttgcaacttctcagaaggacctaggacataatctttctgcaaagtggttatggtcatcttggcgtcctttaaagactgactctggacgtagaatgctgacagaaaactggccagtgaaagagattcacaacttttcccaggatgatttgatgacagaagatatttacatcttggattgtcactcggaagtctttgtctgggttggccagcaggttgactcaaagaatagaatgcaggctctaacaattggcgagaaatttcttgagcatgattttctcctagaagcattatctcgtgaagctccaatatatattgtcaaagaaggtagtgagccacctttcttcactcgcttctttaaatgggagtctgcaaaatctgcagtaaatgctaggaaactcatttcaaaggaagcttgcaatcgtgaaaaatgggggtctagtggtgcaccagataaatcccagcgttcccgcagcatgtctgtcagtcctgatcgtgttcgtgtgaggggcagatctccagcctttaatgcactagcagctaattttgagagctcaaatgctaggaacctttcaactccacctccaatgattagaaaactgtacccaaaatctgtggcaaaggatacagcacaactggtacctaaatcttcagccatagctcatcttacttctagttttgaaccattctcagcgctagaaaatttgattcctcagtcacaaaaagcgaattcagttacccccaaatcaaaccctgagacaagtgacaaggagggttctatgagcagtaggatagaatctcttaccattcaggaggatgtgaaagagggagaagctgaagatgatgaaggtctcccagtttacccatatgaacgtgtaaacacagcttctacagatcctgtagaagatattgacgtgactaaacgagaggcttatctgtcatctgcagagttccaagagaaatttgggacggcaaagaatgaattttataagttgccaaaatggaaacaaaacaaactcaaaatggcagttcagttgttctga

SEQ ID NO: 39035 - DNA, 720 bp, Glycine max
  Peptide Sequence Number=SeqID_155813
atggcggaactgaacactctggtggtgcgaaagccatgttttggccttccaaccggttgcactcaatccctctctgcctacatttatctcaaattcgcccaaattcccttccaattggacttccacctcaacaaccctcattctaatcaaattccttactttgaggttggtgactctgtggcttataataatgagaaggaggggatcattgagtgcttgaagaaagatgttggggttgttgatttggatagtggggtttcttcactccctgagtggatttcaaccaaagcaattctcaccacttggcttgctgatgcacttgcctatgaactctggctggggtgtgaaggttcctctgcttatagcatctattactctgatcttccttggccattggggaagattctgtcttggaagaaagctatttgggtaaagctgaaacatgggataactaatgacaatgctgaagtgaaaaaagaagagatttatgagagagcaaagtctgcatatgaggcgctgtcaagttgcttaggtgaacagaattacttatttgagaacaggccatcaagcttggatgctatttttcttgcacatggactagttgttcttcatgctttacctttggttgcagttgttgtgttcctcacacttatgacttcatttgatgatgctgaagtggagttagatgatgatgatggtagttatgattacgatgaatga

SEQ ID NO: 39036 - DNA, 1368 bp, Glycine max
  Peptide Sequence Number=SeqID_155814
atgccagtgaccttgaaagcttgttacactgtgaagcctatagagacaacatggtgcggacgcgtatctttatctgaatgggatcaaacaggaaatgtaactcacgtccccataatctacttctaccgtactccctcgcaagagagcaacaacaacagcattgcttccaccttgaaagactcattaagcagagtcctagtgccattttatccactagccggtcgtttacactggataaacaatggtcgtttagaacttgattgcaacgccatgggagttcaattcattgaagctgaatcctcatcaagttttgaagatctcggtgatgacttttcaccctcttcagaatacaactaccttgtccccactgtagactacactctcccaattcacggcttgcccttggttctgattcaattaactaacttcaagtgtggtggcgttagtatcggcataacactttcacacgcggttgtggatggaccaagtgcatcacactttattagtgagtgggcaaggcttgcacgcggcgagcctttgcaaacggtgccgtttcatgatcgaaaagtgctacatgccggggacccaccttcggtgccactagcaaggtgtcactctcacacggagtttgatgagcctccgttgttgctcggaaaaacggacaacacggaggaaagaaaaaagaagaccgcaatggttatcctcaaactgagtaagacacaagttgagacattgaaaaagacagcaaattatggcggttatggtaatgatagttatagccgttacgaggctatagctggtcacatatggagaagtgcatgtaaggcaagagggcacaaagaggaccaaccaacaacgcttactgttatcgttgactcgagaagtcgaatggagcctcctttgccaaaagggtattttgggaatgcaactttggacactgttgctactagccttgcgggtgatttggtgtcaaagccgttagggtatgcgtcaagtagaataagagaggctattgagagggttagtgatgagtacgttaggtcggggattgagttcttgaaaaaccaggaggatttgagaaggtttcatcaagatcttcatgcaatagagagtgagaagaaggagcctttttatgggaaccctaatctggctgtggttagttggttgacgttgccgatctatggcgttgattttgggtgggggaaggagctttatatgagtccagcaacgcatgacttcgatggagattttgtgcttcttcctggtccagatggggatggatctttgctggtttgtttaggtctgcaagtggagcatatggatgcgtttaagaaacatttttacgaggacattgagtcaaaatcatga

SEQ ID NO: 39037 - DNA, 435 bp, Glycine max
  Peptide Sequence Number=SeqID_155815
atgctccaaccatatgggatcaacataggcttaaaggagcactcaaacccggtgacccccaaggcctacactccgaagagtccatcagggcctctccctcttgattcagcttacaacaagagtaatgtcacatcaagtgttaactacacacttatccacaaccaaaactcattcacaatttcacatctcatagtgtcacaatccaccatcacatgtttacacgctcacgtgtctttagacagcgatatcagcatctctagcggttccctgagattcctccagttttttcctctgactgctccgatagagttcccaaacgtcagagagacagagaagggattgaagcctccacttgtactgtcttcgtgtgattcctttttctatcttcatgaatattatcttgcaaatcccaacagtgaaggtgtgcaaaactga

SEQ ID NO: 39038 - DNA, 411 bp, Glycine max
  Peptide Sequence Number=SeqID_155816
atgaccactcttgctcagacttggagcgttctttccttttctatcctcatccccacttcccacacttctgatgtcacttttgacagagccaaactcatttatggcatcatcatgaagatagacatgaatgtagggaaggctaggggtaagagatctgaggccccttccactttagcatcagaggcaccaacaccttcttcttctacagtacccccttcttcatccactcaaattccatttattcctctagtagcttggccaggagaccagccctcttcttctagagggggtggggcctctgcagcccaggagcctgatattgaagagccaccagaaccagcagaggaggagactgatcctgatcagacccatccatctacaccaattgcagagccagaacagcctatctag

SEQ ID NO: 39039 - DNA, 1149 bp, Glycine max
  Peptide Sequence Number=SeqID_155817
atggcagttatagtgagctgctttttaagtgctcagacaaaaaaggttctttttatcggaatcgatggttgccgggcagatgttatgatgtcttccgatacacctaatattaagtcgttaattacaaaatcggtgtattcccttgacggcctttgtgctgctaccacctggagtggaaatggatggagcaccatgctaactggggtatggcatacaaaacacaatgttcaggataataatttcacaaaccctaattatgtaaattatcgcgatttccttacccgtgcagaggcctataattcaaatttaagaacaatctccctcgtacattggtcgcctattaacgatattattattaaaaatgcagatgtaaagaccaatttcagcacagatctggcggtaaaaaatgctgccgtagatgcattgcagaatgataacccagatattctgtttgtggattttgatgacgtggatcacgcaggccactcttatggtttttcttcgaccgtaccacaatatgtttcctcaatgcaaacaacagacacttatatcggagaaattgtaaatgcgatgaaaaacaggtcgacttacaacaatgaagattggctggtagtcctgacaacagaccacggggcagtaaataatggccatggaggaggaaatctctctgaaaggaatatctttacgatctactctaatccgaatcttactccacaacagatcagtaaaacggacatcgattcgaatatcactttcaaccaacttaacttccctgccggtacttatgccaagcctaccaaccaggttccttttaactttggggctaatcaggactttaccattgaattttgggtaaagcctaatgccagcttctcgagtgatcctgtaatgatcagtaataaaaactggaacagcggaaaaaacaaaggatttgttatctcaggatattcgggacaaacctataaagtaaatattggtgatggtacgaacagaattgacctggtaggaggaaaaatggaaaccaataagtggaaacatattgcagtaagttttgatagggatggccttgtaactctctatgaggacggtgtgcctgttacttttgccaaaatgatacaatcggaaatattgattcagggcttccgttaa

SEQ ID NO: 39040 - DNA, 765 bp, Glycine max
  Peptide Sequence Number=SeqID_155818
atgccacccaatgtggtgtacactcccaatgagaatgtaaataactccactcctatactcattaagagccaacaacctcaatctgatcatgcacatgtctctcgacccataggggagacacatgaaatgccccaccacaatctagccaacttcgagccttgcctcggatatgccactgaagggcaagcagttggtgatatacccctgcaaaatactttggaggaccctcagtatcacccacaaccacacctatttcattccatagcaggtaaaaaccctcatgctatgacagaaatgggaaatttggatcatctagagaaaaggctcagggtcattgaaggaggcgaagattatgcctttgctaacctagaagagttgttcctagtacccaatatcatcacccctcccaagttcaaggtgtcggactttgacaagtacaaggggactacttgccccaagaaccatctaaaaatgtattgtcggaagatgggggcatatgcaaaagacgaggaactgctgatacatttcttccaagaaattcttactggggtagttgttacctggtacactaacttggaaccttcccgagtccattcttggaaagacctaatggttgccttgttaggtagtatcagtacaattctgatatggctccggatgcaactacagaatgtgtgcaaaaaggggcacgaatctttcaaagaatacccccaaaggtggagagacctggcagctcaagtggcacctccaagtgggatcctctag

SEQ ID NO: 39041 - DNA, 696 bp, Glycine max
  Peptide Sequence Number=SeqID_155819
atggagagactccgttctgtgcaaagcaagaaacatcattgttgtccaaattcattccttgatcaaatggaagggcaagtagctaaacgcagacgtgtatactccgtggaaccgaaccaaatagtgcaatctatatttactaggaattatttgaatcatttggttccagcgttggtgaagataaaggaaaagagttctgtggaagaagatagaaggcattgtgatgatattaacaatgctgtcaagtatgaagtggacatggcaatggtgttgtcagcacaaggatttgcatggagtaacggccttaaagataagcttcaaagcgatgacgttcatgtcaatgcagctaaaagcactagctttcttgaaaatgatgaggctggtgaaggttcatcatcaaagaatgcttatgacaaaaatgaagttgtactcccaatggaatatttctcttcaaaccctagctcaaagtctaagtgcaaggacatgtcagaaatgaaaagggatttagccagagaagatgatgataaggaggatgaggacatcagcaaccagtggaagaagctgagaaggttgatacccggaggagaagagatgtgtgatgatgaacaaatggtttcagagctagagagttacataagctgtttgcaaatgcaggtgaacgctcttcagtttctgtgccacacacgcgttagttaa

SEQ ID NO: 39042 - DNA, 453 bp, Glycine max
  Peptide Sequence Number=SeqID_155820
atggcacgcagagacaaattatggtcattatgcgcccttttgtcatccagaggcggcgagcccgatgacatgcgaagacaaattatggttattccggacactttttcgccattcagacacgatcgtgtgcgatggcacgcaaagatggtcattctgcgccttttgtcatccagaggcggtgagcccgatgacatgcggagacaaattatggtcattccggacaccttttcaccatttagacacgatcgtgttagatggcacgcagagacaaattatggtcattatgcgcccttttgtcatccagaggtggtgagcccgatgacatgcggagacaaattatggtcattctggacaccttttcgccatccggacacaatcgtgtctgatggtacgcagagacaaattatggtcattctgcgtccttttgtcatccagaggcggcgagctcaatga

SEQ ID NO: 39043 - DNA, 579 bp, Glycine max
  Peptide Sequence Number=SeqID_155821
ttttcaaacctcggtcctctcgactcacatggatttgctagaaaccaattctggacaattgatgattcccctcctccttttccaacaagtacttcgaataaagcctttgttgatttgattcttaaaccctcagaagacgacatcaagatttggcctcacagtgaagtgcgggttgaaggattagagacattggattatcttgacaacttgcagaaaagggaacgctttactgaacagggggatgctttaacatttgaatcagaatttgacaggatatatctcagcactcctacaaagattgcaattcttgatcatgagaaaaagagaacaattgtattgcgtaaagatggtcttcctgatgctgtggtgtggaatccttgggataagaaagcaaaggctatatctgatttcggtgatgatgagtataagtacatgctttgtgtagaggctgctgctattgaaaagcctatcactttgaaacctggtgaggaatggaagggaagactagaactttcaactgtttcttctagttattgtagtggacagcttgatcccaaaagagttattcaaggaagctga

SEQ ID NO: 39044 - DNA, 1422 bp, Glycine max
  Peptide Sequence Number=SeqID_155822
atgattgataaaggcacaagaaccctgctggttcatgccacactcggtaattccgataatcgcttgtctcctggcgtgttagtgaaaggcagcatttctttgcccgatccgcagaagatcgtgagcgtaccggaaacggccatcaactataacgcctaccgggattttatctacgtaattgataaaaatgatgaaaataaactcattgcccgccaggtttatgtcaaaaccggggggcgcgatggcagctacgtcgctattgtcgaaggcatcaaggccggagtacgcgttatcacgtccggacaactccgtatcaacaacggggcacctgtcgaaattgcatcggtggatactctagccactgaagatcaaagcgcgcatagcgtggctcacacattgatctttttaatggggctgttagcgcttaataacttgcccgtacggcaatatcccttaaccgaaagttcgacgcttaccatcaccacacagtaccctggtgcgtcaccacagctgatgcaaggttttgtcacccagacgatcgcgcaggctgtcgctaccgtcgaagatgtcgactatatgacgtcaacatcgacacagggtcgcagcgttattatggtgcgtatgaagctcaatgccgattctaataaggcaatgacccagattatggccaaggtaagcgaggtgaaataccgcttgcccgcagaagcttacgatcctgtaatcgtgaagtcatcgggagatgctactgcggttgcttatgtcggtttttcaagcccgacgatgagtacggcggcgctttctgactacgtttcccgcattgtacagcctcagctctcttctatcgaaggtgttgggagtctggatttgaacggcgggcaaagaatggcgatgcgagtttggttgaacgccgagcaaatggcggcgcgcggcatcgcggctggagacgtttcacgggcgttgctggagaacaatgtacaggccgctccgggccaggcgaaggggctttatgttgtttccgatattcaggtaaatacggatcttgtcagtgtcgatgagttccgcaatatggttgttaaaagaacgataaacggtgttgtgtatcttcgtgatatcgctaccgttgaactgggcgcggcgtcaaccaacaccagcgcattaatggatggcgtcaatgccgtttattttgggctgaatgccgcgccaaatgccaacccattggttatcgtaaaaaaacttaatgaaatactgccggagattaaaaagaacctgccccctgatgtaacggttgcggtgccttttgaactggcacgttttatcagcgcctccatcgatgaagtcgttcatacgttaattgaagccatcgttattgttattttcgtcattttcctcagtttgggctctgcgcgagcggtcattattccg

SEQ ID NO: 39045 - DNA, 408 bp, Glycine max
  Peptide Sequence Number=SeqID_155823
atggatggcgcatatttcactgctgtcgcttcgttcaggcagcacatatcgggcattctattattagccgtaggtgctgtactctttacaacgttatgcattggtgttgtcgttcacttccttatcccaacgctcccttgggctgcttgcttcgtgttaggcgcgatcgtttcaccacctgatgccgtttctgcccgggcaattctcaataagtgtgcaaggggcggcagtgctaagttgggctgggatgcgaggtattgtaacaatggcagtagcgtttacactaccggaagaatttcctggtcgagatttaatgttgattacggctttctcggtcattgtggtaaccgttatgctgcaaggtgcctcgctaggctggatgatccggtggttaagaccgcaagataa

SEQ ID NO: 39046 - DNA, 969 bp, Glycine max
  Peptide Sequence Number=SeqID_155824
atggatcccttatccgccttgctcggactgttaagagtcactaactatcattcagccacattgtcgctcggcggcaattgggcattcgattttccgcaaagaggcggtatcaaatttaccgcagtggtaaaaggaagctgcctgttaaaagtggacggcgagtctacccttcaacgccttcatcaaggcgattgctttttaatgacccgaggcgtcccttttcagctttacagcgatacctcactccctcccatggattcaaatgattacattgtgcaccgaggcgagcgtgaaattgctttgcattacaacggcgacgatgttcagctcgtcggcggccgatttgaatttaccggcatgccggcgcgcgtcttgctggagatgctgccgccggtcgtgcatgtgcatggcgaatcgctgcaagcctccgccttacgctggctgcttgaacgtttatctcaggaattgcacgaaaccaaatacgggcgctcgcttatcgccgaacactatgcccacattatgctggttgaagtattgcgcgttcatctcgcgtcacgaagccaccatgatataggctggttttccgcgctggctgacaagcagttgggggcggcgatcgcagcggttcacaacgctttatcgttcccttggaccgtggataacatggcgaatagggccaatatgtcccgctctgcgtttgcccaccgcttcaaagatgtggtcggattatcgcctatggaatatcttacccgttggcggatgttgcaagcctgcgatatgctaaaaaatggtgaattatcaatatccacgattgcatttgagctggggtatcagtctgagagcgccttcagcaacgcctttaaacggataatgacgctatccccccgccattatcagcggctgcccgccaccggaatgcgtattttgccgcctatctcattgacggcctctcctgatatgcatcagtaa

SEQ ID NO: 39047 - DNA, 231 bp, Glycine max
  Peptide Sequence Number=SeqID_155825
atgcaaggttctcaaagaaaccgcgaaggaaggattggaggcttcattctctatcgaatcctcgagataagttttgaagattccgctccaattaaactattcatcttcgtgcggtggtcctacgacaagcaaagacggctcgtggcggtcatcagtgcctgcaacactcgcctgggcgagtttggctcacctgggcgagctgatccagctccaaattttctactttggtga

SEQ ID NO: 39048 - DNA, 573 bp, Glycine max
  Peptide Sequence Number=SeqID_155826
atgtctcttgccactttctttgggaaacttgaagaacatgaaatggaacttatgagactctatcaacatgaagagaatgacaaaaagaagaaaggaattgcactcaaagcctcatcttcttctattcatgaggaaaatgacaaagaagactcaaatgaaaagaacttagaagaagatgatgatttcagtctctttgtaaagagattcaataaattcctaaggaacaaaggaaatcaaaggagaccgaacttcaatccaaagaagaaaggagaagatttctccttagttccaaaatgctatgaatgcaatcaacctgggcacctgagatttgattgtcctatctttaaaagaagaatggaaaaactcgacaagaaaactttcaaagataagaaagaaaagaaagcatatatcacttgggaagataatgacatggattcatcaagtgattcagaaaacgaaatcataaatctaagcctcatgacctgtcatacgctaattttgttcggggactatcattcaaggattctcactagtcaaactgcgttgttcaacaccagttaccacacaagatga

SEQ ID NO: 39049 - DNA, 477 bp, Glycine max
  Peptide Sequence Number=SeqID_155827
atggtgcctaatgccttgttaactaggaaaaaggtggttcttcgggcgtctcatgtcgatctcataattatgaaagaatgcgctttacggtgcccttaccgaacgcgtgccaaagctagagtaatgagtgaaatagaggaggtgcaagagcagatgaaggctgacgtggaggccatgaaagagcaaatgaccacaatgatgaaagccatgatgagtatgaaaaggatgatggaggtcaatgtggctatagtcattgccgcaagtaccgccactgaggtggacccgactcacccttctggctcattcaaaacaagaattccttcccaccatatggcttgcctcccaactatacaccacccaatgttgcacacactcccgatgagaatgtcgacaactcctcacccatgcccattgagagccaataatcccaatctgatcatgcacatgtctctcaacccatggggggcagacacatga

SEQ ID NO: 39050 - DNA, 453 bp, Glycine max
  Peptide Sequence Number=SeqID_155828
atggcaaatgctttgagagttggtagtgttatctcactctgctcccttcggaacacgagaccccatcttccccttctctccaacgccacgcgcttccgttccaagttcccatttttcaccctctcatcgtcgccaaatccatctgggtatccaccatttcgcacactctcttcttcttctgcttccacagatgaggcagtgaccaccgaagccatcactagcaataatgcaagtggtgaagctgagaacagtattaaggatgcggcggggttgcttgacatgagggttgggtgcattctgagagcatggaaacatgatgaagctgattctctctatgtggaagaggttgatattggtgaacctgaacccagaatcatatgcagtggccttgtcaaatacatccctctagaacaccttcagttcagaaggaatactaattgtatgtcgaattag

SEQ ID NO: 39051 - DNA, 531 bp, Glycine max
  Peptide Sequence Number=SeqID_155829
atgaaaaataggatgtggatcaaaggtcttgttctaggaagatggatggttggaggatggggtgtcgccgaaggagaagtatccaagacggtaccatatttctcaacaacatcaacgcatccaacaaatggggataacatcaaatacaggttgggaatggaagtttcaatggaggagcgtttgacagtacatgtgcagcaacaagacatatggagatgggagggagactcaagcggcaagtatacaatggggagtgcttacgagttactcaatagtaatttgtcgatggagagtcaggatgaaacatttaaagcactatggaagataaaagtcccaagtaaagcatccattttcactagcagattgatcagggaaaaattgcctacaaagaataacttaagaaggaggaatgtggaaactaataatgtcagctgtccattttgcagaagtcatgatgaggatgaggatgagactcacttattcttcacttgtgctaaaatcttgtcgttatggtgggaatcgcaatcttag

SEQ ID NO: 39052 - DNA, 204 bp, Glycine max
  Peptide Sequence Number=SeqID_155830
atggagtttgatttagtctttgcctgcgtaaaggtgccaaacaaactgctcaaagttgttcgtgtctctacttcagctcaatatgttgatattctcaccaaagccctctcacccagtaattttgagttgctcagattcaaactcacaatgtgtgattcctctgcttcacttcggcctcaccctgagtttgcaagggagtattag

SEQ ID NO: 39053 - DNA, 1134 bp, Glycine max
  Peptide Sequence Number=SeqID_155831
atgacatcggttactggaaatcagctgggatccacattggtaaatgacttgcaagaacaggaaaatgagcttaagcaatatatggtgcaacttgaaaatgccgaggctgccagggctactttactttcccagcttaaagatgcactgcaggaacaggaatcaaggcaagagcttgttcacacccagttactacacccgataatcagtttaaagtttgtttctccttggtcattgaacataatagatttggaaactccaattcccaagatcctgcagcatatttttaaaccaagattcttggatggccaagctgcacaaggccagattgagcaagctgcaagtatcaggaagaggtttaccgtagcaccagaagctactagggcgttggagcaaaatcttccatcagttcaaccaaacaacactcctcttcagccttcttttacccaaccacctatatcatttgctcctccccaaaccactgaagaagataagaaggcagctgcagctgctgttgctgctaagcttgctgcctctacatcctctgcccttatgcttacatctgttctttcttcccttgttgcagaagaagctgcctccatgaatggtagcttaaactctactgggtttacttcagggttacctgttttccgtccagagaaaagacaaaaacttgaaaaacaaatgcatgcttctgagtttaacagtactgatatggggagctcttcttttctgggcactttacaacaaccatcagtagcaaatgtgccactgacacactcaatcagcttgcaacccataccacaacccaaccaatcacaagctgcatttgcttcaggtcccccacctcctcattcccccgtgaacccaccagcaaatcagtttgttcaatctactggattaatggttgggggaattccttatggatatggatcaaacaacctaccacctccacctccacctcctttacctccacatgtggcaatggggttatcaatggccggcatgcagccatcacagtcacaggcccagcaacaacagccgtcagcaactggaggattttacaggccaccagacatagggttttatgggcaaagccattcatcaacacaaccagcaccagtacctaggcagtga

SEQ ID NO: 39054 - DNA, 264 bp, Glycine max
  Peptide Sequence Number=SeqID_155832
atgaagaacaagattatgggccaaggaaatagtgcttatattgtcacaatgaacgacaagaaccatgtgcttgactctaactttagagagaagagattgaagccaagagatttcagttgtgaccaaagcaaggcttcttcattggagcaggccacaactgtttgtttctttggccaccaagaaacaaggttaggtccaaagaacacacaagcaccagatgtagatctcctgtcatccggatcagaggctcaatcagcatcatag

SEQ ID NO: 39055 - DNA, 522 bp, Glycine max
  Peptide Sequence Number=SeqID_155833
atgacaaggacacatgctaagaaaacaaaggaagccttgaaccaaattcacaagggtgttgctaggtgcacccagcaacattgcaagtgcacccaacacttttataaaatgtgtcgtgtgttatattttatgtttcacgctttctttctttcattttggtctggtttttgccgttcttggtggttttttgcgagtgttgagagaggtagcggttcggtgaaggttaaagtcttatttggtggtgttttaatttcgacggaggatgtaacatacataagaagttctttcgtaagatttttacggaagaacttctttcgtaattgtaaaaagtttcttacggaagaaggtataataattaagatggacgaagatcaatggacgtatgacagtacgatgtctcaagaagttgatatggattttgaaaataaacaacaatgtggtgtgaatcaaccacatgtcgattgttcggatgtttttaatacttctcagggttgcgttgtaggtctttggtacccgagatga

SEQ ID NO: 39056 - DNA, 1443 bp, Glycine max
  Peptide Sequence Number=SeqID_155834
atggtgggctctgacataaatgggtctgaccctaagtggaaggctagatgggaggtacagccagcatgtaatagtgctagagggttactatgtatatggaatgaggagacattcagactagaaaacaagttgattggagatggtttcatttacctggaagggacatggcatgcagatggtggcaaagtcctgatagatgagggtattatgaaggaatttaatgaatggattgcagatttaggggttgaggaggtgtcctctgtgggacgaagattcacttggtatagaccaaatgggacggccaaaagcagattggacagagttcttgtatccactaaatggtttgctaaatggaaaggaagcacccagcttatcatggatcataacttctcagatcactgcccaattctgttgagatctacctgcgcaaattggggcccaaagccatttcggactctggattactggtttaaggataagtcatttaggaagattgtccgtgacagctggacaacgaatgatttcggtgatatgccgcaaaaaataagaatggagatggagatgaacaagttggaaatagaaggtgagaacaggcaattcaatgatgaaaagatcaaaagggtaaaagaggaaatcagacactttttcaggaagagattcgaagaaactaaatgggagaggcctaaattagatggggattgtggcagcgagaagagcccccgaccggatggattgaatttcaagttcataaaggaattctgggatgttattaaaccagatttgatgcgatttctggatgagttccatgtcaatggagtttttccaaagggaaccaatgcttcattcttagcattgatccctaagaaggtgctgccaaccatcatagacgaacaacaaaccactttcgtagaaggtagacacctgctccacagcatggttattgccaatgaagtgattgatgaagcaaaaaggtgcaataaaagttgcctcgcgttcaaagtagattacgcaaaggcatataactcagtttgctgggagttcctcctcccaactgcggagttcattcctcaaagaggtctcaagcaaggagatccactcgccccattcttgttcaacattgtagttgaaggcttaactggtttgatgagagaagcacaagagaagaacttgtttgaaggatataaggttcaagaaaaatattatgcaaatgacacaattttctttgggacagcaacgtgggaaaatattagagcaatcaaggtgatgttgaggagctttgagctggatgtcgaagaaagtggtggacaaactagtggggcagtagaggcggtttttgtggggtggaaactcagaccagaagaagattgcttgggtgaattggggtacagtttgtctaccatagaagaaagggagtttgggtataagggatttatggatgtttaa

SEQ ID NO: 39057 - DNA, 672 bp, Glycine max
  Peptide Sequence Number=SeqID_155835
atggcttcacctatagacataggaatagacagaatccaaagcaccatggatgatagaatatggaacttggttccaaaggataggcgagggcatgcgattggtcaccggtcatatgatcaaaggtgccaaaatcaagtatccaagtgcctagagtggagaggattgggagacaaaggctataggattaccaaactgagccacaacagtcacagacgagacaagttgttgggcagctcagaaccagaggaaatcaaaatactcagtggcagaaagtcacatcagcaggtggggcatagtctcggccgatggccagaaagggttgctggagataggggaaggcagttggaaggtctcagcggatgggtcatgctggaaaaaaaaaaagcagatgcagcacctatttggaggctggatgtgaaacacagatgttgtggtggtcacaaaagagcaggtgacgccagaaaaagagaaaggcggcacatggcagcgtatcaagcggtggtaggcggcaggtctgatggcgtaggactcgctggagaagggcacttttattgtggtggctcactggagaaaaagcatcacggcggaaggaaaagagggcatgcaatgaggtgggtactgttcacccataaggaactccactattgcagatcacaaccgaaagaactctga

SEQ ID NO: 39058 - DNA, 113 bp, Glycine max
  Peptide Sequence Number=SeqID_155836
atgtgggacatcccctttatccctgaaccaaaccaaaccttgacatatgtcatgtccagccgttctacaagccttgagccgaaatcccaacttaccataaaccttgacccagg

SEQ ID NO: 39059 - DNA, 600 bp, Glycine max
  Peptide Sequence Number=SeqID_155837
atggtggaggcatctgttaattggttcccccgatggaaggaaggaagagttggagttctgtcctcatgtgaggggttctcaaacatccccttgatgggaacgaggggctgtatcaattataatctcgtccttgccataagacaacttggctaccccatgagaggagcgctgtcggaagaaagtatcatgcccttcatcgcacggggtttcagtgaccccaaagcaaggatatttcaaggggtccgaaaggcatggagcgtggtgaaaagaaaggataaggaacttaggggaagcagcaatgggatcatcggaagctatcacaagtggctgaaagctcggacgcaagagttagtttggctcccgaagctaaaggcatcaagtgaggaagaggctgaaacccctgaggagagtaaggaggtgcaagccttgaaggcagaacttgaaagggcgcaagcaatcaaggaaaagttcaagatgatagctatcaaggtctggaaagaatatgatgaactgagagacatcaatgtggccaccgctgaagcattggagcgggaaacaaagagggcacgaaaggaagagtggggccgaaacaagttctga

SEQ ID NO: 39060 - DNA, 735 bp, Glycine max
  Peptide Sequence Number=SeqID_155838
atgggcgatgacatagccgagggcgctgtcggccagggtggcgagcaggccgccgtgggccatgccgtgcatgttgccgtgggccgcgccgatgcgcatggccagcacgtcgtcggccgcgcgccggtagaagccgcccaggtccgccaggtggcgcatgaactggctgctgggttgccacggcgcgaagccggcggggatggtgtctgtcatgggatgcgcaaagccgacggcgcgcgccagcgccggccggtggcgaccggtgagcggacaatttcggcggcggctggcgcggccgtcgcgccggcgctacattctgcccatgcaatcgtccgtttctccgccccacgcatgaaccgcatcaagacctacggcatggccgagcgcgcggattatttcgacttcgatatccgggcgcagcaggtgcgcgagccgctggagcagccgcaccggcacgagtatttccagatccagcggcaccacgcggccgtttccgcgcggcgggctgagcttcgtgctgccgtaccgggtgcacctggtgccgcatccgcccggcgcgcgctacgtcatcatcaatttcgcgcagcgcttcctgtggccggagctggcggtggacgcgctggacctggaggacgtgccggtgtcgcaggcgccggcgctggcgccgttcctgttccaggaatacctggattttcgagctggacgcgcaggggctggccgaggccgagacgctga

SEQ ID NO: 39061 - DNA, 237 bp, Glycine max
  Peptide Sequence Number=SeqID_155839
atgagaacagtgaagaggaggaaacggaggaaggaatctacgcttgctgagcctcggaatgtcgttggcttcggctcaaagaacccttgtgctttttttatggttctgccggacttgatttggacaagaaatgagcaagatatggcagaaacaagaattgggaacgagggggcagggacatgttgtaatcgattacagcatttggtaatcgattacacccttcttaactgcctgtaa

SEQ ID NO: 39062 - DNA, 156 bp, Glycine max
  Peptide Sequence Number=SeqID_155840
ttttcttctgagggcagggattacggtaagttgggattttggctcaaggtttgtagaacggctggacatgatatatgtcaggatgttggtttggccagcggttcagggaaaaaggagatgtcccacattatttccatgatacacatgcagcactga

SEQ ID NO: 39063 - DNA, 384 bp, Glycine max
  Peptide Sequence Number=SeqID_155841
atggagtcaggtgacatgcgggggtaccatatggttatccgcacctttcgtcaaccaggggcaaacgagcctgttgatgcgcaaagactaacatcgtcttctacaccttttgtcatcctgacccatggagtcaagcgatcaagttcgatggcgtggggaagtgtcgtggttccactggggcaactgtcataccctaatttcatccgggaaccattgtttggtggcatgcaacctttgcttgaacatctcgagggggtgcaaatagcaaccaaacccacttgcgccttccaggaggttccaacagaaggtggtgccttctggtggaagcaacccagctcgcctgggcaagctgggcggcaaccacctccctcttttctcctataa

SEQ ID NO: 39064 - DNA, 723 bp, Glycine max
  Peptide Sequence Number=SeqID_155842
cgcctaccgctgcgcgcgccgatcgatggcgtgctggtggagcggcggatgagcccgggcatggcggtcagccccgacagcgaacagccgttggcggttattggcgatccggaccgcctgtggttgctgctggatgtaccggagagcctggccggacgcttgaaggcgggcatgcaggcgcgcgccgagctggacaaccgcgcacgcggtttcaaggcggggcagtacgtgcgcgcccaggtggcgttgccggccgagggcggtgtctcgctgcccgatgcggccgtgttgttgatcgacggcaagcaggtggtgttcgtggaggagggcaagggccgcttcgtgcgtcacgcgggcggcctgctgctgcagcagctggcggacagcgcgcctgccgccgccagcagcggcacggggcacgccgccccatgatcgatcgcctgattgcctactgcctgcgccagccgctgatggtcatgctggcactgctgctgttcatcggcgctggcattgccgcgttccgcgtgctgccggtggaagccttcccggatgtgtccgacacccaggtgacagtggtgtcgctgcacccgggccgtgccgccgaagaggtcgagcgcgaggtgacgatgccactggaagtggcgttgtccggtgctggaacgcctgcagggcgtggaactgccggaaggggtaacgccggaactggaggcgatgagctcggcg

SEQ ID NO: 39065 - DNA, 366 bp, Glycine max
  Peptide Sequence Number=SeqID_155843
cccggcgtctggaccaactccgtgtgcggccacccgcagtcgggcgaagagacagtccaggcgataattcgccgctgccgctttgaagtgggcgcggaactgaccgatatcaccgccgtcgcccctgaatttcgctatcgggaaaccgacccgtccgggatcgtggaaaacgaaatttgcccggtattcgccgcccgcatcaccaatgacgtgacgataaacgaagatgaagtgatggactatcagtgggttgagctggacgcgctattccgcgcgctggacgcgacgccctgggcctttagcccgtggatggtcatggaagcgacaaccgcacgcgaaaaactcaaagccttcgcggcgcaataa

SEQ ID NO: 39066 - DNA, 495 bp, Glycine max
  Peptide Sequence Number=SeqID_155844
atgaatcatttttcaaggctgccgtcccttgggacggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggcatttgaagcaagaggcagcaaacatgatgaagaagattggccttctttaagctgcaaaacgtccctcaggaagttcttgggggaagggttgggggcttgctccattgaggaactgcaatggatacaacaacagttggagaggagtttaagtaatgttagagccagaaagatccaggttttcaaagaacaaatcgagcaactaaaagaaaaggaaaaagtcctacttgatgaaaatgccaagctcactgaaaatggcacacacatatga

SEQ ID NO: 39067 - DNA, 642 bp, Glycine max
  Peptide Sequence Number=SeqID_155845
atgggcaaaccagtgaggataaattgtcaaaaggcgattctgatgatgaaatgctcagctctgttctcaagacctttgtctactagccctaatcagttagacggtgacaaaataacaggagctaccaatcataaatccgtgaattttgagggaagcctgttggttcagcacctattcaaggaccacagaagatgtagttacatgatagccaatgcactggataaggatggtaaattcactactgcccaagtctctcgaaaacttaagcagcttggtttgtatcttcctctgcccaaggatggtaaattcacttctgcccaaggatgggaatgccattacatcaatgctgaatatttgttgagcgagcttggtcatttgaagaaagaaagtgccaattggaataacactctgggagatgaagaaattggttcatccccagcaaaggtgtggacacaggatatcaaaaacaagcttgatgttattaaaggctttgcacctacctttggcagtaacagtgacaaagatgatcataatggggagcaattgatggaagatgaatctcaaattgctctaaggagaaggaagaaacttgttcttgatggtgatttggaaagacaaatcaaagatctccatgagaaatag

SEQ ID NO: 39068 - DNA, 1305 bp, Glycine max
  Peptide Sequence Number=SeqID_155846
atggatatcctacaaacttttcaaataatagaggaggtagagcaagcacttgtggctcttttggcagagggagttctgcaggcagaggcaatttcaataatggtaaacaagcatgatcaagtgacatggatctttgattctggtgccattgatcatgtcatttcatccttgaaatattttgcatcctacagagaaattattcccattgtagttaaacttccaaatggccaacaaaccacaaccactttttcaggaacaatacaacttactaattccttgtttccctatgatgtcttatatctgccacactttactttcaacttggtctctatatccaagcttgcttcgtttcttcgttgccaactaattttttctgttgacaaatgtctaatacaagacataatcaccaagaagatgagtggtatagttgatgcaaaggatggactttacaaattgaagattccatcaagtaccattacatcaaacagaaagaaacttgacccaagagctttaccatgtgtctttcttggatttaaacctcataaaaagggttatataaccttcaatcttaagactagagccattgaaatttctagaaatgttgttttttatgaagattattttccatactttgatgattctagtgtcactacagatcttcatcttttatcacatcctcctttcatttaccatgataattctcctgctccattacaacctcccacgtcagttcatagtgagtctgaatcatctatttcccattttgcatctgttgaatctgatgtttcaactcatgacacatcatcttcagtagagaaccaacctcaacttcgtagatctgatagaccaaagtcaagaccaaaaaggttttttgacttccaaaccaagtttgcatcaactatgacctctcattcttcagttgcaaagatcaccattgtcagaatactattagccatagctgcaactcaaaattggcaccttaagcaactagatgttaacaatgcatttttgcatggtgatctcaatgaagaagtctatatggtgctcccccctagaatgaaagcttccaaaccaggccaagtatgccggctgcaaaggtctctctatgaccttaaacaggccagtagacaatggtatgccagattgtctacttttcttatttcacagggctatcaccaatctgtttcagattattctctctttactatgcatcaaggttcatctatcactgttctagttgtttatgttgatggcatagtcctttctggaaatgatcttgctgaaatcaaacacatcactatgtag

SEQ ID NO: 39069 - DNA, 1620 bp, Glycine max
  Peptide Sequence Number=SeqID_155847
atggctaacaacgcagctgcttgtgctgagagagcaactagtgatatgctcattggtccagactgggcaatcaacatagacttgtgtgatatcattaatatggaccctgggcaagccaaggatgctttgaagatactcaagaagcgtttgggcagtaaaaatccaaaaatacagcttctggctctttttgtactggagacccttagtaaaaattgtggtgaaagtgtatttcagcagatcgttgagcgagatatcttacatgaaatggttaagatagtaaagaagaagccggatttaaatgtgagggaaaaaatactgattttaattgatacatggcaagaagcttttgggggctatggagtttatcctcaatactatgcagcatataatgaattgaagtctgctggagttgaatttccaccacgggatgagaatagtgtaccattcttcactcccgctcaaactcagccaattattcattctgctgcagaatatgatgatgctactattcaggcttctcttcagtcagatgcatctgaccttagctaccctatcccacacactcacactgttaataatgatgctgtgtggccagcagttatgctgtcaatgactgctataccatgtttgctagagattcaaaatgctcaaggactagctgatgtattgatggaaatgcttagcgccttgaatcctaaagaccgtgagggtgtgaaggaggaagtgattgttgatcttgttgaccaatgccgttcgtaccaaaagcgtgtcatgcttcttgtgaacaatactacggatgagcagcttttgggtcagggattggcactgaatgacagccttcagcgagtactcagtcgacatgatgacattgtgaaaggaactgctgattctggtgctagagaagcagaaacttcagttctgccacttgtaaatgtaaaccatgaagatgatgaatcagaggacgattttgctcaactagcccataggtcatcacgtgatactcaggcgccgaatcggaaaccagcctatgacaaggcagaacctgggaggataaacccactcattcccccaccaccagcatcaaagaagccagtctactctggcactggcatggttgactatctcagtggtgatacatacaagacagaaggatctcctgaaaactcagaacccacttcaattgcagctccccttcattctagccctaatccaacctcatcaactattccatctctgtcttcctctcgtcctcatgccatgagtacctcatctccaattttgagcagccagcctgtgtatgatgaacaaccatcttctgtggacaaatcttcagagggtctgcctgcagctccctgggacgctcaatctcctggcatcattccgcccccaccttcaaagtataatcagagacaacagttttttgaacaacaaggtgcatctcattcaagtagtggatccaattcctcgtctgacagcttggtgggacaaactcaaaatctctccctgaattcatcctccccaaccaaacaacagaagccagaagatgcccttttcaaggatcttgttgattttgcaaaatccaaaacctcatcatcttccaaacccaataggtcatattga

SEQ ID NO: 39070 - DNA, 939 bp, Glycine max
  Peptide Sequence Number=SeqID_155848
atgcttgatccaagaacacaccaccccaccaattcttttgaattgtacgacgcagcaccacacaaacctcacacatgggaagctacgaacagttccggtttgtggccttcgaaaccagctttcgaggaggtagaggttgatgattccggaatatgttcacctcccatgtggacaacgagccccgcacgccgcaagaacaacctccgtagcctctcgccgacgtcgaggacgcaagccatagtgagtgggcagagggagctcatggagatggtgaagaacatgccagagtccaactacgagctctctttgaaggacctcgtggagcaccacagggttgttgatgctactagacaagagaaaaatgtggtggaagagagaaaaaacttgagcagcgtgtacatgaagagagaaaaaagtagaaaggttgataataataataagatggcacaggtgaagaggaacgggaacattgatcgtggagggttctacctcaaaatgggtcttccttttccttttggatcaaaggacaagaagaagaagatgaaaaagaaaaatgagtccttggggaatagtagtagttcgagagttacccctaaaccttctgatggatcagcaaagggtggtggtgttgttgataaggagtggtggaagaagagtcctttggcgtgtaaagagagtgatagtggtgaatcaagtatcaatagtgagagtgggaagagctccggtagcagtagtagcaatagcagcagtagcaggagtaacagcaggcgtgagaacagtggtaagcgttgctggcctttcatccgcagacccaaaagtcgaacacaaaaaaaacatgataaggcaaatacaagcatgccaatagaaggtgtaccaagtttcgattttgtatctataccctcagatgaatatgaacctgcatttggaaactttttatga

SEQ ID NO: 39071 - DNA, 375 bp, Glycine max
  Peptide Sequence Number=SeqID_155849
atggaattccagacaaggttgttctttgagggcatgtcattgaagagagagtgggctagtaggacgtgtccggacttggcaaacgcggaaacgaccatgttccacgagaagtgggtgttgcgaggcatggcattgaacaagtggagggcattgtgggtgtgtcctgagttgaggtgggcttggacgagggagttccaagagaaagagtttgtttggggcatttcgtcgaacaagtgggacgcatcgtggagatggccgcagcgtgagtatagctggagaagccgatttgccacggcgacggaggagtttaggatgccggttataaggaatgccacgtggagttgcctcccttcacgaatggaagaccaggattga

SEQ ID NO: 39072 - DNA, 2910 bp, Glycine max
  Peptide Sequence Number=SeqID_155850
atgaactcggacccttcacaagaagtgcaccgtgatgcctttgtgctggccacttttcttggcgcttgtgctgacttgctggctctcgactgtgggaagcaagtccatgctcatgttttcgttgatggcatggggttggagcttgacagggtcttgtgcagctcgctgattaacttgtatgggaagtatggtgatttggatagtgctgctcgcgttgagagttttgtgagggatgtggacgagttctctttgtcagctttgatatctggttatgccaatgccggcagaatgagggaggcgagaagggtttttgatagtaaggttgatccatgttctgtgctatggaattcgattatttcaggttgtgtgtccaatggtgaggagatggaagcggtgaatcttttcagtgcaatgcttagggatggtgttcggggagatgcgtctactgttgctaatattttgagtgtagccagtgctggggtgactcatgatatagtggttgctagtgctctgcttgatgcctactccaaatgtcaaagcccttgtgaagcttgcaagctgtttagtgagctcaaagattatgataccattttgcttaatactatgatcactatgaataagctggacttaaaaatggacaagtttagctttgccagtgttatcagtgcttgtggcagcaaatcatcccttgaacttggtgagcaggaatggagcaagggaaggcgctgccggacgacgaaaggtgggaatgatggctacggagacgccgtcggaagcgtcggaagaggggagaggagggagataaagcgagcggagaaaaggggtgggacagtgatgccgccgtcggttatcatctccgacgacaacgcacggtgggcagcggcggaggatgggagagagggggtggagagcacggagaagaggaaaatgggagaagtttcagtggggaggggtatactaaatactctctcaaatgtgcctgtggcttgtagttgtgggcgtggcattagcatttgcatgtacccattattgaagcaagcgcaaggtccttacccttctctttcatgttgctctctcctcctaaaccactgtttatctcaaaaatcccttaactgtgtcaaaatcgtgcatgcccacttcctcaaattgggacttaacacctacacatatttgggtaatcgctgcctcgacctttactctgagttcggccacattaacgatgcactgaaggtgtttgatgatatttcccacaagaactccacttcctggaacatttgcctaaaagggttgctcaaaagtggccagcctggcaaggcctgccacatgtttgatgcgatgcctgttagagatgtcgtttcttggaattccatgatttcgggttatgcttcctgtgggtatttaagtcatgccttggagctttttgttgaaatgcaaggcaccggtgtgagaccaagtgggtttactttctccattttgatgtcactcgtgtcaagttcccctcatgctaagcagattcactgtaggatgatcagaagtggcgtggatttggataatgtagtgcttgggaattcgttaataaatatttatgggaagcttggtcttgttgaatatgcttttggtgtgattatgattatgaagcagtttgatgttatatcttggaactctttgatctgggcctgtcatagtgctggacaccatgagttggcattagagcagttctatcggatgagaggtgctgagttgttacctgatcagtttacgtgttcagtgttgatgagtgtctgttctaacttgcgagacttggacaagggtaagcaggtttttgccttttgtttcaagatgggatttatttataatagcattgtatccagtgctgctattgacctcttttccaaatgcaacagattggaggattctgtccggctatttaagaaacaagatcaatgggattcacctctatgcaattccatgatttcaagttttgctagacacgatttaggggaaaatgctttgcaactttttgtgctgaccttgaggaagaatatcaggccaacagaatacatggttagctctctcctgagttctgtttcgattttcttaccagttgaagtgggtaatcaaatccattctttggttcctaaattgggttttgagtcagatgcagttgttgccaattcacttgtcgatatgtatgctaaatttgggtttattggtgatgccttgaatatcttcaatgaaatgaaaataaaagatttggtatcatggaacactataatgatgggactgacttactatggcagagtgtctttgaccatggacctcttcagggaattattgactagagaaggcatactaccagatcgaataacacttactgcagttctactagcatgcaactatgggttattggttgatgaaggaatcaaaatattttcctcaatggagatggaattcggagtaaaacccggagaagaacattatgcatgtgttgtggagatgttgagtaaagctggtaagctcaaagaagccattgatatcatagaaacaatgccgtgtagaactacctctgacatttggaggtcaattctttctgcatgtgcaatttatggagacttgcaaattatagaaggagttgcaaagaaaataatggatagggaatcacagacatccttaccttacttggtgttggctcaagcatatcaaatgaggggtagatgggattccatggttcgaatgaggaaggctgtggaaaatagaggtactaaagagttcattggacacagttggattggaataagaaataatgtgtacacttttgcgtcaaatcaattacagcattatggtggcaaggatctatatctggtgttgaatttacttgtctgggagatggagactgaaggttatgtctaa

SEQ ID NO: 39073 - DNA, 1827 bp, Glycine max
  Peptide Sequence Number=SeqID_155851
atggaagtgacgaaagaccctaattcagatttcgaactcgaactctacaccatcccaagctcttcaagatggttcgcgtgggaagaaatccacgaaacggagagaacagcgttcaaggaatacttcgacggaaactcaataacgcgaacccctaagatatacaaagagtaccgagacttcatcatcaacaagtacagggaagagccctcgaggaggctcaccttcaccgaggtgcgcaagtcgctggtcggcgacgtcacgttcctgcacaaggccttcctcctcttggagcattggggtctgatcaactacggcaccgcgcaaccttcttccggtgcggacgcagcggaggaggaggaggagcatcgcaaggttcgtctcgaggaaggcgcccctggtgggattcgtgtcgcggcgacgccgaattcgttgaagcctatgttgttgcctcgcaatgggaagagtggggtgaatgcgagtggggcttctctcaaattgccgccgctggcgtcgtactctgatgtttatggtgatttgattaggcagaaagagggcaactgtggcctttgcggtcacaaatgtggttctggacattaccgatgtacacaggataatttcattatttgtattaattgtttcaaaagcgggaattacggggagaaaaggtccacggaggattttgtattgagtgagtcaagtgaaaatagtggtaagcatgacactgtctggactgaggcagaaactcttctccttctagaatctgttttgaagcatggcgatgattgggaacttgttgctcaaagtgttcaaaccaagaccaaacttgattgtatctcgaaactcattgagctgccctttggggagctcatgttgggccctgctcacagaaatgttaacattaacgatgctaatggcatcgtgaacaatgcaaaacaagttcaatcatcttcatctgataaccaagagatttcaaagacaaaggaccaatctcctgagtttacaaatgaaaatgagcagaacggagatgctgtgaaggaaagtccttcaaaaagacagcgtgttgcttccctttcagattccagcagttcgctaatgaatcaggtgggactgatctctaatgtggttgaccctcatatcacagctgctgcagctgatgcggctgtttcagctctttgtgatgaggatttgtgtccaagggagatatttgatgttgacggtgaagaaggtttagagatggagaggtcctctctatcaggaaaccatcttatggagggcaatgattactcaatggtgatttcatgttccttgttaaatgaatgtttgagccagtaccttgtgatagtgcattttagggattttgattggattgatttcctagaagaaatacctttgacactgcgtgtaagagctgccactgcaactgctcttggagctgctgctgcacgagcaaagttgttggcagaccaggaagacagagagattgaacatttagtagcaactataattgaagcacagattgacaaaatgctacagaaggttaaacattttgacgatctggagctattgatggaaaaggaacacgctgaaatggaaaataaaaaagattctatcttgactgaacggattgatgtgttacggagaacatttagatctggagtcactagatggaaagattattcttataacactttagctggaagggtgagagagacggagaccttgtctgggaggtggtggtttgagtggggccccctcatgtcctcatccacgtgggtatctaagccgatggaggagctctatgaggaaactgattttggattggattaa

SEQ ID NO: 39074 - DNA, 1590 bp, Glycine max
  Peptide Sequence Number=SeqID_155852
atggcatcctggttattgggaaggtcgagtaggatcttgattcatcaacatcaccaccttcacaaaaagtacttgcctttcttgttaggaccatttcttaaccataataatagctcttgttcctcttttccatcaactgaaccatttaggtgccgtgatgcatttccgggtaagaactcatcacccaccctcttccgattctcgcgtcatgaatcaaccaaagctgaggcacaattggaattggagcaagatgttgccaccgaggatgagcctaatcaggtcattgattttcctggagggaaagtgggatttacttctgaaatgagattcatttctgagtctcctgagaaaagggtgccctgttatcgtgttcttgatgacaatggtgagatcgttaaatacagcaactatgtacaggttagcaaggaaatgggtgtgaagatgtattctgacatggtcactcttcaaactatggacaacatattctatgaagtgcagaggcaaggtagaatttccttctacctcacccaaatgggggaagaagcagttaacattgcatctgctgctgcacttgctcctgatgatataatattgcctcagaaattcagaacacaacttcctcaagctgttggagctgcttattcccttaaaatggatgggaaaagtgcatgtgcagtcactttttgtggggatggtgccaccagtgagggagattttcatgctgctatgaattttgcagcagtaatggaggcccctgttgtttttatctgtcgtaataatggatgggcaatcagtacacctgtggaagaccaatttcgaagtgatggtattgtagttaagggtaaagcttatggcatctggagcatcagagtagatggaaatgatgctcttgctgtttatagtgcagttcacactgctagagaaatcgctataaaagaaaaaaggccagttttaattgaggctctcacttatagagttggacatcactctacatctgatgattcaactaagtaccggggaactgatgagattgaatattggaagatggcaaggaatccagtgaataggttcaaaagatgggtagaaaggaatggttggtggagtgacaaggatgaattggagcttagaagcagtgtcaggaagcagttaatgcatgcgattcaggtggcagagaaagcacaaaaacctccacttcaggacttatttaatgatgtctatgaccaaataccatcaaaccttcaggagcaagagagactaattagaaaaaccatcgagaagcatcccaaagactacccttctgatgatcatagccctccagcttctgcatcttacgtggtggttgcatgtgatgccactagggaccgcactgaacacgagatcaaactcgttgttgatcatgttcgggccaggcgtgtctttctctcttctggtgacaagttgcttgtgctatgtgtcttgcataagacattagcatgtcccgagtcttttgctggaaccaactttcgtgcaatggaggatgaagtcaagaagaaagttgatgcatatgcaactgagcttttgtcaagttatgaagattttgaaagtgaaggg

SEQ ID NO: 39075 - DNA, 294 bp, Glycine max
  Peptide Sequence Number=SeqID_155853
atgaatgagaatggcatgacatataaaagctgtgagaggagagaagggcacctcagaaacaagggtgttgtaggatggtgtggcattggtgatggacaagagaaaggaactctctggttggtgaaaatgaaaaggcattgtaagaagcacaatgacatgccattgaacatgcataacacagtgcccctcttcatgtttcgcaagccaccattgtcttcttctcaagcctcagagaaagtaaagtggtgtgggaaaataggtgttcttggttcggttcgtttgtgtggactgtga

SEQ ID NO: 39076 - DNA, 2508 bp, Glycine max
  Peptide Sequence Number=SeqID_155854
atggcgctggggaagaattcccaaggcaaggggaggaagttgtcaaactactgttcaaccgtctctgtggctgtgtttgttgcattttgtttagttggtgtatggattgtattgtcatccattgttccaattcagaattcagtcattcaggtatctgagactgagacaattaatgatgatgttaaaaatgtagcaagtgattccaagcaatttgaagacagatctggtgatatatcagaagattcaacacggggatctagccagactaaaaaatctcagagtggtgatagccatccagaaaaccaggatgaccaaaagggaattgaaaaagtgtctgataatactgcagaagaaaaccaggaggttgttggggacaactcagatgaaaagaatgatttggagaagggtctggagaatactattgaggagaatgatcaaatgaggaatgtcaagccgagcactgacgagacggagaaagaatcagatagaagcttaaattcagaatctgaagaaacagaaacttcgaatgatcaaattcatgacgatgaacttagaggatcaatggaaactttagatgaaaaagaatctgacaagagcacaaatgataacaaattagggacagaaaagagtatggatgaagccacacaacaagatgagatggttggcgagactgcggaggacaaaaaacatctgcattcagaggcaacacaaagtactggagggagtaacacagaaagccatgaaaacaatccagcttctaaagaaattttagttactggtacctcatcagaaattttgatcgaaactagcactgaaaatggaacatggtcaactcaagctgcagagtcacagcatgagaaggaatcacagaagtctttggtttctattgacagcagaacatatgactggaaactttgtaatacaactacaggatcagagtacattccttgccttgacaattggaaagcaattagaaagcttcagagcataagccactatgaacatcgtgagaggcactgtcctgatgaagctaccacttgtcttgtttctctgcctgagggttatagaagcccaattaggtggcccaaaagcagggaaatgatatggtacaaaaatgctccacatacaaaactcgttgtagataagggtcatcaaaactgggtcaaagttactggtgaataccttacttttcctggtggtggaacacagtttaaacatggcgctcttaattacattgaattcattcagaaatctcttcccaaaattgcatgggggaagagaagtcgtgtgatattggatgttgggtgtggggtagccagctttggaggctatctgtttgaaaaagacgttctgaccatgtcatttgctccaaaagatgtacacgaggcacaagtgcaatttgcactggaacggggaattcctgccacattaggtgtcatgggcactgtaagattaccctaccccggttctgtctttgatcttctccactgtgctcgttgtagagtcccttggcacgtagaaggtggcaagctgctcttggagcttaatcgtgtattacgccctggaggttactttgtatggtctgctactccagtgtaccaaaaggatccagaagatgttgagatttggaaagcaatgggtgaaattacaaagtcaatgtgttgggatctggtggtaattgcaaaggacaaattgaatggagtggcagcagcaatatatagaaaaccaactgacaatgaatgctataacaacagaataaaaaatgagccatcaatgtgcagcgaatctgatgatccaaatacagcttggaatgtatcactacaggcttgtatgcacaaagtgcccgtagatgcatcagagcgtggatcaatctggcctgagcaatggccactgaggttggagaaaccaccttactggatagactctcaggctggtgtttatggaagagctgcttcagtggaattcactgctgattacaagcattggaaaaacgttatttcccacttgtatttgaatggaatgggtatcaattggtcttcagtaagaaatgtcatggacatgaaagctgtttatggagggtttgctgcggcactcagagccctgaaattgaatgtttgggtaatgaatgtggttccaattgattctccggacacactgccaataatatatgagcgtggattattcggtatttatcatgattggtgtgaatcattcaatacttaccctagatcatatgatctgctccatgctgactctatattctcaacacttaaggaaaagtgcaataaagtagcagtgattgcagaagttgataggatcctgagaccagaaggatatttggtcataagagacaatgttgaaactattggtgagatagagagcttggctaaatctctacaatgggatattaggttgacatattccaaaaatggagaaggattactttgcattcagaagacattctggcgtccaacaaaggttgaaacagttgcatcagccattgcatga

SEQ ID NO: 39077 - DNA, 1494 bp, Glycine max
  Peptide Sequence Number=SeqID_155855
atggagtttgtaacttgtgcattgttccttctattggcatgtgccaccattggttcattccttgcaaaaacaaccagaaaaccaaaccacaatcttccaccagggccttcacgccttcccataatcggaaaccttcttgaactcgggcaaaatccacaccaatcaatggccaaacttgccaagattcatggccctgtgatgagcctcaagctaggaacagtaaccactatagtcatctcctctgctgacatggcaaaagaagttcttgtaacacacgatgaatctttgtcaaaccgtcccataccacaatccgtgtcagttctgaaccacgagcactatagcctagcattcttacccgtttcacccctttggagagagatgagaaaaatatgcaatggccaactatttgcacacaagactcttgatgaaagccaagacgtgaggcgcaagatagtgcagcaactccttagtgacgtgcacaagagctgccaaattggtgaagcagtggatgttggaagacaagcatttaagaccacattgaatttattgtcaaacaccattttctccgaggatttggttctgtctaaaggtaccgcgggagagtttaaggacttggtgacaaatatcacaaagcttgttggatcaccaaacatggcagattatttccctgtgctgaagaggattgacccgcaaggcgcgaaaaggcaacaaactaagaatgtcgccaaggtgttggacatcttcgatggcttgattaggaaacggttgaagctgagggaaagcaaaggttctaacacgcacaatgacatgttggatgccttgctcgacatttctaaagagaacgagatgatggacaaaacgatcattgaacacctggcacatgatctgtttgttgcgggcacggatactacatcttcaacaattgaatgggcaatgacagaggtagtactcaacccagagatcatgtcaagggcaaaaaaagaactggaagaagtgataggcaaaggtaaaccagttgaagaatctgatattggtaaactcccttacttgcaagcaatcataaaagagactttccgtttgcaccccccggttcctttcttactccctagaaaggcagaaagagacgtggacttgtgtggcttcaccatcccaaaggacgcacaagttttaattaatgtgtggactattggtagggacccaaccttgtgggaaaatccaactttgttctcacctgagaggttcttggggtcaaacgttgacatcaaaggtcgaaattttgagcttgcaccctttggtgctggaaggcgcatatgccctggaatgatgctagctattaggatgttgcttttgatgttgggttctctaatcaactcctttcaatggaagcttgaagatgaaattaaaccacaagatgtggacatgggagaaaaatttggaattaccttacaaaaggctcaatcccttagagttgttcctattaacataagcaactaa

SEQ ID NO: 39078 - DNA, 1023 bp, Glycine max
  Peptide Sequence Number=SeqID_155856
atggtgaagcaaactgtatcatcagtaatcactctgcttcttcttctcttcattctaagggaagtggaaggagataaacggtcacatgaggtaaaactatttgtttttggagactcttatgttgacacagggaattcggtgaactcagcatcatataagcctcctagtggagacacttttcccggtaaacctgctggaaggttctctgatggttgtgtcctcaccgattacattgcctcatatttgaaaattaaatcccccacaccttatatatttagaaattcctcggaactacaatatggtatgaactttgctcatggagggagtggtattttcaacacttcggttgatggaccaaacatgactgtccaaattgactcatttgagaatctaatcaaagaaaaagtctatactaaagctgaccttgaaagctcagttgctctagtgaatgctgcgggtaatgactatgctacatttctactacgacaacatgggagcatacaagatatgccagttttcactacaatccttatcaggcaaatgtctttaaatcttagacgcatccacagcttgggaataaataaaatagctgtcgggttattagagcctatagggtgtatgcctttgttaaccgtggcatcttcatatgagaaatgccttgagcctttcaacttgatctcccaaaatcacagccaaatgctactccaaattgtgcaagaactaaacaaggaattgggaaaaccagtgtttgtgacactagacctttacaactctttcctctctgtcatttcaactatgcagaaaaggcattctgaaaacccaacattgatgaatccgttgcaaccatgttgtgagggtgtgagtatggaatattcttgtggaagtgtggatgagaaaggagaaaagaaatattgtttatgtaagaaaccagagctttcatttttttgggagggagttcacctttctcaaaatggttggtatgcagtctatatgatgttgtattcttctctcagcaaactttga

SEQ ID NO: 39079 - DNA, 1314 bp, Glycine max
  Peptide Sequence Number=SeqID_155857
atggaaaaaaaatcgcgtagtattagatgcggtggacacgtgggagagagtgtaaggaaggaagttgcatccatccatccatcgtcgtcgtcgaaccaattaaccaaaccctatctagcttcttcgcattctcattcactctgcccccaacccaaagccccattccataaccctaaccctaaatccgaatcttctcatgaaacctcccacgcaacactccaccgtttcagaatcagtttctccatggagggctctgcagaggatctcggagcccccgagtcatgggaggtcgctgatttggacgagtccatgaaccgcttgaacctcatggtcttttccaacaacgattctaagcaacctcaccagcgtctcgccgattataatgacgatgatgctccgctgccgccgcctccttcgtccagttgcgacgaggtttccgatgacgccatcaatcaggttgatcagttccttcgcgaagccattcagaaccctcgcgaacggctttcaagtagatctaataagctgtatgttcttagaatgatatatcttgcccaactgattaaggcttctaatttgatgaattcagtcttgaggatggagcaagatgttgagaattttattcgtgatcctactcaacagcagcttgaatttaagcagcttccaacatcctatttaaggctggccgcacaccgggtggctcagcattactcattgcagtcaatggttttactggataatagtttaccagatggttctgggtcaagaattattgttcgcaaaacctctgaatgtaagcttccagttatccgccttgcagacatcccagtaaaattatcaccagaaaacagtgctgtcatgaaggttgcaatcaaacagaggccgcagaagtggacacagattctcagcaatgcaaattcaaactcaatgaagaataatagctctaaaagtgtggaggagagaaaagaggaatataatagggctcgagctaggatttttaattcaagtaataatgatggtactgtaggtgggaagccagaatgtgagtcaaggcagcaggataactcattgcatagttccttggttgttcctcgggtggaagataaatcagcttctgtatctgatgtcacttctggtagggggctggttgagtcttcaactaataccaatagggctagaagtaggatagagaaggagccagttggtaggtacaggcaaaataatagggtggctatatttcgggaccgagaggttgaccgcaaagatcctgattatgacaggaactatgataggtatgtgcaccttttaccatgttag

SEQ ID NO: 39080 - DNA, 2224 bp, Glycine max
  Peptide Sequence Number=SeqID_155858
tgttaacattccttacccatttggtacagctgaggactgctacttgaacagcaacttttatgttgcgtgtaacacaagtcacaaccctcccaaaccatttctgtggaatgtcaccaaaagtattgagatcttagaggtttcattgaatggccatttgaggataaaatcccctgtagcttatgtgtgctatgatgaaaagggtgtgctagtggattcagggaattcatctatgactttgcaagcattccccttctcatacacccagaacaagttcattggaattggatgtgacaccctttcaagcatcaatgcaacaattgggaaaaactactcagctggagggtgtttttcactttgtagtagtgtagaaagttcagccaatggttcctggtttggcgttggtttctgccaaacctctatcccaaaaaacatcttggcatatcaagctcgtgtgctgagtttaaatttgatgcatagggatatgaatattccttgtagctactctcttttggtggaagaagactctttcaagttctccactgatgacttcatcaaacttcagaagagaaaaaccgctcccacagtgctagattgggctgttgggaatcaaacatgccaagaagctaagaagaatttgactagttttgcctgccaagaaaatagcaagtgtattgactctgacaatggaccagggtacctttgcagatgcttagaaggttatgtgggaaatgcataccttcatggtggatgccaaggtatgggggagggatgttgtacacagccttacccttgcatatgcaaagaggctgtttccggattcccacaaagttatattgatgagtgtgccaatctgagtctaaatgactgttcagatctttgcattaatctacctgggagctataattgttcttgtcctaagagcaaggggtaccagggagatggcagaaaaggaggaagtggctgcgtctcgaatctacaacatgtggttaatcagattgtgataggcactggcataggccttatgctgttgttaattggtagtggctggctataccatgtgtttcgtaaaagaaaaagagtgagactcacaacaagatatttcaagcaaaatggtggcttaatgttacagcagcaaatttcaaacatggaaggatcatctgagagagccaaaattttcactgcaagagagctaaagaaagccaccgaaaactttcacgagagcagaatcattggcagaggaggatacggtacagtttataggggaatacttccagatgaccatgttgttgctatcaagaaatcaaaactagtagaccacagccaaaccgaacaattcatcaatgaagtggttgtactgtcccaaattaaccacagaaatgttgtcaaactcctaggttgctgtctggagacagaaatgccacttctggtttatgaatttgtgaacaatggcaccctctttgaccacattcacaacaaaaacaccacacttccttgggaagcacgtctaagaatagcagcagaaacagctggtgtgcttgcatacttgcattctgctgcctccataccaatcatccatagggacttcaagtcaactaacatactcttagatgacaaatacacagctaaggtttctgactttggaacctcgagattggttccacgtgacaagtgtcaattgacaacgttggttcaaggaactctagggtaccttgaccctgagtactttcagagcagccaactaaccgagaaaagcgatgtttatagctttggtgtcgtgcttgcagagttgctaaccggaagaagggcactttcttttgacatgccagaggaggagagaaacttagccttgtatttcctttcagctgtgaaggatgattgcttgttcgaaattgttgaggattgtgtgagtgagggaaatagtgagcaagtaaaggaagttgctaacattgctcaatggtgcttgaggcttagaggggaggaaagacctaccatgaaagaagtggcaatggaattggatagtcttagaatgatgacaacaacaacaactacatggattaatgctacatcaaattcaacagaatatgtgattggtgaaaggtcaggtctaagtctaacagaaacaacagactatgctaattgtcattatacttgtaatacatgtgctgggcatgaggatgaaaccatttgcaacgatgtgatgtcaccgatatgggatggtcgatga

SEQ ID NO: 39081 - DNA, 2049 bp, Glycine max
  Peptide Sequence Number=SeqID_155859
atggctgtgtgctcaataatgctgctgctgctactttttacgcttctcattgcagcaactaaaactcaacccatgtcaaagccaaactgtccaacaaactgtggctctgtcacggttcccttcccatttggcatgactgaggattgttccttggacgcttcatttctcgtctcctgcaaccgaacctcttcttcatcacatgtccttttcttgccacaaaccaacataagcgtcctaaacatctcactcaatggcgaactgcagatttcatggccagtagccagcgactgctacgccgaaagaggtaaactcttgagtcaaacaatccaagacctaagtattacaagcttccagctctcttcgaaccgaaacatgttcaccgtactcgggtgcgacacgcttggactagtggtgggaaccgattcggatggaaggaactacaccaccggatgtgtgtccctgtgcaacaggctccaagacatcgaaacgaacgggtcttgttccggcaccggttgttgcgagacttcgatcccgcgcgggttgtcggggttctcctacggttcttcgagcgtgtacaaccacacaagcgtgattgacttcaacccgtgcgggcatgcgttcctggtagaacgtggggcctacaacttctcctccacggacctcttcaagttcgagaagacaacgtttcccgctggggtggattgggtagtgaagaaccaaacgtgccaagaagctaagaaagaggtttcaagttatgcgtgtaaatcagaaaacagtgaatgttaccattcattcgagggatctggttatctttgtagctgctcaaatggtttcgaaggaaacccttacctacttggtggttgtcaagatgttaatgaatgcatgggatccacggccgattgctttgatggggcaatatgtaataaccttcctggtggttataattgttcatgcccggaaggatttgaaggagatgggaaaaatgatggatcaagatgcagtccgaaatctagcaccaattcaaggaaagcgatcatcatattgataattgctttgagacaagatcctaggtcaaaggagggccaaggaacagtttacaaaggagtattgctagataatagaattgtggcaatcaaaaagtccaaaatcagtgatccaaatcagattgagcaattcatcaatgaggtgattgtgctttcccaaatcaaccataggaatgtggtaaagcttttgggttgttgtttagagacagaagttcctatgcttgtttatgaatttattcccaatggtactatttatgagcaccttcatgattttaattgttctctaaaacttacatggaaaacaagactgagaatcgcaacagaaactgctggggccttggcttatttgcattctgctacttctacaccaatcatacacagagatgtgaaaactacaaatatattacttgatcacaatctcattgcaaaggtttctgattttggagcttcaagaattttcccccttgatcaaactcaattaaccactctggtgcaagggacattagggtatctcgacccagaatactttcatacaagtcaattgaccgagaagagtgatgtttatagttttggtgttgtcctagcagagctactgacaggaaagaaggcactttcatttgataggccagaggctaatagaaaccttgcagcgtactttgtttcttcaatgaaaacaggccaattacttgacattgtggacaactacatatcacatgaggcaaatgttgaacaactaacagaagttgccaatattgcaaagctatgtttaaaggtgaaaggagaggatagacccaccatgaaagaagttgcaatggaacttgagggacttcaaattgtgggaaagcatcgatggggaagtgttagttcatcttcagaagagacagaaaacttgctacaaaaagcatcatctgttctcgctggtgaagaaggcattagtggaagtggaattaattctggttttgatagcttaaaccgattttcagtgtctttgggtggtggaagatga

SEQ ID NO: 39082 - DNA, 1254 bp, Glycine max
  Peptide Sequence Number=SeqID_155860
atggctgattctttattttaccaatacatgatgtccttctttggcatatttggtatgtgtgtggaatataatgaggaaattgttggaattttcaagatggtggtacttccactactgggtcagctctcagatgagtatggccgtaaacccttgctcctgattaccatatccacggctatatttccctttgttttacttgtctggcatcagtctgaggaatatgtctatgcctactatgtgcttcgcacaatttcaaatataatcagtcaagggagtattttctgcatttctgttgcatatgcagcagatgttgtcaatgaaagcaaaagggcagcagtatttggttggattactggtctcctttctgcttcacatgttctgggggatgtactggcttggtctcttcctgaaaagtacatttttgcggtttcaatagtactattgacttcttgtcctgtttatatgaaattcttccttgttgaaacggtgataccggctccgaaaaatgatcgtgagtcaggttgctgggctaaaattgttgatgttccccgacaaagatatatatctatgaggagagctgcggaaatagtaattttcagtcccactttgaggggcatggctcttgtgtccttcttttatgagctgggaatgtcaggcataagcagtgttttgctgttttttgacagtctcacaattcctgtgcagtactatttgaaagctgtttttggttttaacaaaaatcagttctcagaacttctgatgatggtgggaattggttcaatcttttctcagatgttgttgcttccaatactcaatccattggttggagagaaagttatactctgctctgccttgcttgcatcaatagcatatgcttggctctatggattagcatgggcaccttgggtaccatacttaagtgcctcttttggtatcatctatgtccttgtgaaacctgccacttatgctattatttcaaatgcgtcaagctcaaccaatcagggaaaagcacaaacatttattgctgggacacaatctatatctgatttgctatctcctattgctatgagtccattgacttcatggtttttatctagcaatgctccttttgaatgcaaaggttttagcattatatgtgcatccatatgcatgataatttctctttgttttgcttgcttgctgaagccagctgatactagttcgagtaatgacatagagggaagccaagagaccccgcttctgactgataattga

SEQ ID NO: 39083 - DNA, 342 bp, Glycine max
  Peptide Sequence Number=SeqID_155861
atggcaccgccccatgtaccaacatcgttggttgcgtcttcactaccaatgactaagtccccacctcaccaaaagatccctttccaccacaagatggaccaagtcaccaatcgccacacaaatcaatcttcaaccaatcaaataatcaattattcatttattccatttaactgtgtatctttcgggacaggtggttcaaggattgaggatgggatcgcagtttcatgcaagatggaattactgccattgttggttctggtgcttgggttgttcgctttagggatcgagaatgagtatctttggatttgtgataagagtcgtggggagtgcaaggccatttag

SEQ ID NO: 39084 - DNA, 663 bp, Glycine max
  Peptide Sequence Number=SeqID_155862
atgggatcaaatcaaacacctctactcaagaaaaggttctatcaagtcaaaatcaagagcttagaggtcaccagtttacaagagttggggcaattgatgggtcaacttcaacagcaagccttccgcaaagcctatggtaagatttgggacttagctacgatagaagtctctgtggaagtgattgcatcccttacccagtattatgaccaacccctgaggtgcttcacatttgaggatttccaactagtgccgactatggaagagtttgaagaaatcctgggatgtccactgggaggaaggaagccatatcttttctctgggttctatccctccatcgctagagctaccaaggtagtgaaaatctcggcacaagagttggaccgagtaaagcaaaacaggaatggggtagtcaaagtaccaaggaggtgtttggaggaaaaggcaaaggccttggaaaatcaagtggaatggacttcttttattgacatcttggcgcttttgatcttcgggtttatcctctttccaaatgtggaagggttagtggacctagcactattgacgctttcctcgcctttcaccatagcaaggaaagcccggtcatcgccattttggccgacatggatgacacgtttgaccggaggtgtgaaaagagcggcgcaataa

SEQ ID NO: 39085 - DNA, 270 bp, Glycine max
  Peptide Sequence Number=SeqID_155863
atggagagtatgggaagtgataaaggtctatctttcctcaggcataatacgcggatgatgctcatcaacctcgatcattggctacagcaaatactcgctgtctggcaatcattgtcagatcaagtttggcagcaggatgctttcatgttgctcgtatgcctggtcacgtgcctgttgctatttctgagtggtaccgtgctcggcctctttgtgcaatcgctatggggaatttttatgtccggtcgccacgcggacgaagagcataagtag

SEQ ID NO: 39086 - DNA, 465 bp, Glycine max
  Peptide Sequence Number=SeqID_155864
atgttgcgtgtaggggatttgcaacgttctattgatttttacactggcgtgctcggcatgaagctgatccgaagccaggattacccagatggggagtttacgctggcatttgttggctacggtaatgagtatgacaatactgtgctggagctgacttataactacggtaaaaccacttacgatatgggcaccgcctatggtcatatggccatagaagtggaggatgcctatcaagcctgtgaacttgtgaaagccaaaggcggtaaagtggtccgtgaggcggggccgatgaaacatggcacgattgtcattgcgtttattgaagaccctgacggttataagatcgagttcatccagaaggggaccattgagtctggcggtcaccagtatgaggatcatgggccagatgtggctggtgaactggcggcgctctatcagcagttgagtacggctaccacgaagtaa

SEQ ID NO: 39087 - DNA, 1053 bp, Glycine max
  Peptide Sequence Number=SeqID_155865
atggcgtcgataggtggaccacagattctactgcactctccttctccatcgttgaaactcaaactgaaactgaaaccctcatcatcatcctttctcctcttcccaaaacgcattcctcgtcgcaccttctgctccatcaattcgaattcggcgcctcatggttcgagttccatcgtccccaacctcctccattacctgaaccactcctgtacccaattccacgccacagccgaagctaaacaacaattactcgccgccggtttccacatgctcaacgaaaacaaagactggcacctcaagcccggcgggcgctacttcttcacccgcaacatgtcctgtttgatcgctttcgccatcggagataagtacaatgtcggggacggttttcacgtgatagcggcgcacaccgacagcccctgcctcaaactgaagcccaaaacggcgtcgtgcaagtgtaactattccatggtgaatgtgcagacttatggagctggcttgtggtacacttggtttgatagggatttgagtgttgctggaagggtcattctcagaactggccataattcttttgtgcataagcttgtcaaagtcgatagacccattttgcgcattcccacactcgccattcatctcgaccgcacagtgaacctggatggttttaaaccaaatctagagactcatcttcttcctttactctcaatgaaacctgaggacacttctttggaatccaactccaaggagaagaatagtgccttgtcatccaaagctcatcatcatcggctgcttatgcaggtactgtcagatgagttgaactgtgatgttgatgacatagtgaatattgaactgaatgtttgtgatactcaacctagctgccttggaggtggaaacaatgaatttattttttctggaagattagataatctggcttcaagttattgtgcattaagggcacttattgactcgtgtgaatctcctggtgacttagcaagtgaaaatgcaattcgaatggttgctttatttgacaatgaggaggtgtttctttatcttgcttaa

SEQ ID NO: 39088 - DNA, 963 bp, Glycine max
  Peptide Sequence Number=SeqID_155866
atgcagaaaacatactctttctccttcatatcctctagtggcagtgatagtgcctgctacttagaagctgacgaagttgacaatgaagattccatttccctctcccttgcccctcctagccagcaccaattcaaatccaaggtctctaacccaaaacactcttctactatgcctgatcaccaccagcaaaaccctgacctcatcagtggtgtaacagtggccctccacattggccttcccaccaccaaaccttcttctcctactccgattcactgtcgatattggatccctactcctcaacaaatcctcattgggcccacccagttttcttgcactgtctgtaacaaaaccttcaaccgtttcaacaacatgcagatgcatatgtggggacatggatcgcagtataggaaaggagcggagtcattgagagggtcaaaagcaggttcttcaatgctgaggctaccctgctattgctgtgaagagggttgcaaaaacaacataaactatcctaggtcaaagccactgaaggatttcaggaccctccaaacacattacaagaggaagcacggagggaagccattcgagtgcagaaagtgtcataagccatttgcagtgagaggagattggagaacacacgagaagaattgtggaaagctttggttctgcgtctgtggttctgatttcaagcacaagaggtcccttaaagatcatgtccgtgcattcggcaatggccatgctccacataacttattgagtgaagaaagagagaatgaaggtggagatgatgatgacaatgaagtggtgtacgttaggctcttttttttcgttgtaactaggacttggattgatccattaaaagattgtaccttgtctgtggtggaagaaaaggagtgcaagacaaacagtgaaatgaaagctaaggttcttgcattaaagcttgaagtggcagtcttatcaacttaa

SEQ ID NO: 39089 - DNA, 324 bp, Glycine max
  Peptide Sequence Number=SeqID_155867
atggatgtgaagaggaagaagaagagaaggggagtgagtggtttaagtttgaaaaaaggaagggacagtcagggaatgtcttttgcttttagtgttgctctttcacttttcagagtgttttatttgaatttgagtaccggggacgggttccgttgggaactagtaatggtagggtctacgtctttgtgtgtactgtgcaatgccacaacgttttgggccaactcatctactacttcgatcagtttgacaaaaggggtgctttctggaagcaaaaaggatgcaggaagcaatagcctaggaagctgtgtggcccaacaaaggtaa

SEQ ID NO: 39090 - DNA, 999 bp, Glycine max
  Peptide Sequence Number=SeqID_155868
atgggttgctgcgttagcaaatgcaggcccgaatacaaaccctcccaagaagaacaacaacaacataatcaacaccacttcaacttcaaccacgttcaacacaagcttccaatctcatcacaaactccaccaccacttccaccaaccctttactcctcaacaaaaatctcaccctccccaccttctccaacctcttccacttcctcaatctcctccttcacatgcaccacttccaacaccatctcttcagcctcttctttatccaccgcttcctcttccttgagctccaaggacaggtccttctctaacgagttcctctggtcgtgctacaaagacaaccctcacatcatcactcgcatcaactctctcagggatgccacctctctctccttcttgccaccaactaaacctaatagaaagcttgtaaacataaacccctcaccgccaaaacccaacttggcttcactgaataagcgctctccgccaccacaatcgttttccatgccacagaagagggttcgatcaaattctccaacgaacctaacacgacagaagagtttccgaaaggacacggagaggtctattactattaatcatgcttccaacgtgcagagtaggtcgctaattaggtcaccctctcccagcagaagattcaatggagacaaatgtgaaagtgctaatttggctacaacgatgaatagttccaaggttaatggtgttataagtggagttcattcgaattctcatcattctgttttgtcttctaggaggaaagagagtgttaaagcggcgagtcccaataataattgttcacgaagagtatttcattctggtttgagaaacactcgcgagacttcttgcactttgggattgggggttagtcctaaagttgatgaaaccgtggttaaggatgtggtgtctgactatgacatggacttaactctgatggaggatattgacaaccctcttatctccttggattgtttcatctttttgtag

SEQ ID NO: 39091 - DNA, 711 bp, Glycine max
  Peptide Sequence Number=SeqID_155869
atgttgaattcgtacaaggttgatgattcggggctgcgccagcactaccattcggagtttcgctctcctccgatttggttaggttccttgggaggcagagacaccaaggtggtggttgcagtagtgaaactgacgaatgaaaattcacgacgaccttattcaacttttgaggtcattgctgggtacttgtggcggtgtgtgagtaaagcacgctatgaaaaagggaaaagtgaccaacctacgaggttgtccgctttggttaattgtaggaaccgaatgagaccaccacttcctgatgggtatgcgggaagtgcagtattgcccacagtgacacccacatgttcctttgctgaaatcatgcaaaatccttcgagttatgctgttgggaacgttggagaggcaattgaaagggtgactggagagtttgtagagtcggcacttgatcacatagcaaaggagaaagacataaatttggtgaagtacaatatttattaccctgccccacctgtgcataagggacattacaaggggaacccgaacctttttgttgttagttggatgaatttttcgtttaagaatgcagattttggatgggggaagcctgtgtattttggccctggctacatgaattctgaagggaaagtaattgttatgaacagggctaatggttgtggccattgctttggaggcatctcacatggatggtttcaa

SEQ ID NO: 39092 - DNA, 276 bp, Glycine max
  Peptide Sequence Number=SeqID_155870
atgtccttacacctcagcaatggaaaagcgtgtttacccaggatggggggtgttgatcctagtatcagagctgaagtttggccattcctacttggagtctatgacttggacagtacaaaagaagaaagagatgctataacaactcaaaatagaaaggagtatgagaaactccgcagacaatgccgccaactactaaagcacagcaatgggagctttaagttaaatgaaataggtgaaatcaactatgaaggagatagtgcaagttttatcatgtga

SEQ ID NO: 39093 - DNA, 309 bp, Glycine max
  Peptide Sequence Number=SeqID_155871
atgtcactaagtgatgatcatagtcatggccttatgaaaggtcacgagtatctatcatctatgtcttctctcatgtttttaatcagcataagtagattatatcttccatttcttgtacagtgcatcgacagagtagtggaattgaaaattccagtaatcctccaaagcttcgtaggaatgcctctacttcatgtcatacaattagcacttcccaatatggtccttcagatccagtatgctatatgtgcttccttacaatataatgcttttacggtagtgagtttagtaatagccatgttttcagggtga

SEQ ID NO: 39094 - DNA, 708 bp, Glycine max
  Peptide Sequence Number=SeqID_155872
atgcctttcaggttgcattcaggacaaaggtatttcactgatttctcagttggtgttccacttcccaatgtttctctcactcaaaagtcatacgaaattcacgcggagggttcacattcatacacattgcatacatgcaggctgtgtgcgtttcgggtatgttttaatcattcctccaacacggataagataactgccatcatgaatgactttaacaagcctggatgtcttgttccaataggattgtatctcagtggcacaaaatatatggtcattcagggtgaatccggtgttgtcattcgagggaagaagatctacctactttttacgacacctgcaacaaagacggttcaaaaccgtcgtagaaagtgctttagaaccgatgtaaaatcctctttttgtagtagtgtaagtgtctcttccaagaggttagttaagaaggaaagtcattttgaaataaagaaaaatattaaagaaacttcccctcttagacaacttccacatcttctcatttgtaaaaagacacttgttagcactgccacacctcttgggctagaggctatttctcaagtaaaggagttgttggatgagggtttggttcgtgtcgagggaaggagcccagagtatgaagaacctcgggatttgaggtcaaatcctttccaaggtggaggggatgatgcaatcctaccccccaagggtattggatag

SEQ ID NO: 39095 - DNA, 251 bp, Glycine max
  Peptide Sequence Number=SeqID_155873
atgctggcgctcagtgctgacggcggtgaggaggccggagatcatgtggatgtcgcgaaaggtcccgaggatggcatggcagctcctgatgaagtggttgtaggtccgtgggttgtcgtagcgccgcacgacagaccacacggtggagaccgaggcgtcgatcttctgcaccacagcggggcaccactggtgcggggacacgacgcgggtgtggtggctgcgagccaccacgtcgggaacaatcgtggaaa

SEQ ID NO: 39096 - DNA, 663 bp, Glycine max
  Peptide Sequence Number=SeqID_155874
atcgcgctttacgacacccttaccagacacgtgccaaggctagaataataagtgaaatcgaaaaagtacaagaacaaatgaaggctgatatggaggccatgaaggaaaaaatgacaatgatgatggaagaaatgatgagcacgaggaagatgatggaggataacactactacaattgttgttgcgagtacaactactaagatggacccgattcacccaatcgcttctagtgagaatatcgacaattttgcacctgcactcattgagaatcaacaaccccaatctcatcatgcacatgtctctcaacccatgagagaaacacatgaagttccccaagaccacactctggttggattcggggtttatccaggatataacactgaagggaagaaattttctagcatccctgtgctgaatgctctcggaatatctcaatgttgcccgggccttccacagtacttgagaaagaaaggattgagccatatggaggagaggctacgcgccattgaaggaggaggaaattatgcctttgctgacatggcagagttatgcttggtactcaacgtggttattcctccaaagttcaaggtgccagattttgataagtacaagggaatcacttgcccaaagaatcacccgaaaatgtattgtaggaagatggggg

SEQ ID NO: 39097 - DNA, 186 bp, Glycine max
  Peptide Sequence Number=SeqID_155875
atggcattatgggtcatggcagctcacccaggcaagcgagctggttacttcacccctaagctatttgggggcccaggcaagccagaggctagcctgggtgagccagggtttataaaagagcttaaaatgacacttttgccctcccttttgggtattttccatattctttaccgaaacatggaatga

SEQ ID NO: 39098 - DNA, 204 bp, Glycine max
  Peptide Sequence Number=SeqID_155876
atggagaccatgaaagagcagatgaccacaatgatggaggccatgatgagtatgagaaagatgatggaggtcaatatggctacagttgttgccgcaagtaccgccacagaggtcagggaggcgaagcattgggaagtgtgggcagcccccattttgtacagttgttcccttagcaagcattcaattggttctctaacctcttaa

SEQ ID NO: 39099 - DNA, 474 bp, Glycine max
  Peptide Sequence Number=SeqID_155877
atgatcaacagatgttgtctttgtacggataatcacttaggtatatccgcctaccacctgacgtgtgagtcagaatcaacagatgttgtctttgtatggataatcacttgggtatatttgcctgccacctcacttaaggatgttgtgagaccaaaagagtctcgatcagaagaagctgacatctccggaaagggcgcagatgactacattggtctccgcttgtcaatcagacttggggatggggtggtcgacaaaaatggggcttttgctcctatgtatcctcaatttgagatgaggaattcagacctaagtagttcttgcgagcggtgtgagactaaaatagtcccgggcgaggatggacattctcaccctaggtcaaggtttatggtgagttgggattttggctcaaggcttgtagaatggatggacatgatatatgtcagggcgttggtttggccaacggttcagggataa

SEQ ID NO: 39100 - DNA, 294 bp, Glycine max
  Peptide Sequence Number=SeqID_155878
atgactgaaaaggccaagaggattactaattgggcttgggcaattaagttgggggttggggtaggaatggagagggcagaacaaattggaggaggcaaagctgtggccacagtcctagccattggcacagcaaatccacccaatttcatccttcaggaggattatcctgacttctactttcgggtcaccaatagcgaccatttgcaccgcttgaagcaaaagttcaagcgcatttgtatgtttctcatatttgcatcacattctcttgcatatatttttctgataactctttga

SEQ ID NO: 39101 - DNA, 1572 bp, Glycine max
  Peptide Sequence Number=SeqID_155879
atgcaggatgtgacgaaaccatgtgatgtagccttatgcaatacttcagatgattgctcccatggacagtggggaaatattgtgctaaagcatttatatcagtcattaggtgatggcaatggcggcatagaggggtgcataagggaagcacttattcattatcctaaacataatcataccactacagttatggaaacttttaaaattgacaaagatggacaagaatgctctttgcaatttgagccactttctcatagaacagagaaggaagctaatgggcatgcagatgtcatgtgtaatggaggttctagtgaatcacctgaccatggtgtgactgagatgtgtcagcgtgtgctctgtaatgttttaacctcagaaaaattcagttcattatgtaaggctttacttgaaaatttccagggaatgaagcctgaaagtgtacttgactttaccgtcatgaattcaaggatgaaggagcaagcttatgaacaatcaccaacactcttcttgtcagatattcaacaggtttggagaaagcttcaagacgctggtaatgagattgttgctcttgccaagagcctctctaacatgtcaagaacttcctactctgagctggtgggaattccagcacagagcacatttcaagatgagaagcaagtggaatttgactgttgcatgaaaccagaacagacacaagcatgtgctatgtacaaaatttgcagttgcaagtgttgtggagagaaggcagatgacacagactgtttggtttgtgattcatgtgaagagatataccatgtgtcctgtattgagcctgcagtgaaagaaataatacctcacaaaagctggtattgtgccaattgtactgctaatgtgattgaatctctccatgagaattgtgtgctatgtgaaaggttaaatgatgcaaagaccctggatgatgtaattggtgatggaagctttcctacaattgaggaaacacaaaatgaatttgaagagaattcaaattgcacctctgatggaattcaagtttccataggtgaggaaaaaacacccaattgcaagatatgtgaaaatgaagtggatggtggaaaaataaaaatatgtggccatcggttttgctccaataaatactaccatgtaaggtgtttaacaattaatcagttgaagtcatatggtcattgttggtactgcccttcttgtttatgccgggtttgcttaactgatcaagatgatgatcggattgttctgtgtgatggctgtgatcatgcatatcacatctattgcatgaaacctccgcggacttctattccaagagggaactggttctgcagaaaatgtgatgctggaatacaagcaatccaccaggctaaaaaggcatatgagtttaacaagccaagaagaaatggtgaagatgctgcaaagccaaatgccaatcttgaaaagaaacacaacaataaacgtgcacgggaattggaaagtggtggagcaatggacatgcttttaactgcagccaatactctgaattttgaagagaaagaggcggcaagccacatcaagttacagagaacatga

SEQ ID NO: 39102 - DNA, 783 bp, Glycine max
  Peptide Sequence Number=SeqID_155880
atgaagtgtgcggtgtgcttaggcgagtttgaagagtgtgacatgataagaaaaactgttaagaagcaacctcagagtaaacatgtccaatgtcggactctccagcgtcctcctcctcaggcccccatcatagccatcaacgacgccaccctctgcctcgaaggcaaccaagaagtgatcgataagtgcccttgtccttgtttactcgacggtgaaggagaatgtggcagtggagggtgtgacgatgcacttatcgataacttggtcgtttctgcaaagcaggaaggcaccaaagacgacaacagcgacgggacccaaggaggaggacgctgtggagttggacacatggacacaagacagaagcaacctcagagtcaacatgtccagtgtctgactcctcaatgtccacctcctcaagttcccgttgccgccatcagtgacacctgcctctgcctcaaaagcgaccaagaagtgatcaataagtgccctgactttgtttactcaaccgtgaaggagaatgtggcagtggagtgtgcagtgtgcttgagcgagtttgaagagtgtgacatgatgaggcacttatcagtcccttccttcttggtcatttctgcgaaggaggaaggcctcacagacgacaacagcgatgggcacccaaggaggaggatgttggggagttggacactgaacaggttcactttgaagttgattgaatcatgggagtattcatctatcatagctccttttaatcccatgttgatgcattttggtgcaaaattaaaataa

SEQ ID NO: 39103 - DNA, 819 bp, Glycine max
  Peptide Sequence Number=SeqID_155881
atggtacggaatcggagaaggatgcctccgcggcggtgcacggcgtctatgggcagcagcaacgggagcgagagcgatgcgtcagacttggtgatgcggtgcctctcgtgcgaggaggaatacgacatggacgactcgggaacctgcagggagtgctaccaggaggccaacgaggctgaggaggagctccgccgcgagatcgaagagctcaaatccaaagtctccttcctcactctcccctatcccaatctaaacgcttccaccgccgatatcatcctcgttcccgtcgacgactccgacgccgttcccattcccgctcacaagcaccttctggtttttaggagtcattttgaaatccatgctagggaggttagtcgctctcctgttttcaaagcaatgcttgagaacgatatggcagaaaggcggagtggcaccatcaagatttctgacatatcatatgatacccttagtgcttttgttaattatttatacactgctgaagcgtcccttgataacgaattggcctgtaacctgttggttttaggagaaaagtatcaggtgaagcatctcaagacatattgtgaaaagtatttgatcgccaaaatgaattggaataaagctatttctaactatgcctttgcatatcaatacaattgcaaacaattacgaagtgcgtccttggcagtgatcttggacaacatggacctgctcactcaaaatgaatgttatgcggagctggtggacactaatcctcgtcttgttgtggaaatatatgaaacatatatcggcaagcaattaaatactgcaggcgcattttag

SEQ ID NO: 39104 - DNA, 258 bp, Glycine max
  Peptide Sequence Number=SeqID_155882
atggaatcgctgaagaagagagtggaagtggaaggtggtggtggtggtggcacgggtcacgctcagttagttaatgggacccacactctacgtcacgtgataccaccacgcgtcgccaccgtcgccgccgcctccgccatcgccgtaggttgcaccaccaggttccaaacatccaccgtcgcaagcgagactcacggagtgacgctagagggatttattctacattttgtggcggtgaatatttgctaccagctatag

SEQ ID NO: 39105 - DNA, 162 bp, Glycine max
  Peptide Sequence Number=SeqID_155883
atgtcgttttgtgttgtcgcagacagagagcttgagagagtgagtagtactaaagaagaaatgaaccacgactttggtttggtttggtttggaagtactagaggttggttcggcttaaccgtcgtttgttcgttcggcatcattacccatctacctttttag

SEQ ID NO: 39106 - DNA, 564 bp, Glycine max
  Peptide Sequence Number=SeqID_155884
atgggttcctccctcggcgacaacttcaaccttctctctcctcaacagcaagagctggttaaggtgctactggataacggccaagagcacctgtttcgcgattggccagctcccggcgtcgacgataaccacaagaaagctttctttgaccagttgactcggctcgattcgagttaccctggtggtctggaatcatacatcaaaaacgctaaacggctcttggctgattctaaggctggcagaaaccctttcgacggctttacaccttccgttccaacgggtgagactttggcatttggtgatgagagctacatcaaatttgaggaagcaggtgtacttgaagctcggaaagctgcgtttgttcttgttgccggtggtcttggcgagcgtttaggatacagtgggattaagatatatactcagattgaggaggccgagccacccccaatactagtgcccagtggcatgttggggttgcacagcctacccaaacgattactttacatgcctagacagcaagcagttttacttttacctagtcacagttactcaattagcccttag

SEQ ID NO: 39107 - DNA, 279 bp, Glycine max
  Peptide Sequence Number=SeqID_155885
atgcagacaaagaagaatcccaagctccaccaacttcatccaaaccaaattcacaaaaacgagtcttgtttctctgcttggcattacattttggtgcagacttatttcaaccccgacgaacactggcagggccccgaggtcgctcatcgcatcgcctttgggtacggtcacttaacatgggagtggaaacaaggtatcccaagctacttgcatcccttcatcttcgttccgctttatagcctcctcgccttactgcatcttgataccccatggcttatg

SEQ ID NO: 39108 - DNA, 468 bp, Glycine max
  Peptide Sequence Number=SeqID_155886
ccattagaagagaatgagcatgtgattagaagtatgactgaaaatgtaagtcagtttgtcagattgattgtgaaggaatgcattaactgtatcccgatgagagccatgtttgattgtgatggctacttagccaaaaagctgaccatgtgcttgaatgaattatcccttgtacccacatcatccacaggaagcgtggttcaaagcaaatttgtcccaaatttgggggaggcactgggtaagaatggaagtggtcaaacatcaatgaggtccttcaatggtgattttccaccatggagatgcagtagacggcaaaggagaataggagaggggaggcaccatccactagggaataagccatggaagaaggagcttcaccaccaaaaatgtgccttggataagaagcttgaagaggatgctttaatggaggaaaagaaagaaagaagggggagcacgaaattgaaggaataa

SEQ ID NO: 39109 - DNA, 345 bp, Glycine max
  Peptide Sequence Number=SeqID_155887
atgcaaagcaaggatggacccctaaggatgtatagaatgaattcaaagcttaaaaatagaaaactaaccggtcgaagaacgacgaagaacggacgaagaacgatcacgaaatcgatcacggaaatgctacggaagcattacggaagcgcctcgaccttgatttttcttcttctttctcttctttcggatgtgggctccattggagcttgtaggcctaggatcctcttcatcaatggattcctttgcttcttggaagataaatggcagcggaatggagaaggaagagagagagaggagacgccacttcaaggagaagatgagtctagaagaagctcaccaccatag

SEQ ID NO: 39110 - DNA, 291 bp, Glycine max
  Peptide Sequence Number=SeqID_155888
atggtgactagtaggaatttgaacgctccaggggcttttggtattggtctcaatatgtccattccccacatgatgaaaggccaaggggagcttaagctatggaggttgtcaggaaggggtgtcgaccctgagtgtcaaccaatagtagccgacacacaccactttggttgcaagggaacgtcccccgatatggaggtcgtagatcccttgatgaagctctcacatgacatagtgcatttgttggttgttcaggaatttaagcaatggtattgtcgaacctcttttgaatag

SEQ ID NO: 39111 - DNA, 783 bp, Glycine max
  Peptide Sequence Number=SeqID_155889
atggaccttgcaaggagtctgtcgtaccatgtcaatgtttcccctttgagggacgtgggaaaacgcgacatgggattgcatcattgttggtgtagagatttgccgggtacgttcataagtggtgtgagtagagtgctcatcgctctgggggcgtcttacacgagcctccaactggttgtgatcagccttaagctttctgagttcctcctcatggcgtcactcaatctctgtaatacgggtttggagttattggaaagtgtccttgtctgtcatggttgttggaagaagggaatgttttatcggggtcccatagtaagcgccaaatgtacttaccaaaatctaaagctgaccaacatcaagggtcgacatagccttggtgtgagtagagtgctcatcgctctgggggcgtcttacacgagcctccaactagttgtgatcagccttcagctttctgagttcctcctcatggcgttggagatgtctaggagtggcttgcatctgaggccagactatgttctaaccattagtgaagagagttattggaaagtgtccttgtctgtcatggttgttggaagaaggttggagatgtctaggagtggcttgcatctgaggccagactatgttctaaccattagtgaagagaggtcgtggggaatattttatcggggtcccacagtaagcgccaaatgtacttaccaaaatctaaagctgaccgacgtcaagggtcgacatagccttaagagcttcgaatccttgtttgtaagggctattacggaggtgtaa

SEQ ID NO: 39112 - DNA, 423 bp, Glycine max
  Peptide Sequence Number=SeqID_155890
atggaaaaaaagaacacgaaaaggggaatgtttaatggaacctatggtcgttatgatgagaacacgaaaaggggaaggtccctcatcgttaaccctaacattgtgatccttgtatgtgttctcgtcgcagatgcaaggaatctcgatggtgtcatcgactttaagaagcgaggttccctaggcatctttagctacgccctgccaattaagcgtgaggctgatctcatagccgaggatgattttcccctagcagaagttgacgtatgcctcgctatcgagaaagcgaagcgatgtcgttttgaggaagaggttacactcatcatgaagaaggcatcgtggaccacaccaagggtcatgcgcatgcttgcaggatgtgctctgctctcgcaactctcatcgtgggagaaaacaagaagaatgtaa

SEQ ID NO: 39113 - DNA, 204 bp, Glycine max
  Peptide Sequence Number=SeqID_155891
atggtgatggtggtggtggtggtgatggctaaagggatggagaagcaggggaacaacaccaagattggaaaactgagtggcaatggcattttgcatagagagcctgaactgctcattttcttgcctttgtcactcagtgaagaagggcaacctcatcagctacggttgcattggattcctctggagtttcgcccatggaactag

SEQ ID NO: 39114 - DNA, 2175 bp, Glycine max
  Peptide Sequence Number=SeqID_155892
atggaggagatgtcaaggttcagaaatgaggtccgacagaagcgggacgaaagagaaggaagcaccaggactgactcacacaagggacccaagtatgagcgttacacacccctgatagccaattgcaccactattcttgaagagtccttcaacatggaggtacccataaaactacctccgccgcttcctcctagacccgggcctgacaatcacctagtaggagcaagaccagaggacatcaagaggaccaacacagaaaccacaatgccgatagaagaagggacaaagcagaagatagagggagatagaggcatcactagcaaagacatgaacgacaacctcaagaagaataggaaaacaaacctacccaacaaattagagttaggcatcaatcccatcaaccaggatgaccccatggttgtctccattgtgattgctaatttcatggtgtccaaggtccttattgaccaagatacctcctacttagttttgatgggcaggaaaacactgaatgaactcagagccatcgtctccatgccgcatctcaagatgaaattcccaaccttgatgggagagatcactactattaaggcagaccaaaagcaggcccgacagtggtatgctaaaaacctaaaggtgacaccctatccttccactagggagctaggcaagccttatcccaaagttatgagcttggacgaagggtccccaatccagaccctgatcgtctacaaaggaattctaggagatcaagatggtgtattcgatgtagatccacacgatgacactattaacaaaggaccaaagcctattgaagaatttgtcaagttgcaacttggacttaatcctgggcaatccaacgacaaatggcgaatgtgcactgactacaccgatctcaacaaggcatgccccaaggatgcatatcctttgcccaacatcgacaggctagttgacgacacgtccgtgttccaagtactaagcttccaagatgcctattcaggatacaatcaaataagaatgcacatcccagacgaagagaaaacaacattcataactgaggatgctaatttttgctattgggtctacgtggacgacatggtcgtaaaatcctatagcatagcccaaaacatggcaaacatggaagaggtattaagagaaatccgtaggtacaacatgtacctcaacctagaaaaatgcactttcgggatgcatagccctaccaatgtcgaggaagtccagaggatgaatggtagactagtatctctgtccaagttcctcccaaagctcgcagagaaggtgaagccattctataaactactcaagaaaacagagtcattcctatggaacgaggcctacaagaaaactttcttggccttcaataagacaattgtcacatcgccagttctgagtcgacccaagccaagagtacttctactcctatacctctcagtagttgacgaagttgtcagctcaacccttgtacaacaagacaagagacaccgacttcccatcaacttttccagccatatccttcatgatgttgaaaggcggtaccaaatgatagagaaggtcgccctgacactcataacctcggcccgatgcctcaggccatactttcaagattggtggaacctctatgtggatagagcatccaacgtgaagggaagtagggcaaccatcatccttgaagggcctgacaatgttactttagagcaagctctcaagctcaacttcaaagtatcaaacaatcaagccgaatacgaggcacttatagtaggcctaaagccaataaaagaagttggggccaagaagctaaggtgctacactgactcgcaacttgtccaagggaaagttgccaacagatatcaaaccaaggagacagtacttctcaggtactaccatactgcaaaaactctcattgacaactttaattactttgagatgtaccacataccttgggagagcaacaccagagcagacatgctctccaagctagccaacaccaaaaagacatggcatgtcaaaaccatcatcaaagagacactccaagctccaaccatagacaccaaggaggtcatggaaggagaagaggaggaaccaggcaggataaccccttacaagaatttcctaatttgggggtgttgccaccagacgaaaatgaaacacaatgcttga

SEQ ID NO: 39115 - DNA, 552 bp, Glycine max
  Peptide Sequence Number=SeqID_155893
atggaacaaaacctaaaggaagctccacaggtggacatggatgccatcaacaggaaaaagcagaaaaggctagctagggccataattgatgaagacaaaggtctcaacagttttggtattgctaagaaaattcaaaagatcatgaatgggaaacaaaagaagacgaggaaaaattctcagaggggagaagaagatgaggaattgatagcaagggaacacataactaagaagaggcatgatgtcaaaacaagagctattaaagccaatcccaagattggtgaaaaagaatggtctatctccttcactggcaacaaagagagtgttgtttcatcttcatttggcaatgagtccattgaaaacactcatgtctctcgtctctgcaaacaatactctgcatctagcaagcgtccacctccaccacccattcacttagagaaagagtgcgtaacagtgcaatcaccaaactggatgaggcatgattatgtgcacacaccatctaaagctttcatggctcttccatcagataccatagttcatttacaacctccttag

SEQ ID NO: 39116 - DNA, 291 bp, Glycine max
  Peptide Sequence Number=SeqID_155894
atgggtgccaagcacctcacgaggaccaaagaatggtcgcacgtcgtcgagcaaagatatctaattggaactcataatcttagtctattgttcaaaaaaagagaagattttaggctcacaagtttatgtgatgttgactatgctggagacaaagttgaaaggaaaagcacaagtggaagctgccacttcattggcagtaacttagttacatggatatgcaaaaagcaagtttcaactacgttgtccattgttgaagcagaatacatattagcaacaagctattgtgcttaa

SEQ ID NO: 39117 - DNA, 405 bp, Glycine max
  Peptide Sequence Number=SeqID_155895
atgatcaaagaattttggaggaactttaaacttcatgaatctatgatgtgtcaaaaatctagaatcaaatgggttagggaaggtgatgcaaatacaaatgttttccatggggtggttaattggaggaagagaagcaattgtataaaaggcttggaggtggatagggtgtggtgtggggatcctgtaaagagtattgctaaaagaaattcaaagagaagggatgatcatagtatgcttacttgtgttttctcggaagaagacattaaggaggcgatttgggaatacggtggagacaagagcccaatccttctcccgaatggtttcaactttacgtttcatgaaggttgcaagtgcgaggaatcgacttgggataattatgtgcggatcagtaatgttagaaaatga

SEQ ID NO: 39118 - DNA, 351 bp, Glycine max
  Peptide Sequence Number=SeqID_155896
atggattgctttgagaatgaaggtagcgaagaagacaaaggcaggtggtggtgctcagccagtgctaacagcttgattgggggtggaggaggacaaccaataaacagtcctatgccaaagctacaaaaagaagaggcatttaaggaggttggtggaggcttagactggggaaagagaaagaagaaccagccacagctagctgaaggaaaacatatccacataagggaatgcaaggatggactgttgaacctaaacttctttggctcaaggtatacattagagaaaacaagaagtgtagggagattaggtggtaaggaagcagctgaaggttctattgaagaatttgtgtaa

SEQ ID NO: 39119 - DNA, 360 bp, Glycine max
  Peptide Sequence Number=SeqID_155897
atggagaagtacctgaatagcatatgcataggagagatggggatgattgatgcctccatgatcgctatccgggaagtgttctttttaaatgggttcttttctattcacgtaagacccatgggaaataatttggcattactatctgggaacaaagaagacgatttgaaggagttgctgcaaaatgacaaggaagggcttgtgatgagaatcctgaaactggccaaatacaggctaaaggcccaagtggagaaggacaaaggcccaagtggagaaggacaaagcccccgagtggagaaggatgaaggcccaaaggcagagacactatcaagactattaattgttgctgaaggcccaaactaa

SEQ ID NO: 39120 - DNA, 1689 bp, Glycine max
  Peptide Sequence Number=SeqID_155898
atgctgcgctataccgatcgtgacgcggcgctggccgctatcgctgccgaccaggctgatatgctgtttagcaaagccgggaacactgtgcccgccaacgcccagctggacgcctcacagaatctgctgatcaaccgaccggtggtggtgacccagcgcgatcgcgccatgcagccggtgccttatgcagcgccagtcagactggcggtggaccagcactatctcagcgacagcgtaatccgggcgcaatttcctcaggcgcacatcatgcgttatgcctccagtcgcgtcgcgctgtcggcgctggcgaccggcgaggcggattacgtgctcgataatctgacctccgccagctttttaattgaacgcaactacctcaatcagctggcgctggccgacattctcgccccacgcgcgcaggatgccagtcggctactggtcagtcagcgcaggccggtactgctgcgtgcaataaatcgcgtcatcgcggcgatccccgcagagcagcatcgcgcgatctcacgccagtggacacagcgcccggacatctggcgtctgcagcagccgctggcgcttacggctgctgaacagcgctggctacagcagcacggcagcgtgcgcgtgggttttaatccgttttttgcgccactggcactgctggatgggcgtaaccagtttcagggcatcagtgccgaactgctgcaccaaatccacctgcgcaccggtatcaattttgtcgccgtgccggagtatcacgaagacacgctcctgatgcagcttcaacagcataaaatcgacatggtagccgcactctcctataacgcgcagtggccaggccgttttacccagccgtggctgcacacgccgtttgtgctgattactgccgctaacgcgggtgcacccgccgcgctgcactcgggcttacgtatcagcgtaatgaaaggcagcccggtcattggctggctgcagcaacactatcctgaagtacagctacagctggtggacaacgccagtctcggcatgcagcaagtggtggaaggcaaagccgatggcatggtgcataaccagctgggcgccgcttacctgatcaaacgctatttttccggacggatgcgtattgtccagcgcgtcggcacccagcccgctcacatcagtttcgccgtgcacgctggcgatcccgagctgctaagcatcatgaataaagccctgaatgaaatattacccagtgagatctcgcagctcaccagccgctggcagggtacgcccgaggtgacggccagcagctggccactgtatcgcgcgccattttatgcgctggcgggcgtggcagccgtcgtctccctcgcctgcctgctctgggtgtatcagcgcggccgggaaatccgccgccgccgccgggcgcagcggcaattgcagatcgcccgcgatcgtgccgaccgtgaaaatcaggccaaaagccgctgggttgctaccgtgagccatgagattcgcaatccggtcaacgcgatcatcggcctgctggcgctggaagcgcgtaaggccggtgccagcgaggcgctgctgactgcatggcaatcggcacaggcattaagcggcctggtgggcgacattctggatatggcgaagattgagcgtgggcagctgacgctggcaccgcagtggcacagcatcgcgaccctgtgccagccg

SEQ ID NO: 39121 - DNA, 272 bp, Glycine max
  Peptide Sequence Number=SeqID_155899
gggaagaatctagtgaagagatctacccccaagaagaaggacaacctttaatggttaaggaggagtgtaaggagacacttgttagcattgccacatctcttaggcttgagtttattcctcaagtaaaggagttgttggatgagggggttcccatgaaccctaagagaataaaggtgattcctgagtggcctactccaccaagtaataggtttttccaaagttgggctagagatcctatcccgcaagggtattgggtagaagactccaagtag

SEQ ID NO: 39122 - DNA, 300 bp, Glycine max
  Peptide Sequence Number=SeqID_155900
attcaagagactaaccgcctaataattctttgtcttaacacattggagggtacatcctttgtggtacaagtagagcgtacatctacttggattgtaatactgagaacaagagagggtacatctcttgtggatcagttcaagtggagggtcatccacttggttgttcaaagagaacaagggagggtacatcccttgtggatctttgcttgtaaaggattttacaaggttattggaaatctcaagaacccgtggttgcttggagattggacgttggcacgggttgaggccgaaccagtataa

SEQ ID NO: 39123 - DNA, 228 bp, Glycine max
  Peptide Sequence Number=SeqID_155901
atggcttcatgtttggagaaaaacgacaacgtttttgaggaagaggccattacggaagaggatgttgcagtagatgacgtggcaatcgagggtgggaagtatcgtgagggttttggaaagggagttcgaggtggaggcatttggggattcggcggagaaatcaccttgaagtttctcaggcttaggagtttcgagtccaagaggagacatacactacttgcaaggtga

SEQ ID NO: 39124 - DNA, 222 bp, Glycine max
  Peptide Sequence Number=SeqID_155902
atggctgatattgctcatgccatagagattatgccaattgcactacaacaacaaagtgccactgtgttggagaaaatctttatggccatgacatgtcctaaagatagaaaggttacttatgccacatacacattagttgatgaagcagagttccacaacatagagctcaatagattatggaagatcatggagaatccctcactagggaaatttattatttga

SEQ ID NO: 39125 - DNA, 258 bp, Glycine max
  Peptide Sequence Number=SeqID_155903
atgggtgtcaagtacctcgaagtggtcaaacgagggtcgcatcctaacaatggatggtccccagacgaaattaggacgcagaatggccataatttgtctctacgttttgttggaaacgatcgagcctgggcggcaagatacagaatgaccataatttgtctctacatgccaccgaacacgatcgcccgttttttgaataacaaagggtgcagaatttgtctctgcgcgttcatcacccgcttcgctgctcctgaatga

SEQ ID NO: 39126 - DNA, 253 bp, Glycine max
  Peptide Sequence Number=SeqID_155904
ctccttcttccatggcttattccttagtggatggcgcctcctctcacctcttctcctttgtcttccgctgcatctccatggtggaaaatcaccattaaaggaactcattgaagctcaaagatccagcctccgtagaagccccacaagcaagcttccatcaccccctccagaggatgaaggttggtcttctggccaggccacctgtgcatcaaactccttcatgctcataatggagggcaatcccaagccctaa

SEQ ID NO: 39127 - DNA, 885 bp, Glycine max
  Peptide Sequence Number=SeqID_155905
atggccttccctgtttccagtattgcattgggatggggacgggacagcaatggcaactaccatgccaagtcggcgaagttaagacacgcgcgacatacctcgaagcgcgagcgtggcaatgtcatgcgcatgtgtgaccatctcaggtgttggatacgttccaagccaaattgtcgtggacttgtcgttgggaacacgaacctcacagacccacttgttgttgttcctccatcgcactcctctgtacatgggaatggccaccaccaagcgaactaccaagaaaatcctcgtggacttgtcgttggtggtgatgcatttgattcaatggaggatgtgggatttgtagactcgcttgggcgagctaccattgcccctagtgcccattttcctataaataggcatgctagggaggctgagaaaggttccaaggttaagaagttgagggaattgagagaagagagaaagaaaaagaagaaagaagaggaagcaaagtcgaggcactaccgaatcacgaccatgatcattgttcggcttctgggatgtgcaccggatcgcacaaagagaaaagttccattggctacccttagctttcaagggtatgccctctattggtggacttcccttgttagggaacgaaggattcatggggatcctctagtagagtataggaatgatcttaagagtgcccttaggaagaggcacattccctcctactatgaaagggagcttatggacaagctccaaaggattagacaagggagtatgagtgttgaagaatatagacaacaaatggaactactccttttaatagctggacttagggaagaggaaagaacaagcatagctaggttccttagtggacttaatatggaagtgagggacaag

SEQ ID NO: 39128 - DNA, 384 bp, Glycine max
  Peptide Sequence Number=SeqID_155906
atgcaacctttgattgaccgcttcgaaatacttagcaccctttgttgcacaatatgtgaagtcccaagacgcgccggaaatcaaaagaacgcatggttacgcgatccgtggaattccgtaatgtggcggaaaccaaaaagagatattgttatgcaatccgccctatggccttccggattcttcctccagaaggcggttgcttctggaggaagcaacctggctcacctaggcgagctgggcggcaagctcctcccctattttgctataaatagggggaggaatgaagagggaaagggttcaaccttcttggcacttcgtattttcttaaaattgctgaggaaaattgtttccgtgaagaaaatccaagccgaggcgcttccgtaa

SEQ ID NO: 39129 - DNA, 496 bp, Glycine max
  Peptide Sequence Number=SeqID_155907
atggctactcagttgaaccaagctcagtcccaaaattctgacaaattgccttcacaaactgtgcagaatccaaagaatgtgagtgccatcaccttgaggtctggcaagcaaattgaagtccctccgctagtagcagcacctgcacttgaacctgtcaagcttcattctacacctgcacaaaggagaaagcttcccgatcgtgagggagctaacaaaaaatttcatgtaggtggaccttcttctagtagttctgacttgcagcagcctcttatccctcttccatttccacctagagcaattccaaacaaaaagatggaagaagtggataaggagatcttggagaccttcaggaaagtagaggtgaacatacctctgctagatgccatcaagcaaattctaggatatgccaagtttctaaaggagctgtgcacccacaaaaggaggctcaaaggcaatgaaaggattagcatggacagaaatgtgtcagcattgatag

SEQ ID NO: 39130 - DNA, 327 bp, Glycine max
  Peptide Sequence Number=SeqID_155908
atgccatccactatttgttgggatcgcgcccacaagacacccagtggacctggaggagtccaacagggccctggggtttccaactcttgttacgggcctctgtcagtcctaccgggtgcccatccccccccagcaaggtcatgccattgtgacatagggatcgtgcccgcaagacacccagtggacccagaaaagtccaatagggtcttggggtttccagctctgattacgggcctttgtcagttctacggagtgcccgtcgcccccaacaaagtcatcaggccccctattaatcggactttcatcaagatgtactgcgccccctag

SEQ ID NO: 39131 - DNA, 409 bp, Glycine max
  Peptide Sequence Number=SeqID_155909
tggtttcccagttatcttcaattacttagtgagagcttatcgaattgatgtaaggcagggataccatgtaggaggcctgatcatacaccttaactcactagagcgtggacattaccttgaaggaacgtcggtgactaccctgtcggtagagtttctcctagagtgtatagctcattcgaagttcgacctcatgaaacatagagctgtaaaagtcctctccttccagtcgttcttacagagtgaactgatagagatggataaagggcttcaaggagttctcacttctggccacaccaaccctttcaactccgagatggatttctcaatcaacatcgagaagggcctcccaccccttgaggcaatcctccggattacagacttatccaacaggcgagaatgctggtcctga

SEQ ID NO: 39132 - DNA, 1042 bp, Glycine max
  Peptide Sequence Number=SeqID_155910
aggactacacatcctcacctttagaggactacaagtcctcgccttcaaagggctacacgccctcaccttcagaggactacaggtcctcgccatcagaggactgcacgtcctcaccttcagaggactacaggtcctcgccttcagaggactacaggtcctcgccttcagaggactgcacgtccttgccatcagagggctacatgtcctcactttcatagggctacacgccctcacctttagagggctacacatcctccccttcataagactatacgtcctcgccatcagagggctgcacgtcctcgtctttagagggttgctcgccctcgccttcagaggactacacgtcctcgccatcagagggctgcacgccctggtcttcaaaggactacacgtcctcgccttcagaggactgcacgtcctcgccttcagaggactgcacgtcctcaccatcagaggattgcacgtccttgtctttagagggctgctcgcctttgccttcaaaggactacacgtcctcgccatcggaaggctacacgccctcaccttcagaggactacacgtcctcgccatcagagggctgcacgccctcaccttcaaaggactgcacgtcctcgtcttcagagggatgttcgcccttgccttcaaaggactacacctcctcactatcagaggactacacgtcctcgccttcagaggactgcacgtgttcatcttcagagggctgttcgccctcaccttcaaaggactacacatcctcgccatcagagggttgcacgccctcaccttcagaggactgcacgtcctcaccttcagaggactgcagatcctcaccttcagaggactgcacgtcctcgtctttagagggctgctcgccctcgccttcaaaggactacaagtcctcgccatcagagggctacacgccctcaccatcagaggactacacgtcctcgccttcagaggactgcacgtcctcaccttaagaggactgcacgtcctcgtcttcagagggctgctcgccctcgccttcaaaggactacac

SEQ ID NO: 39133 - DNA, 363 bp, Glycine max
  Peptide Sequence Number=SeqID_155911
atgccaaaagcccaagtgattgattcaagacttcaagatcaagcttcaacaatccaatccaagattcaagattcaagagaagaaatcaagaagcaacaagtcaagacttcatataggataaggtacatcctttgtggtacaagtagagcgtacatctacttgggttgtaagagagggtacatctcttgtggatcagttcaagtggagtgtacatccacttggttgttcgaagagaacaagggagggtacatcccttgtggatctttgcttgtacagaattttacaaggttatcggaaatctcaagaaccggtagttgcttggggactggatgtaggcacgggttgttgccgaaaccagtataa

SEQ ID NO: 39134 - DNA, 612 bp, Glycine max
  Peptide Sequence Number=SeqID_155912
tggttgaaggctcagacgcaagggataacttggctcccaaagctaaagagtccaagtggggaagaagctaaagtccctaaggaaagcgaagaagtgcaagccttgaaagcagagcttgaaaggacaagagtggtcaaggaaaaactaaagacgacagtcaccagggtcaggaaagagtgtgacgagctaagggatgttaacatgaccacgatcgaagccaacaataagctcaagcttcaaagggccaaaaaggacgagtcaagggtggaaagtatgatattagaggataaattgaaggcttgtcaaaggtcaaagataagtttgaccgaacaactaagtaggacgaaagagaatatgttgtcaatcattgaccaatttaaagagaagctaaacctagctgctagccatgggcagagactagaggatgagcatgcaatggtatcagctctacaagtggaaagggaagcgagagagagggtgatagaatcattgcacggggaagctatgaaatggatggatagattcactctcattctgaatgggagtcaagagcttccaaggctgttagtcagagccaaggcaatggcagatgtatactcagctcctgaggaa

SEQ ID NO: 39135 - DNA, 230 bp, Glycine max
  Peptide Sequence Number=SeqID_155913
ttgagccggttcaagcgatagaggtgtcatcctctgaagaggatcttgaagaggatccagaggagttacctcttgaacctgctatggatgcccttgacttacctgtggatgatgaagacccactccctaatgttgattctccagaggatattatgtcagcatctgaggcagactctacagaggagagtggccctagagggacagcgaatagtgacgactcttcatcatag

SEQ ID NO: 39136 - DNA, 384 bp, Glycine max
  Peptide Sequence Number=SeqID_155914
atggatcctattcgaagggtgcataaccgcatggataagctcacactaacccgtcaatttgggatccaattcggttccttaggaggtatcgggaaggaattttggaatagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgtccgaggaaccctagatgctgtcggagtaaaggatcgtcaacaagggcgtactagtgcgtag

SEQ ID NO: 39137 - DNA, 168 bp, Glycine max
  Peptide Sequence Number=SeqID_155915
atgcctacaaatgaagatgctacaaatttggcgatggaagacccccccttaatgatcgtcctatggtttcatccatctaaggtggtggcaaaggctgtcactttgtccattaggcaacaatttggtcagccttggcctacatggggagtgattccaaaagatcattag

SEQ ID NO: 39138 - DNA, 717 bp, Glycine max
  Peptide Sequence Number=SeqID_155916
atggccctgacggcgatcgcccagctgctgaccaaaggcaaagcacagcgcggccgggatcaggaagatgctcagcatctgcacaaagttggtcagtgccgtagggttttcgaacggatgcgccgagttggcgttgaagaaaccgccaccgttggtgccgagcattttgatcgcttcctgcgaggctaccggcccgagcggcagcgtttgctgcgcgccttccagcgtggtgaaggcatgatagggttcaaagttctgaatgctgccctggctgacaaaaaacagcgccatcagcaggctaatcggcagcagcacgtagacggtgatacgcgtcaggtcgcgccaggcgttaccgagcgtttccagcgaacgcgtgctctcgcctgcgtacgcctgccagttggtgttggtgacaaagctgatcgccgtattgagcgccagatcccagctcaggccaggcagatgctgaggattgagcggcagcgcgccctgccccatcagcatcgccagcagcagcacaaagccgagcgcgttaaacagcaggatggccagcagatagtgcggccagcgcatcgccgcgccgtcaacgccggccagacgccacagcacgcgttcgctgcgcgccagcaggggtttatccgccaccatcagcgccagcaagcggcccagcggctgcgccagcaccatcaacaccagcagatagcacgcaatcagtaa

SEQ ID NO: 39139 - DNA, 399 bp, Glycine max
  Peptide Sequence Number=SeqID_155917
atggcggcggtgtgtgacgtttacgacgcggtgacctccgatcgcccgtatcgcaaaggctggacgccgtcggaggcgatgcacaatatgctgagctggcgcggccactttgacagtgcgctgctgcacacgtttgtgcgtaccatcggtatttatccggtgggctcgctggtgcgactggcctccgggcgcgtggcgctggtggtgcaggccggggaaaaatcgctgctgaaacccaaagtgcatgtgttctggtcgctgcattcgcagcgcgaggtcaaaccggaagcgctggacctcggcgacagcttctgcaccgataccatcactggcgctgaggacagcggcttgtggcacaacgttgacctgaatcgcatctgggcgctggaaagcgcctga

SEQ ID NO: 39140 - DNA, 213 bp, Glycine max
  Peptide Sequence Number=SeqID_155918
atggccgcaacgcgctttaataagcgcatcatcacgggggaaaccattatgtctgccatgtctcaatcttctgccatgcctgctgaaaagttgccggcgccgctggtgtttacgctggcggccggtgccggtctcagcgtggcatcgatttactacagccagccgatgctgatatcatcagcaagcagttcaatgtgggcatcggcagcgttg

SEQ ID NO: 39141 - DNA, 939 bp, Glycine max
  Peptide Sequence Number=SeqID_155919
atgggacgtatgagcacactcaccagcgttgaccgcatcgaactgatgcagacgtttatccgcattgttgaaagcggctcgctatcggcggccgcggcgcagctcggcaccacccagcccaccgtgagtcgccgtctgcaggcgctggaacagcggctcggcctgaaactgattttacgcaccacccatgcgctgaaactcaccgacgacggggaacgctgctatgcccaggcgcggcagctggtggcgacctggcacgcgctggaagatgagttaaccggcgcgaatgacgacccgatcggcacgctgcgcgtgcgtgcgccgcatgcgtttggtcaggatcagttgattgcaccgctgatggattatctgcagcgctatccgcgcctggcagtggagtggatgctcaatgaccgcacgccggactttgtcagtgaaaacgttgactgcgccattcaggtcggcgcgcccaccgatccgtcggtggtggcggtgctgctggcggaagtgccgcgctttgtcgtcgcggcaccggcgctgctggcggctcatgcgccggtgaaagaggttacccagctgacgcagctgccgtggctggcgctgaccagtttttatcgtaatgaaattgcgctgcagcgtctcagcgacggccagccgatcaacctggcgattgccccgcgcctcgccagcgatagcctgtacgcggtgcgcaaagccgcgctggcgggcatgggcgccgcgattgtgtcgtcatgggtggtgcaggaggatttagccagcggcgcgctggtgcagctggtgccggactggcaggcgccgccgctgccggtgtggctgacctacccgtgggccagttattatccggcccgcctgcagcattttttcgcaatgatcagggacgtgatgccgcagctgaccggcacgcagccggtgcggtaa

SEQ ID NO: 39142 - DNA, 285 bp, Glycine max
  Peptide Sequence Number=SeqID_155920
atgcaagggtactccaaggagttcacaaggcatgggatgcggcatgaagaaaggacagagagcttaggggaagcaactgtgagagacaatgaggttaaagcttcggaagaaagtgatgaggtacaagcgctaaaggcaaagcttgaaagagcccgggtagtcaaagagaagttcaagtccatagccatcaaagcagcaatagtgagctcaaactccgaagaggtgaaaggaatcatcacgggtcaaaggcatgatctggaaggacgagctaaaggcttgccttag

SEQ ID NO: 39143 - DNA, 261 bp, Glycine max
  Peptide Sequence Number=SeqID_155921
atgtccacacgcatgaccctccagttagctgaccgttccatcacaaggccatatgaagtcattaaagatgttttggtgaaggttaagcaccttatatttctagctgatttcattgtcatagatatagaagaggatgctgacattcctctcattcttggtcgcccattcatgtctaccgcaagttgcatggataaagatccacctagccaaaatgcctgtctgaaagtgcatgtgatggaagaaaggacacctgagaagaag

SEQ ID NO: 39144 - DNA, 981 bp, Glycine max
  misc_feature (101)..(101): n is a, c, g, or t
  Peptide Sequence Number=SeqID_155922
atgcttgcacggccctcactatcagaggattacacgtcctcaccttcagaggtctgcacgccctcgccatcagtggagtacacgtcctcaccttcagaggnctgcacgacctcaccttcagaggattacacctcctcatctgcagagggctacacgccctcacctatagaggagtacacgtcctcggcttcaaagggcaacaagtccaaacctttagaggactacatgtcctccccatcaaagggctgcacgccctcgccatcagagggttgcacgccctcgccatcagaggactacacgtcctcgccatcaaactgctacatgccctcaccttcagaggattacatgtcctcaccttcaaagggttgcacgccctcaccttcagaggactacacatcctcacctttagaatgctacaagtgctcaccttcagaggactacacgtcctcgccatcagagggcaacacgctctcgcctacagaggactacacgtcctcgccattagagggctgcacgccctcgccattagaggactacacgtcctcgccatcacatggctgcacgccctcaccatcaaggaactacacgtcctcgccttcaaagggctgcacgccctcgcttttagaggactacataggactacacgccctcaccttcagaggactacacctcctcgcctttagaatgctacaagtgctcaccttcagaggactacacgtcctcgccatcagagggctgcacgtcctggccattagagggcagcacgccctcgccttcagaggactacacgtcctcgccattagagggttgcaagccctcacctttagaggattacacgtcctcgccattagtggatttcaggtcctcgccatcaaagggctgcatgccctcaccttcaaagaactacacgtcctcgccttcagagggttgcacgccctcactttcagaggactacacatcctcgtcttcagaggactacac

SEQ ID NO: 39145 - DNA, 420 bp, Glycine max
  Peptide Sequence Number=SeqID_155923
atgaaggccatgaaagagcaaatggccacaatgatggaggccatgatgagcatgaagaagataatggaagccaatgtggttgcaattgccgctaccaacgctattgctaaggtgaacccgatgcccccatctgatctcaaccaaatgaatcatccaacctcagatatggtaggcaaagatttgggaagtatggacaaccctcatttagtgcgaaaaacaagcatgccttcccactgtcataccgtaatttcatccgggagtacttgcggtcggcccacttgggccttcctgagggttccaaaagaatacggtgccttctggtggaagcaacccagctcgcctgagcgagctgagctcgcctgggggaaggagggcagagcaaatgggttcagccctcctggtattgagaaatctctctaa

SEQ ID NO: 39146 - DNA, 297 bp, Glycine max
  Peptide Sequence Number=SeqID_155924
atgtgtgcagttaagaaggtgatatggaccttccaacttcccgtgacaaaagacgagaccaacatacaacgcatgtgtgacagcatgatgcagatgcgcaaaagagcaacagggggatgcgctgcatgtggtggtcatgcggcaacagaagagctcatagtgaaggtgatgatgggtttgccacgggaatgtaaaatgtgggtatttgaaggggatttcgaagaagggttaggctgtgaagtggagattggggagtgtggaatttggtcctttgagcggaaaagagtttgtggctga

SEQ ID NO: 39147 - DNA, 630 bp, Glycine max
  Peptide Sequence Number=SeqID_155925
atgtttcccattagtcggagagtctccggggcgacatggcctgctaaagagttgagagaaatttgggccggcgggtcatggtttatgctgttgggtgggtccgaaacgggtataagggaaggggctggcaaagacccttctccctccgagaagcaatctcttccggggaaaggcgcttccatgccggaggtggggttcggggtggtaacggcggaggtaataaagggggaagagaggttggggatatcgagagaggtgggggttgcgtgggggatgaaagaggccggagaggtggggagggttaaggggtggttgtgggtcgcgggacgagggtcggaggaactggtgagggtcggagacgggagtgagttcgcatgtccgcgaacttctcctcctgtaatcttgcgagtccagcagcctgtacgagggtggccggttggtgcgcctgaacctcccgccgaatctccggcgccgatggtccgattagccaagtcttcaaaatcagccaagtactgggccacggtgccactttgcgtgagcttgcacaaagcccccgaggggtcctcgaactgggacggagcaaatcgagtgcgcaaggcgtctaaaaacgcaggccacgacggaaactga

SEQ ID NO: 39148 - DNA, 126 bp, Glycine max
  Peptide Sequence Number=SeqID_155926
atgtcgccatgccgtgtccatttgattgattacgttgtgggtttgataaaggtagctgctgataacctggacttcgagggccaggaacctcctaagcaagagtataaggaaggaagggcagggtaa

SEQ ID NO: 39149 - DNA, 3474 bp, Glycine max
  Peptide Sequence Number=SeqID_155927
atgggaaacatttccggtcacccattattattgctcgtagatgggggttcaacccataatttcgtgcagcagcaattagtgacccacctgggcttgccttgccgtgccaccacacctttacgggtcatggtcggcaacggtcaatatttagagtgtacctccatttgtgacgccattgatatacaaattcaagatcacactttcaccattgatctgcatgtacttcccgtatccggtgccaatgttgtattaggtgtgcagtggttaaaaacattagggcctgtcctcactgactattcctctttgactatgcaattcttttataaaggaactttggtcacattacggggtgatcccgacgccactctgagcccaatttcttcttcccagtttcgtcgcttatgtcgcacccaaacctctggcctctgcttccatatcaccgttctttcggaggacagtcatgcttcttcagaccctttacttccacccattcaggccttgcttactaaatatcaggttttattccgaccaccacagacattaccccccgaacggcccaccgaccaccacattcatcttctacctcagtctaacccagtgaatgtccggccttaccggtatccgcacttccaaaaacgagagattgagttacaggttgagtcaatgcttcaacgaggcctgatccaacctagtaacagtcctttttcttctccggttcttctcgtcaggaagcatgatggaacctggcgcttctgcgtcgattacagggcattgaactccctcacagttaaggatcgcttccccatacccacaattgatgaactgcttgacgaattggggggagcacagtgtttttcaaagcttgatctcctccaaggttaccatcaaatccgcatgcattcgactgacatacccaaaacggcatttcgaactcatcatggacattatgagttcagagttatgccttttgggctctgcaatgcgccttcgtcatttcaggcgacaatgaattcgattttccggccattccttcgccgctttgtcatcgtgttctttgatgacattctgatttatagcgggactttcgaggatcatctgcgccacttggatatgactttcaaggtattacttgataatcaatttgttctaaagatgtctaagtgtttctttgcaaaagcgcaggtcgagtatcttggacacctagtttccggcaagggcgttgaaccaatggcagacaaagtagccgccattgttaattggccaagacctcaatccaccagagttgtccgcagctttttgggattagcaggcttctaccgccgattcatccgaggatacgctatgatagctgaaccactagttcgtatcaccgccatggacacctttcaatggccctctcaagctcagcaagcttttgagaatcttaagggtgctttggcctcagctccagtccttgctctacctgattttcagattccattcacagtggagaccgacgcgtccggccgtggtatgggagcagtcttgtcgcagaaaggacatccgattgcttacttcagcaaaccattctctccgaagttgttaacagcctcgacgtatgtccgtgaattgtttgccataacttccgccgtgaagaagtggcggcaatatcttttgggccaccaatttacaatcctcacggaccacagaagcctgaaggagctattaacccaagtgattcagactcctgaacagcatcaatatctagcacgactgatgggatttgattatcaaatacaatatagatcaggagctcataatcaagcggcagacgctttatcaagatcaccgggaaatgatccgccggaatattctgcttctcagttaatgattctttcaatcccttgtctgacgtttctggacgaattgaagcaacaagtggccactaatcagcaatactcacaacagcgacaagctattattgactttcccgactcacattctgatttcaccattcatcacgatctcattcttcagaaagggcgactatggctgccacgggaccttccaattatacagtcccttttgcgtgaatatcacttgactcccatgggaggacatgctggggtaaccaagacgatagcacgattatcggagaacttcacttggccagggctcagggcggatgtggttacatacatagctaattgtgtggaatgtcaggtcacgaaatatgaaacaaagcgtgtcgcggggttgttatgtccccttccagttcccttcaggccttgggaagacctttctcttgattttgtggtaggtcttcctccttttcagggcaaaacggtgctcttggtcatcgtcgatcgattttcgaaagggattcacttgggcattcttcctcaggcccatacagctcacatggtagcacagctgtttatagatattgttgtcaaactgcacggtattcccagaagcttggtgtccgatcgtgacccattattcattagtgggttttggcaagagctcttcaagctcagtggtactcatctcaggatgagttctgcctaccatccacagagcgatggtcagacagaagtcatgaatcgagtaattgaaggatatttacgagcttttgttcatcgccggcctacatcgtgggggaagttcttaccatgggtagaactgtctcataatacttcatggaacactagcacgggctcgactccttatgagataacatatggacgcaagccattttcttttcccgattatatcgcgggttcctccagaattgatgcagtgaatgatcttcttctgtcccgtgatgaagtttttgacagtattcgccggaaattacttaaagcacaagcttctatgaagaaatccgcagacacaaagcgacgcgaggttaattatgagcctggcacttgggtcttattgaagcttcgcccttatcgtcagaaatcgctgaaggaagctcagacagttcatggcaaattagccaaacgtttctatggtccgtttcaaatcatcgatcgtgttggtaaagttgcatatcgtttgaagcttcctgatggaactcgcattcatccggtgtttcactgcgccctcttgaaaccatttcatggagatcccactctcagttcccctaacccactgccgacacaattcttcaatggtcaacctctgattacaccacttgccattcttgactatcgtagacataaggagaagaacacgtatgaagtgttggtccaatggcacggactgtcccctgatgaatcatcatgggaagactgggaacagctcaagcaggatcatcaccttgaggacaaggtgattctccaagggcccaaggaagttgatagaagtgtcacaacagagaccacagcagaagggcagtttggggaatcaatcaacaagggaggtgtgcaattagtgaaaacaaagaggaagattaccaggcctgcatatctcagagactatgcttga

SEQ ID NO: 39150 - DNA, 657 bp, Glycine max
  Peptide Sequence Number=SeqID_155928
atgtcttcttcatacggtggataccattctcaatcctatgctccatctgcgccagaacaacctccatattccaattataatcacacttcttcttctacatcaaattcatcgtcatccagttttccagcagggacgccccaggacgtgattcggagctttcagatggtggatagggaccgaagcggcttcatcgatgagcgtgagttgcaccaagctctctcttctggattccaccacttcaactttaggaccattcgtcttctcttgttcctcttcaagaatccacaccaacccctcacaattggaccaaaggaatttgcagcactctggagttgccttggtcattggcgaggaatatttgagaggtacgatagagataggagtgggaaaattgatccattagaactcagagatgctctgtatggtattggctatgctgtaccaggctcggttctacaactactgctttcaaagtatggtgatggaagtggtaggagggttgaacttggttttgacagttttgtcgagtgtgggatgattattaagggtctgactgataaattcaaggagaaggatacacggtatacgggttcagctacactttcatacgacgcctttatgactatggtccttcctttccttgtatcttatgattga

SEQ ID NO: 39151 - DNA, 909 bp, Glycine max
  Peptide Sequence Number=SeqID_155929
atgttttggaagaagataccaagtcatcaagtcatttccatgaccgtgtgtaaaggtaactttcagattggaagcccttttagtaagggtgatcgagagtacctagacaactttaagaatacatgttacctaggacttttatatggccaacaacaaatcctggctaagctacttctacacaaagcaccaacactggctagcaagaagggcatggcaacatgtgggagcctgcatcacatcttcgacacccttttgccagaaaagccaaccctgcttgaatccctctcatggaaccaaataaaacccctaaaacccacagaccaaacccactccttcactgaaatatttggagaacttcatttcaaggagagtcctatatcttcatcattcactccccacgtttctacttcatcatcatcatcaactgagataacaaacaacaccaacaggcacaagagtagtgacagcttctcatccttgagttctgagagcttgcacctttgcactgagggtcttggctttgagagctctgatgatgttgaagacttcaaggatgaaatgagtgagagttgtggagtgtataaggagaaagagggcgtcaaaaagtatgcgacttcaagggtaagtgagtaccctcctccaatttcatgcatagggaggagtgggaagccttgggtttgtttcagatcctacagaagtgaagggaggtttgttcttgaagagataaggattcctacacacgagttcttgcatgcttgtagagaggatggaaggctgaagctgcattttgttcatcctgaggaggaacctatagaagaagaagaagaagatgatgatcatgttggtgtagaaactatggatgaggaggaggaagaagaaaacatgggagaggaaaatgatgatgtgtga

SEQ ID NO: 39152 - DNA, 792 bp, Glycine max
  Peptide Sequence Number=SeqID_155930
atgcagaaacttgcaaaagagttaggtgtagttataccagttagcttcttcgaggaggcaaacaatgcacattataattcaacagccataattgatgctgatggaactgatcttgggatttatagaaagtctcatattccggatggaccaggttacgaggaaaagttctattttaatccaggtgacactggatttaaggttttccagactaaatttgcaaaagttggagttgctatttgctgggatcagtggtttcctgaggcagcccgagcaatggtgcttcaaggtgctgagattctattttatcctaccgctattgggtctgaacctcatgatggaagcattgactctcgtgaccattggaaacgagtaatgcaaggacatgctggggccaatttggtaccacttgtggcttcaaataggataggaaaggagattattgagactgagcatggaaaaagtgagataacattttatggaaactccttcatagcaggacctactggagaaattgtttcaattgctgatgataaagaggaagctgttcttattgctcaatttgatttggacaatatcaaatccatgaggcattgctggggtgtattccgtgataggcgtcctgatctatataagaattatacctggaatggtttaagcctttacaaacttccagagcgtttatcactcaccaagaaggcaagaacaagaattttggtaagattcaacttaacttcaaaagttagctcaccagttcatgagatgagaattacctatcaggattatgatatgtga

SEQ ID NO: 39153 - DNA, 1413 bp, Glycine max
  Peptide Sequence Number=SeqID_155931
ctcaacgagagcaccaaattgataaaggtagctgctgataacctggacttcgagggccaggaacctcctaagcaagagtataaggaaggaagggcagggaatatatgcataacagaattggttatggatgcatccttgcagggaacattcgaatctagcaaatccttcattgtgccagcttggctcctctctgtttggactgcgatatcaagcatagtctctgagatatgcaggcctgccatgaccgaggtcctccactcctcatccccaccccattttgttgcttcttcatcaccgccaacaaagacaaggacaacaaccactacaacaacaacctcttcattctcttctcacaataatgcctttctcctccgacctctcttggctcttcttctgacccttctcaggaaatccttccagctttctcgcagaaacatctgctccattattatgaacattggttccccaactaacgtgcgccatgttgcgcatgtcacctttgataggttcaacggtttcttgggcttgcctgttgagtttgaacctgaagtcccaagaaggcctcctagtgctagtgcatctgtttttggagtttcaacagaatccatgcagttatcacatgactcaagagggaacagtgtgccaacaattctgctgttgatgcaaaagcatttgtatgttcaaggaggtttgcaggtagaggggattttcagaattaacgcggacaatggtcaagaggaacatgctagggatcaattgaatttgggagtggtcccagaaggcatcgatgtacattgtctggcagggctaattaaggcttggtttagggaacttcctacaggcattctggattcattatctccggagcaagtaatgcaatgccagactgaggatgaatgtgctgaactagtgagacatctacctcatactgaagcttcactcttggactgggccatcaatctgatggctgatgttgtccaacatgaaaatgtaaataagatgaatgcgcataacgttgccatggtttttgcaccaaacatgactcagatggcagaccctatatctgcattgatgtatgcagttcaagtaatgaacttcttgaagacacttatattaaggacagtacgggaaagaaaggattctgtgcaagatactccagcagaaaataaagaggctcaagaaaactttgttttagagaaaactgccttagatcgttcccctgaatcactccaaaacaactccactagagcagagcctggcagtttgacaaactcttctgagaatcttgtttccaatgaggatttgtattgtgagtttccacccgtaggaaacatggggaagagtaaaactggccaatcaagtaagtcaaatgctagaaaagagtccaaaaagacaagaggcagcaacctgtga

SEQ ID NO: 39154 - DNA, 150 bp, Glycine max
  Peptide Sequence Number=SeqID_155932
atggagaagggtagaaccgtggtggtgtccgctctgcagtttgcttgcaccgatgatgtctcaacaaatgtcgccaccgccgagaggctagttagagctgcacataaacagggtgcgaacatcattcttattcaggttaacgtcaagtag

SEQ ID NO: 39155 - DNA, 273 bp, Glycine max
  Peptide Sequence Number=SeqID_155933
atgagggcggcggcaagttgcagcaaccaggggcggcgcggcgaagaaatagctccgcgcaatgcgaagaacggtggcgatttccagaatccagtcaccagaggcgcggcggccggcggcgagaacagagataaggggatttgggggtttgtgcttcgtgagagtctgagagagcgattgatgaacagtgcgaaactcggaccgggttgccaaaccggccgggtcattggttttaaacgagtttgtctgggctacactgggctgacttcgtga

SEQ ID NO: 39156 - DNA, 930 bp, Glycine max
  Peptide Sequence Number=SeqID_155934
atggatctacacgacccgaaccggttccgcaaccgcaaacaaaccctctcctcgcgggaacgcttcctcggcgtcccatcatcccacgcgcctcgaatcgaaaactcttcctcctccgccaccgacgacgacgtcgtcgttttctccaacaacgacgacctaatcgaagacgatgtcgttttctccaacaatgacgactccaccgaaccctcttcttcttctcaaatccctaatcgccaccacaaccacaataaccaccacaaagccttcgcgttcggtccctccgacgcttcgttcggcatcctcgccgcgctgccggagaacgaccacgcctcctcgaacggctcgcacttcttccaccacaaaccctcggtttccgtctccgtctctgtctcgctctcctcgtcctcctcctcctccgccgccgcgcgcctcattccggcgatcccgaagcccccgccggagcggactccctcctcctcctcctccctcaagttccaccagtccgcgccggtgaacgtgccgcttatgccgatgagaagacaccaccgccgcgacttcgatgacgacgacgacgcgacggaggagatgctgccgccgcacgaaattgtggcgcggaattctgcgcagtcaccaatgctggcttattcggttcttgaaggagtagggaggacgctcaaggggagagacttgcgtcaggttcggaatgccgtttggcgccaaacggacattggaactgggcaaagtaggttgctcagtcttggatgtttggcaatccaagctgagagatttgcggctatggccccaccatggcagaatggtgtggtggattgccttccaccatcgatcaacactgtttgggacttgggtattcattttgtgcatgttaggaatggcaaactggcaaaggatggaactgaagatgagtaa

SEQ ID NO: 39157 - DNA, 657 bp, Glycine max
  Peptide Sequence Number=SeqID_155935
atggctgtgctgctaaaccagcttgaagaacctcatcaactgctctcgtcgattcctttgaactccaaatactacgccgcgcccgatttcatcaacagatcgattgtcttgtccgcgcagaacaacgcccttggacctcccaaatcgattacagaggggttggtggacgaggtcgacgacaacgatgttgtcagagttggaggatgtggtggcggttgcggcggaggggagggagtgcggggaagtgaggtaggaagtgagatcatgaaaggagagagaagcaagtgtgccgacgatgatgagatcaaatttgacgggatcaatgggagggtaggagaagataacaatgatgagtccctcccaacaccatacgtgaaggcaacttgttcaccttcaccggcttcagtcatattttcacccaacaacactgtctcagatttcaaagtgctgaaggcaaccaaggcagaattttctgcccttgatggacaaagtgtctcatatgcaacccttgaattcccagtgccagtgctggtactgtgtcaattcctaacactctttaacaccaccattgatgacaatgacttggctctggccttcaagactgatgttgccaccattcaaactctcaagaaaggctttgctgcttataaagcatga

SEQ ID NO: 39158 - DNA, 177 bp, Glycine max
  Peptide Sequence Number=SeqID_155936
atggagaggacagaggagctcaagaaaaggagatatttgccgagtgaaatgagaaaagtgattgaaacttccacgcggttacaggagaaggaaaacgtctttgtgggtatatttttctgttgttattatggttttgtccccatgatgtcaccagagaagtacccaggtgtattataa

SEQ ID NO: 39159 - DNA, 657 bp, Glycine max
  Peptide Sequence Number=SeqID_155937
atggactctgggaaagagggtgaggcaccggcagctaccaccagcccggaatcgaggaggaccaggagcaatggaaaagggaaaggcattgctgatgctgctccaccttctgcaactgtagtttccacaaaagctaccccactcccaagagctggatggaaaaagggtgttgcaatccttgatttcatccttcggctcggagccattggttctgctctaggtgctgctgccatcatggggaacagtgaacagatacttccattcttcacacagttcttccagtttcatgctcagtgggatgattttccaatgttccagttttttgtgtttgcaaatggagcagcaggtggattcctcatcctctccttgccattttcaattgtctgcattgttcggcctttcgcagtagggccaaggcttctacttgtgatcctagacatattgatgatggctctagtgatggcagctgcttcagctgctgcagctgttgtgtacttagctcacaatgggagccaagatgcaaattggattgccatttgtcagcagttcactgacttctgtcaggttaccagtgaggctatggtggcttctttcgttgcagcatttttcttgatttgcttgattgtggtgtcctctgtggctctcaaaagggattga

SEQ ID NO: 39160 - DNA, 843 bp, Glycine max
  Peptide Sequence Number=SeqID_155938
atggtatctggttctataatgcacgtgaatgtgaagaggttgccaatctttttagcagcggtaaagttgtgccttggtgacttgttggtcatgggttcgaatccggaaacagcctctttgcatatgcaagggatccttaatgcgtatgccaaggttcctcctaagtcaaaggtttcttctacaaagagtgagtttgaggaactagaagcagtaccaactatggcagtaatggatggtcctcttgagccatcatcatctactacttccaatgtggctgatgttcctgatgatccatcctttgtaaacttcttcagtgcagccatggctattgggaatacttcaaacactccaattactggacaaccttatcagtcttctgctgcaatttcttcatcttcagtgccaactcatactgctacacccactgttccaaccttacagataccctctctttcacaatctactcctctaatacccccgcttgatgctgttgagtccatctgcagcagtaaccgaaccgcaaaacttgtgaagccttcttttttcgtccctcccccttcttcagcaatgatgataccccccgtatcttcatctactccgacggcccctccacttcatcctgctgttaatgtacatcgcccatatggtgctccactgctacagccatttccaccgccaaatccaccactgtcacttgctcctgctgcttctccctcttcctctccaaactatggttcagttatttccagagaaaaggttcgagatgcgcttatggtgcttgttcaggacaatcaattcattgatatggtctatagagcactgctgaatgctcatcaatcatga

SEQ ID NO: 39161 - DNA, 1218 bp, Glycine max
  Peptide Sequence Number=SeqID_155939
atggagaagtcacttccttcttcaaagttcgaagccatgcgaattaagccaatcctgctcccggagccgcccagcccgacggcggcgcgtggcactcccgacatcttcgaatccggtgtccacaccctcgtccgccgcgccgttgtcatcggcaacggtttcccctcctccgagaatcacagcatcggtttgctccgcgcccttggcctctcccacgaccacctcctattccgcgttacgaggccgagaggtggaatcgacgattggctccattggtttcccctttctctccatcgaaaatttcattacctaatttccatgttccgcgccttctcctccaaatctaactacctacccctcacttcccaccctaacggcttgtcctctatcctccaagccgatgccaatcacatagtcaatttagctcgcgaaacttatgaaaaggagggaccgttattggtagttgcatctggaagagacacaatttctgttgcgagttccataaaacgtttagctcctgatcttgtttttgttgttcagatacaacatccaaggtctcatttgaataggtttgacatggtaattacacctcatcatgattattatcctttgactccagaaggacagaagcaggttcctaagtttcttagaaggtggataactccacgcgagcctccagatagtcatgtggttctgacattgggagccttacatcgaatagattttgcttcacttcgcagtgctgccattgcatggcaagatgtgtttgcaaatgttccaaggccattgctcgtggtcaacattggaggcccaacaaaaaactgtcaatatggtgttgaccttgcaaagcagttagcaacatctttgatcagtgttcttggtagttgtgggagtgtaagaatatccttttctgataggactccacaaaaggtatccaatattatagtgaaagaacttggaaataatcggaaagtttatatttgggatgggcaagaaccaaacccacatatggggcatctggcttgggctgatgcatttgttgtcacagcagattcagttagcatgataagtgaagcttgcagcaccggcaataagactttcattgatagcacaagttgtgcaaaattacaaggagagcagcaaataccccactcacagaacctatataatcttatgacccaaagcacttttagagtgtccatgagtgcatctagctag

SEQ ID NO: 39162 - DNA, 519 bp, Glycine max
  Peptide Sequence Number=SeqID_155940
atggttgacagatacaagaaaagtagaaagttgaaagagagggaaacatcgagtttcattgctgttttagggttacacttcttgccattgctggctggaatcatgtcgaggcccatgttgcttgtttttttgctgattatacttataatcacctcacagttcgagtggaagcagcagcttgtggccgatgttgactctaaccccaacttgcctcagaagcagcatcagatttctaaggctgaagaaaccgttaaggagaaggtcttgttacattttgattataaacgagtaaagaaaatttcccagaataccgagagaggtgttgatgaagattataacaaagatggtttcagtttatatgcttgctgtcacggacaaatgcagaaaggaagtagtatagagaaagagagggataacagaatactttccatgagcaccctctcacttccatccatttacttggcacctcttgcttcactcaaaatccctgtggttggtgttagctgctttcctttgtga

SEQ ID NO: 39163 - DNA, 891 bp, Glycine max
  Peptide Sequence Number=SeqID_155941
atgacccatcccgtcccctcacaagcagcgagcacgatcacgcgaagcgctccgctggccatgcccgcaccgtcgctttccctggacatcaaggtcctcatcggcctccttctcttttcggtggtctggctgctgcagatcgacagctccagcctcacggcacccaaggacaacctcgagcagctgacctgggtgcacagcctggaatggggctactacaagcatccaccgctgccgacctggatgttctcggtgccggtcaatgtgttcggactgtctgcccgcaccagctatgtgacgggcgcgcttttcacgctggccggcctgcttgtcttctggaagctgatgcagaccttgcgcggcagccgccatgccacgctggccctgctggcggccctgtgcatcacctactacaacgagcggctgcacttcttcaaccatgaagtggtgctgatgcccttcttcgtggccagtgccctgctggtgtggcgtgcgatgatcctggccgccgtggcggtattcctgttctggctggcgtcaggcgcctggcgcgagcgggtccacatgatcggcctggtgctggcggcggccatctcgctggccatcatctcgccgcacctgtactggctgttcctgaacgacttcggccccatccgctatgccaccgaatcctcgctgggcgccagcctgggcggtggtgcaagactgctcaatacgctgcactggctggccgaccagctgctcaaccgtgcattgctcgcctgggtgctgctggggctggtgatggccctgcaccgccgcagccgccttgcgccgcaggacacaccgcagcgtcccgggacagccgatgcatcgcgcgcgctgatcctgtgctttggcctcacgcccatc

SEQ ID NO: 39164 - DNA, 438 bp, Glycine max
  Peptide Sequence Number=SeqID_155942
atggtcaaaagaaaaagtccctatttgacaaggcttcttactatacctatgaattccattggacccaaaaatgatacattggaagaatcatctgagtcttccaatatcaataggttgattgttccactcctgtatcttccaaaaggaaaaaagatctttgagagctatttcctggatccgaaagagagtactcgggttctcccaataactaaaatgtatatcatgcctgaatctaactgggttcgcggtggtggaggaattgagattctagttgtaagatatctaatgaaaccattgctggaattgagatctcattcaaagagaaaggtatcaaatatctggaattcctttttgtatattatatggatgatccgatccgtaaggatcatgattgggaattttttgattgtctttctccaagaaagaggcgaaacgtaa

SEQ ID NO: 39165 - DNA, 405 bp, Glycine max
  Peptide Sequence Number=SeqID_155943
atggcggtccgccgtgatcaagggttgtgctatcattgcgatgagaagtggtcacatggccacagatgcaagccgcgcttacacattctcatcgcggatgaagatctagaaccttcgtcaggtccctcggccctcgattcacacactggttctgcgattgacacccttctgactccacaaatcagcttgaatgctatggagggtacccccgcgccgcaaatcttctgcctccttgggtctttgagccaccaccaagtggtcattctcgtggatggcggcagcacgcacaacttcattcagtcgcgcgtggccaagttccttactctgccatcaactccaacgtcagctttgcgagtcatggtgggaaacgaccacactctcgactgcgacacattgtcgttttag

SEQ ID NO: 39166 - DNA, 135 bp, Glycine max
  Peptide Sequence Number=SeqID_155944
atgaaaggtttcaagtcattcaaggcacatcctatccctcttaagttattgaggccacaaggtccaacagcctcatgtggtggccgtgagctggtgcaggtggcggaccgggggatgaggatggagactgtgtag

SEQ ID NO: 39167 - DNA, 129 bp, Glycine max
  Peptide Sequence Number=SeqID_155945
atgtggataccgataggggcgaacgttgactggggtggtttgggaaagaagatgaatatggctagaacagtgtttatcagaggtggaatgggtgtgattaatgaaggggatgaagggggtgaagattga

SEQ ID NO: 39168 - DNA, 258 bp, Glycine max
  Peptide Sequence Number=SeqID_155946
atgacgttgctatttagaaacattctgcccaatgaccacattaccgatctcgccctgtggaagtatcagttgttctgtgcgggatcatgcccccaagacacccagtggacccggagaagtccaacagggtccggggggagttcccatcgcccccagcaggttcatcaggcccctattaacagggctttcatcgagaagtattgggcccccaggcaagcccaagggggggttaatgggggcggtcccggaatcaaataa

SEQ ID NO: 39169 - DNA, 628 bp, Glycine max
  Peptide Sequence Number=SeqID_155947
gaagcatttggaggagaaagcgaaggctttagcggttcaaggtgaatgggcttcattcattgatatcttggtgctattggtgtttggagttgtcctctttccaaatacggatgggctagtggatctagtggcgatcgacgccttccttgcttatcactatagcaaggaaagtccggtcgttgctgttttggccgatgcttatgacatatttgaccggagatgcgagaagagaggcgcaaggatcgtctgttgcacaaccgttccttatatatggttggtctctcacctctttcatcatgaaagtagacctgtctgtcccctacaaggtcaccgcatgtgcgtcgagaaaggggaggcaaattgggagcagctcttggctggaatggtagaggcatccattaattggttcccccgatggaaggaaggaaaagctatagttttgtcctcatgtgagaggttctcaaacgtccccttaatgggaacaaggggttgtatcaattataatctcgtacttgccataagacaacttgactatcccatgagaggagcatcgtcggaagaaagcatcatgcctttcatcgcacggggtttcagtggccccaatgtaaggatgtttcaaagagtctga

SEQ ID NO: 39170 - DNA, 261 bp, Glycine max
  Peptide Sequence Number=SeqID_155948
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatgg

SEQ ID NO: 39171 - DNA, 234 bp, Glycine max
  Peptide Sequence Number=SeqID_155949
atgagtgacaaaggaaatgcttgtgcattgctggttatgggaaagcttgaaggggttgatggggacccggtgctgagaggaaggaggataagggctacgtgggggtacgtgagctcagttgaaggtgggcaactggggatggtgggttcatgtgtaatttgtggatgtgggagagttgatttgcaccatcgcccgatcacatatgacgggtaccccataatcctacaagcttga

SEQ ID NO: 39172 - DNA, 294 bp, Glycine max
  Peptide Sequence Number=SeqID_155950
atgaaggaaagcttattcaataattttatggaaaaatatagattcaagacaagttatgattgtaatacggcaagaacgatttggaataagatttgcgtggatcgattttctgatgctttggctagagcaagggaaaaggcaaaacaagttactgtatcagagaatgttgctgattataaaggccacggaccaagaggaatgagaactgaaatatgggatggcttagtaggtatttggaatacaccagggtggaagaataagtctattaaagccaaaatgaatagagttgcctag

SEQ ID NO: 39173 - DNA, 168 bp, Glycine max
  Peptide Sequence Number=SeqID_155951
atgtgtttccgtgaagaaaatcctagccgaggtgcttccgtaactcttctgagacgtttccatgagcaattccatgaagattttccatctttcttcgtcgttcttcatacgttcttcggtcttcaaccgcaaaatctaatcaattgttcacgctgtaaccttggttaa

SEQ ID NO: 39174 - DNA, 453 bp, Glycine max
  Peptide Sequence Number=SeqID_155952
atgcatagcataggagttagggaccctttggaacagcccccttcccctatttataggagaaaaggggaggaagttgccgcccagctcgcccaggcgagcaggtcgcttcctctggaagtttcttatgcaccccctaaattgataatggaaaaggcttacccagggttacgggaattttatggaagcattacggaagccttggaggcccgttttcagaaaaaagaagagaggtgcttgccgcccagctcgcctaggcgagttggattcttagccaggaaggaagaaacaatccagaaacctctagatgggccaagattcgaaaatttttatttacacccacatcttgataagttcaatcccccgccatttttgtgctttttggctgttttctttccgaaacctcatggaactttacgaattccatggcgatgggtgttaagtcttccaaagtga

SEQ ID NO: 39175 - DNA, 351 bp, Glycine max
  Peptide Sequence Number=SeqID_155953
atggttgtctacgctagcataacaccaggagaccctattgatccttctgagaaagttgaaacaacaatagacgaagcacaacgagtagtagacattgtagaagacgtggctgagggggtggacaaggtggcagaagaagctgtgaagcatcttcctgatggaaaacttcgtgatgctgttgaatttgttgaaaaagtagctgaagatatagataagcatgccgaacgcgcagaagatgaattagaaaaggtggagaacatggaaaacgagtttgagtccttcattgaatcaaccactcatcatcaggaaaattcagtcacaacgaccgcagaagcaaaagaacagaagtag

SEQ ID NO: 39176 - DNA, 303 bp, Glycine max
  Peptide Sequence Number=SeqID_155954
atggtggacctcatggttgccaatgttcttggtatagagaaagcaattggtttggagttcttaagcaaacacgacatcattaagatcttcaaaatctcggccaaacatagacttcatcagctcgacttaattgcaggtcacgaacaagaacacgacgtcgctcaggcaaaaatggttgcttcgatggtggaagacacagggaaagggagttgcggtaagacaaagacactttcgataacaacaaactcatttcacatggagatagggcacaataaactaaaatacatgttaattaaaaattaa

SEQ ID NO: 39177 - DNA, 222 bp, Glycine max
  Peptide Sequence Number=SeqID_155955
atggtgacagcggatccatggacatggagatcccttgtatcgaaagtcttcctgacgggtgagtccatgcatagaggccaggcaacgagtcttgcaagtgttgcgacaatacaagttgggttagccatagttaagctctacgggtcaccattggatactagtggattgaaaatgactttcgttcgaagggaacgttaccatgtggaagagactcacacttga

SEQ ID NO: 39178 - DNA, 246 bp, Glycine max
  Peptide Sequence Number=SeqID_155956
atggataaagttgatatctttgtccctcatcctctcacaaacgcatgtttgcttattcaactttcaccggaatgtgggtgtaagccattggtctgtttgctcaagcaacctgcgctcctaagtgttgacttccaagaccgttcaatcagagattactcatcttgcacgttggtggggagaagtgagttatcaagaataggatgttggacaaatggcctcagttaccttaagaaaaaggggggttga

SEQ ID NO: 39179 - DNA, 456 bp, Glycine max
  Peptide Sequence Number=SeqID_155957
atggccctagaggccgtggttttcccacaagatccattcacttacggttgcaacaacaaagacttcttgtactcgttagtaggaggtggtggaggaagccaaacccatgtgggaatcatcaacaacaacaacatagaccacaccctgcatgcaaattgggattcatcttctccttcggtgttgcaaaatgttaaagaccagtgggattcacactcctcccctgaagcttgcactgttgatcaatcccttcctgcagtcttccctcctccttcttcctcggccgaagccgctgccatgggccgccgcaaacgacgtcgcaccaagagcgccaagaacaaggaggagatcgagaaccagaggatgacccacattgcagttgagcgcaatagaagaaaacagatgaatgagtacctcgccgtgcttagatccttgatgcctccttcttatgtacaaagg

SEQ ID NO: 39180 - DNA, 222 bp, Glycine max
  Peptide Sequence Number=SeqID_155958
atgccactactccttggaaacactggttctgaaagcacaagtcaggtcaagaaatggaacatgaatagcacaaggtgggaagatacgaaaaatgaggttacattaagcaaaaagggcaacataaatgaagagaaaaaaatagttctgaagcaggcccagcccaacactcgcgctaagcgcgcatcaggcgctaagcgagcaaagaagacaggcgctaagtga

SEQ ID NO: 39181 - DNA, 773 bp, Glycine max
  Peptide Sequence Number=SeqID_155959
gacaggtcgttcgttttgacgctgacacaattaacgacttcctcgacaccccagtcatcttggaggacggggaaaagtacccagcatacaccagatacctcagcactcaccccgatcctgacaccatcgccgccacactatgtactccaggggggcgttttgttctaaacgccgatggccttccctggaaactgctgaagaaggacatgacgacactcgctcagacatggagtgtcctttcttattatgatatcgcacccacttctcacacatctaatgttaatcttgacagggcacacttgatctacggggtggtttctgataccctgatctttgagtcactcagccctgcaatcaacttggcctacatgaagaagaactgctggaaccccgccgatccatcgatcacatttccaaggactcaccgcacacgtaccagagcctcgacatcagaggcccctcttcctacccagccttcgtctcagccttcttcccagagacagcgacctccacctgcctccacctcagcatctctggacaagcatggtcagattctgaggtcccttcacatcagacagcagctcatcatggagaacatgcacaagttgtccctacatctgcagatggacccaccactcatcactctagaggcttatcgtcagcaggttgcctggccaggagaccagccctccattgacaggggggcagagccttctggagccgctgaggatcctgcgaccgatgaagacctcattgctgacctagctagctag

SEQ ID NO: 39182 - DNA, 246 bp, Glycine max
  Peptide Sequence Number=SeqID_155960
atgaagctaagtgagattcattacgacaatatgcacgctaaattccggaaacttcatctctgcattctctctctaaaaaaatttgcacattttgcatctgcgctttctttctgcattttcaactttgaagcatcaaccatacaccatccaaaactcgctaagcgcgcttaccgtgctaagcgagttcatcttttgaggatgaacactcatcctcttgctaaactacctgtggctaagcaaggctga

SEQ ID NO: 39183 - DNA, 555 bp, Glycine max
  Peptide Sequence Number=SeqID_155961
atgtcttgcctagcgatcataactccgatctccctctgccgaagtgtcagttggtgtatgccacccaccaggcaccctctagacccgaataagtctaacagggccctggggtttccagcattgatcacgagcctctgccagtcattcggggttcccgtcgcccccagtaaggtgatccgaccgccaatcactcgggccttcatcaagaagtactgcatgcctaggcaggcgcagggtgaggcacatcaggccacagatgctcagccactacctcatcaggccgatcccgctggatcactaggcatggagcgttatctacagcacttggttcgccagcaggcggccaaccaccgtgggcaggtgcagatacatgagtgtctctaccggttcagcctcagtcagcaggggcagggttccgctccttttgcatgccctactcccgaggcccaggaaggggaggagcctgcaggatcccccaatgaggcagaggaggcacgtatggatgaagatatgactgacttgctcagtttcttaggaggaagcggagccacgtga

SEQ ID NO: 39184 - DNA, 351 bp, Glycine max
  Peptide Sequence Number=SeqID_155962
atgggtggtcatgaaggtcttgggttccacaaaaaatatttgttcaatcatattgagcgtcaaaggcgagctaaaatcaaggatgaggatgtgttggtgtctttaagttatcttgagggcaaggctgacaatgatcccatgttttatggcagatatgttctttctaagttttttggagaagtagttgcctgtgacaacacgtataagaaaaacaagtacaataagcctttggtattattttctggaaaagatgatcattgtcaaactgtcatatttggatgtgctcttgttttcgatgagactacagaaacatataagtgggtcttggaatcttttttggctacaatatga

SEQ ID NO: 39185 - DNA, 1179 bp, Glycine max
  Peptide Sequence Number=SeqID_155963
atgagcatgcaaaaggagagtcctcttattagactccacagtttcgaccaaggccatgcatggctagctctactgcaccttctcattcacatctcaccggcagtaaccggtcagccggtaaccccgccggtgcaacccgacagcaacaaatccgtgatcgccatcatggccatcgtggtcatcatgttcctcatctcagccttcctctccctctactcccgcaagtgctccgaccggccggtccagacacgtggcatcctcgacctcgcgggccccacgggcgcagccggtaacccgttgcaagccgaatccaacggcctcaatcaagccaccatagaaacgttcccaactttcctctacgccgacgtgaagggtctcaagattggaaaagacacgcttgcatgcgcggtgtgcttgaacgagttcgaagacaacgacaccctccgcatgatccccaaatgctgccacgtgtaccaccccgattgcattggtgcgtggttagcctctcattccacgtgcccggtgtgtcgtgccaaccttgttccacaaccagaagacatgaacacgaacacgaacacgaacatgccttcaatcttgtccattcagatacccaatgaagaagaacgtgaacatgaacatgaacatgaatacgaggctgttattgttggtgagcaacataagagagatgttgacgtggagtcaccgaaggtggatttacttcggaggattcgaacgttgcaccatgatcatcagagccgtccatcgaggtcgaagtcgacggggttcttgtcttcgctcttgtttccgagatcaaactcgatggggcaattggcgcagcatgctggggagaactatgagaggtttacgctaaggttacccgaggaggtactacggagccagatggtgctgaagcgtgcgaatagctgcgtgtgctttacgaggatgagtagtggcacgtgggggtataggacgagaagcgtggggagagggtgtgtgcagtacgagaggtttggtggtgagaatgaacagtggggtttcactttgacgccgccaagtctcgttaggaacagttggaataataatagatcaacgagaaaatcaccggttcagcgttcgggtgtggcgttggataataataatgctggtgagagatccactgaattcttgcgtcttgggtag

SEQ ID NO: 39186 - DNA, 300 bp, Glycine max
  Peptide Sequence Number=SeqID_155964
atgaaggtttttagccgaggattttataatcttgtgaaagaccagatcttagttgctggatcattgaatgccatcaagaaaattggaaatcatgataagcgtggtagacaacgtgaggttgtgtatcataaagctgaggcaaaattttcatgtgcttgtaggctgtatgaatcgaaaggaataccatgcagtcacataatacgtgccatgaggtttgaccacgtggaagcttttcttgcaacattgatttgcaagaggtggttaaaggatgctaagaaatcattcattaaaatcatatga

SEQ ID NO: 39187 - DNA, 514 bp, Glycine max
  Peptide Sequence Number=SeqID_155965
cttggacctgttcacggacaaagtgatagtccaaggattaatgtttcattcgtgagtgcaacatcgagtttgagctcaaagccaagagatagagttgcttctaaagaaaacagtgttgatggtggatttgatgtatcgaagaagccttttaaggtgttagaggggagtgggagatggtttggattctgtcatgccaaaatgttcaaggatgtctcttatgaacttatgttgggagagttgaatgccaaagaccatagattgcttatgaagtttgaaagcatgatcatggtgttgagagtctttgaggccaggaggttaggtcatgcatactacttcttcatggagggatccttgaaggaacatattgttgacatcaagttgatgcatatgccagctattgccaagggctatggaggagaatcattacctggtgaggacaatggtaacaagggttttgcaggcgtgattgttgagatggggaccattatggggaaggcatggtgggagttactag

SEQ ID NO: 39188 - DNA, 180 bp, Glycine max
  Peptide Sequence Number=SeqID_155966
atggcagtagtgacttctttacattccttttcaagaccattaagggtgtggatgatgacatcatcatcatccatgggagtggtgacaatgggaagattagttgatcctgtcgaatccatcaacaaatcccatccagttgtagcctacaaggagagcatttatttggactctccaggctag

SEQ ID NO: 39189 - DNA, 300 bp, Glycine max
  Peptide Sequence Number=SeqID_155967
atgccgttcttcccacactcccaccggcatatctcgccatcgcaaccgccagaaaacaacccccccccccccccctccaacgcaagtgcgtttaccgttgacttctgcctccctatgttgctcaccaactttgccgtcgccgttaacagcaacggcattaatcgcgtcctcgtgcgccttaacggactccaaacaccggtaactcagcaagtcccacaccttaaagcttctatcccacgaaaccgaatacataaacctctcgttaaccgccaaacccgaaacgggtgtcagaatgtttga

SEQ ID NO: 39190 - DNA, 213 bp, Glycine max
  Peptide Sequence Number=SeqID_155968
atggctaatgctgctgacttgatacagcgcagacagcgttctgaatttcaatctaaggttaaggaaacactttttacagccataaagggaaatcctgatcttatcccatccttactgacactggctctaaatgatgctttgacttatgataaggcaacaaaatcgggtggtccaaatggctctatacggttcagtttacataggaaaaagtga

SEQ ID NO: 39191 - DNA, 1731 bp, Glycine max
  Peptide Sequence Number=SeqID_155969
atgaagaaacgcaagtggattccgttggtggtgctgagaaagttgctcattgcggccatatgttccatagcgtttgttgctctcttctctgcgcgcgtacacattgtcccttcttctaaagatcacaggttcaacgacaagatctccacgactcaggatccgcaaagctggatgcgggagctcgccccacctcatttatccaaagctccacttcctactcccaagttgagtggttcaaaagggaatttagattaccagaagctgtggaagcctccatcaaatcgtgggtttctgccctgtacaaaccctacacctaattacaacactcctgccgagtcacaaggatatcttttagttcatacaaatggcgggctcaaccaaatgcgttctgggatatgtgatatggtagcagtagctcgaatcataaatgccactcttgtaattccagaacttgataaaaggtctttttggcaagatactagcaatttctctgatatttttgatgaagagtattttatgaattctcttgctaatgatgtaaaaatcattaagaaacttcccaaagaattggttaatgcaaccagagtcgtcaagcaattcataagctggtctggcatggattactatgagaatgagattgctagcttgtgggaagattaccaagttattcgagcttccaaatctgattcacgattagcaaacaacaatctgcctccagacattcagaagctccgctgccgggcttgttatgaagcacttcgcttctctcctcgcattgaacaaatgggaaaattattggtggagaggatgaggtcatttggtccttatattgcattgcatttgcgttacgagaaggatatgctcgcatttagtgggtgcactcatgatttatctcctgttgaagctgaagagctacgatcgatcagagagaacatttcctattggaaaataaaggagattgatccaatagagcagaggtccaaagggctttgccccttaactccaaaggaagttgggatttttcttactgctcttggatacccatcaacaactccaatatatattgctgccggagagatatatgggggggagtctcacatggctgaactgcgtttccgttatccattgttgatgagcaaggaaaagttggcatccatagaagagcttgaacctttttctaatcatgcatcccaaatggctgctcttgactatattgtatctattgaaagtgatgtatttataccttcttattctggaaatatggcaaaggctgttgagggtcatcgccgttttcttggacgtggaagaacaatatctccagacaagaaagcccttgttcatctgttcgataaactggagcagggaataataactgaggggaagaaactatcaaataggattattgatctccacagaagacggggtgagcatcagtcggattcgggccaagaatgctcaatccgaccaaaacagaacattgccatttcaggactgtatccaactgtgaagcatcctcggttggagaaaacggtgccatgttttacagtagcagaggtagcgagctatattgaagctgacatagaagggaacgaagaatgcagctgtgatggaggggtcatcggtgaggcagtcatacggcttcacgcggttgctgacgaggacgttgacggtgaactggttggtgttgtagcagttggtgtcggagaagacagtgttgacaaggaagactga

SEQ ID NO: 39192 - DNA, 320 bp, Glycine max
  Peptide Sequence Number=SeqID_155970
atgtgcatgatcagtttgaggttgtcagctttcaatgagtatgggttcagagttattaacatcctcactgggagtgtatgccacattgggtggtgtatagttgggaggcaagccatatggccatatggaggggtcaagtccacctcagcaatggtgctagtagcggctattgcaaccgcattgacctccattatctcctttatgctcatcatggcctccattattgtggccatttgctctttcaaggcctcagtgttggccttcatttgctcttgcacctcctctacttcacccattactctagctctagcaccggttcg

SEQ ID NO: 39193 - DNA, 1446 bp, Glycine max
  Peptide Sequence Number=SeqID_155971
atgggcgaaaaagaaaatccttctgcagaatctgcaccaaccacaaccgttcccaccgtttccagaaccacaaaaaaacccaagaaactaaccctaatccctctgatattcctcatctacttcgaggtcgcgggcgggccctatggcgaggagcccgcggtgcaagccgcgggccccctcctagccctcctgggcttcctcgtcttccccttcatctggagcgtcccggaagccctaataaccgccgaattaaccaccgcctaccccggcaacggcggcttcgtcctatgggcctcacgggccttcggcccattctggggctccttgatgggcacgtggaagttcctcagcggcgtcatcaacatcgccgccttcccggtcctctgcatcgactacgtccagaaaatcttccccgtcttccactccggctgggcccgccacgtggcggttctctcctcaaccctcaccctctccttcctgaactacaccggcctcaccatcgtgggctacgtcgccgttttacttgctgtgatttctctcaccccctttatcgtaatgtccctcatcgcaatccccaagattaaaccacacaggtggatcagtctggggcagaagggtgtgaagaaagattggaacttgttcttcaacactcttttctggaacttgaacttctgggacaacgtgagtaccttagcaggggaagttgatgaaccgcagaaaactttccccttggctctctttgtggcagtgattttcacttgcgtgtcttacctgataccacttttcgctgtcaccggagctgttttggttgatcaaactcaatgggaaaacgggtttcacgcgcaggctgcggagatcatcgcgggaaaatggttgaaaatatggattgattttggcgcggttttatctgcaattgggcttttcgaggcccaattgagcagcagcgcgtatcagatcctcggcatggcggagatcgggatattaccgaagcttttcggtgttcggtctaagtggttccacacgccgtggttggggattttggtttctaccataataacgattggtgtgtcgtacatggacttcaccgacatcatttcctcggcgaatttcttgtacagtttgggaatgttgttggagttcgcctcgtttctttggttgagatggaaatctccttccattaagaggccttaccgagttccattgaagcttccacttttggtggtgatgtgtttggtgccctctgggtttctggttttgattatggttattgctacgaaaactgtatatttggtgagtggggtgatgagcgtggctgggattgggtttttcttgttcataaaactctgcaagaggaagaagtgggtagggtttgaacaagaggaagatgatggctttgaaagggataatgtgtcttcgctgtgtataagtgtagtagtcttagattga

SEQ ID NO: 39194 - DNA, 372 bp, Glycine max
  Peptide Sequence Number=SeqID_155972
atggctggccatatgggtagaggtgtcatagaagagcaggtatggaggaagggaccttggactgctgaagaggacaggttgcttgttgagtatgtcaggttgcatggtgaaggcagatggaactctgttgctaggcttgcaacaaacaagaactctgagtacttcgacatccttaccttgacagtagcaagatcgcgacaccactccaaagagcacgacttcggctatggtggtggtgggaacaacaggatatttttagtagtgtttcttttaccaacaaaaatgcaagagtatgagttggccactgagacgaattttgacctgcgttttccgatgaaatccctagcgataatggagatgaagaactcttga

SEQ ID NO: 39195 - DNA, 201 bp, Glycine max
  Peptide Sequence Number=SeqID_155973
atggcagaggagtgcacaatggtggatgtgcataacgacattgtgatggtggaaaggagttgcccccatggagcctcgaaggtggagattatgcacgggtggaggtcgcgcacgaggagggtggagtcgcaggggtttggtgagaagaaggttggggtgtggggagtgggtgtgatgatggaggaaggaggggcaaaatag

SEQ ID NO: 39196 - DNA, 156 bp, Glycine max
  Peptide Sequence Number=SeqID_155974
atgttcgattggcttcatgcggtgattcttttcgggatacagcgaccggccaatgtcgaccgaaacacaacggcggttgagttcccacgaaataccccaggcgacctcgatggtaaacctattactgagcgaaatcaaaaaggaaaatttgcttga

SEQ ID NO: 39197 - DNA, 333 bp, Glycine max
  Peptide Sequence Number=SeqID_155975
atggcgttcatcttactcggtttttcgaaagaattcgccatgaatgccattgtttcgatacggaatctgacaaaatcctacgcaaacggctttcaggcgctcaaaggtgtcagcctcgatatcagggagggggaaatccttgcccttctcggcccgaacggcgccggcaagacgacgctgatctcgattgtctgcggcctcgtcaatccgggtgaaggttcggtgcttgtcggcgggcatgatgtggtgaaggattttcgccagacccgcgccctgatcggcctcgtgccgcaggaactgacgaccgaccagttcgagacggtgtggaacacc

SEQ ID NO: 39198 - DNA, 210 bp, Glycine max
  Peptide Sequence Number=SeqID_155976
atgcagtcagctgacaagcgcgagtaccatatggtcatccgcacctttcatcaaccaggggcaaacgagcccgttgacgcgcagagactaacgtcgtcttctgcaccttctgtcatcctgacccatgaagtttactttagtcgtccgaagatattcaagcccaacgacgcacgagattcttctctgctgggcggtgacgatcaggtttga

SEQ ID NO: 39199 - DNA, 636 bp, Glycine max
  Peptide Sequence Number=SeqID_155977
atgcaatcacagggacttgcactgcctccggagcctgaggttgctccttcagggcctcgtgtcggcacaaaggagagttgtgttgatccctcagggaacgatccaaagatgggtgactcaaacaagtgtgggctgtacatcgaagcaaatccgccccacctggttgcccttggaagactttatgagggatcaacagttcacaacattcctttgttgcctggccaagtgaaggttggtgttgaggaggttaaagatgcacaagctcccgttcttgtacccactgatgaggttaccttagtggggcagacacttaacaccttccttgcttggccgacacatctcatgaaggctttatcagtacaacgtaattatttaactatgtttgatcagcaagcagttgtttctccagcaaaacctccacaaaggccggatcctgaggtcgatgatccgctatatttgatgacattgaccatcccagagcttttcttgcagcctttccaggttaactgggatgctaccatgtttggagtgtgtcatccaaacttcccgttgtacataaagtacgaagatctctctaaaatcgcacatggtagtcaatgtctcaacatatctgtcatacagttgtggattctgtaa

SEQ ID NO: 39200 - DNA, 105 bp, Glycine max
  Peptide Sequence Number=SeqID_155978
atgaaggtttggagatttagggatgaaggaggcacgaggaggagctttggttacgcagcaagactggatgttgtaatcgattacaggctgcctgttcttgtgtaa

SEQ ID NO: 39201 - DNA, 252 bp, Glycine max
  Peptide Sequence Number=SeqID_155979
atgtgtcacaaaatttccaaatcatctaatactttacaaagtaaccatcattgttatagtacccatgatttctttcaagctgctcaccataattattgttggtaccaagaaatggtttatccaagtggtactagacaagaatcccttaagcatgtagtaaagggtttgaatcctgacgaatgcatatatggagaaaatcttgttgagagggagatcccacttatgagtgccaacaggtcccttggaggataa

SEQ ID NO: 39202 - DNA, 360 bp, Glycine max
  Peptide Sequence Number=SeqID_155980
gacttcataaattctcaagggaggagaatgaagtttaacgtcaagtattatgcaagtcttgagaacatgttttctgatccatctattccttttactaaaggaaaaattggcccagcatctgctttggcagctgatattgttgggattggcgattcatggctcaaatttgctattaacaaaggtataattgagccaataagagatgtagaagatcaggagtggtttaaaagcttagatgacaaatggaagatttttttgagttccttatatatcagagacagttcctacataccttattttaagagagagactgttaggccaggaactgcagaaattgaaagtgggcttgagattgaatga

SEQ ID NO: 39203 - DNA, 375 bp, Glycine max
  Peptide Sequence Number=SeqID_155981
atgattacatggcaccgggttagatgcatatccgatttgatatgtgacccgagccggtgctatgcccgggttctgttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgctgaaagtcacaaattaatcacatgtatttcatgcttcgatgagcgttcacttgcatatcatgctgttggatatggaagaggatctcacattccagcagtagccattacatcatcaggcactgcagtttccaaccttcttcctgct

SEQ ID NO: 39204 - DNA, 330 bp, Glycine max
  Peptide Sequence Number=SeqID_155982
atgtctccaagtacacgagatgaaagcggtggcatgtcttcatccaccacattcaactatgcactcggagaacaaaaaaagacaattaacatatatgtattgtcacaacatgcccttttgcgggcgagcgaggtgaggtttacgggtgcgctttccaaaggaggaaagatgcgtggagtcgccaccaacgtttatttgtgggaaacgtcggaaaaaaccgatggaaaaccgatcaaaacgaaaattctaagttcgggagttgtatttacatttgaggaaggtattagcgcctctcacatttgtctcaaaggacaacaacctattttttag

SEQ ID NO: 39205 - DNA, 1075 bp, Glycine max
  Peptide Sequence Number=SeqID_155983
agacgacccggatcctggccgcccgctcggcggtgtattcgcagtccttcaaccgccgcgaaacgcgagcgcgcctccggcaacgtcgagcaaccgaaggaggccgcacgatgagcaccggcaacggccacttcaacctgctcgcgcgggtgctgcactggtccatggcgctgatgatcatcgccatgctgttcatcggcgtgaccatggtcgcctcgctgcacctgcggccgatgctgatcgacctgcaccgcccactgggcatcgccatcggcgtactggtgctgctgcgcctgtacaaccggctgcgccatcgcccgccgccgctgccttccgacctgcccgcctggcaggtgctggcagcgaaggcctcgcactggatgttgtacgcgctgatgctggcgatgccgctgatcggctgggcaatgctgtcggcgggcggctacccgatcgtgctgtggggtggcctgcacctgccgccgatcgtgccgcacaccccggcgctgtatgccgcgttgcgcaatgcgcacagcctgctggcgtatgtgttgttcgccacggtgctgatgcatgtaggggctgcgctgttccacctgtgggtgcggcgcgatggggtgttccaggcgatggcgcgcgggaaggattgatcgggttcgccggggccacacccgacgctaccagtgtgtcggcgcacgccgctacaaccaccccttctgccgcgccagccggtacgcctcgatccggttggccacacccagcttgccgatgcactcggacaggtaattgcgcaccgtgccgtgcgacagccccagctgctcggcgatctcgctggcggtacggccttcgccggccagccgcagcacgcggcgctcgcggtcggtcagtgggtcggcctgcgaccaggcatcgagtgccagttgcgggtcgatcgcacggataccctgcttcaccttgcgcagtgcatcggccaggttctccgccggtgcgtccttcaacaggtaccccagcacgcccgcttccagcgcgcggcgcaggaaaccggcgcgggcgaaggtggtcacgatcaccaccttga

SEQ ID NO: 39206 - DNA, 174 bp, Glycine max
  Peptide Sequence Number=SeqID_155984
atgcacgataactggccttctgtcagccgctcccagattgagttagatgagctggaaagtgtttccattctgtccatgacccttgcatgggatgaattttccttctctacttttcaagaagcccattattcgcttcaagattctctagaccaggtgcctgacatgcctttttga

SEQ ID NO: 39207 - DNA, 465 bp, Glycine max
  Peptide Sequence Number=SeqID_155985
atgaaaaaagacaacaattggtacctcaaagccttacactggggcaatgaaaggccccatgcagaaacctcaaacgaacctaggggcagattagaagttctcaccccgataggttcccagctacaaggtcatgacgaaagacaacaattgccttacactggggcaatgaggggcattgtgcatgagcctcaagtgaacataggggcagatcaaaagttctcacccgtcgatgtttttaaacaagaaaaaagaggagggggagacaaaccctggaatttcaatagatggattaaacgtcaaacggctccattgccgtcactccaaaatggtcaagtgactaaatcaaacagaacatacactctgagggagttcccagagagatttgcaaaagataggatgaggttgcatgaattatcacctttttcaaaaaaggacagtcaatctgtgttttccaaaaaagattaa

SEQ ID NO: 39208 - DNA, 405 bp, Glycine max
  Peptide Sequence Number=SeqID_155986
atggccttcagtgcgacagatgctggtttgttgctgttgccctcagggattgcgctggtgttgaccattccgttggcgggccggatggcagacagattttcaccccgacgtattaccctggcaggcttggccatattcggtgcctcgtttttagtctttgtgtttgtggcgatgcgggtgcaatactgggagatcgttgctgcgactgtgctatgcccggcagttgggcggggttgtcggggtgaccatgatggcggtgtttatggagtggcgggagcaggtatggggctcagtggcgccaggcgtgtttcaggcctatgcacaaggcttcttattgctgtctgtggtgtttgtgctggcgatactggtggcgatgggaatgaaggatgcaaggcgccaaggtaa

SEQ ID NO: 39209 - DNA, 473 bp, Glycine max
  Peptide Sequence Number=SeqID_155987
gattgacagactgagagctctttctgattctatgggtggtggtgcatggccgttcttagttggtggagcgattgtctggtctgtgatgcccttagatatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacg

SEQ ID NO: 39210 - DNA, 1271 bp, Glycine max
  Peptide Sequence Number=SeqID_155988
tcagagcactatccgtcttcgcttttagaggactacacgtcctccccttcagaggtttgcacgccctcaccttcagaaggctacactctctcgccttcagaggactacacatcctcgcctttagagggctacacgtcctcaccttcagaggactacactttttcccctctagagggctgcacgccctcgccttcagaggactacacgtcctcctcttcagagggctacacgccctcacctttagaggactacataggactacacatcctccttttcagagggctacacgccctcgccttcagaaagctacacgtcctcatcttaagaggactaaacgaccttgccttagaggactacacatcctcgccttcagagagctacacgccttcgccttcagagggctacatgtccccaccttcaaagggctgcatgccctcgccttcaaagggcgacacaccctcgactttagaggactacacgtcctcaccttcagaaagctagacaccctcgcctttagaggactacacgtccttcccttccgagggctacccgcccgcgagttcaatggactgcacgtcttcctcttcagaaggctacacgcctgcgctttcagagtactgcatgtcctcacattcagaggactaaacgtcctcaccttcagagggctacacgccctcgccatcagaggactacacatcctcgtcttcagaggactacacgtcctctcctgcggaggtcaacacgtccacctcttcaaaaggctacactccctcgccttcagaggacaacacatcctcgccttcacaggactgcacgtcctccttttcagagggctacacgccctcaccttcagatggctacaggccctcatcttcgaaggactacacgtcctcgcctacagagggctacaagccctcaccttcagaggactacacaccctcagcttcagtgggctacacatcctcgcctttagaggagtacacgccctcgccattagaggactacacgtcctcgcctttagagggctacatgccctcgccttcagaggactacacgtcctcccctttagaggactacacgccctcaccttcagatggctacacgctctcaccttcagatggctacacgccctcacattcagaggactacacttcctcgcctatagagggctacacgccctcgccattagaggactacacgtcctcgccttcagaggactagaagtcctcaccttcagaggactacacgtcctcaccttcagaggactacac

SEQ ID NO: 39211 - DNA, 237 bp, Glycine max
  Peptide Sequence Number=SeqID_155989
atgtatattgttgtggtaaaacaggagcaggatcaccttgggctaccttccggagtagagacaagacatgaacggcagaaaccaatcaaggtacttaaggacgaacgcaagtggggatggggtcacgaccgaccgatcgttgcccttctctgtgcgaaacaagcagagaatgtcgctgcaaggcagccccgtatcctttgtattttgcagctttcttttactttttgtttgttttaa

SEQ ID NO: 39212 - DNA, 378 bp, Glycine max
  Peptide Sequence Number=SeqID_155990
atgactcatcaggattttcaagtgcaagccattggtcagtttgctcaagcaacctgtgctcctgagtttggacctccaagactgttcaatcagagattactcgtcttgcacgttggtggggttgccgtaaaacaacgacaaaagataaatagcaataaaagaagtttaaaggaagagaggaatgcaaacttgatttatactggttcggccacttcccgcgcctacgtccagtcctcaagcaacccacttgagattttccactctctttgtaaaactccttttacaaagtctgaaccacacagggacaacccttcccttgtgttcaggaatcctctacaacaagagatccacgatctcttaatcccttttcagaaataa

SEQ ID NO: 39213 - DNA, 390 bp, Glycine max
  Peptide Sequence Number=SeqID_155991
atgccgatctccccctgcgaaagtatcagtttggatcgcacccataagacacccagtggacccggaggagcccaacaaggccctagggtttccagctctgggatcgcgcccacaagacactcagtggaccctgagaagtccaacaagttctatggagtgcctgtcgcccccagcaaggtcatcaggccccttactaaccgagctttcatcaagaagtactgtgcccccaggcaggcgcagggcgagacaccacaacagcctggggatggccggcagcgggcaacagacgcaccgccgacacctccaaaagcccctcaactcatctacaaaagctggagcattgcctacgaaccgtggtcgaccagcaggcggccaagtccaaagccaaag

SEQ ID NO: 39214 - DNA, 332 bp, Glycine max
  Peptide Sequence Number=SeqID_155992
ggatcacgcccgcaagacacttagtggacccggagaagtccaacagggtcctggggtttctagctctgattatgggcctctgtcagttctacggagtgcctatcactcccagcaaggtcatcaagccccctactaaccgagctttcatcaagaagtactgcgctcccaggcaggcgcagggcgagacaccacagcagcctggggatggccggcagcaggcaacagacgcaccgccgccacctccaaagcccctcagctcatctataaaagctggagcattgcctacgacctgtggtcgactagcaggcgaccaagtccaaagccaaagataa

SEQ ID NO: 39215 - DNA, 732 bp, Glycine max
  Peptide Sequence Number=SeqID_155993
atgaaggtctacatggaggccatgaaagagcaaatgaccacaatgatggaagccatgatgagtatgagaaaaatgatggaggtcaacacgactacagtcgttgccgcaagtaccgccactgaggtgaacttgactaatccctctggtcatgcacaggtccctcaacccatgggggagacacatgaagtaccccgaagccacactctagccgacttcgagcctcaccacgaatatgccactgaggggcagacatttggtggcatacccctgccaaacactttggggggccctcagtatcgcccacaaccattacattttgcagtgggaagactgcctcctgccatggtggaaagggaaaaatttgatcatatagaggaaacgctatgggccattgaaggaggtggaaattatgcctttgctgacatggtggagttgtgcctagtgcccgatgtcattatccctccgaagttcaaggtgccgaatttcaataagtacaaggggactacttgtcccgagaatcacttgaagatgtacaacaagaaaatgggggcatactcaaaaaatgaaaaattgttgatgcatttcttccaagaaagtcttactgtggcagccgtcacctggtatactaatctggaaccttcttgggtccattcctggaaggacctaatggttgcattcattaggcagtatcagtataattttgatatggctctggatagaatgcagctatag

SEQ ID NO: 39216 - DNA, 480 bp, Glycine max
  Peptide Sequence Number=SeqID_155994
atggaagtttcatggccttcttgcatgggttttgggtttctacagtttattaggccacaaggaattcaggtttgtcttgccagttcttccgatagttctgatgttttctgtttattctttggccatgatagaagatcccggttatgcacaagaggacccgaggatgtcatgaaccaccttgctagagaagctcttcatgggaaagtgaaaagcatcctattcctaatgccttgccatgccactccctactattccatgctgcatcataacctgccaatgcaatttctggactgcactccaagtgaagagaaaggagttcctgatgagtctgaccgtttcttgatggaccctgttacatttgtgtctgaatatgcaaaaaacaagtctctgcccagccacgttgttttatttgattcggaagaacaaaaactgaggaaccttttaatttcatttgattatagagaggaaattttgcagtag

SEQ ID NO: 39217 - DNA, 909 bp, Glycine max
  Peptide Sequence Number=SeqID_155995
atgaagtttctgagcattgtgggaaattcttttggatgttctgcatccggtgagcgcctagtttctgcagcaagagatggggatattcaagaggccaaggccttgttggaatataaccctcgtcttgctaggtattccacattcggagttcgcaattcccctttgcattattctgcagctcatggccaccatgagatagtgaatctcttgcttgagtccggagttgatatcaatctcaggaactatcgcggtcagactgcattgatgcaagcttgtcaacatggtcactgggaggtggttcagaccctgattatatttaatgccaatatccataaagctgattacctaaatggaggtactgtccttcacttggctgctttgaatggccatacccggtgcattcgactcatcctcgcagactatatacctagcgtccctaacttttggaatgcattacagacaggtgatcataaatcaatctcagaatttgatcaaagtggactctgcgaggtgattaacagaactgctgatggaggcatcactgctctgcatatggcagtattaaatgggcatgctgaaagtgtgcaattactcttggacttgggagcttctgtgtctgaggttactgtggaggatggaactaccattgacttaattggttctggaagcactccactccattatgctgcatgtggtggaaatcaacaatgctgtcaactgttgattgccaagggtgccaatctgactgctgagaatgcaaatggatggacccccttgatggttgctcgttcgtggcgtagagactggcttgaggacatcttaaaaacacctccagaagaccccttacaagttcttccttctccatatatatctcttccacttatgagcattgtgagaattgctaggtaa

SEQ ID NO: 39218 - DNA, 186 bp, Glycine max
  Peptide Sequence Number=SeqID_155996
atgcatgcaaaagaggtgcggaagaatgggagaggaacagatagaggtgcagaagggagagaggtcttggagttcctagaagcaggcaagattttgacatatgaacatattaatggtggtcctccttgtcgtggaatggagaggtcagaaaatttcaaatcatatccttctcccctaatttactaa

SEQ ID NO: 39219 - DNA, 150 bp, Glycine max
  Peptide Sequence Number=SeqID_155997
atgactctatttcgcacacgacttcctatcgaatcaaagatcaaacgtggagtgggatatcgccagtcgagaacgaccttgaatggcaatctgaagggaaaagacaccaaaaatgggttttcctttgccggcagtcccttaccttgctga

SEQ ID NO: 39220 - DNA, 2427 bp, Glycine max
  Peptide Sequence Number=SeqID_155998
atggaagtgccatcaggggcattttggacagatacagaagtagagagcacaagtgatcagccatgtgatccgaaagatggtgaggatcaaaatagtacttgtgaagaaatcatcaacattaattcatgtgtaaaaatatcatcctctccaggttgcaatgagactgttgggagctcacctgtagttggttttccttgtgagcctgccctgttggatccagagtatgaaatgaagaatggcatgctgcaaatagaagatgatgcctgtaaattgaaggactgttcctcagaggaaactaccaactctacctttagaaaaccattttctccagaatcaggtctgccctctgttgctttaattaccaactgctctgcaaaggatgttcctgatcaacagtctaagggtgatgatgtttccattgataataataatgctgtgaacaatcaagggcagatggataatgatggaacagaagctgttgaagttgatggtatcactgaaggcataccgttaccttctcaaaggaatagtcgaagaactaaatttggccgtaagacacaaaccaaaaaggcttcaagaaaatgcaagaacaaaaccaaggttacacatccaaatgggggtatgaagctaaacttagaggctgctagaaagaaaagaagttgtttctccaaaccagctcgttcttctatctggggattgattggaaatattgaacagttttttgagcaagataatgagcttggagatggtgaagctgtgtgccaagaattggggaaggctagaagcaagcctcaaagtgggaaagcggttaagaatggtgcaagtactacctcattgggttcagtacagaagcattctgtttcaactactcgtgttcgtctgaagatcaaatttgggaaagaagttgatttaagttgctcaaatgtcttgattccagagtctgttgatggcttggcttctgcttcctatttggggtctggttcaggttctcagaaagtagctggcaatgctgatgataaaatttctgaagtggtggctttgggccattcagaatctttcaataatgacctggacaaggatggttttgttctaaatgaacaagttgcaaataaccccttagaaaccactgaaataacagagaagtcatatggggatgcagaggaaccttgtcttgcagttcctccagagaaggtggttgaagcattgattgaacctatcaataacaagggtatggatcctggaacctcacctgattctgaagttatcaattcaattcccgaagtccaggctggagaaaaacatcaagaagatgcacatcatgctgttttaggttcttctaaagaattaaattctaaattggatgttaccatcagtaagagagggaagaacaaagagaaagttatttgttcaagtaattgtatcactgaagatggatcacaaggtccacataagaatagtagagctaagcattcaaagaatcacagacgtaagaaaaattgcagggatgtggtcagctctttggaattgcccactgatataagcaaatctttgagcagtaaagaattgtccccagaatcattgcctctttctgtagagactgaacttggaggctccactgaggctttgaaagttaaaaatcatacggacgttaagacaagtgacaaaccatctgttgaccatggattttcagattccctggttgctgagaatatgctgtcatctgcaagacctttggagcgtaaactacctaaaagtcttagagctagtaaagttagcaagaccaaatctaaagcttctgactcaactggcaggaaaaagactactgctggtatacgcaaggagaaacagataaaggcaattaataagagcaaagtcaagggaaaaggtgtttctcttaaagttacatgtgaagtggaagattgcctgcatccagaagaaaatgctggaaatcataagctggatgctgttggaaaaattattgctgatgacaacagagtatcggtcaatttatctaatttggacatgctgtctggtgttggttatggggagcaacttctatcaccccgtaatgcatgggttcgttgtgatgattgtcacaagtggcggcgaattccagctgtgcttgcagaccgaattgatgaaactaactgcacctggacatgtaaggacagcagtgataaagcctttgctgattgtgctatccctcaagaaaagtcaaatgcagagattaatgcggagttgggattatcagatgcctcgggtgaagaagatgcatatgaaggttccaaaaattttaaggaattagaatatcggcctccgttagtttcccaggagtcaacttttacccatattttgaccaatgaatttctgcatcgtagccataaaactcagactattgatgaggtcctggattgttctagtttgtaa

SEQ ID NO: 39221 - DNA, 1587 bp, Glycine max
  Peptide Sequence Number=SeqID_155999
atggtctgtcattgcaagccatctcaagaaggaaagttgggctgtggggatgaatgtctaaatcggattcttaatattgaatgtgtgcaaggaacctgcccatgcggggaccgttgttccaaccagcagttccaaaaacacaagtatgctagcctgaagtggtttaaatgtgggaaaaagggttatggactgaaggcaattgagaatgtagctcaaggccagtttcttattgaatacgttggagaggtacttgatatgcaagcatacgaggcacggcaaagagagtatgctttgaagggtcatcggcatttctattttatgaccttgaatggcagtgaggtgatagatgcaagtgcaaaaggaaacttggggcgtttcattaatcatagttgtgatcctaattgtcggacagaaaagtggatggtgaatggggaaatctgtattggactgtttgcattgagggatattaagaaggtgtgccttcagccttcacttgctactttcatcaagtgtaagtgttattctgtgccaaaagctgaatttgtttatcaccaccctccccaggatgaagaattgaccttcgattacaactatgtgagggtttttggtgctgctgccaaaaaatgttattgtggttcacctaactgtcgaggttatataggtggtggtgatccacttaatgctgaactgatagttcaaagtgattcagaagaagaatttccagaacctgtcatgctcaccaaagatggtgaaattgaagattctgtacctacacccgagtattttaataatgttgatacacaatctgctaaacatatgttgaaagacagggatatattggacaattctacaactgctatagattcggatggttctctagagaaagagcgttctatgaaccctgcctctgctgtttctctgttgcacagctcagcagaaatggaggattcaaagggtaaattacaatcttctgttcaagttgaagaaatttctcaacaaatggaggatgtaacaagcaaacccatgcctgctgtacaccaaggatatgaaaaggaatcagaatttgcagacaaaacttcttccattcaaagattagacactacttctccccttacaactgtcagcaaaatgttaccgaattctgctggtagtaacagggagtcaaagtctgaaataattggaggcaggaagactcctaagttaaaaggttctgttaaaaagggaaaggttcatgctaatcctccaaatggccttaaaactgaggtgacagccaatcgattacaggtgccatcaataaaacacaaaaaagtagaaggttcttccaatggacggtttgaagcagttcaggagaaacttaatgagttgctggatggagatggtggaataagcaaaagaaaagatgccaccaaagggtacttgaagcttttgtttctcactgtggcatcaggagatagaattaatggtgaagcaattcaaagcaatcgagatctttccatgatccttgatgctcttctgaaaacaaaatctagagcagtgctgaatgatataattaacaaaaatggtaatacatatttgctttctatgtaa

SEQ ID NO: 39222 - DNA, 503 bp, Glycine max
  Peptide Sequence Number=SeqID_156000
atggaactgctgctccagccaccaccacgtccacccagcgatgacagtggcgaacagcaccagctagtgcctcctcaagtacatcctctcacggtctcattcctccatgccaagaaccccgacgagacttctccccaaaccaccgccacggacaccaagctccgcggcaagggagcgccacaggaggagtttagtgtcgaccacgtgctgaccaagcgccaccgtcgtgagaagctgaatcataaacaagttggacatgctttgttttggggtccaggaggttgtgaagaacggaaaaaggtatatctatgctatgcagctgaaccccggaacactgagctagctgtcaaattgttacataaagcttctgtttgtgggaatctttgtgcccagtaccagcttgggctttgtctgcatcgcggtggtgggaggggggtgccatcagcaagcatgaatgaaggagtgccatcagcaaggcccaacaggaaaagcacaaaaccaaa

SEQ ID NO: 39223 - DNA, 882 bp, Glycine max
  Peptide Sequence Number=SeqID_156001
atggaatgtaaaaggaagagtttgacatcaagtcctggtgccaaaaggcagcaaagcagtgagacgatgatgactagctctagcttgttcttctcctcaccacccctctttctcaatccccacccacctcgctctttcctccccttcagacctctcaaaccactcttcaacccctctcttctcctccgccctccctccaaatctcgccacaaccctttcctaacccgcgccgacgatgacgacggcgacggcggcggccccgaccactacgagatggacgaggacgaaatggaggagctcgacaacaagaaggacttcgacatcgagtacgaccccctcgtccccgccgccgccgccgccgcttccgccgctggagacgacgacatcgccgtcgtcgagagcaagagcttcgtgtccacgcagggctggcactccgacaccgtcgtcgactacaaaatcaacgaggacgagttccacaagatttgcctggtcgattgcgacttcttcattcgcaagccccctgaccccgacaacgatgtctacgacttcagagagatgtatgttactcctccagatacagatgtttattcagttcccaaggttctcgctccaatgccgcagaagtacattagatgtgcgcagagtgattatggaagctacaatgtgacagagccacctattgatgcgccgcgagatcctctgtataaaactgagagggagatcctcaaggtgtacttgacaaaacactacaaaaatcgaaggaagggtgattctgagtttgtgcttgattttgaagagatttatgttattgattccaaatccaagtcaattaccagagccaaagttttgacattatattcatggaagtgcacttttgcttaa

SEQ ID NO: 39224 - DNA, 477 bp, Glycine max
  Peptide Sequence Number=SeqID_156002
atggggaggggtaagattgagatcaaaaggattgagaactcaagcaacaggcaagttacctactcaaagaggaagaatgggatcctcaagaaggcaaaggaaattagtgttctatgtgatgctcaagtttcccttatcatctttggtgtctccgggaagatgcatgaatacatcagcccctacaccacgttgattgacgttctggacagataccaaagagcttctgggaagaccctctgggatgctaagcatgagaacctcagcaatgaaattgatagactcaagaaagagaatgacagcatgcaaattgagctcaggcacttgaaaggggaggacatcacgtcactcaattacaaggaactgatggcactagaggatgcccttgaaaatggcctcagtggagtccatggaagtgcacaggatgttcaagagaaatcaacagcatttggcagtagaaggaattggaaacatgcatga

SEQ ID NO: 39225 - DNA, 2715 bp, Glycine max
  Peptide Sequence Number=SeqID_156003
atggtgttctccgtcgaccggattactcccaccttcgtgtctgtgttttctgccaaggccagagtgttggctttccgcttccaattgcggaggaacacagacctcgttaccgcccaactttccaactctttcgccttcaatttcggattggattcccagagtttgaattccattgaatcccatgctgcaccacagttgccttggactggtccagttccaggtgacattgctgaagtggaggcatattgtaggatctttaggaattccgaaaggcttcattctgcgttaatgcatgccttgtgtaaccctttaactggtgaatgtagtgtttcctatgaggttccgtacgatgagaaacctcttctagaggataaaatagtatctgtccttggatgcattgtggctcttgtgaacggtgggaggcagtatgttctttctggaaggtcttcaattgggactcccttttgttcagcagaggtcagcgtcatggaggatacgctccccccccttgcccttttcaggagcgagatgaagaagtgttgtgagagcttgcatgttgctcttgagaattattttattcctggcaatggtcggagcttggatgtgtggaggaaacttcagagactgaagaatctgtgctatgattctggctttcctcggggggaggattatccgtctcctgagctgtttgtgaattggactcctgtgtatttattcacttccaaagaggacatggagtccaaagaatctgaagcagctttttgcaccggcgggcaagtaacagaagaaggcctaaagtggttactggataaaggatataaaacaatcatagatctcagagaagaggatgtaaaagataacttctatcaagcagctgtgtgtggtgctatttcatctggcagtatcgagttggtcagaatccccgttaaagttaggactgcacctacgatgaaacaggttgagaggtttgcatcttatgcttcagattgcagcaaaagaccaatttttcttcatagcaaggagggagtttggagaacatctgccatggtctccagatggaggcagtacatgactcgccctgcatcaaagtttttttctaatcaagcagttatttccaatgacatgtcatcatattatacaaatggatctggaaagctgcaggactcaatgattgccgaaggatcctccctgcaaaaagatactaatttgctgcaagagggtttgggtgcaacacatggttctgccggcacatttgactcatgttcctcttcaaaaaagaataacgaaaaaacaaaaagtaatggagctttaagtgaacttactcctgatgatattgcttcatcacaagccactgctgctactggggaaggatcttttcccagtttctccagtgaaactagccctttagaagctcaagttcctccttttgatatcttctccaaaaaagagatgtccaaatttttgggaagtaggaagatctcaaaaccctctcatttcagttatcatggtaaaagattggaaggcctgccagattcgaggaatcttgaacctaaaattgtggatccagcaaaaagttccaacgggtcagctcatgtggattgtccatctggagagtcccagaacacagttggtagcaattggaagttagtgaatttgaataattccagctctgttaggacaacagttaatggatttagtgaaggggaaatgtattacaggagtgatgccaatttctctaccactgtgaacaatgatattgataatgtcaatactaactctcaaaggattggagttaataatgataaggctgggctagccttatgtgatgaagacctggggctcattgaaggagacatgtgcgcttcatcaacgggggtggtaagggtgcagtcaagaaagaaagcagagatgttcttagtacgaacggatggattttcttgtgccagagagagggtgagtgaatcctcattggcctttactcatcctagcacccagcaacagatgcttatgtggaaaactacgccaaagacagtattactgttgaaaaagccaggagagcatctcatggaagaagctagagaggttgcttcttttctatattaccaagagaaaatgaatgtttttgtggaacctgatgtgcatgatatatttgctagaattcctgggtttggatttgttcagaccttctatacacaggatacttgtgatctacacgagaaagttgattttgtagcatgtttggggggagatggtgttatactgcatgcttcaaatctgttcagagatgctattccccccattgtgtcatttaaccttggttcccttggttttctgacttctcataacttcgaagacttcaagcaggacttacaacaagttatccatggtaatagtacaagagatggagtgtacatcactctcagaatgcgtctccgatgtgaaatttttcgtaagggtaaagctgtaccagggaaagtatttgatattctcaacgaggttgttgttgatcggggttctaatccgtacctttcaaagatcgaatgttatgaacacgctttcactatctctaaacaccttttagaagcagtgtcatttcttctatatgatgattgtcatgtctttcaggtacaaggtgatggagtcattgtggccacccctactggaagcactgcctattctacagctgctggaggttccatggtaagcttgagctag

SEQ ID NO: 39226 - DNA, 2262 bp, Glycine max
  Peptide Sequence Number=SeqID_156004
atgaattcggtgtttccgatggccgaggagaagagggcgtcgtcgttcgtgaagaaaggcgaccggcaaatgttcacggtggagctccggccaggtgagaccaccatagtttcgtggaagaagctgttgaaggacgctaacaagcccaacggatccacttcggtgccacagtacgtcgcaatcgctccgatacggctggactaccatgatctagtagagtctttaatatttgagaatcatggtcaacctgttgaggtcgaagaaacagatccttctcagccaaaccgtttcagtgctgtaatagagaagattgaacgcctttacatgggtaaggatagtagtgatgatgaggatctgcttgatgttcctgatgatgatcagtatgatactgaagactcttttatagatgatgctgaactggatgaatattttgaggttgataattctgcaatcaaacatgatgggttctttgtaaatagggggaaattggaacgcataaatgaacctcctgtactacctaatcagcaaccaaagaaaaggcgcagaaaagatatattgaagaatgctggtgaaagcaatgatggtcatggatcaaataaaaatgtaaaagttggcaggccagcatctgccaaaacagcttcactacaggcaaagaatatgttaaattcgtctgagaatttagttacacctggtgaacatattgaagacttgaaacttccaaatcaaccggacgtctctggaattatttcgaaaaggaaaactgctgatactaaaccaatattgaacccttctgtctctttgaaaacatcaagtgatgatgttcctgctgtaacagatgcaaaagatgctgacaagcagaagataggagcttttcaatctaagaacattagtgataaatataaagatgacagtggatcatttgatgcatctcatcataaatacaatgaaaaaagtgcttatgctcattccaaatcccaagctggaagacccctaagtaatattgatgatttggaaaatatcaatcggacaaaagaaaaaaatggtatgcgtgagctgccagatcttaacttgtctgagggaaagtctgctacccaagcaacaaaatctgaaaacatgcacaagaaagagggttctagtgttaggccaaaaacttcaatgcttgaaaaggctctttgtgagttggaaaaaatggttgcagaatctaggccaccagcagtggataaccaagaggctgatgctacatcccaggcagtcaaaaggaggttgcctagagaaataaagctaaagcttgctaaagttgctagactagcggcaacgcatgggaaagtatcaaaagagttaattaaccgtcttatgagtattcttgggcatctgattcagctaagaacattaaagagaaacttaaaaataatgatcaatatgggtctttcagcaaagcaggaggaggataataggtttcaacagataaagaaggaagttgttgatttgattaagatgcaggcccctactctggaatccaagcagcagcagaaaggtgaagcatctggtgattttcaagaatttggtcctgatggaaaaccaataactaaaaggaagtttactatggatgctgcattggaggacaagatttgtgatctctatgatctttttgtagatgggttggatgaaaatgcaggtccacagatcagaaagttgtatgctgaggtgcttgcacagttatggcccagtggttacatggacaatcatgggatcaaacgtggaatttgcagggcaaaagagaggcgcagagcactgtacaacaaacataaggatcaggagaaaattaagaggaaaaagttgctggtacctaagcaagaggagaatgttcgatttgatatcaattcaattgcttcacagcagaacccacgggagagatcagctccagagtctagcagtcatgcttatacttcagggaacaagcaagcttctaacacaagcacgactggccgggtcccttgtccaatgaatggtctaaaacaagaaaaaacaaagggaagttcaagcagttccgtggatgatgtcagggctgcagatggtgttttgacaaagaaggtaaagagaaaaccagaacttgagttggaaggaggacatttaggtgctgagaaggtagcttccttgcagggagaagaaaggcccaggtccctaaagcagtctatagggtcacttcccaccaaatcaaatcttcagccaacatctctgcctgatcttgaacagtcaagctaa

SEQ ID NO: 39227 - DNA, 654 bp, Glycine max
  Peptide Sequence Number=SeqID_156005
atggacatcccactgagaagcactaggaagtaccttttcaaaaaaacagacctgttgagattaagggagctagcatctttacttgtccccacacttgaagagtactcctacctagtaggtttacctgtgccagacaagatacctttccatggttttgagcctacccctaaaccctccgacatcgcagccgccctccatcttaaaacctccatcatccaagcaaaccttacctctaaaggaggcctccaaggtcttcccacccacttcctctaccaacaagcctccatatttgctgaagcagctagtatccttgccttccattctatcctagccctccttatatatggccttttattcttcccaaatgttgacaacttcatcgatatcaatgccattaaaatctttcttacaaagaaccccgtacccactctactcgccgatacctaccattctatccatgaccgtacccaggctggccggggaaccatttcttgttgtgcacctttactctatcaatggtttaccttccacttacctcaatcccgtgccttcaagaccaatgatgacaagctttcctggcctcgccgaatcatgactcttgacccatctgacattgcttggtaccaagcagctagtgatgttggagagattatt

SEQ ID NO: 39228 - DNA, 372 bp, Glycine max
  Peptide Sequence Number=SeqID_156006
atgttaatgtgtaatgatcaattttcgtgtgttggtccgattgagttattatgcaccattggaagaacaccagatggagtaataaacttacttcaacgcactatgccccgtactcatgatgtgatcatgtattacaacgggaaatggaacatgccaccccagaacaaatttgttggatgcgcgttcacaggaaaaaatcctaagaaatttcaaattccttcaacatgtaccatcgatgaactgaaggatttaataaagcaagttgcacctaaagggattccccctcttggaattcacgaattcaaacggtgttatttgatggaaccagggaacggcattaatttttttaggttctttgacgtccaaacatga

SEQ ID NO: 39229 - DNA, 213 bp, Glycine max
  Peptide Sequence Number=SeqID_156007
atggcatgttctctactggtttctttgctgatggcgaaaatgcatattccctttgggtcctcgggtttctactctctgttcttcgacaatgacaacattctccgtcttctttacgatggtcttgaagtttctgcctttactggccacatccatggctggcatcttggaaagctcattaggacgcagtgcatgctcgacggagtagtgaagtga

SEQ ID NO: 39230 - DNA, 2663 bp, Glycine max
  Peptide Sequence Number=SeqID_156008
atggcgctggcgctgtcgccgctgttgggctcgttgcccggccgagcggcggatgcgccgccggatatcgcccgcgttgcggcgctggaatggctgccgatcgaactgctgttggcattgggcgtgacgccgctggcggtggccgatgtgcataactacaacctgtgggtggcggagccgaagctgccggcgacggtggtcgacgtcggccagcgcaccgaacctaacctcgaactgctgcagcagcttcagccttcgctggtgttactgtcgcaaggctatggcccaacgccgcaaaaaatccaacccatcgcgccaaccatgagctttggcttcaacgacggcagcggcaaaccgctgaccgtcgcccgccagtcgctgctggcgctggggcaacgattgggcatagaaagccgcgcggtacagcacctggcgcagtttgaccgctttatgcaggacgcgcgtcagcgcctgcaaagctacacccggcaaccgctgctgctgttttcactgatcgacacgcgccatgcgttgatcatcggccagaaaagcctgttccaggaagcgatggatcaactgggcatccgcaatgcctggcaggaagaaaccaatttctggggcacggcggtggtgggcattgaacggttggccacggtgcgtaatgcccgggtcatctatctcgatcacggtaatcaggcgatgatggacaaggtcagcgcgacgccgctgtggcagtcgttgcccttcgtgaggcaaaaccagctgcggcaggtgccggcggtgtggttctacggtgccacgctgtcgacgatgcggctcaggagagtgcgtcatgagttcgggcatccggaaattgccgctgacgctgatcctactgttgctggcggcggcaggtggcctgacgatatacaatctggcgcagcagctgccgccggcgcaatgggcgcgggcgctcagcgcgccggacatcgacgacgtgcggcaaatgctgttccattacagcctgttgccgcggttgacggtgtcgctgttggccggcgccggtctggggttggtcggcgtgctgttccagcaggtgttgcgcaatccgttggcggagccgtcgacgctcggcgtcgccgccggcgcgcagcttggcctgaccatcgccacgctgtggttggccgctatggtgggcgcgattgtggtgggcgggctggtgttcggcgtcgcctggggcaaacggatgtcgccggtcacgctgattctggccgggctggtgctggggctgtactgcggcgcgggcatgttcctgtggggcaccggcgcgttgaaccaacaggactggagcgccgtgcagttcctcctgccgcgtttgctggtggctggcctgttagcggcgctgttgctgcgcccgctgacgctgctggggctggacgacggtgtggcgcgcaacctggggttagggctgtcgatggcgcgcttctgtgctttggggttggccatcatcttcagcgccatgttggtgagcgcggtgggcgttatcggctttatcggcctgtttgcaccgctgatggcgaagatgctgggggctcgccgcctggcgcaccgcatgatgttggcgccgctgctgggggcgctgttgctgtggctgaccgatcaggtgatgctcggggtaacgcaggtgtggcgcgagatcccgaccggcgcggccaccgcgctgttcggcgcgccgctgctgctgtggctgctgccgcgtttgcgcagcgccgccacgccgccgccgatgaacctcggcgacaaggtgcctgccgaacgcgggaatctgcctggctggatcctggtgggcggcctcgtgctgctgatcggcctggcgctggcgctgatgctggcctgggcgcggaattggacgctctgctgccgtggcgctggccgcgggtgttgtcggcgctggcggcgggcatgatgctggcggtcgccggcacgctgatccagaagttgaccggcaacccgatggccagcccggaagtgttgggcatcagctccggcgccgcttttggcgtcgtgatgatgctgtttatgcctgggggcggccgctacgttgctgatcatcatgatcgccgcaggccgcggcggtttctcgaccgaacgcatgctgctggccggtatcgcgctcagcaccgcctttaccaccgtcatcttcctgctgttggccagcggcgatccgcgtatggggggcttgctgacctggctctccggttcgacctattcggtggagccggcgcaggcgctgcgcaccgcgctgatcgccgccggattgctggtattggcaccgctgtgccgccgctggctgaccatcctgccgctcggcggcgccaccgcccgttcggtgggcattgcgctgacgccgacgcggttgaccattctgttgctggctgccaccctgaccgccatggcgaccctgaccgtagggccgctgagctttgtcgggctgatggcgccgcatatggcgcgcatgctgggcttccgccgcgcgctgccgcaaatggtgatcgccgcgctgctgggcggcttgctgatggtgtttgccgactggtgcggacggatgctgctgttcccgtatcagatccccgccgggttattggcgacctttatcggtgcaccgtacttcgtgtatctgttgc

SEQ ID NO: 39231 - DNA, 234 bp, Glycine max
  Peptide Sequence Number=SeqID_156009
atggatgatggcgataaaaaaagacatgacaagaaaacccgtactcgtaggtatccgtctgaatccctctcgactttgacgggtaatactcaagttgatcgggtatgggttcgagtttgggttttccccgataaccaaaagtcggatatagagatattggggagtcgaggtcggggattgaggagacaataccaatctccaccccgtctcattgccatgtctaacagggagtga

SEQ ID NO: 39232 - DNA, 273 bp, Glycine max
  Peptide Sequence Number=SeqID_156010
atggaaaatccaccaacaagtagggactactttaattcctcaaatttgtttatgccaccaagagaacatttggaaggtgcagaagttgctgtctcgctacgtcgagatcgtgcgcttagcgagtatcatctgctaagcgaggcagcagttggcttaacgagtaagaggaatctggaagggaatcttccatgcaagtccgtgcttagcgtgtcatcagctcgcttagcgagtcatctgtccccttctggcactaagcgcgcttgtcgcaattag

SEQ ID NO: 39233 - DNA, 900 bp, Glycine max
  Peptide Sequence Number=SeqID_156011
atggttagaaccagaggtttgggttgggctttaggtagagttataagaagagccctagggagagaacctgaagaagtagttgttgatgatgtggttactattgttgaaggtttttcaggtggaccccacgacacatcagctttgattgactatgttcatcatgttgcaatgactgtttggaatggagatgtgactatcatcctcgatgatgtggcatcattgcttcatctacccatcacaggcgcctttcatagcttcgaggctcttcatatggatgaagtcgtgttgctgttagttgaattgcttgaagttaatttagaagaagcaagagctgagacaatacaatgccatgggtggaagctaagcatggagagcgctaggaaacttgtagaatatatcacacttttacagcattttccttctattgctttctgtattgctgctgaagattatcatgagaggaaaccacgtgcctatcattggaagtctaggaaggcatttctttgttttccggacatatctgatggggtccatctgttgtcagataccgaccagagagggttgtgcgatagtttggtggatcaaatatgtgttgtgtctggacagtgtgcagcagactacgtggagtggttctacaggatttctcatcccttcataagtccgacacagactgaggctccacctagacatccacatgtggtgcagaatgacacatttattgaaccagatattcctcagcacctggtggcggcaacaactatggtcgaaacacctgcagatgcacttgctcatgtagagcaccctcgacatgcaatggttggaacgattgctaaacctaaggatcgtgacataaggtacataagcatacactatcgccagagattgcctaaggatcgctag

SEQ ID NO: 39234 - DNA, 960 bp, Glycine max
  Peptide Sequence Number=SeqID_156012
atggagatcctccctcctgcatcaccttacacgtacaattccaattggcttctagatgacaacaggaccaacaacaacaccaaatggacccctgcagagaacaagctgtttgagaatgctcttgcggtttacgataaggacacgccggatcgatggcacaaggtagccgagatgataccgggaaaaacagtcatggatgtggtgaagcagtacaaggaattggaagcagatgtttgtgacatagaagcagggttgatctcaattccaggatacagaagcaccaccaccacctcacccttcaccttggattgggttaatcctgcctatggtgatggcttcaaaggactcactgctaagagatcctcctctggcagacctcctgagcaggaaaggaagaaaggtgtgccatggactgaagaagaacacaagttgtttcttctggggctgaagaagtatggcaaaggtgattggaggaacatatcgcgcaattatgtgatcactcggacgccaactcaagttgctagccatgctcagaagtacttcataaggcaactatcaggaggcaaggacaagaggagggctagcatacatgacattacaacggttaatctcacagaaaccaccagaacttcttctgatgaaagcaagagatccacttcgccacaacattccactattctctcacaccagcagcagcagcagcagcagccgaattctagtgtcgcctcatccggattgaacctccagtggagcaatcagccaaatgcaggagtggctatgccactcaaccctgcacatgaacaagtcttcatgtccccttatggccttaactcatatggttttaagatgcatggccaaaatctgcacagaagttctgttcatgagtcttcttacctaggacctcagacaccaaacatggttttccaaatgctgccctcccaacactattcccatgcatga

SEQ ID NO: 39235 - DNA, 309 bp, Glycine max
  Peptide Sequence Number=SeqID_156013
atgagacaggcaccagaaagtaggcaattaggcactatagatttagacgagggttccaatagaacagtgtggatacaatcagtccacacacatcttacttccagtttctcaaacgttctcccacaaggtagatgtttgccttggatatgccaatttggaattgtaaagctcctccaaaggccaaagcctttttttgacactaataacatgttacagcttttattccattggtgcccaaactccatgttctgctcaatattggccgcaaaatgcaccgcaacagctctacaagttatttttaataattga

SEQ ID NO: 39236 - DNA, 3382 bp, Glycine max
  Peptide Sequence Number=SeqID_156014
tgcccggtatttcttcaatccttcgacgagcgcgacgcaattcctcgtgtcttatcatgtggacactccgtctgcgaagcttgcctcgcggagcttccgcagcggtaccaggacactattcggtgccccgcctgcagcccaactcgtgaagtacccttctcaacaaggcccttcctctctccccaaaaacattgacctcctcagactctccctccaacactccccttccccttcctcttcctcttcctctgatcattcccagataccgaatcaacgctccacaaccaattcttgttactatcaccctcccttctcgtcccatgagctttatgttacatggaaggattggattctcccgcacgacgccgttttaacggacgatcattgtattggctggttcagttcgaccaagggtaggggttgcttcggagttaaccgtagtgtaagtcttgctcccattgtttgtttccctcctcgggatcgttccaagtttaggtttagttatgtcgcatgggtgattaagtgtttggaggggatgaacgagggtgcgaaggaggagttggcgttgattctagaagcttccgtgaggcaggggaggatgtgtagggtttatggtttgtggagtgaaggggtggaagggcctctgtatatggtgtgtgagaggcaaagatgtaatttattggacaagtttggtgaattgggaaatgggtttcttgctgtgagtgagggtggtttggagttggataaaggtgggatttttagttttttaatgattgggaagggtatatgtgaagctgtgcttgctttgcatttggaagggttggttgctggctgtttggggctttcttgtttctcttttgatgagcttggtgggatttgtgttgatttgaatgaggcattgatgctggcaaggaagtttgtgaatgctgtttccgttgaacacaaagaagaagcaatgtgtaagggttgcttggaaaatgaggtttttgcaagccctgaggttttgtatgagttgttgcacaagaggggcactgctcccgatagtgggcattcgagatatccaattgggtatggctcggatgtatggtcattggcttgtgtactgctgcggcttcttattggaaatgtgctggcttggaataccttggaaatgaaggaagagaatgacggtgatagctctgctagttatgcatgctgggtggagaaagttagttctgttttggaagacaaactaggctctgaatatctgtcactgaggcagattctttgtaaatgtttggatgtcaatccaggaaaccggccagatgtggtggatgtaaggaaatgcattcagaatatgttagtcaaaccgcaatttgattttctgggcaacttggaggtcacgataagtagggactacacaggaatctgcttggttctaggggagttgtgtttgttgcctaagcaaagttctaatgaactgattgaacatgagttgtgggagaaagaaattggtggtcaaccaaatgttgttcaagatggcaaaggcaaatctgatgaggactttgctgctggcttacctaagggaatgactgaactcaaagatctgcagggccatcttgattgtatcagtggattggctgttgggggtcatgagaataaagtcatggctctagtttatgtagatgaagaagaaccattgtgcataagtggtgacagtggagggggcatatttatctggggaattgctgcccctcttaggcaagatcccttaaggaaatggtatgagaagaaggattggcgttttagtggtatccactccttggttgtttccaaaaatcattctctctacactggaagtggagatagaacaataaaagcttggtcattaaaggatgaaactttgatatgcacaatgactggccatagatctgtagtttccacacttgctgtatgcgatgaggttctttacagcggtagttgggatggtacagttcggttgtggagtcttaatgaccacagtccactgacagttttgggggaagatccgcctgcagagatgaagtctatcttggctattactgtagataggcatttgcttgttgctgcacatgagaatggatgcataaaggtctggagaaacgatgtgttcatgaattccaaaacattgcataaaggggccatttttgctatgagtatgcagggaaaatgcctttatacaggaggttgggacaaaaatgttaatatacaggaattatctggagatgagtttgaactggatgtcaaagcatatggatccattccttgcagtgctgttgcaacagctatattatgcagccaaggaaaactgtacgttggatatgctgacaagtctatcaagttggaagcacaaacacacacctttatggctgcgctctcatattcacctttcttcgcccttcacagaatcacttccacttccacttccgcctgcgccaacgccaacgccttcttcattcggcctcgtccttctgttcctcctcgacctcgcctgcgacgacgtcgttgcgcacccgttctcgtcgctgcagcgtctgttaaggaaaatctcggccgcgttcagaagagtttagccgacttcacgagcttaaactactgggttgttcgcgactactaccgtctcgtgaactccgtcaatgccttcgagccgcaaattcagacgctctccgatgaacagctggccgcgaaaaccgccgaatttcgccgccggctcgcgcgaggggccaccattgccgatattcaagctgaggcgttcgctgttgttcgtgaagctgcatggagaaagcttggaatgcgccatttcgatgttcagattattggtggagcagtgttgcatgatggttccatcgctgagatgaaaacgggggaaggtaaaaccttggtttccacgctagcggcttatcttaatgccctgacctctgagggtgttcatgtggtaactgtcaatgattatttagctcaacgtgatgctgaatggatgggacgtgttcatcgtttcttaggtctatctgttggccttattcaggagcttggctttgattacttgcgagataatcttgctggaaatagtgaacagcttgtaatgagatggccaaagccctttcattttgcaattgttgatgaagtggattctgtcctgatagatgaaggaagaaatcctttgctaatcagtggtgaggctagtaaagatgccgcacgattccctgttgctgcaaaagtagctgaactgcttatacagggcattcattacaaagtggagcttaaagataattctgtggagttgactgaggaaggaattgatcttgctgaaatggctctagaaactaatgacctttgggatgaaaatgatccctgggccaggtga

SEQ ID NO: 39237 - DNA, 513 bp, Glycine max
  Peptide Sequence Number=SeqID_156015
atgacctcgatcactaacctttacgagaggatgacaaaactggaagagactcttgctcagttcatgcaggtttccatgtcaaatcacaagagcattgagtcgtccattaaaagtctggagatccagctggtaattgaactagcacatgaaccagttgaaccattgtgtgaacttgaggaagaggaagaagaggatgatgaccagttgagagagacgccaataattgtgactgaaaaagaaatacatgtagaagaaaaagagggaaaagaaaaagaaaaacaaaaagaaaaagaaaaaaatgaaataaataaaaaagaagaaaagagagaagagaagaaaaagagtaagagtgagcttgctagagacaagaagaaagaatcagctccagctgaagggaaagaggtgccatacccattggtaccctcaaggaaggataaaaaacgtcatctggctagatttcttgatatcttcaagaagctagagatcactatgcctttcagagaagctctgtag

SEQ ID NO: 39238 - DNA, 1878 bp, Glycine max
  Peptide Sequence Number=SeqID_156016
atgaacaaaattttgaaaatttctcagctgactggaagagttgaagagaaaaggagatggtctgaggggattcaccaggctgtggaggcaaaggaaggtttgaagattcaggcagattctgttgtagtggcacagatcacataccagtcattattcaagctctatccaaagttgtcaggaatgactgggactgccaaaacagaagagaaagagttcttaaaaatgttccagatgccagtcattgaagtgcccacaaatcttcctaatattcgaaaagatttgcctattcaagcttttgctactgctcgtgggaaatgggagcaagttcgccgagaagttgaatatatgtttagacaaggtcgtcctgtcttagttggaacaactagacaacttaagcttcatccttgtttcaagcccaacagagcttttactagaggtggcaagccagagagggatgcgttcattgtagaaaattcagaacttttgtctggtctgcttagggaatggaatattcctcataatgttctaaatgctagacccaagtatgcagcaaaagaagctgaaattgttgctcaagcaggacggaaacatgccattaccctctctacaaatatggcaggcaggggcacagatataatccttggcggaaatccaaaaatgcttgccagagaaattatagaggatagcttactttcatttttgacacgagaggatccaaatgttgaacttgcagatgaggctatttcacagaaggtgcttccaaaggtaaaggttggatcatcatcaatggccttactggctaagacaaccttaatgggtctgtgcctctgtgctaaatatgtatccaaaagtgagggtaaaagttggacatatcagaaggctaaatcttttatcttggaggctgttgaaatgagcctttcatatagtttggaggggctggagaagcttgctaatgaagaatctgagatctaccctcttggtccaactgtagcccttgcctatctgtcagttttgaaggattgtgaagaacactgtttgcatgaaggttctgaggtaaaaaggcttgggggtcttcatgtgattggtacatctttacatgagtcccggagaatagataaccaggatgagatgtttcagaaattcaattttgatactgaatgggcagtgagacttatctcaaagattacaaatgacgaggatctgccaattgagggtgatgcaattgtaaagcagcttttggcactgcaaatcaatgcagaaaagttcttctttggcataagaaagaaccttgttgagtttgatgaagtattggaggctttggcctttggaggagctttacaattccaaattggcatatccaaggcaaacatctaccttgtgggagaacgtttgagaaactggaaatttgtgtgtactgcttataggtacatgcaagcggtggtggatgagattgtcttcagtaatattgatccactgaagcatccacgtagctggggtttgagtaagctcttgaaagagtttgtgactgttggtggaaagttgttgcgtggtatgcttgtttgctacgactatggaggaattagtgatgacactttgctaaattcacttgggctagtgaatgatttgagttcagttgatatcgtcaacttttcccttccgaatttgccagcacctccaaatgccttcaggggaattcgcaggaagagttcttcattaagacgatggcttgctatttgcactgatgatttaattgggaatgggaagtaccaaacaacttctaatcttctgcgcaagtatcttggagattttctaattgcttcatatttaaatgttgttgaagagtctggttatgatgagagacatgcaaaggaaattgag

SEQ ID NO: 39239 - DNA, 858 bp, Glycine max
  Peptide Sequence Number=SeqID_156017
atgtgtgctaatcccttgctttgttttataaaggtcgagctaagcgcgccctgctgcgctaagctcgaccatcttgcgatggcatctaagaaaaggaagtctactgcttcttcatcttcccaggtcagatttgacaggtccagattccattcacaagaggcctgggatagatataatgactttgtgatcaccaggaagatcctcccagagaggaatgaggtggtctatcacacaaaatttgatgaatttaaagaagaactgatgcgaaagaaatgggatgagaagcttaccactttcatagagggcagcattgatgttgccatagtcagagagttctatgcaaacctatatgaccctgaagacaaatcacctaagcaggggaccaaggctaagaggtctgaagcttctacatcttctattcctcctacttctacagcaccagacattcctgctccttcatcagcttctctaccagattcttcagcaccatctacttcagcaccacagattccacaacttccgacatcagttttagatccctctgctacagatttttcttttactcctcagatgcttcactccatgatgcagagtctacaccgagggcaggagcctgaggcagcagaggaggagcctattgtggaggaagatgagctcattccttctgagcctactgcagacattgctcaggaggaggcacatgcatcagagaccattccagagtcatctcctccactcatctttgaggatgcattgccatctacaatagtcatggagccagagcagccacaggatgcaccagctactccagtgctggatcttaatgaagagcagccttatgatgatcaggacttttag

SEQ ID NO: 39240 - DNA, 1377 bp, Glycine max
  Peptide Sequence Number=SeqID_156018
atggacgagttcggcgttttgaccgaaaagttcggtctcaaaccgcaaggaaaatccgctccaatggcaagggcaaagcgacctccgaatgtcgctgattcccaaacacgccccaatcccaaattcccccttaacggatccccgtctcaccaaaattccaccttcgatttcgattacggagttttcagcaacagcaacaccgacaacaaaacgcagcgtttcgacgacatctttggcggaaacgccaaatccaacggcgcttcgttcgattacgattccatattcgccggatcgaacacaccagtttccacgtcatcttatgtggatgacatattcggtggaatacatgggaagagtgtcggtgttgatgatctgcttgataagattggtggcttaaatacaaacgctaaaagtccaaacgcaaaatcacccgcttttgatgatttgatccctggctttggtgtttccaataatggtgttgggatgaacaatccaagtgttactccaaacaaacctgctgcagcagcggcggcgtctcatgatgatccgtttttgatatttgaaactgcttcaagctcgccgtcttcagaatctttcctggacgcgctggagcagattagtaagttgaataattctaaagggacaaaaggaggttccccatcattgaagtctccacccaagccaatgagtaaagttaatagtctgagtgtatcaacaatcgatgagcttgaggactttgccatgggtgggacacagactaatgctagtagtagaaaggccaatgttaaagctgctgagactaaacaaaacttggcggctaggatgaacaatggtaaaagagttccagctgcaaaagtgaatcaggcaaacggtgtggatgatcttgaatcctttttcagcatgggctctcgatcaagcagtgtgccaaagtcaaggactccaactatggatcgtatgtatgataaccaaatgaagaacaaagggaaacctgaggtgtcaccaagagtgccatctagatcctcagcaaatgtgaataaatctccagtgatgacatctcttgatgacctgtctctgatgtttgggggttccccgtcatctgaattccaggaggttgaaggggaaactgaagaaagacgaaaagcaagattaggacgtcatcagagagcacaagagcgagcgttaaaagcagtgaatgatatgaaccagcgtgaccttcaaactaagatggagcaagaagagaggaggaaaattgctgatactgcggatgttcagataaagcgctgggctgcagggaaagaaggcaatatgcgggcattgctatcaacattacaatattggcatggagtggccgactccaaaaatgctatggcaggataa

SEQ ID NO: 39241 - DNA, 600 bp, Glycine max
  Peptide Sequence Number=SeqID_156019
atggcatattcttcttccggagcttataaaataaaatatgtttttcttcttctttgtgatctcttgcttatctcaggattgacgggtgaaatatcagtgcaaatatcagataatattcctcaaataaagtatgatgtttttgttagcttcaggggtgaggacatccgtcaaggttttcttggttatttgacagaggcttttcatcaaaagaagatacatgccttcatagatgataaacttgagaagggagatgaaatatggccatcacttgttggagcaattcaaggatcattgatttccttgaccatattctctgaaaactactcctcttcgcgttggtgtctagaagaacttgtgaaaataattgagtgcagggagacatatggacaaactgtgatacctgttttctaccatgtaaatcccacagatgtacaacatcaaaaggggagttatgaaaaagctcttgctgaacatgaaaagaaatataatttgacaacagtgcaaaattggagacatgctttgaataaagctgctgatttatcagaaatcagtgctctattttgtttttctctgcttatgtttacttcctctcaaatataa

SEQ ID NO: 39242 - DNA, 150 bp, Glycine max
  Peptide Sequence Number=SeqID_156020
atgactcttcacgcacaaacacgaatggcgacaccttcacccatgatgacaccttcacgcagagtctcggtctttacgagtttgcggtttgcgggtttaaggctccaaaaatcaacctttagggttgggctaattgttatacatacataa

SEQ ID NO: 39243 - DNA, 327 bp, Glycine max
  Peptide Sequence Number=SeqID_156021
atggagaacaatgatagtttgtggtggctaatggtggatgtgggtgatggagaaactacaccaaagcaaaggctgaaatgcttaaataagagatgctctcgggaatggaagcttctagcacactacagacatcttctcacagatcccaacggtcagatcatggacaagtgtcttgtgaagttacaaaccaaatttcgagaagatccaacggttaaagaaggctgggaatcatttttaccgaggcagctccatgtagttttctctagaagcttcattaagaggcttctagcacactccagacatcttctcaaagatcccaacggttag

SEQ ID NO: 39244 - DNA, 144 bp, Glycine max
  Peptide Sequence Number=SeqID_156022
atgaagaacgcaaagatcgaacctggcaccgctgtttacaaggagaatcggaaatggaacgaatataaacaaaaaacaattaaaaacattgaggcttccttcatggtattcaagagggtgagtggcccgacacgtcagctatga

SEQ ID NO: 39245 - DNA, 1065 bp, Glycine max
  Peptide Sequence Number=SeqID_156023
atggcctacttaatgctaagtggtgctgaaagtacaaagctcactagtggtagtggcttagctccatctgggttaggctcaattggtcttaactttcacaagaggtgtttcttcaagaagagtgttgtgtcctatggtatcaaatgcgtggtacccagatgcagcatctcatcattgagtcctgcttctcaacctggattcaaggagggattttggttctacaggtttttggctactattgtgtatgatcatgtcataaacccttgccactggactgaagacatgagagatgaggcattggaacctgttgatatctatgaccgtaaaatgagagtggtggatgttgagggaggaactgcattcaccactcttggtatagtgaagcatgtggatgctaaaaatgttacaattattgaccagtcccctcaccagctggccaaggccaccaagaacaagaaggaacccttgaaagaatgcaagataattgagggtgatgcggaagatcttccatttccaactgattgtgctgatagatatatttctgctggaagtattgaatactggcctgacccacagcgtggcattaaggaagcatacagagtgctgaaaataggaggcaaagcatgtatcataggtcctgtatacccaactttttggttatctagattctttgcagacatgtggatggtcttccccaaagaggaagagtatattgaatggtttaaaaaggccggtttcaaagatatcaagttgaaaaggattggtccaaaatggtatcgtggtgtaacacgacatggtctcatcatgggttgctctgtgactggaatcaagcctttatctggggactctcccctcaagagaaggggaaggggggaagacgaaggggcacgcaagggaggggaaggggagaagccagggggcccgcggtggagaggaaggggggaagaaggggcgcacggaggagaggaagaagaaggggcgtcgaggaaagagaggaagagaagaagaagagtggggaagacgaaggggtgggtgaggagagaagaaaaaaagtggggaaaatga

SEQ ID NO: 39246 - DNA, 285 bp, Glycine max
  Peptide Sequence Number=SeqID_156024
atgaatgttgaagaatggtcgagaatcttcgcaagcgcctcggctcggactttcttcacggaaacaattttcctcagcaaatttaagagaatacgaagtaccaagaaggctgaaccccttctcccttcactcctccccctatttatagcaaaacaggggaagagcttgccacccagctcgcccaggcgagcaaggttgcttcctccagaagcaacagccttctggaggaagaatctggaaggcccaagtgggtctgattgctatttgtacccccttttttactaa

SEQ ID NO: 39247 - DNA, 288 bp, Glycine max
  Peptide Sequence Number=SeqID_156025
atggcatcgaaacgaagcgcgaagtcgaaaggattagggttgagcggttccaaagctgcaaattctccatcatcctcaacgacgtcgtcttcgaagctgtttctagaaacttccgtcgacggtatgagctcgccggcgtcttcttccgctcggagcaagacgccgtgttcgttttccgagagcgtgccgttggacgcgaaggaaaatgtggccgtgacggtgcggtttcggcctctgaatcccagggaaattcgtcagggagaggagatagcgtggtatgcggattga

SEQ ID NO: 39248 - DNA, 2303 bp, Glycine max
  Peptide Sequence Number=SeqID_156026
agcatagacatgttgggtccacaaatttcaacctactcagcagcaggagccatacaatattttccctgactatagagagtagtccatgtggtgaaaataatgaaggagaagcaataacactgtctcaactgaacctcatcgatctggcaggttctgagagctcaagggctgaaacaactggcatgagaaggagagaaggatcttacatcaataagagtcttctaactcttggaactgttatttcaaaattgactgaaggaaaagctagtcacataccttatagggactccaaattgactagattacttcagtcttctctcagtggtcatggacgtatatctctcatttgcacagtaacaccttcatctagtaatgctgaagagacacacaatacgttgaagtttgcccaccgggcaaagcacattgaaatacaagcagcccagaacacaattattgatgaaaagtcacttatcaagaaataccaacatgagattcagttcttaaaggaagaattggaacaaatgaggcagggtattgtctcagttcagtcaaaagaaactgttgaagttgactttgtgcttctaaaacaaaagctagaagatggtcaagtcaagttgcaatcaagattggaagaagaagaagaagctaaagctgctttattaggaagaattcaacggttgactaaattaattttggtctccactaaagcgccacacacaactagattttctaaccgtcctggtcctcgtagaagacattcctttggggaagaagagttggcataccttccctacaaaaggagggatttaatctcagatgacgaaaacactgatctgcatgttaatttagagggaaatgctgaaacagctgatgattcttttaaggaagagaaaaagagaaagaaacacgggttactaaattggttgaagatatggaaacgagatactcggttaagtgccttgtcaggcaccagtgaaaaatcatgtggagcaaaatctgttagcacaccttctactcctcaagcagaaactggtaataacgcggagtccagacatttccattctctacctgcacaaagctctccatcagcagatcttgtatcagtggcaagagaggttaaagaaatttatgaggatagtttattgggacaagagacacctttggtaagtgttaaatcaattgatgagattgatcttttgagggagcaacaagagattctatcaggagaagttgctcttcattcaagtgctttgaagagattgtctcaggaagctgcaagaaatcctcagaaggatcagattcattatgattactttgactatcatggcagtatatctgagagtttgcatattttgtggttaactcataccaaggtggagatggaaaggttgaaagatgaaattaaggctaagaaggagcaaatagatttgctggaaaggaaaattgctgattctttcattgtgaagaataagttggatgaatcaggagtatcactaagtctcaccgaactgatgacacagttaaatgaaaaatcctttgaactggaggtcaaaacagcagataaccatataattcaacaacagcttagtcagaagatccatgaatgtgaaagccttcaagaaacaattggctctctgaaacatcagctggcagatgcattagagttgagaaacttaagtcctcaacctttctctgtaaccaaagactaccatggtgaacctcaccatgacaaggaaagtgccatgataaccaataccaatgaaaagattcttttgcaagagcaggcaggcgagatagaagggatgaatcaaaagttggcggaactaacagaatcaaaagaacagctagaacttttgaatcagaaactggcagaagagagttcatatgctaaagggctagcttcagctgctgcagtggagcttaaggcattgtcagaagaagtttccaaactcatgaaccagaatgagagattatcggctgagctggcagcatcgaagaattctcctgcccaatgtagaaatagtggacctggaacagtccgaaatggacgaagagaaagtcatgttagacgaaatgatcaaggtgggtctaactctgatatcaagagagaacttgccttgagtaaagaaagggagctttcatatgaatctgctcttttagattgggatcatagagaagccgagcttcaaaggaagattgaagaatcaaagcaaagagaaacatacctagaaaatgaacttgccaacatgtgggttcttgtagcaaagctaaaaaagtcacagggagctgacactgatgtttga

SEQ ID NO: 39249 - DNA, 567 bp, Glycine max
  Peptide Sequence Number=SeqID_156027
atgggttgcaaaggacttgtaaatgcatttcatgagatggatgttagaattgaacacagattctatgtaaggcatatgtatgctaaaaaaattggagaaggagctctgctgagggacttagtgatggttgcttcaaaagcaacttatttggagagatgcaaaaaatatggacacaacactcgaacctgcaaagagcgacttgtggcagttggtggatctgaggcacaagctattggatatgaaattccaacagcaagaaataatgttgcaaatgctgaatctaaggtcggaggacttggatctgcaattccaacaggaaacaatgttgcaacaactattgaatatgaaatttcaatgcaagaatctcaagttgggacatccatcccgagtgggagtatgtttagaaaaaagcaaccaaaaccgaaacaaaaggcaaaggagaaggcatgttctaccctaagcatgaaggacatcaacaaagaaaaggatttccttgcaaattgtactctagcacaattggtaacaaagattgtgaatcaaaatatggtaaaccaaaataagatctaa

SEQ ID NO: 39250 - DNA, 717 bp, Glycine max
  Peptide Sequence Number=SeqID_156028
atgctggatgatgtggcgtcactgcttcatcttccgatcataggcgccttccataacttcgagcctctgcatgtggacgaggcagtgattatgttggtggagttgctagaggtctcgcatgaagaggctagagctgagactgcacagtgtcatggggcatacacacgcctatcgtggctatgggatatttatcagaggagatgcgaggcccgacattggattgttgcaactcacttggctcaaagtgggagctatgcatggggagttgccaccctagtgcatatgtatgatcaattaaatgatgcttctcagagtattagtcgacaccttgctgatgtcactacgtgcctaccggtggcttactaccagacacatatagatgcactgacgatccctgacgtatgctggatgccttatggtgaccaccgaggagttagggcgtttgacctcatttcatgctttcagggtgagtttaaatggggtcccgttgtggatatggacgacaggtggatgcattactcggaccatctagtagctgcaggacaaatttgtcttgtgcctggccagtgtgcaacaaattacattgactggttcttcgggatatctcatccgttcatcacacccacacaggcaactgatcctcctagacatccacttgtcccacagcatgagaaatacatggagccagatatcccggaggttccaatggcaccagaa

SEQ ID NO: 39251 - DNA, 546 bp, Glycine max
  Peptide Sequence Number=SeqID_156029
atggtacaggtcgtagagcctatccggcaacaacgcagaggagtggccgcaaatggcaatgatggccacgaaatcagccatgataagtggtgctacagctgcaactcaaccggctccgtgatggcaagcagaactgcggggagggtgtgttgtggtgcattgtgttattgctggagtgttggtttagttatgaatgcctctgctagggacgagctatctggcttggagaagctaatgggtgatgaacaagtacaagtacaacaatctcaccaaactgtggatggcctattacatgcattgggacttcaaaaatatgccattctctttaaggctgaggaagtggatatgactgcattgaagcagatgggagaaaatgacctcaaagagcttgggattcctatgaaaaccctctttcacttgtttagtagcttaattgctattttgctagaatacatgaatttttctcatgcctgcacatttagcccgtggggtcccaggaaaaaaattcttcttgctgtcttgccccgtactaagcgtcaacaatga

SEQ ID NO: 39252 - DNA, 1107 bp, Glycine max
  Peptide Sequence Number=SeqID_156030
atgtgttgcaaccttaaggattccacaaaactcaacaccaagaggagtccccaagattatccttcatggacattcaagcaaggttgcctgcaatctgtccacctgaatccgaattcaaaccgtggtggtgacgtgtttttctctgcctctgcttctagtcgcggcaatgggattagggttacggttacggttagggtttcggttatcgtcatgtccgatccttcgaggggtcgcgttaccattactctagggcgtagcggtcatgttgtgaagagggatgcatctgctgtagatgtttcttctttctcttctattcattcagctggcactaagcggtctgtaagagacagaattggaagtaatgcagatagttctgggtggcatggaaatggacatagcggcaataaacgacaccgaggagatgtaagcatgcaaaatggactggatggcaatgatctacgattgaagctcatgcgaaaaagtgcattggggcaggctgacagcaatggcagtaagaggcatatggacctccgtgaaaagctgtcaaaggcaagtcaccctctggctaacacttataattcgaagcagcatgggccagattcaagggaaacaagtttgaggcaaattccctcagctagaagttctgataaattactgcgtatggaatccatgagaagctcatactctccttggacattggatcatattaggagaagatcaccagatgggtttccaagtacttccagggggatttccccccaaagggatgtccaagacctacatagaaggcctgtaagcaggacatatgatggtgtcagatcagtttcatatgtaggtagggatgttcttgaaacttcgaggcctccaataagtacaccccaatctttcatgtcacgctccacaatgtccacattgcctccagtaactgtcaagcctgtagcatctcatcctggtcaacttcctccatcgggcagtgttgctcaaaggccttcatatgtggtgagtattacttatcttctggcctctagatatcctttttctcaacccttcttgttggtgtacttggagaaaattttcttacgaccatctgttggatatccaagttga

SEQ ID NO: 39253 - DNA, 228 bp, Glycine max
  Peptide Sequence Number=SeqID_156031
atggaggcaacttcttttgagtttgtttctggtgctactgattctaaatccaacattctgataaaaacttgcatttgtttggcaaaacttctagggttgcctttgctctctcctgtgaaggattctgataaaaatagggatcttttaggggcatattgggataagctctccgtagaagaggccaaggaagttgtgtcattcaagaatgtgatgttagagcttgtataa

SEQ ID NO: 39254 - DNA, 2172 bp, Glycine max
  Peptide Sequence Number=SeqID_156032
atgccctggttgtctaataaccattcagcagacgatgcccttcttcttgctatttttccagatagttgcagagaaacacttgctcactcagccccagcaaggatgaagacacgccacttacttaatgatctgtgtctagtagtgctagtgttagccctaggttgtgcagcggaggaggattccacttccaccgccagcatcatcttcaccacactcggcagagcctcctacgccttcgacatctattccctcccagtcccagttcagcaacaacaacaacaacctctctccccaagccaagaacttctactcaccgatggccactccgttaatttcaacggccacttcctttccaatagttccgctattcaactacccaaacactcccctcctctccaactcgtttacgtcaccgagagaaacggctaccccaccatattctacgacgccatttatagttcttctatggtctcaaacagaatccaaatccctctcttatccaaccacctcagcgacgcttccatcaaagacaagcccagcgtcacccccgatggacaatatttactatacgtgtccagccacgagaacccgggcgttccacgggccagttggaccgcggtttactccactcagctcgagtcaggcctcacccaaagactcaccccttacggtgtcgctgatttcagcccatccctctctccctctggtctctggaccgctgtcgcttcctacgggcctcacggttgggccggtgaagtagaagatctcaccactgacatctacgtcttcctcactcacgacggaactcaccgattcaaaatcgttgagcacggtggctggcccacctgggtcgatgatcgcactctttacttccaccgtcgaggccaagaccactggtggagtatttaccgagccattctcccctccaacgctcctttttcagttgactcggtcttcgtcgaacgagtcaccccaccgggtctccacgcgttcacacccgccacttcccccggcaacaacaacttcatcgccgtcgcaaccagaaggccaggctccaattttcgtcacatcgagctattcgacctcgctagtaacgaattcactgagctgactcggttggtctcgcctaattctcaccacctcaacccgttcatctcgcccgattcaacccgggtcggttaccataaatgcagaggagaacccaacgctcacagtaccccacagtttttcctcgagaatgttcggagccccgtccccggtctaactctcttccgcttcgtcggttctttcccggttttctccccctccggcgaccgaatcgcgtacgtcgagatgcccggagtttatgtcgtgaaccgggacggttcgaacctgcgtaaggtttccaacgcgatggcgttttcaaccgcttgggaccgggttcgacccggtgtcatctacaccgcaattggagaaacatttgctccggagagctcgcaggttgacatcgtgtccatcgacgttgaccatgaaaacagtgtgaagaggttgaccctggacggaaaaaacaacgcgtttccgtcaccctcgccagacggtaaatggatcgtgtttcggtcgggtcgatcggggcataagaacctttacataatggacgcagttgatggtgagaagaaggagcttcgaagattaacggagggtccgtggactgataccatgtgcaactggtcaccggatggagaatggatcgcttttgcgtcggaccggcatgacccgggtagtgggagcttcgagatctacctgatccacccgaacggaaccgggttgaggaaactgattcaaagcgggtcgggtggaagaacaaaccacccgtatttcagccccgatgggaagagcttaacgttcacttcggattatgcgggaatttcggctgagccaatctcgaacccgcaccactaccagccgtatggtgaaatattcaccgttagattggatggttccgggatcaagaggttgactcataactcgtatgaggatggaacacctgcttggtcccccaagtatatgccgccggtgaatgtgccaaagggaggaccctattgctcttttgatgattgtcattggctcaacaatatgcccatttctactgctttcggtgtgtctaaggctaagcctcagtgtgctgctctgtaa

SEQ ID NO: 39255 - DNA, 1119 bp, Glycine max
  Peptide Sequence Number=SeqID_156033
atggcaaagtcggtaatcctggtggaggatctagatcagtttatggaaccagagtcgggagcaacaacaacggttaccgcgttgggaatccaaagcttcatggacgggatcattagcgcgtgttgcagagaggagagggtgatggtgttcacgatgaacaacaaggagtgcgtgaacccgaacctattgcaaccgagtcgggttgctgtgcacattcacttttcggtgtgtgatttctcgacgatcaagacactggataataatctgcttgataatcacgagaaagaccatgttgctaggtatcttgttcaaaagtgtgcacctcatgcaatgacaattggataccatgtgatgcatgacagctggataaatgcttttcccgccacaggcatgccacatttatatcctcttcctttccttccctccctatggctcacatccaaacaatatgaagacacgaggccacttaccttttctgtgggtagtaatagtagtaatgttactgtaacccttcgttgtagtgcagcagaggagaaggaggcttcaacttccaccactagcatcatcttcaacacagttggcagagctcattacgccttcgatatttattccctcccaattcaacaaccacccacccctgaccgagaacttcgactcaccgatggccacttcgtaaatttcaacggccacttcctctccaacttccccccacacactcccctcctctccaactcgttcacgtcaccgagagaaatgacgtcgtttatacttccaccaccacaaggagaaaaagatcggttttggaatccgttaccgcaaacagaatccaaatccctctcctcagcgacactactagtactagtcaatagccctcagcttttactcgagagtgttaagagcctcgtccccggtctatcgctattccggttcgtcgttcgacccgaagtcatatacactgccatgggggaatcatttgctaccggtgcttcacaggttggtatcgtgtacatcaacgtcgacgatgaggaaaacagtgtgaagaggttgaccgcggaacgacgccatgtgcaactggtcaccggatgcatactggattgttttttcgtcgaaccggcatga

SEQ ID NO: 39256 - DNA, 612 bp, Glycine max
  Peptide Sequence Number=SeqID_156034
atgagcttcttgaggccttctgcgttgtacaactttctgatcagttatcctgcgctgcgatggctgccatgtcagagttggggcttccttcgatggcccggccttgatgggttcttcaggcttttcgtggttgtgcttctgtggtctacactatccgagcttcgcttcataccctcatcttctatgtaccccacccttcgtgttggcgaccgaattattgtcgaaaaggcttcatattacatcaggagtccagctatacatgatattgtaacatttaaggatccaacacagtcctctggggaaaacacagatgctgtttttatcaagagaattgttgcaaaagcaggagacactgttgaggttaatcatggggcactctacatcaatggtgttgctcagcaggaagatttcatagccgagccaccagcatacgcaatgcaattaactcttgaacttcaagtgtttggcttgtctgaattcgtatactgccctagttgccaggataaatggctttgcttaatagccaactgtgctcctttccctttgtgcactattccaatagataatgtggtatacactgttgtcagcatgaaggctttccagtttaactga

SEQ ID NO: 39257 - DNA, 522 bp, Glycine max
  Peptide Sequence Number=SeqID_156035
atgggtgcagtgagtgtagtaagagtggatgatgatgatggtgattcatttaagaaggcaggtgcagttccttttaagtgggaggtaaaaccaggactccctatagtgcaacagaagctccaccaccagaagctggaatcgccgtcgctgaagctgaggccgccgccgccggtgggtgcctacctgctttctccggcggagcctcggtcccggtccttccggtccactccgagggaccggtctgatcggtggcggttcaagcggcctcttctggcccaagccgagagcgtgtcgtctggttgtttcttttcgccgtttttgaggaggctgcaacggaggaagaaggttccgaagcgagtatttgaagaggactataggccggagcttgagacgctaggtcggtggtctttgtcgtcgacgaagtcgctctcgccgttccgggcctcgacgacgtcgtcttctgtggcgtcatcgccccggcccgttagcgatgccgaatgggccgggtttgggcttttctga

SEQ ID NO: 39258 - DNA, 1635 bp, Glycine max
  Peptide Sequence Number=SeqID_156036
atggctagcctgacacagcatcaaccaaagggggttaatggaggtagcagccgcatagcagccgtcaatgtcacaccttctaataacctttctacaccatctcatcatgatgcctcctcaaatcatcagaaacctgggtggaaaaagttcctgtcatatgtaggtcctggctttctggtctccttggcttaccttgatcctggaaacatggaaactgatcttcaagctggagctgaccacaaatatgagctgctgtgggtaatacttattggactggtgtttgcgcttataattcaatcattggctgcgaatctcggcgtaaccactggcaaacacctttcagaattatgtaaagctgaatacccattattggtcaagtactgcttatggttattagctgagctggctgtcatagctgcagacatacctgaagtgattggcacggcctttgctttgaacatactcttccacatccctgtatgggcaggagttctaataactggctgcagcaccctcttatttcttggtctgcagagatttggggtaaggaagttagagctgttgatatcaatcctagtttttgtaatggctggatgtttctttggggaaatgagctatgtaaaacctcctgcatctggtgtattgaaaggaatgtttgtgcctaaactcagtggtcaaggagccacaggcgatgctattgcccttttgggtgcacttgtcatgccgcacaatcttttcctccattctgctctggtgctgtctagaaaagtacccagttccgtgcgtggcatcaatgatgcatgtagatactttctcatggaaagtggattcgcactgtttgtggcatttctgatcaatgttgcaatgatttctgtggctggaactgtttgctctgccgacaatctttctgcagaaaatgctgatcaatgcagcgatcttacccttaactctgcttccttccttctcaagaatgttttgggacggtcgagctcaaccatttatgccatagcactgctcgcctcaggacaaagttcggctatcactggaacctatgcagggcaatacatcatgcagggtttcttggacatgaggatgaaaagatggattagaaattttgtgactaggtgcattgccatagcacctagtcttattgtttccatcattggtggttctcaaggggctggtcggcttatcatcatcgcatcgatgatactttcattcgagctcccattcgcattaattccactccttaagttcagcagcagcagtaccaagatgggacctcacaagaattctataattatcattgtcatctcttggatcctaggcttggggatcattggtatcaacgtgtactacctctccaccgccttcgtgggttggctaattcatagcagtctaccaaaggtggcaaatgtgttcatagggatcatagtgtttcctctaatggcactatatgttgctgcagtaatctacctaaccttcagaaaagacactgttaagacatatattgagacaaagaatgaaccagcaatgcaaacccacatggaaaaggggtttatggctaatggtcaattagagttgagtcaagttccctacagagaagatttggctgatatcccactaccacaatag

SEQ ID NO: 39259 - DNA, 255 bp, Glycine max
  Peptide Sequence Number=SeqID_156037
atggaggaaattgaaggtgaatactggcgaataatagagcaaccaactgatgaggttgaggtgtattatggagctgacttggaaactggatcatttggaagtggttttcctaagacgtcatccttaactaagaatgagtcagatagatatgccctgtctggttggaatttgaataacttcccacgacttccaggttctgccttatgttttgaaggaagtcatatctcaggagttgtagcaagaaacaaagtttaa

SEQ ID NO: 39260 - DNA, 630 bp, Glycine max
  Peptide Sequence Number=SeqID_156038
atggaaacttactctaaagttacaaggttcttttttatatgcaactatgttagcaggattatagaaccacttgcttcaaggtgtgcaaaattcaggttcaaaccattatcagaagaaatcatgagcagccggatattatacatctcccaagaagagggactctgtcttgatgctgaggtgggaaccttggtggctctttcaaccctgagttttatttctcatggagatcttcgccgggcaatcacatacttgcagtctgcagctcgcttatttggatcttcaatttcttcagagaatctgatttctgtgtcaggggttgttccggcaaaggttgtggaggcacttcttaaagcttgcaaaagtggtaattttgatttggcaaacaaggaagtcaacaatttcattgcagagggatatccagcttctcagatgcttactcagttatttgaggccattgttgaagaaaatgacttatctgatgaacagaaagcaagaatatcaaagaagctgggtgaagctgataagtgcttagttgacggtgctgatgaatacttgcaacttcttgatgtggtcagcaatacgattaaagcttttaacagcttgccagaagcatttgcttacgaatgttag

SEQ ID NO: 39261 - DNA, 294 bp, Glycine max
  Peptide Sequence Number=SeqID_156039
atgtgttttttgaggcataggatgaaactgccactgccccacctggcagttcgacgagcctgggaagaagatccatttaccatgagtgaggaagttatgaagatgatagcattagaagttgtgcgtgaaaggttattggacttacatcaggaaattttgtatgatgttgagcatcaattaattgactggaaaaagttacaagatggttttcttaggattgagcaacacttcatctctagcaaattaagcaaatgcaagattcttgtggggaagaatggctcaaaaattgggtaa

SEQ ID NO: 39262 - DNA, 459 bp, Glycine max
  Peptide Sequence Number=SeqID_156040
atgaaggtgaaggggccggtgttcattgttgcggtggttggttcgacgtcagtgacaaacaagttgacccgtaaggtttatacggatcaagttgatccgtataagccttatggatcaacttcatccatgaacgaagatcaatgcatgtatgacactataatgtttgaagaagttgatacggatgatcaaaatgaacaagaatgtggtgtgaatgaaccacaagttgattattcggatgcgttcaatacttctcaggtgtttgacagtcgagatgatgttttgcagtgggctcaatccgttgcttatgaaaatggacttgtggcggtcattataaggtctgacacaaacactggtagtagaggaaggacttcgtttgtgttaattggctgtgaaaggagtgacgagtataggtgtaggaagaaagaattttttacaagagatactgggactaggaaatga

SEQ ID NO: 39263 - DNA, 249 bp, Glycine max
  Peptide Sequence Number=SeqID_156041
atggtgatgaaagtgtggtggtgtttttcctttgctttcatttcaacggtgtttattggtaccaccgtctatggtggcaatgtcacctacgacggaagatctttaatcattgatggccaacataaaattcttttctccggttcaattcattatcctcgtagcacacctcagcagtgtaggtatcagttcacatggggattaattagggagacccttgactccttgagagatagatcgttctcgctttag

SEQ ID NO: 39264 - DNA, 900 bp, Glycine max
  Peptide Sequence Number=SeqID_156042
atggcttctgcttcagattttgcgttagcggtttcttctgaactcgagtcagttttgaggctgaagactgttaactactttgttacgaggaggccatggctcgtgttgaatcatctgttctgtgtgcctgggtggcattcacttgtcgttgttgctatgcgttttgtttcagatctttatggagttaacgtgagacctgttgcgcctgttgggagtgcaagtaggaggccttacgtggatcctgcacttatacatcgttccttacctgatgagctgctttttgaggtgtttcatatcatcaatatattgtgtgggagtgacaatgggactagttactatgtgctaatggtttttgctcgaatgactccatatgatttggggaaggcatcttgtgtttgtcgaaaatggaagtacacaattcgtaaccctgtattttggcgcaatgcatgcttgaaggcttggcagaaaactataagatacttcaatcaaaatatgatggctcatggcggaaaatgtggctgttacgaccaaggttgcggactgatgctaggtctctttgtcttacagtgctcccacatctcaggtctttatgtgagtagaaatacttacattcgagctggagttgctgagtggaaaatcactaatcccgtacatgtggtctgctatttccgatacttgagattttttccatctgggcgattcctttacaagaattcatctcagaagatcaaggatgtggcaaagtgcatgaatttccgatcatctaaaatagactgtgtttttggtggccactacacattgtcagatgacaaggttgaagctgcagtcttgtatccaggcatgcgacccactgttttgaggatacgtttaagtaaagctaacatcaagaaccagaaatga

SEQ ID NO: 39265 - DNA, 294 bp, Glycine max
  Peptide Sequence Number=SeqID_156043
atggtgatgtttttggtttttgaaaactactatgtatggttgattaattgcaccaactacacaatacgagtagcggatgccaccgttggtgcacacattactcatccctccctcttggagatgaagataggagaggagaacaaaaaagaagaaggagacacgagtgtgcctcactggtgcgatgccatagccaataactctagtcctatcgcagtggaggatagtgggatagagagagtgtatccaagggagatgaggggagtgtgtttacttacggttacggggataatttag

SEQ ID NO: 39266 - DNA, 930 bp, Glycine max
  Peptide Sequence Number=SeqID_156044
atgactcgtcttggcattttgatagaagaagaggctacaacggtggcaagcacaagtgccaaggtaaagttgacatggttggtagacctatatcaccgctacattgagtcgggctcatgtgtttggtctgccatgacttatctattgcacttgattgatagtatgatatttgccaacaagtccttgactcatgtccatgtcgcctacctcctataccgtaacaacctggatatttgtcacaagtacgcacggggagtcattgcactggtgtacctttatgaccatctctcctatgcgagccagtacaacatcaagcaagttggaatcatgggcatttgtgcatttgcgcatttgctcaatgttggctacttagagctgacaagttatgatgttgatgacccgatagccaccaggtggaagccattgagaggtaccatgtgtgtccttccaatcaaggagaaattggatgagctgcaaatggaatttttcgcttggtgtccatttgatttgcataggggtgtgaggcctttcgcacaacaagcacttttctttagcttcatcaaatgcaagaatgatgtgtggccttatcgtctagagagggcgtggacaaagtgggagcaacatatcattcctttgggaaaagttgtacctctgactatttgccttggttttataaggtttcccaccactgtcattctattggaggaggaacaaccatcatctggtcctatacgtttatcgcccatcctaatacagccactagcagactatgtaccgagtgaagactactcttgcttgtctgcagaaatatgccagcaattccttggactgaacgtgaagagttcagaaggagaatcacatctgagttacaagcatctggaacattctgcaaacattgcaatagcaattccttggttggcgattgtatag

SEQ ID NO: 39267 - DNA, 381 bp, Glycine max
  Peptide Sequence Number=SeqID_156045
gctgataaggtaactgtggtgtatcctatgagattcaacgattcaatagacattgttcttgcaacttcattcctgcaggaatttgtcgaagccaggcgtacagctggacttaataatacccctccttgttcgtggtctcttactcctccactggaactaaaagaagttcccgctgatgcattatctgcgaatgcaggatttgtgacatttgttatcttccctcgtcatgtcgaaggccagaaactggatcgtacagtatggaatctgtcaacttttcatgcctatgttagctatcatgttaagtgctcagaaggatttatgcatacacgtatgcggcggcgtgtggagtccttgattcagttgaatgtgtttcattattaa

SEQ ID NO: 39268 - DNA, 231 bp, Glycine max
  Peptide Sequence Number=SeqID_156046
atggacaagtttgatgcgagattcgtggcactagaaacttctgttgaggcattgaagaaagcaatgagtgaacaaggaacaaggttcccatattgcagaaatcaagaaaagtgtgggagagtaccagaggtactgattaagaacagatacaagacacctaaggtgccaccttccaaaaacaaaggaaaaacccaacaaaaccccaccacaaaaggaaacaacccaaattaa

SEQ ID NO: 39269 - DNA, 492 bp, Glycine max
  Peptide Sequence Number=SeqID_156047
atgcatatgaacgttatcgccatcatgaatcacatgggtgtctacttcaaagaagagcctatccgtgaactgcatcaggcgctggaaagtctggatttccgcatcgtttaccctaacgatcgcgaagacctgctgaaactgatcgagaacaacgcccgtctgtgcggggtgatcttcgactgggacatatacaacctggagctgtgcgaaaagatcagccagctgaacgagtacatgccgctgtatgcgttcgccaacacctattccacgctggacgtcagcctgaacgatctgcgcatgcaggtgcgcttcttcgaatatgcgctcggcgcggcaaccgacatcgccgcccagatcaaacagaacaccgacgactatatcgacaccatcctgccgccgttgaccaacgcgctgttcaaatacgtgcgcgaaggcaaatacaccttctgtacgccgggccacatgggcggcaccgcgttccacaaaagcccg

SEQ ID NO: 39270 - DNA, 572 bp, Glycine max
  Peptide Sequence Number=SeqID_156048
cccttatctctggccagatcacatctatagcccaatctaactcttctagacttgggttccctgctctgatcaccgtcctgtgtaaggacagaggggttacttctgacagcttggttttcgagcgcctgagcccggtcatcaacttggcctatatcaagaaaaacaattggaatcctgatgatctaacagtttctatcagaggggctaggcaggcaaggatgaggccagctgagcctccttccacatctacaactcctattccagcacccatgcttcagagcatccatcaggggcagattattctattacagagcttacaggtggtggcacctccaggatctattccttcagtgaagcagttcactgagttggtagcttggcccgggactctgtcttctctttgcaaggaagatgaaggtcccacagcccaggtaccacagcatgtggaggatgattcatccgaggccaccattctagagccttttgtcagggggatggtggcagaggagacacaggaagttgcggccacacttgagagatctcttgaggcagcttctgagcccccagcataa

SEQ ID NO: 39271 - DNA, 486 bp, Glycine max
  Peptide Sequence Number=SeqID_156049
atggcagaaccatcgaagaagcgaaagggcacttcgagtcggagtcaacgacattccaggtcacagaaaatgccaattccttcctccactccctctggatcattgttttcatcagaggaacaacgtatacggtacacaaacatcttttcctctcgttccattatagacccaaaattcatagatatggatttcttctcaaaaatcaatgaaggtaccctaatgtctgaagtttatgggattaagatggtcattgaccaatccctattttatgatttaaccaaattgcctagtgaaggtgtgccttttgagggtacactgattgatgattggaaatttgatttttctgtgcatgatgcccgccagttggtctataactctcgcttagggagttctgcagctctgattggtctacaactctcgcttagcggcccatgggccgacttagcgaataaaatgcttcctgatgcagtagtggggcttgcttag

SEQ ID NO: 39272 - DNA, 210 bp, Glycine max
  Peptide Sequence Number=SeqID_156050
atgatccaaaacaccgagacttatattcataaggagacacactttaggtgtcagtctttggaggagattaagaattacgagaaatatggaagtcttcctcggtgtcacagagtgaaaatacaagacaaagaagaaagcaatgacaaaacccgaagtgaaacagaatttactgacaactacaagctcatgaatacgactgagagtgattaa

SEQ ID NO: 39273 - DNA, 171 bp, Glycine max
  Peptide Sequence Number=SeqID_156051
atggtggaggtggtggtgacaatcataatggtggtacagttgttatggacaatgtgcagtgtaggtgaaggtatcggtgttgagcgttgcggtggtcattggcagcatacgaggtacgcagaaggtggtgctgctgtcgggaaggaacagatacgttacagatcaacttga

SEQ ID NO: 39274 - DNA, 237 bp, Glycine max
  Peptide Sequence Number=SeqID_156052
atggcaatggtagcgacaacaatagtgatggtggtgatgacgatagcgacgagaaggatggtcatgatagcgaaggtagcagcagttgacaatgatatggtggtcatgatggtgacagtgacaacgacaaaggtcatgacgacagaggtgatggcagtggtggtggcggttgatggcgacaatgataatagtggtagttacagtggtggtcatgatagaagccccatcaagaattaa

SEQ ID NO: 39275 - DNA, 393 bp, Glycine max
  Peptide Sequence Number=SeqID_156053
atggcaacggtagcgacattaatagttatggtggtgatgacggtagcgacaacaatgatggtcatgatagcgaaggtagcagcggttgacaatgatagtgacgataacaataatcatggtgatggttacagtggtggtcatgatggtgacagtaacaatgacaaaggtcatggcgacagaggtgatggcaggggtggtggcgaaccacaatggcaacactgtgatagtggtgccacaaacatagtgcagcagtttaaggagagacaccatccttttgaaggagcaaacgacaatgcttatgttgctctgaataatagtcacactggagcaacaccggacaagagcataccagttcttggtggctcgaattgggtgagggatttatgggattaa

SEQ ID NO: 39276 - DNA, 210 bp, Glycine max
  Peptide Sequence Number=SeqID_156054
atgatcaaccgaatcgagcatgcaatccaagaaagctatgcatggcatctatacctctctttcttattaaaacaacccaaagatgggagatttgttttaaggcagaggaggatgatggctttggtgcggttggtgggaggtaaaagatgcggtggggatgatgaaagcgagggtctaataatgaggggaagaagagaggagaggacatga

SEQ ID NO: 39277 - DNA, 177 bp, Glycine max
  Peptide Sequence Number=SeqID_156055
atgactaatgaggaagttttgttcctttcgcttaccttcttcaccgcttcgacgcctgctgggtggacctctactgctccaccttcttgtcctcgtgatagttgtgggataccacggccactccctccttataagcccccaccattgtatagatctacttccaaggggaaaccttaa

SEQ ID NO: 39278 - DNA, 168 bp, Glycine max
  Peptide Sequence Number=SeqID_156056
atggcggcggtagagaaagattatgacaacacagagatggatgacacggaaccttattgcatgagcaccgatgagaacggcaaagaaataaaaaagggaaaaggattgaacattgattggtggttcaatagttctccacttctttctcactctatgcctggacggtaa

SEQ ID NO: 39279 - DNA, 252 bp, Glycine max
  Peptide Sequence Number=SeqID_156057
atgccaagccttatgctggtcttagggtattatcatcaaatctttaagccagaggtagttaaatacatcaagcacaccataggagtatggcacaatgatattgtcaagatcgcatcagatctaataggcaataacgaattcttcatgcagcccgacgtgggaacgctcgaaagcaccaaggaaggaaagcgggaaaggtccgatacaaaggaaagggttgcgaggcttaacgatttagaatatagatgttga

SEQ ID NO: 39280 - DNA, 783 bp, Glycine max
  Peptide Sequence Number=SeqID_156058
atggctcaacctcccgaaaaaagatgcatcatctcctattcccactctaatagctggaaagcgcatcaagatgtgtttcttgttgataagttcgctcttgagcaacaagaagaaaaagtgcattcgctaattcttttgtcgttgtctgatgaagttctttatgaagtttctgaagagaaaatcacttatgtgttatggctcaagttggagaaactcttcatgacgaaatcaatctccaacaagttgctattgaaacaatgtttgtttatgaaggaaggtatgcctcatttggttgagttaaactctgccttgttggagctatatgacattgacgtcaaattagaagatatagatcttgcaatgattctgttagcctctccccgccccctttcatatgagagttttgtgaattttctaagtgttggaaaggattgcatcacacttgaggaagttaactctagtctctattcaagagagcttcgacacaaagcttctacaaatggtgatgaagcctctgcctctagattatcattaacaaattttgcaaaaggacagaaaaaaaaaaaggcaaaggattcaagaagggaaaagttgatccaaaggatatctaattactgtaaagaacctgaccattggaagaaagattgtccaaataaaatcaagaaagattttgttgcagttgttgttcaaagtgataagatgatttggtactctcaattgttgatcaacaacaacatcatgttgaacaatgggtattggactcaagttgttctactcatatga

SEQ ID NO: 39281 - DNA, 234 bp, Glycine max
  Peptide Sequence Number=SeqID_156059
atggccaagaatgttgttaaggttgttgttgttgaaggaagaaattccaaagcttattcgtcaggccataattttgggaacaatctcgtttattggcaaagaagacatcatatgccaagggaacaatttcctcctatcactggagggcattctacatcggctctaaaaccgatgttgaaagtgatgatgttgaatgtatcatcgttaacatcggtttttaaaaaccgatgttaa

SEQ ID NO: 39282 - DNA, 285 bp, Glycine max
  Peptide Sequence Number=SeqID_156060
atgatggtcatgatagcgaaagtgatggcggttgacgatgatagtgatgacaacaacaatcatgatggtggttacagtggtgatcatgatagtgacaatggcaatgacaaagctccatgtggaacttgtaggccttggatcttcttcatcaatggagttctttgcttcttgaagtttaatggcagcggaatggagaaggagaaagatgattggagacgccacttcaaggagaagaagagtctagaagaagctcaccaccataagaagccatgggtaatagcttga

SEQ ID NO: 39283 - DNA, 261 bp, Glycine max
  Peptide Sequence Number=SeqID_156061
atgcttacggatcacttgatccgtaaacaacccagcaacttcccgacagcgttttccgccatcgccggcaaaaaccaaaatgcgaacgacaaacttaccttgaagaagaagcagaaacgcgaagaagaagcagaaatgcgaagaagaagcacaaacgcaaagacccacaccttcctcttaaacgcggcaacaatggcggcgatggcggcgaagaagaagaagaagaatgaagaagctacacgggaggaagaagaaaactaa

SEQ ID NO: 39284 - DNA, 144 bp, Glycine max
  Peptide Sequence Number=SeqID_156062
atggatcttcttgcatttgctgatttgtatgcaaaagaacatcttggctttgatactcatccatttgggtttgtcataattctagttgccaggttgtttggaggtgccttaagtacatccctcacaggtttccttggccattag

SEQ ID NO: 39285 - DNA, 318 bp, Glycine max
  Peptide Sequence Number=SeqID_156063
atggttgattcaatcaagattatgcaagcaaccgcgaaagcgtccttcattgacaatgatcagttaaagagcctgccaaaggatattgtagatgtgttaaaggtgtggaaattacactcgcttatcctatttttcaacaacaacaacaaaaatggaatccactgtaaattgaatattcactacacccacaggaaaactgttaagattgctaaaggatggaaggaattttgcacaaccaacaacattttgaagaacataactctttggtttgatttcaaacgtgccaacaacaacagggtctatgttactaaagtctaa

SEQ ID NO: 39286 - DNA, 276 bp, Glycine max
  Peptide Sequence Number=SeqID_156064
ccgatgtgggatttctattgcatgctcttatttcgccgccggaggaggcgctatagagggacttgccgtggagggcgagggagaagattggggacagaagggaggcttggttgtgaagagagggaggatgaagttgatgactcggaatgaaggtgatgatgggattgtggttgttgtgtgtggcaacacaagggacgttgaagaagtcccatttttgtttgagttttgttgtgtgttggcttttggctcttgtttgtgtgggagttttgaggtgag

SEQ ID NO: 39287 - DNA, 276 bp, Glycine max
  Peptide Sequence Number=SeqID_156065
atggcgtttggggttgttgcaatagcctttctttcaagtgtgagtctctaccatatggtagcctccccctcaaggagcttaaccatggttgcgttaacctatctagtcattgtcgctaacatgctctattaccttgcactgtcgcactctccaccgttccacgaccataggacacgttgcctgatctccacgtatggatttacatcaagcttatcgataccgtcgacctcgagggggggcccggtaccagcttttgttccctttagtgagggttaa

SEQ ID NO: 39288 - DNA, 896 bp, Glycine max
  Peptide Sequence Number=SeqID_156066
atgtctatttttgtggaacgctggcataaggaaactagtggtttccatttgctcgtcggagaagtgactatcaccttggatgatgtggcgtcgttgcgacatttgtctatcgtcagtgttgcaaaggcaagagctgagacgattcaatgtcatggctcttatgttcggctatcgtggctatgctacgtgtatcagacaaaaatcaagacatgtcactggattatagcagcgcatgcgtatttgttgcatctgcttggatgcacactctttgctaacaagagtgccacacacgtgcacgtgctattcttggatgcactgcgtgacttgacgcagagtgggacttacgcttggggcgctgctgcacttgtgcatatatatgataatttaaatgaggcgtcaaagagcacgacaaggcagcttccaggatatatcactctattacaagagaccgcgttcatgctgatggacctttggcaaggcactgctcgtgtcgacgtcatctccttgttttttggctatctcagctggggtcccttgacagtcattcaccaatcggagagggttgtgccttcggtttctattgaagaaataaatgctatatggatgcagtttggtgactacattggacctccaagggatccttctagagtttcaccagttcagcaatatgacacatttgttgaaccaaatgtgcatcaacaatcaatggcggcagtgacacttgatgaagcaaatgttgatgtgcatcgtcttggacatgcagtggatggttatgtagcaattgttgataagttggaaaggctactgaacttgaggatcttgaacgaaggaacagaagcctatattgttgttgaagaatgtctgagcacaccagaagctacattggccaaccaact

SEQ ID NO: 39289 - DNA, 273 bp, Glycine max
  Peptide Sequence Number=SeqID_156067
atgatttcaatgccacgtgatcctattagtgtggccaaaaggagaaggataagtgcacaaaaaagggaagaaaggcgtaagaacgatgaagaacctcccgaacgcacagcattactcatagcaactaaaactggaattgtagaaattgttgaaaaattccttgatgtgaatcccgaggctattttccatgtcactgagaataaccagaatatattgaccataaaaacgacatgcactaaagtgctatcgtctatatatatacaaaaaaactaa

SEQ ID NO: 39290 - DNA, 273 bp, Glycine max
  Peptide Sequence Number=SeqID_156068
atggatggcgaggagctaccttcacccgtgaactctgatgttgtcaagcggattcttgtcctctataatttctcatcgcagtcttttaaaagaaaagaacatgggattaaggatcagaatcgtcttaggcaatggtcaaatgctgggccggatccaaaggtagttagggacggaagcaagcaaaggctaggatcacgatcgatagatcatcgtcccatgcccagctctggacaagcggaaagcgcaactgggaggcagcctagtatcctttaa

SEQ ID NO: 39291 - DNA, 432 bp, Glycine max
  Peptide Sequence Number=SeqID_156069
ggctacacgccctcagcttcaggggactactcatcctcgccttcagatggctacacaccctcaccttcagaggactacacatccttcacttcagaggactacacgtctttcccttctgaggactacacgtcctcgccttcagagggctacacgtcctcaccttcagaggactacacatcctccccttcagggggctactcgccctcgccttcaaaggtctacacgtcctcctcttcagagggctacatgccctccccttcagaggactacacatcctcgcctttaaagggctacacgccctcacctttagaggactacacgtcctccccttcagaggactacacgttctcgcctttagagggctacacgccctcgccttcaaaggattacacatcctcgccttctaaggactgcacgccctcgccttcgtag

SEQ ID NO: 39292 - DNA, 444 bp, Glycine max
  Peptide Sequence Number=SeqID_156070
atgaccactcttacacagatatggatgacgttgctacttagcaacattctacccaactaccacaataccgatctccccctgcggaaggatcgcgcccacaagacacccagtggacccggagaagtccaacagggccttagggtttccagctctggtgtgagcctctgtcagtcctacagggtgaccgtccccccagcaaggtcatgtcatcgtgacatagggatcacgcccacaagacacctaatggacccagagaagtccaatggggtcttggggtttccagctctgattacaagcctcagtcagttctacggagtgcccgtcaccccagcaaggtcatcaggccccctactaaccgagctttcatcaagaagtactgcgccctcaggcaggcgtagggcgagacaccacagcagcctggggatggccgacatcgtgcaatag

SEQ ID NO: 39293 - DNA, 1134 bp, Glycine max
  Peptide Sequence Number=SeqID_156071
atggccactcccacagcataccaagaacacctccctgcatccccccactggctaaacaaaggggacaacgcatggcagctgacagcagccactctcgtaggtctccaaagcatgccgggtctggtgatcctctacgccagcatggtgaagaagaaatgggccgtgaactctgcattcatggccctctacgcctttgcagcagtcctaatatgctgggtgctcgtttgtcaccgaatggccttcggtgacaaactccttcccttctgggggaagggcgccccagcactaggccagaagtttttaacacaccgcgccaaagtccccgaaagcacgcactattataacaatggtacggtcgaaagcgcgacttcggaaccgttgtttgccacggcttctcttgtgtattttcaattcacgtttgcggctatcacgcttatcttgttggcgggatcggtgctaggaagaatgaacatcaaggcttggatggcttttgtgcctctttggctgattttttcgtacactgttggggcgtttagtctttggggtggtggctttctctaccattggggggttattgattactctggtggatatgttattcatctttcctctggaattgctggtttcactgctgcttactgggttgggccaaggttgaagagtgacagggagaggttcccaccgaacaacgtattgctgatgcttgcgggtgcagggttactatggatggggtggtcagggttcaatggtggagcaccatatgcagccaacattgactcttccattgctgtgctcaacactaacatttgtgctgccactagcctccttgtatggacttctcttgatgtaatcttcttcggcaagccttcggtgattggtgctgttcagggcatgatgactggactcgtttgcatcaccccaggagcagggcttgtgcaatcttgggcggctatagtgatgggaattctatcagggagcattccatgggtgaccatgatgatcctccacaagaagtcaagccttctacagaaggagaatacaaaacattcaattcattttaggtggattggagtggaaagaaaagatacgaagaaaaaagaaaaaaataaagaaaatagtaaatctgataaataa

SEQ ID NO: 39294 - DNA, 450 bp, Glycine max
  Peptide Sequence Number=SeqID_156072
atgtcgaaacactatggtgtcaacgattatctcaatgttgataactgcatttgcatgctatacattaagagtgagactttgtgctcgtacgacattattcgcctcaagggtgatcgttatgtcttgattgaggacaagctgcagaggaagatgagctgtaggatcttcagcattttcctcatcagcaacaacctcctccatcaaggcttgatttttatatccattataccggtcacccacgcaccaagcccagcagtattggacgtgacttccatagaagtagctattaatggggggaacaaagcatccgagaaagagtttcttgtgctgacagagctgcttatgagtcaattgctgaaactggatggtattgaggctgaaggtgaagcaaagttgcagagaaaagctgaggtaacaagaaatggaaagggggctggggtagttatttga

SEQ ID NO: 39295 - DNA, 489 bp, Glycine max
  Peptide Sequence Number=SeqID_156073
atggacaaattcacatgtaatctgttgatttacacactttccccccgcgaaaaggtagatgataccttaggagtgttccacacacacgctgtggctggcctattgggtggcctcctcacaggtctcttagcagaacctcagctttgtaggctcatattgccagtgaccaactcaaggggtgccttctatggtggcagtggtggcattcaactttttaagcaattagtggcagcatgttttatagctggatggaacttggtctcgaccacactgattcttctgaccatacagttgttcatacccttgaggatgccaaccgagcagctcgagatcggcgacgatgccatccacggcgaagaagcatatgctctttggggtgatggtgaaaaatatgacccaaccaggcatggatcctcaagagtggaaaaaacttcagcttcgccccgtgttaatgtaactggagcaaggggtgtgaccatagatttatga

SEQ ID NO: 39296 - DNA, 303 bp, Glycine max
  Peptide Sequence Number=SeqID_156074
atgcgtgagacaattaataaattgaatgttgagcttttggcaaaggcaaataaggagaagacacttgaggaaaagatgttgcagatgatggagaatcatgaccaccaaagtcaggagatgcgacaacagatgcaacaacaaattcatcaacaaaatgagcaaatgcaacgtatactacaacacttgcatattcagcctatcataccagctcctagtctatcacataccataggagatggaacagaccaccatgttaatgatgctcaggttgatcgttctcatgacatggaaaatgatcattga

SEQ ID NO: 39297 - DNA, 363 bp, Glycine max
  Peptide Sequence Number=SeqID_156075
gaattgacatcggtaaacaatacatggaagggttcaaagttgtttattaatgattcactactcaaaatagagtcctttacagaaagaactagtgttagattacctattggtgttctagtgctaaactcttcaacaaaagatcaaagtctttcccaatcttctggatcatctcgacatggcaagaaaatccgtacccgtgggtacccgcacgaacccgtcccgactttgacgggtaatacccgagttgaccgggtatgggttcgggttcgggttttccccgataaccaaaagtcgggtacgggtacaggtatgggattcctgtatccaccccgaccccgaccccgtccccgaccccgaccttga

SEQ ID NO: 39298 - DNA, 279 bp, Glycine max
  Peptide Sequence Number=SeqID_156076
atggggacaggtcggggagtcggggtcgggaattggggaaacaatacccgtccccgccccgccccattgccatgtctatttgttaagggtggtgataaaaatgttaatatcttttcaaacccattagataatgtcttgggtcatactctagcattcaaggttcgggtacaacctaagtacaagaattcatctgtgcagaaaatatctgatgacccgactgtaatgagagctattttggatttcctctcaaatgaggaggtgagcaaaggtagtatctaa

SEQ ID NO: 39299 - DNA, 182 bp, Glycine max
  Peptide Sequence Number=SeqID_156077
caaacaagaactctgagtactttcgacatccttaccttgacagtagcaaggtcgcgacaccactccaaagagcacgacttcggctatggcggtggtgggaccaacaggtagctagggtgggcacgacgaaggtcagggaacagcgatgtgagggtgggcacaaaagagatcgagtgggatga

SEQ ID NO: 39300 - DNA, 878 bp, Glycine max
  Peptide Sequence Number=SeqID_156078
gcatgcttggcttggcttttgctgttgttttccttttaactgcatttgtagtgttatcttcatgtggccactcaccacttggttgcaatgaagaagaaaggcatggtcttcaatggatcaagggaagcttcaaagatccatcatcatggctttcctcttgggaagaagaggattgttgtcaatggaaaggtgtagtttgcagcaatattacaggatatattgtcaagttggacctcaggaatccttgcttcccacggaggaaccaaggaggtcaaccaaactgtgactttaacaaatatgttcttaaagctaaacatgctcatccttctatattgcagcttaaatatctcacttatttagatttgagtggaaacaaatttaatagttcaataccaatgttcatccaaactatggagcatctgcaattcctttctctctctgattgtcattttagtgggaggatcccttacaatcttgggaacctcacaaaattgctccttcttgatttcagcttcaatcctcttctatatgctgatgacttttattggatttctcaacttccatcactccaatacctttacatgcgtgatgtgcatcttggtaagacacgaaatttgttgcaggcactcagcatgcttccttctttgatagaaatagaattgaggaattgtggactaaacaagttacacacttatcaacttgttagagccacaaactgtggaagcaatgccttcaaaggttattttgatgatgccaaagaattcaagaatgaagagaaagattcaagagaagtttcaagttttcaagaatcaagaatcaagaataatcaagattcaaggttcaagatctcaagaatcatgatcaagattcaagactaa

SEQ ID NO: 39301 - DNA, 2040 bp, Glycine max
  Peptide Sequence Number=SeqID_156079
atgtcttccattgcagagattgaattttctttcaacaacctgagttccactccattctggttgggaacctatagtaatctggtctatctatctgttgaaaataatgctctttatggctcacttccatctactttacaaaatctgacttccttgatttacctcgacctttcagaaaacaattttgattctgttccatcctggttaggtgagttaaagggtcttcaatacttgtatctttcaggcaatgatttaaaacatattgaaggatctctagcatcttttctaggaaactgttgtcatcttcattcattagatatgtcaagtaacaatcttaaaggagatgcacttggagtctacatacagtacggatgcattaggagtctagagcaacttgtaagcctaaaatctctagatctttcaagaaactctttaaacggtacaattccccaaaatattggtcaacttaaaaatttgatcaccctctatcttttttataataatttacatggaagcataccttatagtcttggtcaacttctaaacctgcaaaactttgacatgtccctaaatcatttggagagttcggtgtctgacataagatggcctaagcaacttgtttacctgaacctcaccaataacaatatcactgggtcacttccacaagatattgctgataggttgcccaatgttagtcacttgctttttggaaacaaccttataaatggttccattccaaattcattgtgcaaaatagactccttgtacaatcttgacctttcaagcaacttgttatctggtgaaattcctgattgttggagtgctactcaaggtctcaatgtgttaaatttggtatccaacaaattatcaggtgttattccaagctgtctcggtaacctacccatgttggcatggtttcatttgaacaataaaagtcttcagggtgggattccatcatctttgagaaatttacagcaacttttaattctggatctaggagagaaccatctgtctgggattatacctttatggatggggaacattttctactcaatgcagattctaaggctacggcaaaacatgttgattggaaaaattccttcacaactatgccaactttctgcactgcaaatcttggacctttcaaacaacaacctgatgggatcaatccctcactgcattggaaatctcacagcaatgattttaggaaagaaatcttctgtcatccaacctagtgaagagcctagagatgttgaatggtatgaacaagaggtcagacaagtcattaaaggaagggaacttgactataccaggaatctaaaactggtagccaacatggacttctcaaataacaatttgagtggtactattcctgaaggaatagcattgctttctgcattgcaaggcctaaatctatcacacaatcatctgtcaggacatatccctaaaaggataggggacatgaaatctctagaatctcttgatatctctcatgaccaactttcaggcacaatttcagacagcatatcaagtttaacttcgttaagccacttgaatttgtcctacaacaatctttcaggaccaattccaaaaggaactcaattgtcaacccttgatgatcctttaatttatacgggcaaccaatttctctgtgggcctccactgccaaatgagtgttctgctgatgattcccaacatgacaatgtagatgaagatgaagatggcaaaaaggataaagtagcaaaattgtggttttactttatcattgcacttggctatgctcttggattttgggctgtgattggaagcttgttgattaagacaagttggaggcgttcttactttcaatacattgacgactcaactcaaaggataaatgtatcatgggcaatacatttatcaaatttcaaggcaagatttacaggaagccctgttgctgagtcacacattattggagtgtttatgctttctgtttttgttttatgcatttataggatttcatgtttattatgcttgataagtgattacttcacatttgtataa

SEQ ID NO: 39302 - DNA, 516 bp, Glycine max
  Peptide Sequence Number=SeqID_156080
atggaagttgaagcagagatcaagcaacgagattataaggaagaagatccagcttcaaagataggagctacaggcttaatagtaggactagaatcagcattaacaggagaactagagttggaatttgaatctgttgtgggatcaacagaagtaggactagcaacagaattgctagagagtagtattggtgtagtggtgcttaagattgtaagtggacttaaggctgtgaattttaggcaacctgaggtgctattggtaaagaaggttcatgaatttgaggtgagaaaaaggccacttgaggcattagcatatatgggactaaatggagagtacaatttgaaggagttaatgagattggtaagcttaggagctgcatgcacccgttctgacccaaaattaagaccaagcactacacagatagtaagcattcttgatggcaatgacaaattaatcatgggagagaacatggacagcagggaagattggagagaaagaaatgcttgcttcagttattga

SEQ ID NO: 39303 - DNA, 267 bp, Glycine max
  Peptide Sequence Number=SeqID_156081
atgatgaacaaaacaaggccatgcaatgcatacttttatctagaggctaaaagcatcaatatatttgtacctcttgagatagaggaaagcactccagtgaagaacttggatggatgtataggatgtggaaccttgaaaattacttttcaacgtcccactcactttgacattgcatcaaacagtttcaaagttcaaacattcagcatgtacaagttatcagaactcaaagggtggatatggactagaagaatatcccaagatcattaa

SEQ ID NO: 39304 - DNA, 477 bp, Glycine max
  Peptide Sequence Number=SeqID_156082
atggagaaggctattttggaagataagaaaaatccagttcccatgtatcaaaaagccaagatactcataagcttagaaagaattgacgaggctttggatgtcttagacgagctgaaagagaagtcaaaagaagaagaatggaagtgttttagagggaatttgacggaaaagtgtggaagaaaaagaattgaagaagagttggaagaattggaaaactctcttagcgtgcaatccaacttagtgtgcaattctcgctcaacatgtgtgctcgctcatcgcgcaggtcttagtgtgcagatgcatgctcagtgcgaagtcagcatgaaaagtaagctacctcaggcctataaaaggagtaggaagttgaaggaaaagatacaccgagtctcagagctctccagtgcagaaattcaaagcccgagcctctcccttagggaaaatcctttccttagtcattcccctttttcttattactag

SEQ ID NO: 39305 - DNA, 204 bp, Glycine max
  Peptide Sequence Number=SeqID_156083
atggagacgacgttgttagacttggagacctcggggaaccattttgggaggatggataagaaggcattgaggaaggagagaaaatgcttggcgagtgaacgaattggggggagagaggtaatcgaagaccagggcgtggatgccgggggaatcggaggactgaagcttggagatgagggaggatttcgagggactcgcagctga

SEQ ID NO: 39306 - DNA, 285 bp, Glycine max
  Peptide Sequence Number=SeqID_156084
atgattgtcaccaccacctccaccatgatgccgatgacaacaacaataatggcaatggtagcgacaataataattatggtggtgatgacgatagcgacgagaatgatggtcatgatagcaaaggtagcaacggttgataacgatatggtggtcgtgatagtgacagtgacaacgacaaaggtcatggcaacagaggtgatgacagtggtggtggcggttgatggcgacgttgataatagtgttagttgtagtggtggtcatgatagaagccccatcaagaattaa

SEQ ID NO: 39307 - DNA, 184 bp, Glycine max
  Peptide Sequence Number=SeqID_156085
atccgataatgagtcctgtgaaggtaatgataccgaggagctagacgtcgattttgagcaactggtaaaccaagctgaggatggggaagatgaggattgggggtttccctcagagctaaaaagaatggttgaacaagaagacaaggaagttgatgcaatcctaccccgcaagggcattggatag

SEQ ID NO: 39308 - DNA, 1954 bp, Glycine max
  Peptide Sequence Number=SeqID_156086
taatctccaaggcaaggacaatgcacctccacctccacctcaatggattgaggctaagagccatgtacaacaaggagcatatgagtgtggatattatgtgatgcattggatgtggtgcatcgttagtggtggtttgaaaaatgaactccacaactatttttctgatggaacagcattagacactggcaccatgacgacactacgcaagaaatgggcagcctattttctagaagttggaaaatggatgtcagcgtttgacatgttcctgcttgggtcgttcagtccgtcgcaaccttctcatacattggtgcaagaaatcatcggaaaagctcctcagaccatcccttattgcagagctttctggatggagatgatgcttataggaactcaagatttaagctcataccatatatttgtaaggtacatttctactaaaaatgtgacatggatcatggttttcctaatgcaaagtgttggaaagaaagcatgtttagtggggcaagcgctagaaatgctttatatccgtgggaagaactatctagagattgatatcgacgttggatcttcaaccgtggcaagcggggtgcctagcctagttcttggatacctgaacaatttggtggtagaaatggcatttttggtacagtacttagtactcactgagaggttatattcttcttctatgaaacttgctgaaaagtttatacaaataggaccacagagtagtgtctcagaaaaaggtccccctgacacatcatgtcactctgcagcaaccatgcagtctgtttatcctcgccacttggagattccaacttttattaacccaaggtctatggagaaggaggctaaagctgctcagttgactatcttctatgatgggcaagttgttgtgtttgatgattttcctgctgataaagtgcaggagacgaagatggctactgcagcaggtgcagttgcccttttgtactacacattgaatcggaaattgcagactcacgatgtaattgatgaagatggtgaagaaaatgggagtgattcgccagctgatacgccattaggtattggctgtgtttctcatcggttaatccaagcccctgcaacatggttggagacaatttctacattgttagaaactctcaggttcacttattcggagacacttgggaagtggccaattagggatttggcgtttggtatcaactttcttctaaagcggcagggaaactatcatgtgggcagtgaattttgtggtaaggacagtgtacagctgaaaggatctgaaattactgctgaacttaagtatctcttaaacttgttgacattgtgttggcacttttcaaagaagccctttcccttgtttttagaagaaactggctacactgaagaaaacgttctccttcgagaagcaaaagcaggaattttgaaaccaacttttacaataatagctgatcacaagatgggatgccttttgttattgattcgtggcacgcataatatcaaggatactttaacaactgttactggaaatgtggtaccatttcatcacattgttgttaatctggggggtgtcagtgatttggttttaggttatgcacattgtggaatggttgctgctgctcgatggattgcaaagctcgcaactccttgtctccttgaagcacttggccactaccctgactataaagttaagattgtagggcactctttgggtggaggaactgccgcaattctaacttatgtgttgagagagagaaaggatctgcccgtaaccacgtgcattacatttgctccagctgcttgtatgacatgggagttggcagagtcaggtgatagttttattacttctattataaatggagctgatttggtgcctacattctcagttgcttttgtagatgacttgtgttctgaggttgtgatccttcgcattgcgtattggaaaatgttattgtag

SEQ ID NO: 39309 - DNA, 223 bp, Glycine max
  Peptide Sequence Number=SeqID_156087
ccaaacggatacgaaagcgcaagacaagaagcgaaacttacctcgacgatggaataccacggcggtggtgtggatggcatcgacaaacctaacgaagactgactacggtgactacggcggcagcacaacaagaaacaccaggacaaggaggaagacgaagaagcgcgttgcagcaaaagggaattgctttgtgcaacatgtaagtttcttgtgcacccagtaa

SEQ ID NO: 39310 - DNA, 435 bp, Glycine max
  Peptide Sequence Number=SeqID_156088
atggatgaagaatctaagagaatggaagaaggaatcaattcagcattgaatggtggtggcaataaggatgacttgaagaggagggtaaccattaaaaccagtaatggaggttctgttattgagcatgacaaaggcacaatggctaagccttatggggctgagagtgagtccgtacagaaaatagctgaacaggagcaaccagtggttaagcagaagaccaagaggattgcaaccctggatgcatttaggggtctcaccatagtgttgatgatactggtagacgacgctggtgaagcttatccacgcattgatcattccccgtggaatggatgtactttggccgatttcgttatgcctttctttcttttcattgttgggattgccatagcccttgcactaaagcactatgattctgaatacaacattgtgtcgtaa

SEQ ID NO: 39311 - DNA, 1716 bp, Glycine max
  Peptide Sequence Number=SeqID_156089
atgaagactttgatctaccatgttctcacggggcgttggttcatgctctttgcatctttactcatcatggccgcagcaggagcagcctacatgttcggcatgtactctaacgaggtcaaaacctctttagggtacgaccaaaccactcttaacttgttcagcttcttcaaagacgttggtgccaccgttggaatcatatcagggttagtcaacgagataactccaccttgggtagttctgtcaattggggtcatcatgaacttctttggctacttcatgatatttcttgctgtcactggccgcattgccaaaccccaagtttggcaaatgtgtctctacatttgcattggctcaaattctcaaacttttgctaacacaggtggtactgtcacgtgtgtgaaaaacttccctggaagccgtggcaatgttttaggcctactcaaaggttacgttggtctaagtggtgccatcattgcacagctctaccatgccttctacggtgatcataaccctcaggctcttattttactcattgcgtggcttcctgctgctgtttcctttcttttccttccaacaattcggatattcaacacagttcaccacccaaatgagaacaaagttttctaccaccttctatatatatcactagtccttgccgggtttctcatggttcttatcatcatgcaaaacaagctcaggtttacaaggcctgaatacatagccgatggggttgtggttttcttctttctccttctcccacttgttgtggtgtttagagaagaaataaaccaattgaaagccaaaacgcaaggtttgaccgattcagtaaaagtagtcactgaagttattccacctccaaatgtggtggagcaagaagtcccatcaactaccacaagctcccacgagaaaagttcttgttttgggaatatactcaaacccccaaaaagaggagaagactacaccatcttgcaagcacttttcagcattgacatgctgattctgttcatagcaacaacatttggtgctggcggagcattaacagccatagacaatttaggacagattggacgctcattagggtacccaagaaaaagcattacaacatgcgtgtccttattgagcatatggaactacttgggaagagtagttgcaggttacgcctctgaaatattcttaaccaaatacaaactccctcgtccctacatgctcactctagttttgcttctctcttgtgttggccacattctgatagccattggtgccccaaactctctctacttggcttcagtgattatagggttctgtttgggagctcagtggccactaatgtttgcaatcatatcagaaatatttggcctcaaatactactccacgttgttcaactttggagccgtagcaagccctgttgggtcttacattctgaacgtgaaagtggctggtgttttgtatgataaagaggctttgaaacagttgaaggccaaaggactcacgagagaagaagggaaggacctaacttgcgtgggagtgcaatgctataaaatggcttttatcataatcacggcttcaacgctgtttgcatgcattgtttcgtttgttttggtggtgaggactagaaaattttacaaaggggatatctatagaaagttcagagtggaacatgaaacaggagagaatgaaatggggatcactaaaactcgtaatagtccttctggttga

SEQ ID NO: 39312 - DNA, 183 bp, Glycine max
  Peptide Sequence Number=SeqID_156090
atggcaaagatcaataatgcgacaaagatgaatggcctcgctaagcgaaccttggagttggagctagttagggccaatgtgccatcaccttcttcactcaccagccacaagaagatatatagtgttgatcacaacggagttataggcttgtgcctaatgcgagaaggaaaaggaaatatataa

SEQ ID NO: 39313 - DNA, 283 bp, Glycine max
  Peptide Sequence Number=SeqID_156091
ggttgagagtgctcattggtcattaaacaaacttctacaaaacttcattggtgacatatgcagtgtttgggaagcaatgaacaacatgatgacacttcaacacacccaaattaaagcatcttttgagacaaagacaatccacattttttggcgtagacttagtttttcagatcaagggttatgtgaggctgaggtgaccatgactgaggagatggaaaccatatcgaaacaatttgagcaactcgatatttgcggcaaggtacatttgaagacaaagctttga

SEQ ID NO: 39314 - DNA, 774 bp, Glycine max
  Peptide Sequence Number=SeqID_156092
atgcctgaatctttagttgagccatgtcggtgcttcatttcagttatatctcacggtcatggcaacatgatcattgatgagggatgtctaaaactgctggcctcaaacaactacattgtcgttttgaaagataacaagccacagcgtgaacttcaggaatattgtcaggagtctggcattcattatcttgttgatcagcctatggggtttggcgcaaacaataactatattttcacttggtgccagcaagagttaggaatgcgtgatggggatcgctttttggtgcttaaccctgatgtttttatcgaaccatctgtgctggcagcactgctgttgcacgcggaacaaaacacatactcgctagttgcgatcaatctcttcaacgataaaaattttactatttatgacaaagggataaggcatttcccaaccattagcagctttgcggtttcattcttgctgcagaaaaataagtctatctacgataaagacaaaattactcaggatacggaagttgaatgggcagcaggctcgtttttactgtttactgccaaatgctatcgagagctgggcggatttgatacgcgctactacatgtactgtgaagatcttgacatttgctggcgagcgaggcgggagttagggataaacgttgtttatttgcctcaatttaaagcattgcatcttgctcaaatgcgtagtcgctcacttttttctaaacattttatctggcacgttaccagcgctttgcgtttttgcttgaaacaagcgtga

SEQ ID NO: 39315 - DNA, 1167 bp, Glycine max
  Peptide Sequence Number=SeqID_156093
atgttcaagcgaatcatgaagggagggcagaagaagccctccaagacggacccgagcgatccgtcgcccttggctccggcggcggcgggtgcggcagccgctccggcgctggtggttcctccgccgtcgggcaccatagagcctctgcctctcttccgcgacgtggcggtctcggagcggcagaacctcttcatccggaagctccagatatgctgccacgtgttggacttctccgacacgctgaaatccgttcgggagaaggaaatcaagagacagactctaatggagctcgtggatttcatccaatccgggtcggggaagataacggagacttgccaggaagagatgatcaaaatggtgtcggcgaacgttttccggtgcctcccgccggcttcgcacgagaacaccggccaggaagccaccgatccggaagaggaggagccgtgcctcgaaccagcgtggccgcacttgcaactcgtctacgagcttctcctcagatacgtggtttcctccgacactgacacaaaggttgcaaaacggtatatcgatcattcttttgttctcaaactccttgatttgtttgactctgaggaccctcgtgagcgtgagtatttgaaaaccatattgcatcgtgtgtacgggaaattcatggtgcatcgtcccttcattaggaaggccattaacaacatattttttcggtttatatatgagacggagcggcatagtggtattggggagcttctcgagattctgggaagtattattaatgggtttgccctgcccatgaaggaggagcataagttgtttcttgcgagggcgcttctgcctctgcataagcccaagccggttggggtgtaccaccagcagttgtcgtattgcattgcacagtttgtggagaaggattacaagctctcggatacggttattaggggcttgttgaagtattggcctgtcactaattgccagaaggaggttctcttccttggggaactggaggaggtgctggaggccacacagaccgcagagttccaacgttgcatggtccctctttttagacaggttgcccgctgcctcaatagttctcactttcagatgtccaatcctgggtgtgaggggagtgtattgagatccctcatcatggccacaccagggcttgtaaagctttag

SEQ ID NO: 39316 - DNA, 462 bp, Glycine max
  Peptide Sequence Number=SeqID_156094
atgcaggttgcagaacgggcactctttttgtggaataatgagcatattgtcagcttaattgcccaaaacaggactgtagtattacccataatatttgaagcattggagaaaaatatcaagagtcattggaaccaggctgttcacggcttgactgtgaatgttcggaaaatgtttgtagaaatggatgcagaattgtttgaagagtgtcagaggcagtttgaagagagggaggctaaagcaaaagaattagaagtgcagagggaattgaattggaaaagactggcagaggcagcttcacagaatggggtggatatggttttgttaggcactaagttttgtaaggagttagtgttgtgccgtcgccctgataagagggcaacgttggcttcaagcaaatctgggcaacgttgccccgccgctggcaatcatgcggcaaacatgttcgatgttacccaccattga

SEQ ID NO: 39317 - DNA, 249 bp, Glycine max
  Peptide Sequence Number=SeqID_156095
atgaccaggccttgcttaaagggaatagaagagaagactgccaagttgaaaggaagtgagaaggctctagttgcacggcatgaagctagtcatgctgtagtaggtactgcagtagcaaaccttcttgctggacagccacatgttgaggtgtggactttggaatatcttattttagaattcattgatcttgttttatggtgggaaattaaagaaaagtataaatctgttatgtgtgatattcaacgataa

SEQ ID NO: 39318 - DNA, 297 bp, Glycine max
  Peptide Sequence Number=SeqID_156096
atgaaggtagacctgtctgccctctacaaggtcatcgcatgtgccccgaaaagggaaatacaaattgggaagaagtcttggcaggctaggacgcaagggataacttggctcccaaagctaaaaggtccaagtgggaaggaagttgaagtccctgaggaaagagaagaagtgcaagccttgaaagcagagcttggaagaacgagagtggtcaaggaaaagctaaagacgacagtcactagggtcaggaaagagtgtgacgagctaagggatgtcaacatgactactgtcataccctaa

SEQ ID NO: 39319 - DNA, 1269 bp, Glycine max
  Peptide Sequence Number=SeqID_156097
atggcttcgtgcctaagcagccagctcgcctgggcgatctgtggtcatgttgggtctccgactcgcttgataatagtgaagccttatctagtgttttcctcttttgatgatgcattatcactgggtgttgaagtattggttatcaaaatttctattcttgcaaacatggggtcggaccaagcatcatcttttaagaaaatgttctatcatgtcaaagtcaaaaatttggaagtagccagcttgcgaaagctggggcagtggatgaatcaagttcaacgtcaggcttttaggaagatgtttcacatttggggactttcagttagcacaaccataaaggagttcgaagggatcttaggatgcccgataggaggaaggaaaccatacctcttttctgggtactatccttctatggcgagaatagcaggagtggcggaaactctggcaagccaaggagagtgggtatcattcatcaacgtattagcactgctagtgtttgggacagtactatttccgaatatagacgagttgatggatctagtagtgatcgatgcttttcttgcttattaccacagcaaggaaagctcaatcattgttgttttagcatatgcgtatgatacattcggcttaagatgtgagaaaagcagtcatagcatgtgctcgagaaaggacaaagcaaattgggaagaactcttggcaggcatgatgggagcgtccattagttggttcccatggtgtaaagaaggaggggcaagagtgttatgctcatgtgaaggatttccaaatgtccctttgataaggacgaggggttgtattaattataatcctgtgttggccataagacagttaggataccctatgaaaggtgcgccatcagaggagaccatcgtgccaagtttcaatgaagctaatacgaagatacttcagaggatccgtaaggcatgggataaagtaggaagaaaagataaagaacttaggggaagaagcaatggtgtcataggcggctatcacaaatggtttaaacctagaacacaagggataacttggctccaaaagctaaagggtctgaatagggaagagagtgaagaggtgcaagctttgaaagctgagctaaaaaagacaagagtagagaatgagaagctgaaggtggcagtcactagagttaggaaagaatgtgataagctgaaagatatcaacatgaccgtggctgaagcgctagagtgggaaacaaaaaaagacagaaaggaagaatggagcaagaacaagttctga

SEQ ID NO: 39320 - DNA, 1122 bp, Glycine max
  Peptide Sequence Number=SeqID_156098
atgaagaaggactcgctctgggttcaaggttcaagttcgtatgcacaaatatttattgcacaatacatttttaatgtgaagtcatctcctgatgcttcatttattcggaggggtattttaaggggcaaaaatacactgttgggtggttttaaatttagacggggtaactcatctgatgattgggctgttagcaacagaagacatcgaagcccatatggagagcgcccaacaggagcaccaagagacccatgtatctggacgactatgctgactatccttaagaaggataggagcaataatgctgtctcttgtcatgatgtgaatctatgtcttcgggatattatgatagatgagaattggtgcgcaaatcatttatatactaatactatcctccttgactctttcatgcagaaccttgccagcattgattgcgtcctagctccaggctttgaagattgttgggtatggaaacattcggcgaatggaacccacacagcagcctctaccaactcttggttacttagcgttcacaatgaagctcatctctccccgttagcgtcctttaggtggctttggaagcttgagatccctgagaaaatttgcatgttcctttggcttatcttgcataaatccctgccaacaaattcagttcgtcgtcaccgtaacttagtgaactccccagcttgtcaagtctgctctcatgtgatggaggacactcttcattacatcagggattgcccacatgcgagagatatttggtctcgtctcaatttcacttctcgagtaggggaagaagttcggacctcctttgcatttgatggctatggtgatgttatgaaggtcgaattgcttgctttgcttcatgtcttggagctagcttggaacaaggacttcagaaatgtttgctgcgaagtggacaatcttgaggtagaaaagattatcaactcgcgggaggaagctaatgaagttgcccacttccttgcatctgttggggttcaccaaacccaaccttttggtatttgggataatccttcacttgcccttgaaaccatccttcttaaggatagtttaggcaatgaagccaatgatgcatcagatagaatgagaggagacacagaataa

SEQ ID NO: 39321 - DNA, 921 bp, Glycine max
  Peptide Sequence Number=SeqID_156099
atgaaggagaaggagaggccaaaaatgctgcacaacgaaggacagagatttgaggtagaagcggtgcagtgccataatggccttcttcctaacggcgtccttggagtggttaagaagcttgacgacacgaggaagcatggtggggatggtctcctcattgatgagcctgcagacggcgttaagagcggcgcaaatgacgaggtagttatcggaggcgaggtctttttggattgtgttgacgatgaggatgatgaggttgtggtcgtcgctgaggaagagcgtgagggtgaggtagtccgtgcgcttcaggaagagggagtcgtgaccaggtcttccttcacaagtccttacttggtagttggtagtagtatcctttgtctcatgagtttgacaatgttcttacttcttgtatcacatcttacagatgaaaggcttaatgatattgttggaagtgcatactatgtggcccctgaagttctccatagatcttatggcacagaggttgatgtgtggagtatagctaatccaagctttgacaaaacactgtggccatctttgtctttagaagctaaagattttgtcaaacgcatattgaataaggatccacagaatcgaatatctgctgctcaggctctaactaacaacattggggaggccttgtcaaaaacattgactgctgatgaactctattatctgagagagcaatttgcactgctagaaccaagaaaaaatggtagtatatctttagagaacgttaacaaggccttgatgaaatacgcaacagatgccatgaaagagtctcacatccttgacttcctttcattgctctttatcgttgggaacaacatgcccgctgtgcatatgaactctttgataaagacaaaaatagggctattgtcattgaagagcttgcttcagtaa

SEQ ID NO: 39322 - DNA, 1443 bp, Glycine max
  Peptide Sequence Number=SeqID_156100
atggtaaaatgttacatgcagcaacttctacaaggacttgaccactgccacaactgtggtgtgctgcaccgtgacattaagggttccaatcttttgattgataacaatggcatcttgaagattgcagactttggtttggcaagtgtttttgatccaaatcaaactcagcctttgacaagccgagttgtcactctttggtaccgtccaccagagcttttacttggtgccacatactatggcactgctgtagatttatggagtacaggctgtatacttgctgagttgtatgctggcaaacctataatgcctggaagaactgaggtggagcagttgcataaaatttttaaactttgtggttcaccttctgaggattattggagaaaatcaaagttgccacatgcaaccatatttaagccccgacaaccctattggcgttgtgttgccgacacattcaaggatttccctgcacctgctttagcactcatggagactcttttgtccattgatcctgctgatcgtggaactgcagcatctgctttgaagagtgatttcttcacaacaaagcctctaccttgtgatccttcaagtttgccaaagtatcctcctagcaaagaatttgatgccaaactacgggacgaacaagcaagaaggcagggggcaacaggaagcaggggccagagacatgaccttgaaagaagaggggcaaaagaatctcgagctgttcctgcacctgatgccaatgctgaactgccactgtcaatgcagaagagacaaagtcaggcccaatcaaaaagcagaagtgagaagtttaatcctcatcctgaagaagcttctggatttcccattgatccccccagatcgtcacaagctgtagaagtaggtatagaaactcaagtaccacaacataaaagagcctcccattcgggtccgctggctcaccgaactgcatgggctaaatctgggaagaaccaggatgatgctccaaagatttcagttgggggcgacctatcaacaatctcaggcttagttgctgcaaggagtatgttgtcagatgatcgcagagaaagatctggatcgtcacaaacggaggcttcaaaattaacgaacagattcccaggatcattcaaggacttctctgaatcgtcaataaaacaagatcaaaggcatcatgtacagggccaagtaggcacttcccaaaaggaagaagggagaagcagcaacaaagacctagttcttgttggttatggatcagagggtcataaaattcattactctggtccattaacatcaagcaacatggatcaggtgttgaaagaccatgaccgccaaattcaagaggctgttagacgggcacgtttggataaagcaaaaattaggaggctccaagctgaagggaaccagcttcaagtttcagatcaaatgtatgctgaagaagagtcttag

SEQ ID NO: 39323 - DNA, 165 bp, Glycine max
  Peptide Sequence Number=SeqID_156101
atgtccgagaggcaatgtatctttgtcctgttttgtaatataaaagtctggccaatccatgttgacctgaagtttttggaaccagttgggcgagaacttaagatgcttggaaagttcatggatgacgctgttgaactaatgaacaaatcattcatagagcgttga

SEQ ID NO: 39324 - DNA, 834 bp, Glycine max
  Peptide Sequence Number=SeqID_156102
atgcagcgtcaaagccacatttcggttgcaatttcactaatatgcatcctgttttgttccacattaactagtgctcttgatgaacctgagtatggttacaatgaaaaaagtgcaaatgggccccaacattggggtgatctgaaagaagaatgggcagcctgtaaaatagggcaaattcaatctcctattgatttgtccactaatggagtggaagtgatccccaagttaggggggctaaagtactggaactataagcctcaacatgctactgtctccaacaggggtcatgatgttgcggtcatttgggaaggggatgctggctcaatagaaataaatggaacacctttcttcctccaacaagcccattggcactggcctgccgaacataccatcaacggccgcaggtatgacttggagttgcacatggttcatgttagcccacagcctgatggaacaaacaagaccgctgttgttggtgttctgtacaagtacggttcccccgatccactgctctctaagttgggaaaatacataatggacactcctgaagaggatgatgagaaaagcgtaggggtggttgatccctcagaaatcatgaagggcagcaagatgtactacaggtacatgggatcactcactgcacctccttgcactgaagacatcatttggaccgttgataagaaggtaagaactgtttcaagggggcaagtgaagttgctcaaggatacggtacttaaatattatgccaaatggaatgcaaggccgctgcagcccctaaatcaacgagcgatacaactttacgtcccaaagacaaagaataaacccgtgtattag

SEQ ID NO: 39325 - DNA, 621 bp, Glycine max
  Peptide Sequence Number=SeqID_156103
atggatcatcttcatgccaacaggattctacctaaaggttgtaattcctcattcattacatttattccaaagagggagaacccccaaagcttgggtgactttcatcctatttctttggagggatgtatgcacaagattttggacaagatatttactaggaggttaaagagtgtgctgccaagtgtgcttgatgatcgacaaattgcattcctaggcggtagaaatatcctcaatggtgtgcttgtgacaaatgaggtgattgatgaggcaaggaggaagaaaaataagtgtatattgttcaaagttgattatgaaaaagcctgtgatttaatgtcttggaattttttgctatacatgcttactgggcttggctttgggataaatgggttgagtggattagtcagtgtctcatgtcaacttatatttcagtgcttgcttaagtgggatgatgagagtgcggtggataaggagttttttgcgggatactccataggtacagaggaggtaaaggtggatttgcttcaatatgccgatgataccacattcattggagaagcaatggtggaaaatgttgtcatgattaagagcgtcttgagaagaagaagaagaagaatagtgtag

SEQ ID NO: 39326 - DNA, 384 bp, Glycine max
  Peptide Sequence Number=SeqID_156104
atggcaaggttgcaggtgcaaaggaggaagatggatgggaaaagatatggtgcggttaaggagattttaattgcagtaaagagaaaccgttggggtagacagtacggttttttacgctttgtggatgtgaaaaatccgaagcgtctggatacaagggagatgggatctagcaaacataacagaaattctgggatggaggatgaaaatcaaacaaaacctaagagtgggagaaagggcaaagctacaagacataaattcgctgggattaacatgcgatgtattggagatgatatgatcctaatatcggggattggagaaaaggatgctagggagatgattgacaaaggaagagataatttgttgtccgtcttccaagcatcgtga

SEQ ID NO: 39327 - DNA, 228 bp, Glycine max
  Peptide Sequence Number=SeqID_156105
atggcggcaacctcaacatcactggcttctcaactctacattggcctgcgccgcccatgcctcaagcttgattctttcaattctcaatctttctctgtcttcgaccccaatcttcgcctatccctctctcctcccagaccctcacgcgccatcgtcgccatggcaggcaccggcaagttctttgttggcggcaactggaagtgtaatcttatagtagcacaccgttga

SEQ ID NO: 39328 - DNA, 231 bp, Glycine max
  Peptide Sequence Number=SeqID_156106
atgtggaaatctggttcttactatgtcactggaacatctaacataatcaacattttgatattgattgatgttgtccttgatcctaggtgtaaggtgaaatatgttaaccaatttgtcaactacttatttaatgaagaccagagagatgaattgaagttgaagttgtcttctagttttaaatcactttatgagcagtaccaaggtgttgaagagggctctcaaattaactaa

SEQ ID NO: 39329 - DNA, 1353 bp, Glycine max
  Peptide Sequence Number=SeqID_156107
atgctgcagacttgctcaaaactgatccttagacactcaaaaccgcgtctcctcctcaatctccattcaatcacgaaaaccctaaccaccgcgtcttcctcccgcgacgagtacttcgcagtaatccaccacgtgtcgaacatcgtgcggcgcgacttctacctggaacgcaccctcaacaagctccgcatcaccgtaacccccgagctcgtcttccgtgtccttcgcgcgtgttccaacaatcccactgagtctctccgcttcttcaactgggcacgaacccacccctcctactctccaacctccctcgaattcgaacaaatcgtcaccaccctcgcccgcgccaacacctaccagtccatgtgggccctcatccgccaagtcaccctccaccaccgtctctccctctccccctccgccgtcgcctccgtcatcgaggcctacggcgacaaccgccacgtcgaccaatccgtccaggtcttcaacaaatcccccctcctcctcaactgccctcagaccctccctctctacaacgccctcctcaggtctctctgccacaacaaactcttccacggcgcctacgccctcgtccgccgcatgctccgcaagggcctccgtccggacaaaaccacctacgcggtcctcgtcaacgcctggtgctccaacgggaaactccgcgaggccaagctcttccttgaggaaatgagcgagaaaggcttcaaccctcccgtccgcggccgcgaccttctagtcgaaggcctgctcaatgccggctacgtggaatccgccaagggaatggtgaggaacatgatcaagcaagggagtgttcctgatgttggaaccttcaatgctgtggtggagacagtttctaaagaggacgttcagttctgtgttggtctttatcatgaagtgtgtgctttggggatggctcctgatgttaacacttataagattcttgttcccgcggtttcaaagagtgggatggttgatgaggcatttaggttgttgaataatttcattgaggatggccacaagccctttccgagcttgtatgcgcccgttattaaggctttgtgtaggaggggccagtttgatgatgctttttgcttctttggggatatgaaggccaaggcccatcctcctaatcggcctctttatactatgctgattaccatgtgtggtcgcgctggcaagtttgttgaggccgcgaattatatctttgaaatgacagagatggggttggtccccatttcgcgatgttttgacatggttactgatggattgaagaactgtggcaagcatgatttggctaggagagtgcaggaattggaagtttctatccgcggtgtttga

SEQ ID NO: 39330 - DNA, 276 bp, Glycine max
  Peptide Sequence Number=SeqID_156108
atggaggttgttgagttaaaagtggagatggtttgtatacatgagaaaagactaaggaaatgcctctcaaaattaaaagggatagaaaaagtggaagtggatactaactgccagaaagtagtagtgactggatacacacacaagaacaaaatcctaaaagcagttaggagagggggtctcaaagctgacttctggtctgctcagaatgagttccttaatgcttatgtcagttccaattatgccaactttagattcaaccccttcaacttcttctaa

SEQ ID NO: 39331 - DNA, 435 bp, Glycine max
  Peptide Sequence Number=SeqID_156109
atggtgaaagcaagaagcaaacttgcccttggcagagtccctcctaggctaaaacaaaatttcggagccttggtagaatcagatgagaataaagaggaggatgaggaagttcaaagagctctagctgcttctatggagagcatgaaagaatcaactgttatgactggaagagacaatatagatacagacgttgcagtctatggacaacaaacaaccttggctaagagacccatatatccagccctgcctgaagaacccaaggttgaaagaaatctcctatgcagggttggtgttcgtcttccagatggacaccggattcagcgtaacttcttacgcactgatccaattcagagtgttatcgactcagctgaattcatgaatttcttacaccaccctgctggaaatagagtagatggaaataggagagatatttga

SEQ ID NO: 39332 - DNA, 915 bp, Glycine max
  Peptide Sequence Number=SeqID_156110
atggggaaagagatattggagaacgtgaaggatgatggggggctcgaggagcttgagatgttgctgaatgagatccctcaggcaacatcacacaatctttaccatgggaaatcgcatgatgttgttgttcatcatggtgatgatgatgatcatcgtcatggttcttttgttgtgtctcatggaatgtgtgatgatgaccacccattcactcaggttcagtatccatgtgtttcatcccctgtgagtggcttttctctgcaatctgatggttcttcctcaagcttgttctcttcttctggccatgccttgtctgacactggatcaccaacccctcctccattggaggatcttaaatccaccaccatgccttcttctggaggttcttcttctcaccctaataaccgtttcatcacacctgattcaactcttatcaggaatgccaatggaggtttggttaatgaacttggcggcctgtgtgccaattttagccaaatgtacatcagcaatcaacaagagagcccttgtgatttcaaggatgcttcaatggccatgcataggcctccatttcctgaatgtgtatccttcactggaaatggtccaagcaatgttcacaagcatggggattcttacagtttcaggagaggttcttttgattgtgttggggttcagtcccctcttccctggagtcctagaaatcaggataccgatatgaattcggccttaatggctaatttatttggatcaagacagtgtgccaaaaggtccgagccaatgctttctcaattaaatgactttagtggttcaatggagtctccatgtcatcatcattcaaggcagctgatggataactactattttggaagaagtcgaaatcagccaccggagtgtactgcttctttgagcaggaatccaatg

SEQ ID NO: 39333 - DNA, 600 bp, Glycine max
  Peptide Sequence Number=SeqID_156111
atgatgtataaaactaacaccactctaactgctaatgctcagttcagcagaaacattgctggtgaagggtttatatttgttgctgctgcaaagtattgtgttgacattgcaactcaccaacacggatgctgtgttctgcaaagatgcattggccattcaagcggggagtatcgagaaaaactgattgcagaaatatgtgctaatgcacttctgctagctcaagatcaattcggaaattatgttgttcaatttatcttggacttgaagatttcatctgtcaccacatgcataaggttgcaatttgaaggcaactatgtgcacctatcaagacagaagtttggtagtcatgtggttgaaaaatgtcttgctgcattcaatgatgagaatcgatcaagagtcattcttgaactgctctccacgcctcactttgaacatttgcttcaagatccacatgcaaactatgttgttcaatcagctcttcgacattctgagggtcatttacacaatttactagttgaagcaattgagtcccacaaagccgtttctcgaaacagcccgtattccaagaagattttctcgcagaagcttttgaagaaatga

SEQ ID NO: 39334 - DNA, 300 bp, Glycine max
  Peptide Sequence Number=SeqID_156112
atggatgtgaaaacaacctttcttaatggtgatttagaggagcaggtttatatgaaacaatctaaaggcttctcctctagtagtgccaatgatcaagttttgctacataaggtgaaacaatttctctccaagaattttgacgtgaaggatatgggtgatgcatcttatgttatcggcattaagattcatagagattgtagaagcaagcttcatgatgatgaatcaagtagttttgatgatgacaaaaagcccaaaagaatgatgtcaagattgagtcaacaagttcaagatcaagattga

SEQ ID NO: 39335 - DNA, 564 bp, Glycine max
  Peptide Sequence Number=SeqID_156113
atgaccgcatcatatgattattgcagaaaaataagctttaggggatacaagtgtagcaatagaattagactttcactaattgagtatgatcctaagtggataaatttgtccataagcacttataggagaagaaaaataagaatgtcaaacgaattgagctcctcgcataatcgaaaatcaacttatgcacttagcttttatagaagctcttttcatttaacttctccaaaagctaagctcggaaaagaagagaaagagcatgacggcggcggaaacgacggtgacaacgccgccggcgagcgtgcggttgtaaaaatcttcattgacttttgggtaagcgtccaaattgcggagcttgttgaagactttatccatcacgggcggtcgccgaagcctttgggagaatatgaagcggtgaacggcgttccgtcgtcgacggtggccggagaatggcgcgtgggggaaggaatgggttggttgaagaatgaagaaagacccaaacaaacacgggatcatatgaatgaccccttcttcaaggtcaaatcagtccaacatgccgtctag

SEQ ID NO: 39336 - DNA, 222 bp, Glycine max
  Peptide Sequence Number=SeqID_156114
atggatattagtggcgagcagcatcttgacatacgacataatatagtgaagaaaagaattgatgctaatggtaatgtgatagaagagaggaaggatggaattggtgcaccaaagattgagagacccttacagaaacatggtggcagacttggacatgatgaaaagtattgtggttcatgttttggtgcagaagaggtacctttgaccatttactacacttaa

SEQ ID NO: 39337 - DNA, 309 bp, Glycine max
  Peptide Sequence Number=SeqID_156115
atgtctatgctttctctatcgcttgttctcatgcagtcagatgaacactgttgtaattcttgtgaagaagtgcgtgaagcatataggaaaaagggctgggcaatgacaaatatggatttgattgatcagtgtcaaagagagggttatgtgcaaagggtaaaggatgaagaaggtgaaggatgcaatcttcaaggatctcttgaagttaataaagtagcaggaaattttcattttgcaactgggaaaagctttcttcagtctgctatatttctggctgatctgcttgctctacaggataatcattataat

SEQ ID NO: 39338 - DNA, 201 bp, Glycine max
  Peptide Sequence Number=SeqID_156116
gcgtggaagctttgtgcctttgtgtgtgagagcatcagaatactcatagggatatggaatgccacgggaaggcttgggaaggttggcgcgaccaagtgtgggaacaaaaccgcaatgaaggaagggttgggaaggggatgtgagaaggaagaaggattgggaatgatggatgagtttggaaattactgcaaaataagttaa

SEQ ID NO: 39339 - DNA, 441 bp, Glycine max
  Peptide Sequence Number=SeqID_156117
atgtctggatgccaagatgaacctttaactcagctactgcaaatgaatgtgttcttcacattctctcaacatatagggctgaaacaaggggtaaagtgggtgcaaggacctgctcatggcatgtaccagtatttcataaaggtggtccctacaatatacacagacattagaggccgtgttatccattcaaatcagtattctgtgactgagcatttcaagagttcagagctgggtgttgcagttcctggagttttcttcttttatgacatatctccaatcaaggtcaactttaaagaggaacatattccatttttacatttcctgaccaatatttgtgcaattattggaggtgtatttactgttgcgggaataatagattcatcgatatattatggtcagagaacaatcaagaggaagatggagcttggaaaatttacatga

SEQ ID NO: 39340 - DNA, 920 bp, Glycine max
  Peptide Sequence Number=SeqID_156118
caggtgaagttaatgaggctaataaggctaatgaggctaatgaggctaatgaggctaatgaggctaatgaggctaatgaggctaatgaggctaatgaggctaatgaggctaatgaggctaatgaggctaatgaggctaatgaggctaatgaggctaatgaggctaatgaggcagttctttcacaaagcgctctgaagtcaatagacaaaggaaaaaagaggcgttatatcaacgcaattgatagtgttctgattgccctgctcttaataggttgtattatcgcattagtgaaacagcagcagaatcttgccatcaatgtccaaccagccgatattgaacctttgttccgtatcaaaaagtgtaatatcttcaccattgaagattacgatatctaccctaaagaaaaaactattaaactcgcattgaatgagatagaaaagaaaaaaatcaactgtaataacatctcttatgacctttactttgccaagatgttactcaacaaggaaaactcccttttttcgttcttagctgtacgctgccaggtagatactgtcgttactgatatgctaaatggcagggatatgctttcctatgaaatgagaatgaattacatatttaatgctcaaaaggagagtgtggttaacatgaccgggtatgtcatccacaataacaacagatatcgctatctgagaacactacatttcatgctcgatctttctgatagtaaggatatctacaatataagatacaccttagaacaaatacatcccagtgataacacacctaaagacatcagctatcttttgatgagctcacaatttgatggttccaacagctatatccgaattaacaaaatcaagggaaatacctacttgattaacggaatatctcaacccatagcgctttgctatcggtattaa

SEQ ID NO: 39341 - DNA, 372 bp, Glycine max
  Peptide Sequence Number=SeqID_156119
atgtctagcatacaaaaatggcttcagcaccgcagaaattccaataagataattcagtcacttgaggccaaaagtactgctcttgaaagtaaggtattgaggacaatgattggcgcaagaaagaagccgaatggcacaagagagaagcttcattgcatcttcaagttgagaagcttacacaggagccacgacgctggaattccttcattgagcattgatgcatttaatgagacactgggtagagctgagcatatgagttttgatcagaggattgctatgatgaagaaactatcagtggccttctgccgtgtttggagtggagtagtttcgatgaaactaaaaaagatgttggagcaactatcattggagtag

SEQ ID NO: 39342 - DNA, 452 bp, Glycine max
  Peptide Sequence Number=SeqID_156120
atggcgaacatcacatctgctgcaatcgcaaacccctttacttaccctattttaccaccaccattagttcatagtttggccttggagatgctattagatatgcggagcaggcaatccatgttcaattttgaattgcagttcactttaaaccaaacttcagggaggtttagtgattttaaaaagaaaagtttagatagaaaacgtttgatcttgaatggtgctgctcatgtttttgatatggacatttcgaatcaaattttattaattgctcaaaagcgagaggcagtaggtggaatgcccttgctaactaaaatgagcttgatgtctccatttgagatgcaaggcatgttactgccgtctggcacaagtggtgttaaagacctatatatttctccttctcatagtagcttggccctctttgcttctctagggaagaaattatcagtgctcag

SEQ ID NO: 39343 - DNA, 468 bp, Glycine max
  Peptide Sequence Number=SeqID_156121
atgggttgcatgtgttgcaagccctctgccattgaagatagtaaggagagtccaagggagcgtttatcgagcaaggctgtgtcagacttgcgtgtatctagaggggcttcatcgaggagggaggaagcgtttcgggtaaaggatagatatgataacaatgatggaagaactgcattgattgataagcaagggaatggttctgttagagtgcaaggtgagagttttgaaaggaagagggagaaaatggaatatgctgttgctcaacatccagggattggtagtgttcctaaggccatggaaggtgagcaggttgcagctggatggccctcatggctggcagcagtggctggagaggctatcaagggatggctgccacggcgtgcagattcttttgagaagttggataaaatactttgctttatctaccttgcttgcttattgtttttgcaattgtctgtagagtattga

SEQ ID NO: 39344 - DNA, 627 bp, Glycine max
  Peptide Sequence Number=SeqID_156122
atggcgtgtacgttcagttctccagccagtggtccttttcgtgatgatgctccaagttggtgtcgttctccttttgaacccgaaggcttgttgagttctatatcagctatcctctctggcactatcggcatccattatgggcacatcttgattcacttcaagggtcattcggagagactaaaacaatgggtcttaatgggatttgtgttactcataatagccatcatccttcacttcacagatgctttaccaattaacaagcaactctatagcttcagctatgtttgtttcacagctggggcagctggaattgtcttctctgggttatacatactgatagatgtttgggggctccgcactccattcttgttcttggagtggataggaatgaatgctatgctagtgtttgtgatggcagccgagggcatctttgcagcatttgtaaatggatggtattgtgaaaatccacgtaactcactagtacactggatcaagaagcatgtgtttgtcaatgtttggcactcagagagggtgggtaccatcttatatgtcatctttgcagaaatcactttctggagtgtggttgctggcgtcttacacaaattagggatatattggaaactgtaa

SEQ ID NO: 39345 - DNA, 267 bp, Glycine max
  Peptide Sequence Number=SeqID_156123
atggataggtgtccagaagccaacgtagtgggtctaagcttggtgatttcaacagtgttaccaggagacccgtttttgcacttgaagcagaatgaacagagtgttctgtcgatggaggctagccggaaatggaatatcatatggaataggcaaagaccttttaacgttgatggaatcctgcaagatgttatcttcgtggcttgggtatggcagaaatttgatgggtctgctagcatggatgatatgtttacatgcaataatacttga

SEQ ID NO: 39346 - DNA, 303 bp, Glycine max
  Peptide Sequence Number=SeqID_156124
atggtgcgttattgcgatattgcccgcgcgccagcgcgggctaggaggcgttatttcttggccggtactgagttgagcacatcgatcagctgtttgataatatcgtttttcaggccggcgtcgctggcgaggatatgggccagtgccttttccaccaaggatagcagctgttgccgattcggccggatttctatggcgtcaaccgcggtgcagcatcatcgacgcgctgcgccgcgggctgaactgccagtacagcgccagcagcgtagcgaagcccactgcccccagcagcaaccagggtag

SEQ ID NO: 39347 - DNA, 321 bp, Glycine max
  Peptide Sequence Number=SeqID_156125
atgattgattcaagacttcaagatcaagcatcaagaatccaatccaagattcaagattcaagagaagaaatcaagaagccacaagtcaagacttcatatgggataaggattcaagggactaaccgcctaagaattctttgtcttaacacattggagcatacatactttgtggtacaagtagagcatacatctacttgggttgttatattgagaacaagagaggatacatctcttgtggatcagttcaagtggagcgtacatccacttggttgttcaaagagaacaagggagggtacatcccttttggatctttgcttgtaa

SEQ ID NO: 39348 - DNA, 522 bp, Glycine max
  Peptide Sequence Number=SeqID_156126
atggaagatggttcaaaagcattgtatttcgattggattgatcttgcttacttcgatatacacctgttacaacgtgaaggcgccatcaatgactattcggacccgatcttaaaagcggttgataaaaaaaagaaaagcataacagcggaagagcgtaaagtattgtctgaaaatattttaatgggaataccaggagaaaagaacattactctggaaagcctcagaaagagtatagacgtctataaaaatatcggaactgaaggattgcgggccaatttaaaacatttcttagaatctatcgcttctgtttgccggaaagagaaaataaaaatgaccattcatcctgatgatcctccttatcctattctgggattgccaagaattttaagtcataaagaagactttgagtatctgttaaacaccataaatgatgagttcaatggtgtttgtttctgtaccgggtctttaggagccggtatccataataatattcctgagatctttgatttggtaaaagaccgg

SEQ ID NO: 39349 - DNA, 462 bp, Glycine max
  Peptide Sequence Number=SeqID_156127
atgcccgcctggtccaagcttcacttctgccaattcgccgccgcctgggccggcggcgcctcccactgcccctgccgcaacgagctcgaccgcgatggcgaaatcgttggcgaaatcaacgatttcgccaacacgttcgagattcgtgatgatacggaagggaaaggggagaggattcccttgccgtgggagattctgcagccttcgctcagaatcctggggcactgtctattgggaccgttgaactctcaggatgtgaaggacgccgcttccttcgcggtgcggtgcttgtacgcccgcgcttcgcacgatttggtgccgcaggcgatactcgcgacgaggagtctcattcagcttgatgtgaggactcgagaggctgccaagacgaatgccgccactaactcgaacgccaacacccccaccaaggccaagaagccggagattcttctggtttccaagtga

SEQ ID NO: 39350 - DNA, 303 bp, Glycine max
  Peptide Sequence Number=SeqID_156128
atgaggcatgtaaagcatgaaggacatgcacaaactgtgggatcaaagcataaggaacaccttaatagtactggagaccttgctcgtacttataaatgcaaaaatgacaacttcatgcagcatacgcaaggatcttcctgtcgcactgaagatgctgcagagattaaccgaccgagggaggagttgcatcaatcaaagaaggatatgcatgtttttctgtcagttgtccttcagttactacctcctgaagcacataatattattcatcaacaacaacaacctcaccaacaacatcaagactag

SEQ ID NO: 39351 - DNA, 431 bp, Glycine max
  Peptide Sequence Number=SeqID_156129
gttaccctgcgtttccaacatcattggatatcaataagattcgtgacattctgccgcacaggtttccatttcttctagtggatagagtgattgagcacaatcctggagtttctgcagtggccataaagaatgtgacaataaatgacaacttttttcctgggcattttccagaaagaccaatcatgcctggtgttctcatggcaatcgcacaagttggtggcttggttatgttgcagcctgaagttggaggttctcgtgagaatttcttctttgctggaatagacaaagtgcgatttaggaagccagtgattgcaggagacactttagttatgagaatgacacttatcaaactgcaaaagcgatatggaatagcaaaaatggaaggaaaggcatatgttggaggtgaagttgtgtgtgacggtgagttttga

SEQ ID NO: 39352 - DNA, 645 bp, Glycine max
  Peptide Sequence Number=SeqID_156130
atggctccgagaaatctccccgtcaagaggtccaggaaagacaccgctagagagggttccaatgcggccccacaggcagatgtggattacgatagacacaggcgagtgcagctgagggacgaagagtatgttgagttccaaaaggagatagcccggaggcattgggcccaactcgtatcacccatggctaagttcgatcctgagatagtcagggatttttatgctattgcctggcctacagaagaaggagttagagacatgcgctcttgggtgaggggccaatggattcccttcgacggggatgccatcaaccagtttctggggcatccactgatcttggaggaaggccagcaagactttgcctggactgcaactgggagacgggtgagtgtacatgttgctcagctgatctctaatgctatctaccagtttgcagggattactcctccaagacacccagtggacccgaaaaagtccaacagggccctgggatttcctgctctaattataggtgatgtaagctccattggagcttgtaggcctaggatcttcttcatcaatggattcctttgcttcttggaagatgaatggcagtggaatggagaaggaagagagagaggagacgccacatcaaggagaagatga

SEQ ID NO: 39353 - DNA, 432 bp, Glycine max
  Peptide Sequence Number=SeqID_156131
atggtcaatttaggggcattcttcagcccctgggcccacctgggcccattaggaaacttcaaggaagttttccctaaaattagggagaagaaggacaaagtagaagaaaaatcaaggccgaggcgctttcgtaatgtttccgtgatcaatttcgtgaccattcttcatcgttcttcgatctttgatcggggtccatccttcctttgcatgtcttctgtagaagcaaagcttcatggtgaatcaaaggtgattcaaagaacaattcaagagttcaagataagaatcaagaagaattcaagactcaagaagaaagttaagagtcaagaatcaagattcaaggttcaagatctcaacaatcaagatcaagattcaagactcaagattcaagaatcaagagtacatgatttttctcaaaaattgagtagcacatga

SEQ ID NO: 39354 - DNA, 237 bp, Glycine max
  Peptide Sequence Number=SeqID_156132
atgtctttcgaacgagactattgccgtctccctttaccatctagagacaagcaagtccaatggcatgcagggacaaatcatggtcttccgcctttcgttattttcaaacttattgcagttccctttgccatccaaagacaagcaagtttcgctgattgggctagtggtcagtcaggcggagagatcactcgaacgaaattagtgtctttatctttacttcccttttatctccaataa

SEQ ID NO: 39355 - DNA, 243 bp, Glycine max
  Peptide Sequence Number=SeqID_156133
atggcactatactttcctaccttttttctgcacttcccaattttttttaatattcctaaagaccttcacacacctcctttcctattctgcaacttatgctcatctccacaactagcatcgtcctctgtttatcctctccgcgcagaagaatttgttgaagaagaagtcatctccacaaacactggggtttccgttaatctctgctcagttccggtgaaggtgggtggcgttgggttgaggtag

SEQ ID NO: 39356 - DNA, 306 bp, Glycine max
  Peptide Sequence Number=SeqID_156134
atggcaaccatggctgaagaagagaaggatgagaggatagtggatggagataaacaacagctggtaactaaactagcatctgaaccagaggacaatttttgtgaacttgaggagatagaaaatgaagaggatgaccaggagaatgaaaatacaataagcaagaatgagaatgaaataaatgatgggaaaaagaaagaaaaagaaaaagaagaagaaaaagaaaaagaaaaccatgaaaaaaatgaaaaaaaaaaagatgaaaagaaaaagagtaagagtaagcagtctagagaaaagaagaaagag

SEQ ID NO: 39357 - DNA, 267 bp, Glycine max
  Peptide Sequence Number=SeqID_156135
atggaagctgctaaggaaggacctcactactctggcgcagacttggagcggacccgcaaggccagggctagaggatctgagggtccattttttgttgctccccagacatctactacaccagctcctattccttcagcaccagttcctgctacttccggtccctctgtgctccccagagcattcactaggtggcctgaccaggagtccagccttcttctcatggaggaggtgagtgatgcaatcctaccccccaagggaattggatag

SEQ ID NO: 39358 - DNA, 192 bp, Glycine max
  Peptide Sequence Number=SeqID_156136
ggtgcccgttccccccggcaaggtcacatcatcatagggatcgcgcctgcaagacacccagtggtcccgaagaagtctaacaggttctacggagtacctgtcacctccagcaagggcatcaggccccctactaatcgagctttcatcaagaagtactgcgtctccaggcaggcgcagggcgaaacaccatag

SEQ ID NO: 39359 - DNA, 117 bp, Glycine max
  Peptide Sequence Number=SeqID_156137
atgtgtggccagtcttggcgtgtgaattgtaattctgtccttattgtgtcatttggctgggcacgtattcttgacggatcttctgtgccgcaagagattgtcaaggatcaagaataa

SEQ ID NO: 39360 - DNA, 240 bp, Glycine max
  Peptide Sequence Number=SeqID_156138
atgatgaaatattacatgatagaggaagacagaagtggtgttaagcatagtcagtggaatattgtggagcctttgttatgcagaatgataaaagaggcattccagaattcttctactattggtgagttgaatgagacgctaatcactgttatattggagaacttaaggcctattaacccttgtaacgtgtcttcttataaagccattactaaacaaggtgttgatggatcaagttgttag

SEQ ID NO: 39361 - DNA, 258 bp, Glycine max
  Peptide Sequence Number=SeqID_156139
atgcgggacccgatggtgcgtcttccaaggaaggaaaaatgcgcggagtcgccaccaacgtttattcgaggaaaacatcagaaaaaccaaaatgggaaaggtcgaaggtctgcgtattttgaaaatgagggttcgagagttgtttatgcatggggaaggagagaatcgttaaggcgttggaccttgaaacgacctctgatttttggaaggagagaatcattaaggcgttggacctttgaacgatctcttgagttttga

SEQ ID NO: 39362 - DNA, 303 bp, Glycine max
  Peptide Sequence Number=SeqID_156140
atgcgcggagtcaccaccaacgtttattcgaggaaaacgtcggaaaaaccagaaaggtgtggtctacgaactttaagtgtgaaaggttcaggagttgtatttatgcacggggaagatcgggctgcacaatgcgcaaggcaagataaaatgtcaaatgaagaagtgaagttgcaggatccacgatgtcggatacaatgtcctgacatcctgcccgagaatactggagttgctgtacaatgcaagataaaagtcaagtgcagaagtgaagctgcaggatccacgatgtcggacacgatgtcctga

SEQ ID NO: 39363 - DNA, 504 bp, Glycine max
  Peptide Sequence Number=SeqID_156141
accggtccgtggcgccgtccggcaaccacgttccatcgccgtatcgacgagaatatcgctccggaatccggttgcaaggcggtgcgatatgcgagtgttggtagtgggggcaggcatggccggcctggccttggcgcagaagctcaaggcggcgggcatcgatgtggcggtgttcgaacgtggtggggcgatggcggacagcctggcgggctatggaatcctgatcgatggcaatggacaacgcgcgttgcggcattgtttgccggccgcggcgctcgatgcgttcgaacggaccgcgggccgtgcgggaaccggggtgtatttcctggaccagatggcgcgtcggctgacggctttcaaatgcagcgcgccggggcaggtggcgcgccgttccatcgagcgcctggccttgcggcgcatcctgtctaccgtcctggatgctcctggcggtcccgatacagtgagggtccacgttcacccattacaagaggatgggggacgtga

SEQ ID NO: 39364 - DNA, 431 bp, Glycine max
  Peptide Sequence Number=SeqID_156142
ctgtgcttccttccacatctgtagctcctactccatcatccacttcagcagctccttcagtcccagctcagagtgattctcaacactttgaagccatgcttcagagcattcatcagggacaaattattttacttcagagtttacaggtggtggcgcctctaggatccattccttccgttgagcagtttctggatagggatgcgtcatctgaggccaccattctagagccattcatggtagaggaggaggtaggtgagacacaggttggacaggaagctgctgctactcctgagaggtcacgagagatcacatcagatccaccaacaccagtggacccgacgacaccaatcctgaatctgaacacttttcctccagctactccagtacttcatctgacagacgaggagggtggtcagacacaggatacttag

SEQ ID NO: 39365 - DNA, 739 bp, Glycine max
  Peptide Sequence Number=SeqID_156143
cctattatcaggagaagatagacaagcttgtttccgataagcaacttcctaaacctccttacaatgataatctatacctcacaactcctttctcttctccggatcccggtatgacctatccattacctttaataggaattaaaagctcttctccagcatcagctgatgtacaacctggcaaccaacttgcctctaaattaaaatactgtaattacgatagtaaaaatggtgaggttaccgacgttagagatggtaaaaaatatgcctataagcgttatgggaataccgattggtttatggagaatctcaattggaatggctatgatggaaataatgcagcaaccaataatacggtgggggtagcagttccaggagattctgaaggaaaagtatatggaagatactaccctaccaatgctttcaatgcatcaaaaagctggtgtcctaacggatgggatgttgccaatacccaggactggaaaaatctgttcaccagtattaagcaagaatacaatacaactgatgaccaacttgctcccatgatgaaatgtggagaagaccgggatcgtgtaagtgatggactttgggcaaaaggaccaatgacaattcagaatgccaatgccaatacagtaggcttcaatgctcttcctgccggtgtttataataatgatcaacaatcttacgatggcggagatcagatgggaatgaaagccagtttcatagacgaatcgtcaacctg

SEQ ID NO: 39366 - DNA, 1522 bp, Glycine max
  Peptide Sequence Number=SeqID_156144
atgttgttaggcctgggtttactcagcgctattggtgcagcggcaggcatcatttatcacaatcacaaaaaagatcacggtaagtcaggtgagggtgaaggcgggaatctgcctgatccggtattcacgcgaggcgcaaccattgatgcggtgacggataacgtgggcgccattcagggaccgctggccagcggcgactataccgatgacgcgacgccaactctgagcggcaccggcaccaatcctggtaatactgttgagatctgggataacggcacaaaaattggtgaagccattgtcgatcaggatggtaactggacatttacgccaggcacggcgctggctgaaggcgaccatagcttcacggtgattgaacgcgacggtaagggtaacaccagccagccttccgaaccgtttgagctaattatcgatctcaaagcgccagcacaggctacgctggacagcgtattcgacgatcacggttcgctcaccgggttgattggcaacggcgaggccaccgatgacaatacgccgaccctctccggcaaagcggaaccgtacagtaccgtatcgatctacgacaacggtgaaaaaatcggtgaagcactgactgatgccaacggcaactggaccttcacccctgcaacggcactggctgatggtgagcacgcattcaccgtggtagctgccgaccgtgctggtaatatcggcctgccctctgctcctcacatcatcactattgatacgcaggcaccggtaaatccgggcattggtgaagtcactgacaacgtgggtagcattgtcggaccggtagacaacggcggcagcaccgacgacaggactcctaccatcggcggcggcggcacgcctggcgacgtggtaaccattattgatgacggcaagccgattggcagcactgtcgtgggtgatgacggcaagtgggagtttacgccggaacaacccctggaagatggtgagcacaacatcggtatcatcatcaccgatccggtcggcaacgagtctgcaccttcagatgattacaccattattgtcgatacccaggcaccggataagccgcgcattgttgcggttatcgacaatcagggtgaacagcagggtgaactgcagccgggcgatacgaccgatgatgcgctcccgaccataaaaggcgaggctgaagctggcagcattgttaacctgtatgacaatggcgtgctgattggctccgcgcgtgcagacgccgcaggcaactgggaatttactccgaacaaaccgttcagcaatggcggacactctctcacggcagaagcaactgacgcggcgggtaacgtcagcgaaacgtctgacagctttgatttcaccctgatcaccggtggtgtgccaagcgcgccggcgattattggtgtgctggacgatgtgggtgatattcagggcaacgtcgcgaaaaacggtgtcaccgatgacacccgcccaaccgtgcatggcacggcgcagccaggctataccgtttccgtttatgacg

SEQ ID NO: 39367 - DNA, 432 bp, Glycine max
  Peptide Sequence Number=SeqID_156145
atgtcaggatgttggtctggttcagggatcaaagggaatgtcccacattatttccatgacacaaatgcaacaatgatgattaggaaattttatgcaaaactagtcatgcatgcacctatgtggacactcaagtgtcgaaatttttttggtcgtgcggacgagggtgcacactacctacttacgtctaaccacaaggtgaacgagaaacacacgaaaatgagatgcagcggaagacaaaggagaagaggtgagaggaggcgccatccactagggaataagccatggaagaaggagcttcaccaccaagatgagccttggataagaagcttggagagaaggctccaatggaggaaaagaaagagggagagaaagagagaggggggagcacgaaatttaaggaagaaaaagggagagaagttgaactttgagtaa

SEQ ID NO: 39368 - DNA, 196 bp, Glycine max
  Peptide Sequence Number=SeqID_156146
gcatgaattcagacttaagcatgatgattggatgaacacggtaaaacctaatcttcatcctggtgtttcagcacaattgcatgaaaaatttgaggtatttgatgtagagattgaaaactctaaatctgttagaagtgagatgcgtgctgttataaattcgcttttgaaggcacatgcacaagaaatttcagagtaa

SEQ ID NO: 39369 - DNA, 1152 bp, Glycine max
  Peptide Sequence Number=SeqID_156147
atggttggtgggggttgctggaggcaaaagagacatagcagaatagttgctagacaggtcatggaggatgataccgccgttgaaagggtttactcttctaggcatggacatagctcaagtccaaatccagtgagagaaaattctgcaagagtctctcaccattcaaggaagtatgatgacagggaacacgaccaacagtatggaagaaatcactatggcagaagcagtgactctcttagacattctgatagacagtcattcaaaagttcctttggtcactctcggtatgacaagtatgcaaatgaagatagatatcgggagaggctgttgtctcgttctggacatgagtcaagggatgatcatgtgagagaagagagtgatagcaggccaaaaaactaccagtgcagtgtggacaagtattcacatgacaaatatgacaggtctgatcatagaagcaaagaaaaacgtagagatacatactcggagcatcagaaatataaagatatggattcttcatatgaaaaatctgcatctagcaagaggcatgcactgtatgatgaagtggagagggaggggcattcaagggactgggatggtcaaaatgaaagaagagattcccgccgaagttcaggggactacagaagtgaccaaagagatgagtcaggtccacaaagagacagtggtaaatttagtttaaaagaagcttataagagtgaacagaaggagtcaaatgatcaaaaccttccatgggaagaaaaaagaaaacatgatgacactgagattaggaagggcaaagactggaaaactagaaaagcaggcgagcagtgtgctattgaagacaaagaatcttctggaaagaaactaaagttgtttgatcctgacaaggatgacaattatagaaaagatggtattgcttacatattttttgtactgatggttgatatgatttgtaccattattggcgattattgcattacttcattttcatgtactgaagcagatgaaagtaagacttcaagttcaaacctttctcacaagagcaaggaagatttatgggctgtcaagtccagtggctttgatggtgacaatgatctagatgcggcgaaaattgcagccatgagagctgctgaattgggtatacacttatcctga

SEQ ID NO: 39370 - DNA, 216 bp, Glycine max
  Peptide Sequence Number=SeqID_156148
gtccaggaggtgacggtgaggctgccgggaccggaagggacagctcccgacgccggtacggcggcgcgtgagcagcacgcgccggaaatcgcgcggaggaaaggcggagcgtgtgggcgcgtgcggcggcctacggctgcacgagttccaggggtggatcgcgcttttcgaggcgatccgaaccctggtctcgccggagaaaaccgccggagttga

SEQ ID NO: 39371 - DNA, 234 bp, Glycine max
  Peptide Sequence Number=SeqID_156149
atgggggatgcaaatagtttctgggcaatttcttgcttacggttgaagcaacctagctcgcctgggccttccagaatagcaatttcgaaattttggattgggccttccagaatgtttttttggagctgggttgctccaggaagcaacccagctcgcctgggcgagcagggcggcaatctcctccccctttttcctataaataggctgaagggggctgttctaaggatcccttag

SEQ ID NO: 39372 - DNA, 183 bp, Glycine max
  Peptide Sequence Number=SeqID_156150
atgcaggcacaaagacctgccaaaaacaaaaggcaacacttgaaacaggctcagagaagaacgacgaagctgccggaacaagttgggcgagcttccgacgtcgggacggcggcgcggttgggtcgcgcgttccagggcggttcgaaccctagattcgccggagagaatgacggccagaagtga

SEQ ID NO: 39373 - DNA, 216 bp, Glycine max
  Peptide Sequence Number=SeqID_156151
atgacactcagttctgtctcaaatagcaatgccacttttccggttggaagccatttttactggcccagatcagcattttatgcagcatatttgtgtagttcctgcagggatgcaaggaaaaagatggcagtggtggtgggtggtgatggtagtgatgatgatgatgatgatgatgatggtgatggtgtgatagaattagctaatgaaagaatgtaa

SEQ ID NO: 39374 - DNA, 645 bp, Glycine max
  Peptide Sequence Number=SeqID_156152
atgagactatatcaaatagacgtaaaaagtgcattcctcaatggagcaatacaagaagtagtccatgtagaacaaccccatgggtttgagggtaacacttttccacaccatgtttttaaacttaataaagctttgtatggacttaagcaagctcttagagcttggtatgaatgtatcagttcatttcttttaagcaatggatttgaaagaggaaaaagggatacaactctgttctacaagaactatgactcccaatttatattagttcaaatttatgtggacgacattatatttggtgctactaatgaactttgtgaggatttttctaagctaatgcaggctgaattcaaaataagtatgatgggggagctgaagttcttcttaggactacatataaaacaaacaaacaatgcaatctatatccatcaaaccatgtatgttaaggaacttctcaagaagttcaaactggaagatgcaagagaaatgaagactcatatgcatccaacggcatgtcttggattggatgaggaatccaacaaagtagacaactcacaatacacagcaatgaggaatccagacttgacatactgttcagtgttggactatttgccagattccaacaagacccaaggaaagttcacttaa

SEQ ID NO: 39375 - DNA, 549 bp, Glycine max
  Peptide Sequence Number=SeqID_156153
atggcttccaataggttgttcataagagaccatttcaaactcgcggtgaacccttcaagttgttcgataagggagtggtgtggtgccccgcattacgaggcgacgtggctagtgtgtttaacggttcacctagtcatgttcgaaagggcacaagggagtagacatacaaaatctttaacgaaagagagaaacactgatgattacgaaggcatatcgcaaagcttgccaatgagagagacaaacaatggagatggtggcaacatctctgccatggtggaggcatttttttcaagcgacatggatcaatttagaaaatacaattcaaagctctgctgctggttttgtcctagattgatccagttgatcatggttcttttcaatttatatcacggctggtgggtggtagaggcaatgcggcgaaaattctttgatatgtacaatgttagacgaggccctggatgtatagtgttgatgacatgctacctcattatacaaatttatatgtacaatgtgatacgcacagttgaattggtgaaaccaacaaattaa

SEQ ID NO: 39376 - DNA, 351 bp, Glycine max
  Peptide Sequence Number=SeqID_156154
atggtggtcggaacacagagcagcaacggcgccggaacgaacggtggccagaacgcagagcagcaatggtgcaggaacagtggacgcagagcagctagggctttcgcgcaacaatggagccctaaatcgttcaaaacaaaggaagtgctgattgggctctatgctaaagaagatccagaaaggagaagcataggaatccaatcggtgttcgatagcggtgagctgagaggggaattcgagaaaaatggaattgaccctaaattcattcaaatcacatggaaggatcttgtttctgccgattcgaagcaacaaaaggaagatgaagattgggaaaagtgtgaattggattaa

SEQ ID NO: 39377 - DNA, 939 bp, Glycine max
  Peptide Sequence Number=SeqID_156155
atggcaacatcaacttatcttgagttagatgagaaagataaatcagttgatgagtcaaggtatcaggctaatcctaagaaaactcacttaacaactgttaaaaggatcattaagtaccttaaaggcacaaccaatgttggtttgtggtatcccaaagatcatatatcaaagggtgattgttgcattgagtttattgatagtgagcatcaactagctgacatcttcactaaacctcttgctagagataggttcttcttcattaggaatgaactagggtttgactttcctaatctgctggaagcacaaggattatcaaagctggtgcacatgaaaggaaccttttatccgaagctagtcaagattatctacacttgtgcacgtgttgaccttgaagtccgcaagtttgatgaaacaaatgatgggtacaacaagatgaagacctataggggaatgcttcttgacccagcaagaaacttgaggaatcactcaggagttgatggactaactgtagaggacagaatgttagtttacctcatcacctacattctcactccgagattcattgactacttcaacgttgatgtctctaatgagattgtggattttaccaaagcatctagtgagattatcaaaaggcatctcaagaagcttggaataagttttgttgatcatgaatggataatggctagagtgccaacaattggaaacttggaacagatggatgaagatgctgaagctgaaggtccacaagagcttgcacatcaatggagtccttttgaatctcttatgattcagaagatggacgctatgcttcacctccatcaagagcacttaactgaagttcatagttcgctggagaacataactacccaactggaaaacatagaaactaggctgacccttagtaacctccttaaccctgatgaggatgaagcttag

SEQ ID NO: 39378 - DNA, 390 bp, Glycine max
  Peptide Sequence Number=SeqID_156156
atggatacaaagacgaccactaagactagaaaatgtgattgtccctttaggttgagaggaagaccactaaagaatagtgaaggatgggtagttagggtgttgtgtgggtcttataatcatgatgttactgagacattggtcgaacatccatatgttggtcgactaacgactaatgagaagacaatgtttgttgatatgacaaagagtaaggtcaaaactaaaggttcacaaaaggaccatttcatccacatgaagggtacatcatccccaacaaccagtgtgcaagagaaagattttcatgttagaccaattccatttgaagctttacttggtatgggtgaagattcttggcctctagtctgtaatgatttgcataaagagttgggataa

SEQ ID NO: 39379 - DNA, 615 bp, Glycine max
  Peptide Sequence Number=SeqID_156157
atggataagagcttgaaggtaggagaagatgagtggagggagaaggagataaggagcacgaaattttatgcctcaaatgagttgaaaaaatacacacacaaggcctctatttatagcctaaatgtcaaacaatgggtcaccatttcaaaacttcaaacaagattcacccacattgtgaatcaccttcttggtctgggaaaaatgtttgaagatgatgagttgaacatcaaaatccttaactgtcttacaagaacatgggaaccaaagatcacagcgattaagaaatctaacgacttagcatcaatgtcgatggaagctctcttcggaaaattgcttgcatatgaacatgaatccaaagacagaaaattctctaaacattcaaagaagatagagagcaacaacaacaacaccttcacatgctttgaatgcggaaagcaaggtcacatcaaatctgaatgtcttatctaccttagaaagcaacttgctgaaaaaaaaggaaagaaggacaaaaaacagaaagctcgagaagacaatgcatccacgccctctaactcttctagtgaagaagaagttgcaaatgtgtgcttgatggcagactcaatggtgaagttttag

SEQ ID NO: 39380 - DNA, 252 bp, Glycine max
  Peptide Sequence Number=SeqID_156158
atggcgccaagcacaacaattgagggagccaagagggatgagaactattcactaccgagaggcctaaagagtgtgaatttcagagagcatagagcagagcaaggggccaagttttcatcttttagggagattagtgagtttttgagtgattgtgagagtcctagaggtggaggagacatcgccactcctttggactttagcattgggaaatgtactgtttccttagaacttgatagagcagggactaaataa

SEQ ID NO: 39381 - DNA, 432 bp, Glycine max
  Peptide Sequence Number=SeqID_156159
atggattacaaaaatactcatgttactgctgctgtacgtggtacgcttggccatatagcaccagagtatctcgcgactggaaagtcttcagaaaagacagttgtttttggatatggtgtgatgcttcttgaactaataactggacaaagggcttttaatttaacacggcttgccattaatgatgaagtcatgtttcttgaatgggtaggtgaaaatactagtgaaagacaagaagttgaagatactggtagctcccctttggaaagaccaacgatgtctgaggtggtgagaatgctagagggtgatggtttggcagaaaagtgggatcagtgggggaagaaagaggatatgatccaacaaaatttcagcccctttaatctctacactccttgtgactcaacttcaaatattcaactgtcaggtcctagatga

SEQ ID NO: 39382 - DNA, 1893 bp, Glycine max
  Peptide Sequence Number=SeqID_156160
atggccaacatggagcgagtgatttcagatttcatgtcttggtttcctctttgggcaattttggtgcttgacttgctgctcaaggtttctggcaacacagaaggtgatgctctgactgcattgaagaacagtgtgagtgatcctaacaatgttcttcaaagttgggattctacacttgtcgatccttgcacatggtttcatgttacttgcaacaatgaaaatagcgtgacccgtgttgatcttggaaatgcaaacctttccggtcaacttgttccacagcttggccaactcccaaatttgcaatacttctgtgctatcagttggaaagctactcatcgatcaattgctgtattgtctaggactaaagtagaacttattgcagcaacagaggtgcaagagattcacatgttcgataatccagcatattgcttggagttgtttattatatgcaaactaaatggatcttctccacgaaccaggcgtctgaacaataacagcttgtcaggaaagatccctgttcgtttgaccactgttgattcacttcaagttcttgatttatcgaacaacaacttaactggagacatcccaatcaatggttctttttcaagttttactcccatcagttttaggaataatccttcattgaataatacccttgtacctccaccggctgtcacaccgccacaaagttcttcaggtaatggtaaccgtgctattgtaatcattgctggaggagttgctgtgggtgctgcactgttgtttgcagctccagtaattgtacttgtttattggaaaagaaggaagccaagggactttttctttgatgttgcagctgaggaggatcctgaagttcaccttggtcagcttaaaaggttttcactgcgtgaactgcaagttgcaacagatacctttaataacaaaaacattcttggtaaaggtggatttggcaaggtttataaaggacgcttaacaaatggtgatcttgtagcagtaaaaagacttaaagaggaacgaactcagggtggggagatgcaatttcaaactgaagtggaaatgatcagcatggctgtccatcgaaatttgcttcgcctgcgtggtttctgtatgacacctactgaacgcttgcttgtgtatcctttcatgtctaatggaagtgtagcttcatgtttacgagatcgtccggaatcacaaccaccacttgaatggccaaaacggaagaatattgctctaggagctgctagggggcttgcttatttgcacgatcattgtgacccaaagattattcatcgtgatgtcaaagctgctaacatattgttagatgatgactttgaagcagttgtaggagattttggtttagcaaaacttatggattataaggatactcatgttactaccgcagtacgcggtacaattggccatatagcaccagagtacctctcaactggaaagtcttcagagaaaactgatgtttttggatatggtgtgatgcttcttgaactaataactggacagagggcttttgatttagcacgactcgccaatgatgatgatgtcatgttgcttgactgggtgaaagcacttctgaaagacaagaggttggagacactggtggatacagatttagagggaaaatatgaggaggcggaagtagaggagttaatccaagtggccttgctatgcacacaaagctcccctatggaaagaccaaagatgtctgaggtggtgagaatgctagatggtgaaggtttggcagaaaaatgggataaatggtggcagaaagaggatatgatccaaccaaacttcgacccctccaatctccacaatggttattggcggccattattagactcaacttcaaatattgcaccagatgaactgtcaggtcctagatga

SEQ ID NO: 39383 - DNA, 972 bp, Glycine max
  Peptide Sequence Number=SeqID_156161
atggctgaccacaattggcaatgggaaatgttggaagaaatgactgctttggatgctagcaacacatgggagttcgttctattgcctcccaacaaatccattattgggtgtcattgggtcgatacggtgaagatcacacctgatggcctaattgatcgctacaaaggtcgcttggtggctaagagctatactcaaatttttggtcttgattatggcgacactttttctattgtggccaaaatcacctctattcatcttttgctatggccgccattcgacattggcctcttcaccagttggacatcaaaaatgccttcctacatgcaatctcctcgtgcctggtttggtcgcttcaactccactctgattgagtttggtatgactcgttgtgaaactgatcacttggtattttctctccattcattgtctggcctgcgcatctatctagttgtatatgttgatgacattgtcatcaatagtgatgactctgatggcattctccgcctcaaccaattcttgaaggaaccatgtggttgtcgttggaatgttgtcatatgtatccttcgatatctcaagagtgcaccaagttgcagattaatatatgaagataaaggcaatgccaaaattgcctgctattctgatgctgattgggcaggatcaccattagataggaggtccacttctggatattgtgttctcattggaggaaacttgatctcatggaagaacaagaagcagaaagcagttgctagatctagtgttgaagctgagtatcgtgctatggcagtagctgcattcttccatgaacggactaaacacatagagattgattgtcactttgtgagagagaaggtgcttttggagaaatcatcaccgactttgtcagctctagtgaccaacttgcagacatgttcactaaatccctcaaaatccggaggatcacttcctgcaacacaacagggagcttgctga

SEQ ID NO: 39384 - DNA, 650 bp, Glycine max
  Peptide Sequence Number=SeqID_156162
atggtggaagaagtaggaaatgatgttggaggattagtgggtagcgttgccggtggtgtttgtgtccatcggtggtatacaagaggtagaggtggagtaggagcaaccaatggcgctagaacaacagatggaacctccagagggacatcgtcaacggtggaaggaaagaaaggagtagtctcaaagaatagtgagatcatgcacaaaacacatacttccaaagacacaaagaggaacaggatggaggcgttgatgaggattcaagatggaataaagaatctgattgttgagaaccaacgaaggcatgcggacttaacattagaaaaactgggaactaacagatgcaatctctccagactcgggtccccaaggcatagatgtgtgagagctggagatgcagatgagacacaggcaatcggaggtaaagatcaagagtacgggatgggtttgtccgatgccccagactttaatttgaaagccatctacgagagtaacagaaggcaaggtgtccaaaaaagtcaaggaagagaaaagagattggttaccagtcatatgatcaaaggcgtcagaatcaagaatccaaggtccaagggagcaggactacgaaacaaaggctacaggattaccaggctgagccatagtggtaacag

SEQ ID NO: 39385 - DNA, 483 bp, Glycine max
  Peptide Sequence Number=SeqID_156163
atgtctaacattttagcatgttatcaactcttggaactcaatgtcatatccgcacaagacttggctcagatggatcgttctatgcagacctatgcggttgcatggattgacccagatcacaaactctccactcgggttgattctcaggatattcacgtggacactgtccacatgctttcgggtgaccttttcccaccatcaacacaaccccaaaaaaaatacatacaaatccacggctatgcagtttatggggctccaagtccaaaaaggccctcgagttgccccaaaggaattttgaacattggtgcagctataattgacagctccatgaaaagcaagcctcttggatacaatcacgacaatctcattaagccaagccatccagtcatgctagagcttcaccacacaaagagcgactatagctcaatgctcagctcagaagccatagctcgcaaacaccaagccaaggctaaaaagggataa

SEQ ID NO: 39386 - DNA, 882 bp, Glycine max
  Peptide Sequence Number=SeqID_156164
atgaagatcactcttcctgacgatcagattgtagaaattctgttaagattgccagtaagaactctattgcgtttcaagtgtgtgcgtaagtcatggctttttctaatttccgatcctcaatttaccaaatcccattttgacttagcggctgcacccacacaccgatttcttctgacgacattctctgctcaagttaattccgtggacacagaggcaccacttcacgatgatactgtgaatgtgattttcaatattccacctccttcagggtttcatgaatttcaaccctggggatttgtgcttgtgggttcttgcagaggatttttactcttaaaatatacgttcctccgtcgtttgcctacttttgccatttggaatccgtcaactggtctctttaaacgaattaaagatttgccgacgtatccacatctatgtggcattgggtatgactcatcaactgatgactacgtgatagtgaacgtaacaatatggaactacaacacgatgatccaatgtttctcttggagaaccaatacatggagcacttcatcatggagctcttatgaaagtactgttccatatccttgctatcacgaaatacgccacgggttgtttattaatggagctcttcattggttggttcgtagttgttactataataaacctagagttattatagcctatgatacaatgaaaaggattttatcagagattccactgccagacgatgcagcggaaactacattttattctttaggtgtcatgagaggatgtttgtgcatttattccaagtctaggtggccaaccatgcttgagattgaggtccccgaattctacaaagttcctgaagttcctagttcatttccagcaaccaatccttga

SEQ ID NO: 39387 - DNA, 282 bp, Glycine max
  Peptide Sequence Number=SeqID_156165
atgcgtagtgattgcttagtggaattctccattctcaatcttttcggagccccacgaattgcgtttttgttcatgtgtcctccaccttcgagtttggagctattcgtaagccccatcaattgcgttttcgttcatgtgtcctccaccttcgagttcggagccatgcgtagtgattgcatagtgcaattctccattctcaatcttttcggagcccgacgaattgcgttttcgttcttgtgccctccaccttcgagtttggagctatgcgtagtgattgcttag

SEQ ID NO: 39388 - DNA, 1257 bp, Glycine max
  Peptide Sequence Number=SeqID_156166
atgagggagaagactagagtggggaggggcatatattcgagaaagaagaaaagtgggacaggggaagagttagttggacttggtaatggtatcacagccattggagtcattgcaggaggagttgctgtgggtgctgcactgttgtttgcatccccagtaattgcaattgtttactggaatagaaggaagccaccggatgattactttgatgttgcagctgaggaggatcctgaagttagctttggtcagcttaaaaagttttcactgcctgaactgcggattgcaacagataactttagtaacaacaatattcttggtaaaggtggatatggcaaggtttatataggacgtttaacaaatggtggtaatgtagcagtaaaaagacttaaccctgaacgcatccgaggcgaggataagcaatttaaaagagaagtggaaatgatcagcatggctgtgcatcgaaatttgcttcgcctgattggtttttgtatgacgtcttctgaacgcttgcttgtgtatcctttaatggttaatggaagtttagagtcatgtttacgagagccttcggaatcaaaaccaccacttgaatggccgatgcggaagcgtattgctctgggagctgctagggggcttgcttatttgcatgatcattgtgacccaaagattattcatcgtgatgtcaaagctgctaacatattgttggatgacgaatttgaagcagttgtaggagattttggtttagcaaggattatggattaccaaaatactcatgttactactgctgtatgcggtacgcatggccatatagcaccagagtatctcacaactggaaggtcttcagagaagactgatgtttttggatatggcatgatgcttcttgaaataataactggacagagggcttttgatttagcacgattcgccagggatgaggatatcatgttgcttgaatgggtgaaagtacttgtgaaagacaagaagttggagacactggtggatgcaaatttacggggaaattgtgatatagaggaagtagaggagttgatccgggtggccttgatatgcacacaaaggtccccttatgaaagaccaaagatgtctgaggtggtgagaatgctggagggtgaaggtttggcagaaaagtgggatgaatggttgaatatgcaagaggatatacaaaatttcaccttcaatctctgcactccttatgactcaaatccaaatattcaaccagatgttctgtcaggtcctagatga

SEQ ID NO: 39389 - DNA, 318 bp, Glycine max
  Peptide Sequence Number=SeqID_156167
atgaagcccaagtcgaaaccatgctacaacagggaattattagacccagcacgagccctttttcctcccctgttttgcttgttaagaaacgcgatggttcatggcatgcagcgcatgctggttctcgaagttagacttgttgcaagggagcacttgagtcacttggaacaagcctttcagattctgcttgctggcaaattctttctcaaattatccaagtgcaccttcgcgcagaagcaagtggagtatcttggacatttggtctctcagtctggtgttcaaccagtctctacgaaggtggaagcagtccaacaatga

SEQ ID NO: 39390 - DNA, 432 bp, Glycine max
  Peptide Sequence Number=SeqID_156168
atggtggtggcatactacgaaaaactgaaaacattgtgggatgagttggccaattatgaccaaattctagcctgtcgttgtggtgggaacaactgggatatagcctcaaaattacaaaagcggaaagaagaagaaagagttcaccaattcctcatgggattggacgatgcaacttacggaactgttcgatccaacctcctcgcaacaggttcgctgcctactctaaatagggtgtactcaacaatgattcaagaaagggacatgaagcaggaaactgttttcaactcattagttatcttgactggtggggggacaaaccaaaaaatagtggacgaggcaagccaatgcaatgaatgtgaactggatgaggaaaaagaggaacagtgtgtgcaaatgttgtgcacagtggtggaacaagtgcaaacaacatga

SEQ ID NO: 39391 - DNA, 940 bp, Glycine max
  Peptide Sequence Number=SeqID_156169
atgaccaatatgcagcgagtggtttcatctttcatgtctttgtttcttattctttggatgtttgtggtgcttgacttagtgatcaaggtttctggcaacgcagaaggtgatgctctgatggcattgaagaacaatatgattgatcctagtgatgctcttcgtagctgggatgctacccttgtccatccttgcacatggttacatgttttttgcaacagtgaaaatagcgtaactcgtgttaacaagtcctcgatcaagaagttaaaaactcaaccgagtgcagctaagaaaattcttggtatggagattcacatggactgtcaagcaggaagaattatggtggtgatctttatcaaagatctctttctagctatatcttttactctatgtaactgtgctatcagttggaaagctacacataaatctgttgctgtattatctataactaaagtagaacctattgcagcaacagagggtgtgaaggaggttaaattcgagttcaaaagagtcatattcggtaatcctgcagatatgctaagttactttcaaatgctaagtttcaagattacttggagttgggaactttatagtaataatataactggggaaatcccagtagagcttggaagtttgacaaacttggtgagcttggatctttacttgaacaaaattactggtcccattccagatggattggccaaccttaaaaaattaaaatccctgcgtctcaacaataacagcttgtcaggaaacattcctgtgggtttgaccactattaattcactgcaagtgctggatttagcaaacaataacttaacaggaaatgtcccagtctatggttctttttcaatttttactcccatcagttttaaaaataatcctttcttgtatcaaaccactccagttacaccagctgctacaccgcaacaaaatccttcag

SEQ ID NO: 39392 - DNA, 316 bp, Glycine max
  Peptide Sequence Number=SeqID_156170
atggtacatctacttgggtttgactgagaacaagagagggtacatctcttgtggatcagttctagtggagggtacatccaccaggttcaaagagaacaagggagggtacatcccttgtggatctttgcttgtaaaaggtttttttacaaggttgaaagaaatctcaaggaccgcaggtcgcttgggaactggaggtaggcacagaaaatgctttccaaccgccaatgatccccacataaacattacagctgagatatccagtttccaacaacttatagctgcagtgcttaaaattgagaagcagttcgcattataa

SEQ ID NO: 39393 - DNA, 327 bp, Glycine max
  Peptide Sequence Number=SeqID_156171
atggacaaggagcagggttcgaagaacgagaagagctactcaaaaaaaagtaaagggaggaagcgagtgaaaaggggagaggaagatgactatagaaagccgatagtccggtactttaagctttcgagagagatagagatggcctgctttattggaacttcctacttacctcctttcaaagacccagaagtcttcgactacctttactttgaagaagaagaagatttagccattggtttggctaccactctagtggagcaccgtgataaggcgcctattactgacttctttttcatgatctcaagacgacttaagcaaaccgattaa

SEQ ID NO: 39394 - DNA, 927 bp, Glycine max
  Peptide Sequence Number=SeqID_156172
atgctaatcaatagcttgatatccaaaaatcaccgcgacagatatatggtttctgactgtgactcggtagaagtgctttacaaatatcagcactacaccaagactcctgaagaagctgcagccatatccattctggcagggttggacttgaactgtggaagatttcttggccaatacacagaaggtgctgtcaagcaagggcttattgatgaatccattaacaatgctgtctccaacaacttcgccacgttgatgcgtctaggattctttgatggtgatccaagaaagcaaccttatggaaaccttggaccaaaagatgtctgcactccagcaaaccaggaacttgcccgagaagctgcaaggcaagggattgtgtcgctgaaaaacagtccagcatcactgcctctcaacgccaaagccattaaatcgttggcagttataggacccaatgctaatgctactagggtcatgattggaaactatgaaggcatcccatgtaagtatatatcacccttgcaaggcctaacagcctttgttcctacaagctatgctgccggctgtcttgatgtgcgctgccccaatccagtactagatgatgcaaaaaagatttctgcctctggagatgccacagtaattgtagtcggtgcaagtctagcaattgaggctgaaagtctagacagagtcaacattcttcttccaggacagcaacaacttctagttactgaagttgcaaatgcatccaagggaccagtgattcttgtcataatgtctggaggaggcatggatgtgtcctttgctaaagacaacaataaaatcacaagcatcttgtgggttggctaccccggagaagctggtggagctgccatagcggatgtgatctttgggtttcataatccagtaagtcacttgaagacactgttcggataa

SEQ ID NO: 39395 - DNA, 780 bp, Glycine max
  Peptide Sequence Number=SeqID_156173
atggctggccatgttggtagaggtgtcttagaggaggaggtatggaggaagggaccttggactgctgaagaggacaggttgcttgttgagtatgttaggttgcattgtgaaggcagatggaactctgttgctaggcttgcaggattgaaaagaaatgggaagagctgcagattgagatgggtgaattatctgagacctgatctcaagaggggacagataacaccacaagaagagagcataattctagagttgcatgcaaggtggggaaacaggtggtcaacaattgcaaggagcttgccagggagaactgacaatgagataaaaaattattggaggactcatttcaagaaaaaggcaaaaagtccctctgatgcagcagagaaggctagaaatagactcatgaggaagcagcaatttcaccagcaacaacaacaacaacaacagttgcagcagcagcatcgggcacaacaacaacaaatgcaattcaactttgacatgaaaggcatcatggccatgcttgaggacgacatccatagaacaccttataaatctcaatcaagacaagaaatgatcaacatgcaccaaaacaccacagaagagcaaggatacttgtactctatgctcaatgacaactcttctgcttcttctgcaccagagacctctgcagaagaagttttgtgggatggtctgtggaacatagatgatgttcatggcaatttcagtgtggctagtgcagcaagcagatttggtctatacaatttagttgctcccttctgttaa

SEQ ID NO: 39396 - DNA, 198 bp, Glycine max
  Peptide Sequence Number=SeqID_156174
atgatcacttctttctcttcagaaggtaatgatgaggaggatcaccatgagcactggaatggatctatgagtagaagtcaatcaaaacatcctaatcaacaagcttcaccacttccaactaaacttccagctggagctcatttaccctcttgtgctcggcctggaatgatgcccattgctgattgcatgaataaatga

SEQ ID NO: 39397 - DNA, 393 bp, Glycine max
  Peptide Sequence Number=SeqID_156175
atggggaagaagactaaagaaccgattggatctaaagaggagttagacccttgtccatctattcctgtcaagttggaagaatttaaagaatggtgtatcccttggatgaatttgttgattgtgaaggtaatggggaaaaaggtcaactatcaaatgatgatgaataggcttaatagagattgggctaggaaaggatctataggaattatagacatgccaaatgagtattatttgaaatggcgtcctttcttctctgtagaggctaaggaggcgaggaagttgctgcttggattcgtattccaagactccctattgagttgtataaggaaaacttccttcggagagcataaacagactcaatgtactcccaatatgggagttcagaaggcttaa

SEQ ID NO: 39398 - DNA, 222 bp, Glycine max
  Peptide Sequence Number=SeqID_156176
atggtggaaacgaccaaattctcagcaaactgggaatggcccagtggccttaagcaaacaaacaaatttaatgaggaaagaaattcaaccgtaaaggaccagtggtttcctgaggcagcccgagcaatggtgcttcaagatgatgagattctattttatcccactgctattgggtctgaacctcatgatggaagcattgactctcgtgaccactggaaatga

SEQ ID NO: 39399 - DNA, 170 bp, Glycine max
  Peptide Sequence Number=SeqID_156177
atggagactgtccccatgtgtgtcacattcaattattggcacatgcgtcaacctctgtctggaagccacgtgtccggtgtcttagacttggacaccgaagtggggccaccagcatctcttatcttcatttgtcgcatagcagacacacacgtttcagttacagtttcagg

SEQ ID NO: 39400 - DNA, 396 bp, Glycine max
  Peptide Sequence Number=SeqID_156178
atgacaaaagtgtccttcgtggcaagtggacagaacaagcgtcacatgctggcggggcatgcatacttttggtcgaaaaggatacaccgtgaaattccatttctacccctggttcagcgtttcgtgcggtcgaaacgaagggtggttttgacttttcgtactttgtccactgtgggggttgtgtgtttgtcttggattagtggaaacaggagctgtcgtggcgcgctcgtgtctacaacgtcgaacaaatattttggaggtgtaatctgctgcggtaacggtggcttcacgaccgtggtcatgaccattgatatccgtgtggccacaacgagggaaaattataacggagctaggtttggcatgatggcgcaagcatcagcttcggcttcggcttag

SEQ ID NO: 39401 - DNA, 633 bp, Glycine max
  Peptide Sequence Number=SeqID_156179
atggaaaggagcaatagcaagaagaagtccctgaagtcgaggctttcgaacgagaacgttcctccattgcagatcgattcggaggaaagaagaggacgctatctccaaccaaccgcgatgagtccacggttccaaccgtacgccgagaacatcgacgccggttcgccgctcacgcgccacctcttcgccggatctccgctctccggcaaggtcgccggcgacggcgaggccttcatttctccgaagttcggcgccaggacagcgaaagcgcttcagtactgcggcactagttcgggaggaagcagtagcttctgttctcgcggttggttgacgtcttcgccgctttcgtcactcgaaaacatggagattgcgccgctcaggtcgcctccggtgtaccgaacgccgtcgacgggggacgatgacgtcatcgtgatggatgctattctcgtgaggccggtgtccggaggaacgagcggaaggtcttcatcttcctccagccgcggttcgtcctcttcgtcgacggcgaagagcgtgttcaagacggagatttgcaaagcgcgggaagaatctggtaacagtcgctacaactccaaaagccaggttcgcgccataaccatactattacgaatttaa

SEQ ID NO: 39402 - DNA, 1920 bp, Glycine max
  Peptide Sequence Number=SeqID_156180
atggatttgaacatgaaatctttactgtctcctcatgatactgaacttaggaaagatgacaacttcggtgatactaaattatgcttgaatggcattggctttggagaaacaaataagactagttatacatgtaccaggagcaatcttgggatgaagttttccaatgcttctgatgatggctgcagattggttctgggattgggcccaacccctatggcatatgtcgatgactacaacaatttggggtttaatatgaagaaaaactcagccaacctttttactcagcatgtgccatctgaatgtgaatcaatccttcaacttggcctttcgggtgtaacaaatgaggcctcaagtgtgcttgactgctcaggttcaactgagactgatgtgaatatgtcatgtttctcaagccaaacttcttcagaaaattattattcaaggattcctgttgttgatgagggttctacctcagcaaagaaatcaggcggctatataccatcacttcttttagctccaagaatggataacactgaaagttcggtgcaaacacaagaattaattgttggaagtaaacctcaactgtgcccagaaccatccaatgctgtaaattactcccttggtactgtatctgggccccaggatacagggataactccagagaaccgaacatgcaatcctaagagatgtagattttttggctgtacgaaaggagctcgaggtgcttcggggctttgtatcgggcatggtggtggacagagatgtcagaaacctggatgcaacaaaggtgctgagagccgaactgcttattgtaaggcccatggtggagggaagaggtgccaacacttgggatgtactaaaagtgctgaggggaagacagattattgcattgcacacggtggtggtaggcgatgtgggtatccagatgggtgcacaaaagctgctcggggtaagtcaggactttgcattagacatggagggggcaagaggtgtagaatagaaggttgcacccggagtgctgaagggcaggctgggttgtgcatctctcatggaggtggacgccgttgtcagtaccaagaatgtagtaagggtgcacaagggagcactatgtattgcaaagcacatggtggtgggaaacgatgctcatttgcagggtgtaccaaaggtgccgaaggtagcaccccattgtgcaaggcacacggtggggggaaacgctgcctttttaatggaggtagcatttgcccaaaaagtgtgcatggaggcacaaacttctgtgttgctcatggtggtggaaagaggtgtgctgttgcaggttgcacgaagagtgcacgtggtcgtactgactgttgtgtcaggcatggtggggggaagcgatgcaagtttgaaggctgtgggaagagcgctcaagggagcacagatttctgcaaggcacatggtgggggaaagcgatgtagttggggagatggaaagtgtgagaaatttgctaggggaaagagtggactctgtgctgctcacagcagcttggtgcaagagcgggaaatgaacaagggcagtctgattgcacccggacttttccgtggtcttgtaccttctgcttccacggcctgtagcagttttgagaacaattcttcctcaggcgtcagtgttctgtccgactcctacgattccgtggaaactccagcaaaaagacagcacctgatacccaaggaggtgttagttccgctctcgatgaaatcaccgtcttattcaaacttcttggctgccaagaagccagaccaagacagaaactgccaaagctcggctgctggctgcagcagtgctcagaaaggcctcgattttaatctaccggagggcagggtccacggcggcgacctcatgttgtattttggagggaatctcaaaaatgcactcggcagcatctga

SEQ ID NO: 39403 - DNA, 1431 bp, Glycine max
  Peptide Sequence Number=SeqID_156181
atgactacaatcaccctctccctcccttgcacaaacccctacttcctctcttcttctccaaaacgattcagattcaacacccaatcagcacaactttccccttcctcctcctcacctctccaatccccaccactccccaaaaccaccggagtcatcgtcatcggcgcgggcctcgccggactcgccgccgccacccacctgaactcccagaacatccccttcctcctcctggaagcctccgacgccgtcggaggccgcgtccgcaccgacattgtcgacggcttcctcctcgaccgcggcttccaaatcttcatcaccgcctacccggaagcccaaaagctcctcaattatcaatctctcaacctccagaagttctactccggcgcccgaatcttctacgatggccaattccacaccgtcgccgaccctctccgccacttctgggactccgcgaggtccctcaccaacccaatcggatcccccctcgacaagctcctaatcggatccaccagaatccgcgccctcgtcaaatccgacgaagaaatcctcaccgcagaggaagtccccacaatcgaactactaaaaaaactagggttttccgattccatcatccgaagattcttccgtccgttcttcggcggaatcttcttcgaccctgacctggaaacgacgtcgcgcttgttcaatttcatcttcaaatgcctcgccctcggagacaacactcttccagcgaggggcatatcggcgatcccggaacagctggcggcgaggttgccgtccggttcgatcctgctcaactccaaggccgtttcggtcgacctcgataattccgattcgccgctcgtgagactccaaaacggcgacgttttgaagagcgagctaggagtcatagtagcggttgaagaaccagcagcagttcatttattatctggaagaaccggtccggttcctaaaaagccggttcgaagcacggtctgtttgtacttcaccgcgaatcgggaccagatcccggtacctgacccggttctgtttctgaacgggtcgggtaaggggattgtgaacaacatgtttttcgtcacgaacgtggctccgtcgtttggcccacccgataaaggccttgtatcagtgtcactaatagggctctttgagggcgtgtcagatgaagagcttgtgggtaaagtggttaatgagctttcgggttggtttggggagaaaatggtttcgaaatggaaccatttgaggacttatcgaatcgggttcgcacagcccaatcagtgcccgcccacggatctgaagaaagacccgagagttgagtcgggtttgtatgtgtgtggggatcatttgacctctgccacgtttgatggtgctttggtctctgggaggagggcagcagaatccctattgaaggatagagccctcactgcagcttaa

SEQ ID NO: 39404 - DNA, 2133 bp, Glycine max
  Peptide Sequence Number=SeqID_156182
atggctgcattcttggtgattctccgttcttcgcatcagtgccttctggaggagttgggtgtggaagtggttatcgctatagctccaatgatgagttcaaacagagagatagaagatgttgcatctttggaggagaagttgggcagggcattgtcaaagcaggaaaggagtaggataggcgtgagcaaacttaggctttttctggaagaattactccaaaagaggtatataagtaatgtacctttgatcattccacttctcgagaaggagtactggactgtgacaaggaaattaagtgacattaatcaagaattgagcacacttgatgaagccaaactgaaggagaaaggaagagccttccatgatatgttcttgaccaagctgtcattgttgcttaaagggacagttgttgcacctcctgataagttcggtgaaacactgcaagacgagcgaattaatggaggtgcatttatcggagctgatggtgttcagttccctcacaagctaatacctaatcttgtaaagcaaacatatgatgatacaggcctaaagcctaccgttactaaggtgtatgttgggagagttaaaaggagcaatgcacccaggagagaaaatggctcaactaactgcctagttggcagtagatgggagggagtgtgtgggggaaagggaggtagaggggaggggaggctggaatttggaattgggaccttggcgagattaagcctcttgaatttcctaagaattgtcttccttcttgctgctactgaaacacttctatacacagtttatacacacatacagaatgcagggatgcgtctttatggtggtgcacaatatcatcgggcaatgggtgaatttcgttttgtggttggaggaatcaagtgtcccccaattactcgggaagaaattgtaaatgcatgtggagttgaagatattcatgatggaacaaactactctaggactgcttgtgtaattgctgttgcaaaggctcgtgacacatttgaaccttttcttcatcagttggggtccaggctgttgtatatacttaagagattgcttccgatctctgtttttcttcttcagaaagattgtgaatatctaagtggccatgaggtgttcctcaggcgtgctgcctctgccttcaacaactttgcagaatctactgaaaaatcatgccgtgaaaaatgtatggaggacttggtgagcaccacacggtatgtttcatggcctctccacaataagagtcgggctgggttacgtctgttcttagattcttttggtggaacagaacattccaatgcttgtaataatcctacatcaactgttctatcacaaacaagtgcgcatgagaaagaagacacaaagtcacaaccggatgtaaaactctgccatgtagcctctggcactgattctagctcatccattcagacaacagaaacaaagcttgctgatcttctggatagtacactctggaataggaggcttgcaccttcatctgaaagaattgtttatggcttggtacaacagatatttcatggcattagagaatatttcttggtttccacagagttaaaggtctctgatgtttcttttttgttcatttatgcttttttgtggttgttcaattgtttccttttgatgcccattgtggacaaattgcctgcacttctccgggaagacctagaatctgcttttcaagatgacctggataatgtttttgacataaccaatatgcagcactcatttgggcagcaaaagagagagacagaaattgaactgaaaagggacgaatgcaaagccttgtgcaccaagttctgggtacttgggaacaatggaaaacacaaaggtagtgctaaaggttgcaacaatggatttgtttttgctagatttgaatggcaaaggagatggatagaatgcatggccaaggatttttgcggaatcttttatcaaggtaagtatgccgtttggcctcacataagaagctccatctattttctagcctgcttgcttaaacccatgttgcacaaaattgatatccgaggatacaaagctcaagagagagtaaagaacaaccacaaggatgccaaatgcatgcattgctatgtttgtgaagttggttttggatgctga

SEQ ID NO: 39405 - DNA, 876 bp, Glycine max
  Peptide Sequence Number=SeqID_156183
atggagatgaacgagttatctcagaagcagactcttgttgtccatgggattgctggtgctggttcggtggctttagccaccgccttcacttaccctcttgacaccatgaaagtcctcattcaggttggttccagcaccggtaaagaattggaccatacccatgttttgaccagactactctctgtatccggcaatgcaggatttttggtctgggagcacgatttggggtttatgaaatcctgtctgccttttataaaggctcttttggctggcgtggtagctggtgccattgaggcagtcataagctctccattcgaactcatcaagcttcgtatgcaagttagctctgcttcatatgttcctagctccaactttgctttggaaaagggggctcgtacacctttaattgcaagattacttcatggctgttatccagacaggagggcattggaccaatatattggtctcatctccaccctaaaagccaaaaatacaaacctgaccagtgcgttgctagagtatccatggacaatgacaggatctgggagtccaccatcagtttccaatgtcaggagaccatctgacattatatctttggaaggatggagcacattatggagaggtctccgttctggaattgtccgagattctgtgtttggtggcgtatttttttcgacctggcaatttctgcaccaagcaatgctagattggaaggctgcagggatgaatcctccacccaggttaaatgaagaagtcggtccattgtctcctttgactgttagtcttactgctggattctcagcttcagttgctgctgctgcttcccatagttttgatactacaagaagtagatcgcagtgtactgtgctgccaaag

SEQ ID NO: 39406 - DNA, 390 bp, Glycine max
  Peptide Sequence Number=SeqID_156184
atggctagaccagctagaagcatagttctacccctccttgttggcattctcgtcgtcattttgttgttagaatcaagatacgtgaaagcgatgggtgaggttgctgcaatggatgatagtgcggcattgatgaatacatcatcatcaggtgcaaactgggatgcgcattcaaaacacagaagaaacatgggtgtgaatgggagggtgttttgctgctatgataaccatataggaagttgcaatccgggttcagagaaagatgaccattattgtaattacatttgcaaaaaacaccactgctacaaaggggttagcaaagcaaaagaaaaaggaaagaaaaaactctcattaatctctcaaactgtaactttggtcgatttagacatttaa

SEQ ID NO: 39407 - DNA, 1758 bp, Glycine max
  Peptide Sequence Number=SeqID_156185
atgtctccaagcacattaagaagagccataggggcagtgaaggatcaaacgagcataggcctggccatggtgggaaacagcacctcacttgctgaccttgatgtggccattgtgaaggcaacaaggcatgatgagtacccagctgaagagaagcatctgaaggagattctcagcttaacatgctactctcgagcattcatcagtgcatgtgtaaacaccctctctaggcgtctcagcaagactagcagttggacagtggctttaaaaacacttattttgattcaaaggctgttatcagatggtgatcctgcatatgagcaagaaatattcttctcaactcgccgcggaacacgcctcctaaacatgtctgatttcaggggcaactcaaaatataattcatgggacttctgtgcatttgtgcgcacctatgcgttgtatctagatgaaaggctagagtacatgatgcaaaacaagcgtggaaagcgtagcaggtttgctattgatgaggaagaagaggaaaccatggaaagagaaagtagatatagtagggaaagagaaaagaatagagaaatcttgaaagtcacaccattgtgtgaaatgaagactgaggagctattttccaaaatgcagcacttgcaattgctggttgagcgctttctagcttgtcgtcccacagggagagcaaagacacatcgaattgtgatagtggctctctatcctattgtgaaggagagtttccaaatatatgacaacattacagaaatactgtgtatcttcattgaccgtttcattggcatggagttacctgactgcattaaggtatatgacattttctgtcgtgttgggaaacagtatgatgaactagacttgttctacagctggtccaagagtgtcggaattgcccgctctactgagtacccagagattgagagggtcacaactaagaagctagaggtcatggatcaatacatcagagacaaagcacaacacaaaaagctatacatccaagaagaaaacaatgaagaagaagaaccagaggaagacatgaatgcaatcaaggcactgccagcaccagaatatttcaatgaggaaccagaagaagtgaaggaagagacaaaggaagaagatataaaagaagaaaaattggtgcaaacagaaggtgatctattgaatttaggagatgacatggtgacaagtcaagaacatggggacagcctagccttggcactatttgatggtgctttaccaacgagtgccactcaagcccttccatggcacgcttttgatgatgcagcagattgggaaacagcattggtccaatcatccagtaacttgtccaaccagaagccatcattaggaggcggctttgacacattgttgttggatggtatgtatagacaagcagcaacaaatatgcaaagacaaagtcatgggatgaatggcagtgctagcagtgtggcgctagggtcagctggaaggcctgcaatgttagcattgccagcaccaccaacatcagggagtggttcaagtttggatagtgcagatccatttgcagcctcattggccgtggcacctccagcttatgtgcaaatgtcagagatagagaagaaacaaaggttattaatggaggaacaagaaatgtggcaacaatatgcaaggagtggcatgcaaggaaacgttgcattcacaaaactacaacctaacaatacttatcacatgggacagtatccacaaaactatggccattattatcattaa

SEQ ID NO: 39408 - DNA, 179 bp, Glycine max
  Peptide Sequence Number=SeqID_156186
aattttcatttagctctacatttctccagcaattatgtggatctggggtgctagctgatggtcgactagctgatctgattcgaagagttgctacttttggcatggtgttaatgaagcttgacttgcgtcagttgtggcctgaaactagcagtgtgacaggaatccggcagacatgctga

SEQ ID NO: 39409 - DNA, 903 bp, Glycine max
  Peptide Sequence Number=SeqID_156187
atgggagtctatgaggggatcttgcgtttgagggtagaccaagtgctaaccatgaatggatgtgagaggattgatgagaggccacagggtatgttttatcgcggccccatgaccttgcacgtcaacattggaaggagggcctttgacaagataggggacctacaaaacaaaggactccaatgtggagcccggttactaagggctaggcgtccgtgctcctatagcaggactgacaaggagggtggacacgtctctgagtgtcacgtaggatgccacgtagattttataggtcctggacggtacaaccaccatcaaccagaatcacgacctgcctctaacctgtcggaagcatggctgatccccacctctgtctacggtagcctatccgcccaaccatccaccaccacccatatctgcacctacccacaaattccttcccttttgtttcaccacctaccttcttcttatgaagacccagctcaatcccaagggattgattttgcaagtactcagaaccgcttgctaggcttgtgcgataccatggaaactcttgatccaccatctccctcctcacacccgaaactggaaacaaatattcatgtagaagtcgcagattctagcggtgaagcgcatgttgatgaaggtgatgactccctacggggtgtccttttgcccgaaccacactcctccatcacgattgcacccaccaccaccaccaccaaaaccatagagagctctgacttgcctcttgagagcattaacaacatccatagtggtaaccgtcttcctcctagtgtgctcggtgtaagtaacagcatcgcgaataacgttcccgagaaagtaacaacgtcgcgaataacgttcccgagaaagttcttaaggactctgcgggttttttcttag

SEQ ID NO: 39410 - DNA, 1770 bp, Glycine max
  Peptide Sequence Number=SeqID_156188
atgtattggcccagttgcttatcgtctcgcattaccggcatcctcacgaattcatccgtgttccatgtttccttgttaaaactgcaccagggcccacttgcttctcagccagcccatttaccacctacaaatgtggaccatcatccagttgttgaaccgctatctgtgttggactggaagtgggacaattctgtctcacccccaaccaagctggttttggtccaatggtccggtttggctccggaagataccacttgggaaagctatgatgcattgcatgaatcttataaccttgtggacaaggttattctcccaggggaaggagatgttagcaacaccaacccaccacacaccagcagaccaaagaggtgtaccagaagaccaacatacctggatgactacaattattcacgtgggaatcaagttgctccagatgttagagaagtcttggatacgttccgaactgctgctgagctagggagtgattcatttggtgcctatgtgatctctatggcctcaaatgctagtgatgtccttgcagtagagcttttgcagaaggatgcgcgacttgctgttagcggggagttaggaagagcatgtcctggtggaacgctgcgggtggttcctctatttgaaactgtgaaggacctgagaggagctggttcagttatcagaaagcttttgtcaatagattggtaccgccaacacatcattaaaaaccataatgggcatcaagaggttatggttggatattctgattctggtaaagatgccgggcgcttcactgctgcttgggaactttacaaagctcaggaggatgttgtggctgcatgcaatgagtatgatattaaggttactctcttccatggccgtggaggtagtattggccgcggtggtggcccaacatatatggctattcagtctcaaccacccggctctgtcatgggaacccttcgttcaactgagcaaggagagatggtgcaggccaagtttggcttgccacagacagctgtcagacagctagagatatacacaacagctgtgctacttgctacccttcgtccacctcaaccgccacgtgaagaaaaatggcgcaatcttatggaagacatttcaaagatcagctgccaatgttaccgcaatgtagtgtatgaaaatccagagttcctgtcatacttccaggaagccacacctcaatcagagcttggttttctcaacatcggcagccgccccacaaggcgaaagagctcaacaggaattggacacctccgtgccattccttgggtgtttgcatggactcaaaccaggtttgttcttccagcctggcttggagttggagcaggcttgaaagatgcttgtgagaaaggacaaactgaagagctaaaggccatgtacagagagtggcctttctttcaaagcacaatagacttgattgagatggttttgggaaaagcagatattcctattgctaagcactatgatgaagttcttgtctcacaaaagagacaagaacttggaaagcaactgaggaatgaactcatctcaactggcaagtttgttctagcggttagtgggcaggagaaacctcaacagaataatagaagcttaaggaagctgattgagagtagacttccctttctgaaccccatgaatatgttgcaagtagagatactcaagaggctaagatgtgatgatgacaatcttaaagccagagatgccttgcttatcaccataaatggtattgctgctgggatgaggaacactggttaa

SEQ ID NO: 39411 - DNA, 351 bp, Glycine max
  Peptide Sequence Number=SeqID_156189
atgccgacaacgaacctccaaggaaaggaaacgacacagggaggagaagaagctcaagaacgaaagaagcttgaacacacgaccaagaaaatgaaacggcacagggaggagaccgcgtacggaatgcaagaacagtgcactggcttgagcacagtcgtcatcaccgcagcgcattcattcttcatcttcgtcttcttcgtcatcatcgaccgcgccgccgtgggtgttgaccatcccagccaagttgacggtggtgttgctgcctccgcacgtcggcattgtcgaggtaagcatccttgcgctgagttcgctgacatcgtttgcagcaggggaagtttcggatcaagttga

SEQ ID NO: 39412 - DNA, 783 bp, Glycine max
  Peptide Sequence Number=SeqID_156190
atgaataacatgatcacgctgcaagacactgaaattaaagcatcctttgaaacaagtacatatgtggttggacatgtttttaaagttaccttatacaagaggcttcttggcatggtttcaatgtatgctttaaatcagattgctgttgagtatgagcgtgtacattatactggcaagaatccttctcattgtggatgtgtgatgagaactacacatggtcttccttgtgcattaattctaaagaataaacttcgggaaattgtgtatcctgatcaaaactctatgtgtcctcctccagaaaaggccattccaagaaggaccatgctgatgttggatcaatttcatccgttcatacacgatttaattgacaacattgtggatgtgaaagctgacagtaattgtggatatcgtgcgattgctgctttattaggtatgggtgaagattcttggtccttggtgtgcaaccatttgcttaaagaacttggcaaatggttagatgaatatatcaacttctttggtggcatagatagattcgaggaattaaggaggtccctacttgttgatgggttatccatggttactatggataagtggatggatataactgagataggatatgtcattgcatcaaggtatgatgtaatccttgtatcgttgttccttcaacaaagcatggcgttctttcctcttagaagtcaaccaccaatagattcttttatgcatcgcataatatgtattggtcatgtctatggaaatcattttgttcaggttaattcaagataa

SEQ ID NO: 39413 - DNA, 601 bp, Glycine max
  Peptide Sequence Number=SeqID_156191
agggctacacgtcctcgccttcagagggctacacgccctcgccttcagaggactacacgtccttgccttcagagggttacacgccctcggccttcagaggactacacgtcctcaccttcagagggctacatgtcctcaacttcatagggctacacgcccttactttcagagggctagacgtcctccccttcagaggactacacgtcctcgccatcagagggctacacatcctcacctttataggactacacatcctcgccttcagaggtctacatgccctcgccttcagaggactgcacgtcctcaccttcagaggactatacatttagaggactacacatcctcgcttacagaggactacacgtcctcgcctttagagggctacacgccctcgccttcagaggacaacacggctacacacccttaccttcagagggctacacgtcctccccttcagaggactacacgtccttgccatcagagggctgcacgtcctcaccttcagagggctacacgccctcaccttcagagggctacatggactcaccttccgaggaatacacgtccttgccttcaaagggctacacaccctcacctttag

SEQ ID NO: 39414 - DNA, 387 bp, Glycine max
  Peptide Sequence Number=SeqID_156192
atgaaagctatgccaagcaagccaacaagaaaaggaaggaagtggtacttgaacccgacttatcaaggtaatccttgtggcgtctaccctgacttatcttccttcaccggaagtggcgtctatcaggacttatcttccttcaccggaagtggcgtctaccctaacttatcttccttcatcggaagtggcgtctaccctaacttatcttccttcaccggaagtggcgtcatccaaaacctccgtagcctttatcaaacgatccgctacaaatcaggttcgcatcaatcgaggtcgcctgtggtatttcgtgggaactcaaccgccgttgtgatgaagccaatcgaacatttcctaatcgacatcatccgaaaattattaagggattga

SEQ ID NO: 39415 - DNA, 577 bp, Glycine max
  Peptide Sequence Number=SeqID_156193
atgtctaatattcaaactggcgccgagcgtatgccgcatgacctttcccatcttggcttccttgctggtcagattggtcgtcttattaccatttcaactactccggttatcgctggcgactccttcgagatggacgccgttggcgctctccgtctttctccattgcgtcgtggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtggagagggccgcgccaaagcc

SEQ ID NO: 39416 - DNA, 1014 bp, Glycine max
  Peptide Sequence Number=SeqID_156194
atgtggtacttgtgcgttttcttccacaggttattggattacagaaaaccagaagtggaatctctggcgcaactcttcggagccaccgaggaccctaaaaatggcgacgttccctcccaaatgcaatggaagctccctattcactaccaccccgattcccctttccatttcgtaaacctcccttccgaaaaactcgctcgtgacatcgccacccgaagcatacttgttaaggggatgtatgagctgtggggtgaagggagtagctatgaggagttgaaggagtctgtgttgagttaccctgacgaaaggaagttgccgtacttggattctgatagcactttcaagattactgtcgatagctttgggaaggtcattagcttggaggaccaaaaggagctcattcaagggctctcttatatccctttcaaggtgggttatgtggttcagcagaaccttgttagtgtttgttggggacgagtaaagttgaaaaacccagatcacaacttctggcttatagaagttgataattatggaggtaataatggtcttcctccaattgtacaaaagagagtcttctttggtcgcgaagttggtggggcagataggaagcttttacccacatatcagttgaaaagccgtacttatcttgggccaacagctatggatgctgaaattgcttttctaatggccaatcaagcactagctacttctggaaaactagtttatgacccttttgttggaactggaagtattcttgttgcagcagctcattttggagcaataaccatgggtgctgacattgacattagggtagtccgtgatggacgtggtcccaactgtaatgtttggagtaattttaagcagtatggattgccaatgcctgttggtcttctaagagcagacaacaaccttcctccctggcgttctacgctgaaagaggagagcatccagcttgcttctcgactcaataatttttccaatatcagcaattttactggtgtttttgctatctaa

SEQ ID NO: 39417 - DNA, 528 bp, Glycine max
  Peptide Sequence Number=SeqID_156195
atggctgaggcaaaatggtgtcacgagggttacattccaacatatgatgaatataaagttaatggaattttgacttcttgtttccctcttttcattacatcatttattggcttgggagaatttgcaaacaaagatgtgtttgattggatttttagtgatccaaatatcattaaagtggtatcaattattggtagagtattggacgacatgggctcacataagtttgagcaacaaagagtacatgttgcctcagctgtggaatgttgcatgaagcaatataacatttcacaagcagaggcgtaccaccttatccataatgacgttgaagatggttggaaggttataaatgaagagtgccttaagtcaaatgacatcccaaaatctgtgcttgattgtgtagttaatttggcacgcatgtctatggtttcatatgaaaaccaccaggataaattcactaatggagaactactgaaaggttatgtgtcttcattgcttatggatcccatgtgccttgaactacaccagtag

SEQ ID NO: 39418 - DNA, 1058 bp, Glycine max
  Peptide Sequence Number=SeqID_156196
atgtcccttccagcttcaacacttgcctcaattcaacatgcagtatctgaccagctcaagcgaccttgcgtgagttttgctccttgcatatggggagatactttccttgaatatgcttctcaatttgaggaaagagaagataagcgaatgagaaagagacagtgcgcattgtcgaatgtggagggagtcaatgatgacgagaagcagcaagctcaaacactaaggaatgaggtgcaaacgatgtttcaatcatcaatcgatcaaaatatcatacaaaaattaaacttgattgactcagtccaacgtttcggtgtatcctatcatttccaacaagaaatcaatcaagcattggaacaaattcacaacagtttcacaaaaaataacaccatcagtgatgatggcaatcatcactctcttgctctactctttcgtttgcttagacagcaaggatatcaaatttcatcaagtgcatttaacaaattcaaaaatgatcaaggaaactttagtgaaacacttgctaatgatattcaagggttgtgtagcttgtatgaagctgcacatctaagaactcccgaagatgacatattggaggaagcatgtgacttctcaaatactcacatgaagtccttggccaaccaattaagcccatctcttgcagcacaaatcaatcactgcttaagactacctcttaacaagagtttaattaggttcgaggcaaggtgtcacatgaatctctatgaaaaagatgcatctcataacaaaactctactaacctttgcaaaagtagatttcaatattcttcaaaaactacatcaaaaagaaattagcactatcaccaagtggtggaaaaagtcaaactttgagactaaggtcccttacgctagaggtaggttggttgaggcctacctttggtcattggctatgtcctacaaacctgaacacagcctcgcaagaatgtttgtgggaaaattgattgctgttgtttgtcttctagacgatacttatgatgcttatggcactattcaagaacttgagctattcacagaagcaattcaaag

SEQ ID NO: 39419 - DNA, 264 bp, Glycine max
  Peptide Sequence Number=SeqID_156197
atgaatatttttcataacaagattactcaaaatcaaaatcaagcaatttcaaccgccctcccgtatgatttcagaaaagagatagacaaggctggtggtacggataacaacgttgacggtaacggtaaatatgcactgcgtagttacggcgcgtattttaaacggagccgaccacacgttagggaattgcctcagaacattcctcgctttttctactctcacctctacgcgggtcaggccacgacttacttagccagagaatga

SEQ ID NO: 39420 - DNA, 578 bp, Glycine max
  Peptide Sequence Number=SeqID_156198
gggttgtgctctccaatctccaagcccctctggcggatttgaaccgtgactgcttccttgaccattacccaccttcactgatatttggtgtgggtggcatgagttttggttgggtggagtcacaattttggtggggattggttatgcttgggaacggggtaggtgggtttggccgtttgggtgatgcaacgattcttggtggtggtggtggtgctactacgctgggtttgatggagacgcaggctggtgtggtagttatggtggatattgaagaggaagggattgttgtcatgtgtagtgctgagtgcaaactgcagagggctagagggattggggaaaaaaaaatcatgtgcagtggatgcggcaatctcaaatctgatactagcgagcccaaccttgaggttgaagagaatgcaaatttggggccaaactcaggtttcactattcctctctctatggcaggtatagtgttcgatgagagcaatcttccaccacataagagcaacaatgtaaaaaaagcaatggatcgtagttgctcaacgcatcaagatctcccaaacaatgtgccacaatcatag

SEQ ID NO: 39421 - DNA, 672 bp, Glycine max
  Peptide Sequence Number=SeqID_156199
atggctactagtacactcagccatgcagaagaagtacttcccaatccagcaaaaaatactgatcagaagcaaatccaagttactgaagatcataccaacaacattgactatgtacaaagggcacagtggcttcgtgcagcggttttaggagccaatgatgggttggtttcggtttcttcattgatgatgggtgtaggagctgttaagaaagatgaaagggctatgctacttgctggttttgcaggattagttgcagggacttgtggcatggcgataggagagtttgtagctgtgtgcactcagtatgaagttgaggtaggtcaaatgaagagagagatgaataatgaggagaaagacttggagatggggatggagaaaagaggattgcctaatccattgcaagctactttggcatctgcagtgtccttttctataggtgcattggtgcctctactttcagctgctttcatagaaaactacaggactagggttattgtggttgtggcaatggttagcttggctttggtggtgtttggaagggtggtggctcagctgggaaaaactcataagatgaaatcttgtgtaaggttccttcttggaggatggatagccatggctatcacttttgggttgaccaaattacttggtgctaaagctttagataaagaataa

SEQ ID NO: 39422 - DNA, 615 bp, Glycine max
  Peptide Sequence Number=SeqID_156200
atggccaaccttggagctagaaccaatggaatttcatcaactaaccaagtggagattcctatgcatgtgtatggtgtggaaccaacacaaagtgaagagagccacatagactactctcagagggctcagtggcttcgagccgcggtgttgggagccaatgatgggttggtctcagtttcctcactgatgatgggtgttggagctgttaagaaagacatcagtgccatgattcttgctggttttgcaggattatatgacatagagaagacacagctcaaaagagagagggaagctaataacaatagaggagttaatgaagaagctcgaagggggaagcttccaaatccatttcaggctgcactagcatcagcatttgcattttctgttggtgctttggtgccaatgcttgctgctgtgtttataaggagtcacaaggttagaatgggagttgttgctgctgcagttagcgtggcatcgttgatgtttggaggggcaggagctgttcttggaaaaactccagtgacaagatcttgcattagggttctggttggaggttggatggctatggccataacatttggcctcaccaaattgattggctcttctgatctttga

SEQ ID NO: 39423 - DNA, 690 bp, Glycine max
  Peptide Sequence Number=SeqID_156201
atggccaaccttggagctagaactaatggaatttcaacaaaccatgttgagatccctatccatatttctaatggtatagagctaaaaccaatctaccaagaggttgcacttgaagagagtagcagcattgacttctctcaaagggctcagtggcttcgagccgcggtgttgggagccaatgatgggttggtctcagttgcctcactgatgatgggtgttggagctgttaagaaagacatcagtgccatgattcttgcgggttttgcaggattggttgctggggcttgcagcatggcaattggagagtttgtatctgtgtacactcagtatgacatagagaagacacagctcaaaagagagagggaagctgataacaatagaggagttaatgaagaagctcgaagggagaagcttccaaatccatttcatgctgcactagcttcagcactagcattttctgtgggtgctttggtgccaatgcttgctgctgtgtttataaggagtcacaaggttagaatgggagttgttgctgctgcagttagcttggcattgttggtgtttggaggggcaggagctgttcttggaaaaactccagtgacaagatcttgcattagggttctggttggaggttggatggctatggccataacatttggcctcaccaaattgattggctctgctgatctttga

SEQ ID NO: 39424 - DNA, 518 bp, Glycine max
  Peptide Sequence Number=SeqID_156202
atggcttttcttggcactagtagcaatgaaatgccaattggccatattgagattctcatacattctaatgatatagaagcaaagcgtagccaagacattgcagaaaacaatattgactactctcaaagggcgcagtggcttcgagaagctgtgtttggagccaaaaatgggttggtcttaatcaacttactgatggtgggtgttgaagctttgaatgaagacatcataatcatgcttcttgccggcttcgcaggactagttgttggggcttgcagtatggcaattgaagaatttgtatacactcagttagttagacacggagcatcagcaattggattttctattggtgcagtagtgtcaatgctagcagctgtttttgtttgggactataagatcagattgctagtttttgctgtgcctatcttggcattgttggtatttggaggtgtaggaatagttcttggtaaaagtaaaacaccagtgagaaggacttatgatcgtgatagtgctgattggag

SEQ ID NO: 39425 - DNA, 261 bp, Glycine max
  Peptide Sequence Number=SeqID_156203
atgaaacgtacctttcatgcggaccaagaaaacaacctcacaagaaaaaatattagcaggaatggtgtgatgaccactattaaggagttagagaaactcagaggatttcttccactcctaatggtgatggaagtttgcttgtggggcttctatggaggctggatctttgagcttcaatggggtcctttaatagtgattttccaccatggagatgcagcggaagacaaaggaaaagaggtgagaggaggcgccatccattaa

SEQ ID NO: 39426 - DNA, 384 bp, Glycine max
  Peptide Sequence Number=SeqID_156204
atgtcgcatatgatcactcttcatggcctaacagcttcttcaacccgttgctcctacgcctttaatgactccaattctcgtttcaaggcattggcagttcctaccagagtggctagcgtctttgccaaggttaagagtaaaagttcaacttcctccgagtccaacaactccgcaattgatttcagcgaccctgattggaaaaccaagttcaaggacgactttgaagaccgtttcagactcccccatgtcactgatatctttccggatgcagtttctatgccctctacgttctctcccaacatgaggttgcggaatacaacccagtccatatggactaataattttaagacaattatcatatggacaggggatccggatgtgtag

SEQ ID NO: 39427 - DNA, 231 bp, Glycine max
  Peptide Sequence Number=SeqID_156205
atggatggtcctaggattgcccatgctaccttgaaaggtccgagtgtggttaaggacatcataattggaataacacttggcttagctgctagtggtgtgtggaagatttctacatcggtcgtgctaataaccgatgtagaatgttacatcggttattacaatggccgatgtagaatgatgactttctacatcggttttcaggacaaccgatatagaaatctggcattctaa

SEQ ID NO: 39428 - DNA, 359 bp, Glycine max
  Peptide Sequence Number=SeqID_156206
caactgctggcgcattccgtgctctttcggctccgtgtcgtttccgtcctcgctttgatcctttcgtggactgcccccgcgaacgccgcgctgcgagctccgcagtttcgtttgcttctcctgctggcggtggaaatggcgatgctggaaccgacgacggttgcggttctggcagtgagtctggagatgctaatctcaaactggtaggagacgtgggtcaagagctttttcgactttcgcctgatgttatcattctcgatgtttcggaatctggtttgagacatgctttggatggtcctgatagcatgggattcgattctcttatttccatagagaatgagaggtccctcatggaacgt

SEQ ID NO: 39429 - DNA, 1044 bp, Glycine max
  Peptide Sequence Number=SeqID_156207
atggctcacaactcagacagtgccacctccaaccttcttctctgttcggagaacagcagcacctgcttcgatgatgatttggaatgttgtgatgccgcagatgggtccaactccagaatctcgcatcagttctgggaccaccatgagggtggtggtggtggtggatcggagttgttggcgtgttttgtggcgcagagtgaggaaactgtgagggctatggtggagagagagagggagcatttgccgagggatgattacttgatgaggctgaggagtggggagttggacttgggtgttaggagggaggctattgattggatttgtaaggctcattcttattttggctttggacccttgagtttttgtttagctgtgaactacttggaccgcttcctatcggtttttgatttaccgagaggtgtgacttggactgtgcaattgttagctgtagcttgcttgtcgattgcggctaaaatggaggagatcaaagtgcctcaatccgtagatttacaggttggggaaccaaagtttgtgtttgaagctagaaccattcaaaaaatggaactacttgtattaagcacattgggatggaaaatgtgcgctataactccttgttccttcatagactacttccttggcaagatcacttgcgagcagcatccagcaaaatcatccgtttcaatatcagtgcagctcatccttggcataatcatgggtattgactacttggaattccggccttctgaaattgctgccgcggtggctgtttctgttttaaaggaattgcaagcgatagaaattgataaggccataattgatctcttagtagtagagaagtggagagttctgaagtgtgttgaattgataagagatttgtccttgatcaatgttgctgctagtttaggcagcaagtcagattatagaaacagctacaaatacttgggacatgcgattggtggagaaaattttgatgaaacaatgttgaggtggcacaaacacagaatgtcacagtatgaatgtaatatttggagaggagagccataa

SEQ ID NO: 39430 - DNA, 234 bp, Glycine max
  Peptide Sequence Number=SeqID_156208
atgaaatacacatggaaaggagtgcaagagttgaagcctgccatgttgatggtgctagcgcaggttgcagctgcttctgtgaatgtgctttacaagctttccctaactgatggaatgagctttagaaaagaacaggccaaagttaacatggagggtgctcttgatgtcattattttgcggcatatatgggtatggttaaactcttcagtcttcaaccctttgccatggccatga

SEQ ID NO: 39431 - DNA, 222 bp, Glycine max
  Peptide Sequence Number=SeqID_156209
atgccaacacaaaggatcctcatattgagacactacaaagaagacctgaccaggaggaaatctgggcattttgcatcatccattggaaccagcgagtgtaagtccttccatgtagatggaagctatgagatggagggttggtcgaggacgatgaagcttaagagttttgattatgttcaacaattgatatccattggagcagctcatcaagcttggtcgtga

SEQ ID NO: 39432 - DNA, 312 bp, Glycine max
  Peptide Sequence Number=SeqID_156210
atggcattgttagagcatgtgcctttatctgtgattctgcatattatatgtgctgcaaataaattgtgcaaggaacaaatagaaagaaagaaaacagaatatggtgaaagaattaaaaacaagatatcctcagttcacaaggaagcagaggagaaaagggcaatggttcaagccaagaatgatgaagaggttctgaagcaagaggaaatggctagaaaacattgtgcaactgccaacaggaaccactccaaagaagacactagtgttttttgctttttgggtccgaacgctgaagtcatagttaatatataa

SEQ ID NO: 39433 - DNA, 192 bp, Glycine max
  Peptide Sequence Number=SeqID_156211
atggagcacagggaaaggcattgttctaagactagtctgcacaatttgtttccccttctcaaagggtataaagtcccagcttcgtggcccaagagcagggaaaaggtagtaaatggacagcagcgtgaagaaaggcccaagaggaaaacgaaagctccaacgtacgtggaggattacgtgggaatcgggtag

SEQ ID NO: 39434 - DNA, 1193 bp, Glycine max
  Peptide Sequence Number=SeqID_156212
atgaaggataggcaacgttggagagctgaagaggatgctttacttcgtgcatatgtcaaacagtatggtcctagggaatggaatctcgtgtctcagcgcatgaacacacctcttaacagggatgccaagtcatgcttagaaaggtggaagaactacctcaaacccggcattaaaaaaggatctcttactgaggaagagcagcgtctagtcatcaatcttcaagcaacgcacgggaacaagtggaagaaaattgcagcacaagtccctggtcgcactgcgaagaggttagggaagtggtgggaagtgttcaaagagaagcagcaaagggaaaccaaggggaatagctgcactattgacccaattagcgatagcaagtacgagcatatccttgagagttttgcagagaaactagtgaaagaaaggccttcaccatcatttgttatggctacttctaacagttcttttctgcacgctgatgcaccggctcctccaccggccttgcttccatcttggctttccaattccaatggcactgcacctgtgaggccaccttccccttctgtgactcttagtctttctccctcgacggtggcagcgcctcctccatggttgcagccccctgtgagaggaccggacaatgctgctcctcttgttttggggaatgtggcgcctcacggggcagttctagcatttggtgagaacatggtgatgtctgagttggtggagtgctgcaaggagttggatgaagtgcatcatgctttggccggacataagaaggaggcggcatggcggttaagtagggtggagctgcagttggagtccgagaaggccggccgaaggagggagaagatggaggaaattgaagcgaagatcaaagctctgagagaggagcaaacagctgcattggatagaattgaagcagaatatagggagcagttggcagggttgagaagagatgcagaaagcaaggagcagaagttggctgaacaatgggctgcaaaacacttgcgccttactaagtttctagaacaggtagagaaagaaagtgttggagaaaaactaggggatagtacgaagcatgaggagtctgttggctacaatttcggggataatgacacaaaaaggatgggttacggaaaggaaaagtggcacaagagaattgttagggtcttttacaagaaaaagtctcctgg

SEQ ID NO: 39435 - DNA, 357 bp, Glycine max
  Peptide Sequence Number=SeqID_156213
atggatagtgccaatagttgctaccaggccatcgatgcggctgggatgttgctgtgcaacgaggctttgctcttgggatggcttgctgctaaagagttcaaacacaaaagctaccaacagcaaatgaaggcatctcaaattaaatggacaaaacctcaccaaggattcttaaagtgtaatgtggatgctagcttcgacaactcaggtaattatactagttacggtctaggcatccgggatgacataggtgggttcatgatggaaaaaacagagtggagtgtatcatgcattccagtgttagaagaaaaggctttgggtcttctgaaagctctcaagtgggggtggagttggatctga

SEQ ID NO: 39436 - DNA, 489 bp, Glycine max
  Peptide Sequence Number=SeqID_156214
atgggtttgggttttcgagcatcgttgaggtcttccatgacccacttgtctaagaacaattatttaactgaggaggttccaccttctttgatgtccttgcctagccttaagaatgtttctttggattataataagcttgatggtcttgttccctccattgggaagggggatgatccttgtcaagatcaaggtcaatattatcggagtttcattgtatgttcaaagaggaaggttattacagtgaatttggcaaaccaaaatttgacaagaatcatatcacttgcatttgctaatttgaggaacttgtatcttaatgataataatttggtgggtccaatactagggagctcaagcttgacaaatttgtctcatctttgggttttggatgtgtcaaataacaacatatctagtgatgttcccaagttctcaagcaaggtgaagttcactacttcaagtaatgttttgcttggatgttcgaagtggtggtga

SEQ ID NO: 39437 - DNA, 154 bp, Glycine max
  Peptide Sequence Number=SeqID_156215
gaaaaggccatttggtgcaagggaagctcgcccaggggagctggtttcttacagcttaaggtatcagctcgcccaggcgagctggttgcataaggatgaaggcattccatggcttaggcaagccagatgctggcctgggcaagctcaggcctag

SEQ ID NO: 39438 - DNA, 450 bp, Glycine max
  Peptide Sequence Number=SeqID_156216
atgtcttccaaatacattttcatgtgcctcctagtaattctagggatggtactttttgcaaccacttccctggctgatcatcatttactttcaacagcagaatctcctatgtcagaagttgtccatcgttatagttacgatcatgattataatcccaatcactattatgatcattatcataaccacaatcatcatcaccatcatcatcacaatcatcatcatgattttgatgatcacgatcataattgtggtgatgacaatcaagatcataatgataatcatggttatgatcaccagattcaaaacccacacgatggaaaacactggccttctaccacacaaaatgagccttcaaaagtagaaaacaagaagccacaagaggagcacagtgtcagctttgatcagtttggctttgttgaaggaataaagatgcgcatgctacatgcctga

SEQ ID NO: 39439 - DNA, 1014 bp, Glycine max
  Peptide Sequence Number=SeqID_156217
atggcctttcggactcagtatgggcattatgagtatgtagttatgccttttgggataacaaatgttccagccatattcatggattacatgaataggatcgtttattccttcttagacaattttgttgttgtgtttatcgacaacattcttatctattcttgttctcataaggaacacaaagaacatttaaggattatgttggggatcttaaaggagaaacagttgtatgctaaacttattaagtgtgagttttggcttgatgatatacaattcttgagtcatgtgatcttggttggtgggattgttgtggatctatccaaagtagaaatagttttgcaatgggagcttcctaagacgactacagagattaggatttttgttgggttagttggatactatcaaagaagattgcttggagagtttccaagagttgaagcaaaggttgaccatttctcatcttatgcatcgcatcagttgaaggttcatgagaaaaactgccctactcatgatttggagttagcaacaatggtgtttgctctaaagatatggagacactatctttatggagccaagtttgatgtgtttagtgatcacaagagtttgaagtacatgtttgatcagaaggagtttttgaaagattatgactttaagttgatgtaccatctaggtaaggcaaatgttgtagcagatgccctcagtaagaagatgatgcaaatgttggcgttgatgataaatgagttagagttgttggagaagttcaacgatctaaacttatgtgtggagttggtccatgatcacattagttgtggtatgatgaccatcaccggtggatttttggagatggttaaagataagcagttgttggatcctagcttatgcaagacgatagagatgttggaaacaaataaggttatggacttcaacatgggtgatgatggcatcttgaaattcaagggcagagtttgtgtaccacaatatcctaagttaaaaaggcatgtcttgacacattcttag

SEQ ID NO: 39440 - DNA, 132 bp, Glycine max
  Peptide Sequence Number=SeqID_156218
atgtttatctgcgatatcccacgcaaacctcccaagattcaacaggaacgtcttagcaaagctaaggtcactcccaagacattagctgatgtgaaatgtgacactttgatttcttataaaggaagcgtttag

SEQ ID NO: 39441 - DNA, 5149 bp, Glycine max
  Peptide Sequence Number=SeqID_156219
atgactttgccatctttcttgaccaacctacacaatgtgtttcatgtttcacagttgaggaagtatatttcggatcctacacatgttctagaattggacacggtgcaagtgcataaagatttgacctatgagactcaactcacgaggataaaggataaaaggatcaaacaacttagaggaaaaatcatcaatttgctcaagagcctcaacctagtgctggaggttgtggtggtgactaacagtgaaaaggcctatagaatggatgagtggacgaatccctacatagatgattgggctagagatgtaggagaaggccctagagttctcatgagccttaggcacaatttggggctttccggaaatccaattagggatttcaacggttcttctctccgttccgttctcgtttcgtcgcggaatcacaaaactgaaaacaatcaaacctggggagtgaaggttcaggcttcgatcctcgctccttgtgctgttgcctccttcggttctggcgctccgtcatggccgataacatggaaatcgatattccctccgattcccagccgctcaagcctcgcgatcgagttgttcgggcttgcccagtttggtgttcctgaggagcagctcgaccaacctggtttggttgcttttgttaaggataagagggcgttgatacctgagctggtgtctgtgatattgcctactgatgcggaagtggcagatgcatgggaagctaaattttcttctaagaagacggcggtgggtgtgatcatgaagaagaggtttaacgagagcatggtgtggttgcagtggttgatgtttgagggtgacccgggtggtgcactgagaaggctttccaagatgtctgttgggcagaggggtgtctgtgggtctgtttggggcaacagtgatattgcttacaggtgtaggacatgtgagcatgacccaacgtgcgcaatctgtgttccttgtttcgagaatgggaatcacaagggccatgattactttgttatatacacgggcggcggttgctgtgattgtggggatgtaaccgcatggaagcgtgagggattctgcttgatgcataagggtgctgagcagatacaaccgcttccggaagaatttgcaaactccgttgatcctgtgcttggttcccttttcaattgttggaaagtcaagctaacattggcgagtgagtcagttactgaaaaaaagcatgtagcaaatgagctaacttatgccgtggttgatatgcttctagaattttgcaagcatagtgagagtttgctcagttttgttgctaggttgttgttttcttctaatggtttaatttacatgctggtgagagctgagaggttcttaactgaggtttccatgtgggtaggtttatatgagacaacaatacgtgttattgaagatattcgatttgttatgagccatgtggtagtgcccaaatatgtaactaatgaccagcaagatatctcaagaacatggatgagacttctttcctttgtacaagggatgggccctcaaaagagagaaacaggtcaacatatagaagatgaaaatgagaatgtccatttgccttttattttagggcattctattgccaatattcactctctattggtggatggggcattttctgatgctagcaagggagaaatggatggagaaattgtttggagctctagtaagaatgattcagatgatggagataatctaaggcatgcaaaggtaggacggagatctgaggaaagctctgcatgtaatgtgaccagtaggaatagtgccttagcttctagaaagcttcatgagataaaagccgatgcctcttctcagctgcctcttccactttctgtctcttggttgatatacgagtgtttaagggctattgagaattggttgagagtcgagaatacccctggtgcaattcctaatgcaccatctccgaacagtggtgctgtctgtgatggcaatttttcagcatttaagagaacaatatccaagtttggaaggggtagatatacatttggtaggcttgtaagttctagtgaagatcatggtaagcagtgttctgaaaataatgaaattgattcagaaaatacctgtatgcgtcccacgtttgatgataatgccatggaagaagatttccccgtggaatcagatggtccgcgttttttgtcattgcctgattggccacaaatagcctatgatgttagttcacaagatatatctgtacacattccattacatagattgctttccatgctgttacagaaggcaatgaaaagatatttttgtgaatctgaagggtcagatgtgactcatgtttcttcagctaattcattgccgactagctacaatgacttctttgaacaagctttacgaggaagtcatccatatggtttctctgcctatataatggagcacccattgaggattagggtcttttgtgccgaagtccatgctggaatgtggcgtaaaaatggagatgctgctttattatcttgtgaattgtatagatcagtacgctggtctgaacaaggtctggagcttgatctatttcttcttcagtgttgtgctgcactagctccagaggatctatttgtcagtagaattctggagcgcttcgggctgtcaaactacttatgtctaaatgttgaacggtctagcgaatatgaacctgttttagtccaggaaatgcttactcttattattcagatagtaaaagaacgacgctttagtgggctaactactgctgaatgtttgaaaagagaactaatttataagttatccattggtgatgccactcatagtcaattggttaagtctcttcctcgtgatctctccaagtttgaacaacttcaagacatcttgaatacagttgctgtttattctaatccatctggatttaatcagggtatgtattctctgcgatggccattttggaaagaattggatttgtatcatccacgttggaattcaaaggatttacaagttgctgaagaaagatacatgcacttctgcagtgtctctgcactaaccacccaattgccccagtggaccaaaattcatcctcctttaagggggatagccagagtagccacttgcaaagttgttctacatattatccgtgctgtgctattttatgctgctttcacttttaaatcatctgaatcttgtgctcctgatagcgttcttctacctgctctacatttactgtcattatcattagatatctgttttcagcagaaagaatctagggagaatacatgccacgatgtgtctcatcttccaataatagccttctctggagaaataattgagagttctttcggtgaacaaagcttgttgtcacttcttgttttactgatggaaatgcacaggaaggaaaatgtcgacaactttgtggaagcaggtggttgtagtctatatactctgattgaaagcttactgaagaaatttgctgagattgacaacagatgcatgactatgttgcaaaaacttgcccctgaagtggtcagttatatttctgaatatgttccgactagagactcaagtgtctcatcgtcggcttctgatagtgagaaacgcaaagcaaaagctcgagagaggcaggctgcaataatggaaaaaatgagaacccagcagtctaaattcttggccagcattgattccactgttgatgatagttcacaacttggtcatgaaggtgacttagacactgagcaagatgcagaagaattcgattctaaacaagttgtttgctccctttgtcatgaccataattcaaaacatcctatctcttttttgattcttcttcaggtatatggcagtagcataccagctaaatctaggcttgtgagttccgttcaccggggtcctccatcgtgggcccaactttgtcgatcagataaagatcacacacctatcattaacaccaaggagacggatacattgcctatgaactgtaattcagttagttcaggatcaacttcatcttcccacttaagtcaatttgttcagaatgctgcgaaagaattagcttcttgtgggaaacctggggaagctcttacttttctgcaatatgtcaagaataagttcccagctttgtcaaattttcagctcccagacacatattatgatgaaaaagaaaatacaccatatacttttgagactttagaacagggtatgtacttctccatttgtgctgaaatgcatgatcttctgttatcttcgaatttgatgaatgaggatgagaaagtttcaattgctggagggagttcaaatcttataatagacactggatctgtattgcttgggaaatataccgccgatcttctgcaagagatgtcagaaatttcttctgtgtctgaaagtgcttctaatgagactgcttctgtagaatcaacatcacagcatccagcatatgatggatttggccctacagattgcgatggagttcatctttcttcctgtgggcatgcagtacatcaagcgtgtcttgatagatatttatcttcattaaaggaaagatctgtcagaagaattgtttttgaaggaggacatattgttgacccagatcagggagagtttctctgcccagtgtgccgcagacttgcaaattgtgtcttgccaactttacctggagaattacagaagccttttaagcagtctaccatcttgagtactgattcaataaatactgcaccccccttagctgaattgagtgaattgacttattcacttcgcctccacctaggcttaaagcttctgcaatctgctgccaatgcagttgggaaggataaatttctaaatgctattcctttgcatcacattgatagaactagaacaaatcttgaaaacttcatacggtggctttctaaaatgtattccccttgcaaagaagagaagctatcaagattttccagactaaaccactcaatgctaatgtgggacactctcaagtactctttgacatcaatggagattgctgcccggtgtggaaagacttctttaactccaaactttgctcttagtgcattgtatgaagaactcaaatcttcaagtggctttatcttatccctgatgctgaaacttgttcaaaagacacgaagtaataattctcttcatgtgctacaaagatttagag

SEQ ID NO: 39442 - DNA, 957 bp, Glycine max
  Peptide Sequence Number=SeqID_156220
atggaacgtggggttcttgatggtatcatcagtcggctgcttcaagtcagagtgagacctgggaaacaggttcagctttcagaggcagaaatcaggcagctttgtgcggtttccagagatatctttttgaagcagcccaatctgttggaactggaaccaccaattaagatatgtggagacatccatggtcaatattctgaccttctgagactttttgagcatggtggattgcctcctcgctccaactacttattcttaggcgattatgtcgaccgtggaaagcaaagccttgagacaatatgtcttcttttggcatacaagataaagtaccctgagaacttcttcctccttagaggcaatcatgaatgtgcttccataaaccgcgtctacggcttctacgacgaatgtaaacggcgattcaacgtcaggctatggaaaatatttgcagattgcttcaactgcatgcctgtggcagctatcattgaggaaaagattttctgtatgcatggtggactctctccagaattgcacaatctaagtcagataagtagtttgccgcgtccaaccgaagtacccgagagtggtctactatgtgatctcttgtggtctgatcctagtaaagacattgagggttggggagacaatgagcgcggagtttcttatacttttggtgctagcagggtgacagaatttcttggaaagcatgatcttgacctgatttgtagagcacaccaggttgttgaagatggatatgaatttttttccaatagacaacttgtgactatcttttctgcacctaactactgtggagaatttgacaatgctggagcaatgatgactgttgatgagacacttatgtgctcttttcagatactaaggcctgtggaacacagaaagcctaagtttggttttgggagcaaaactacattcaaggctagtacttctaacaaaatcttg

SEQ ID NO: 39443 - DNA, 696 bp, Glycine max
  Peptide Sequence Number=SeqID_156221
atgtctcacaaaaaacctataaaggagcattggcttgtcttgcgaatgaacacatacaagataaaaacaaaaaggaaatttggctatggcataggcgattgggacatccctcttttggttatctataaaagtccttattcaccacaacaaaatggagcggataagaggaaaaatagacatatattagaggtgacaaaatcacttttgatagatggtaatgcgccatctcatttattgggtgaggctggaggaaatgaaagtgaattgcataatcataatgttagtatgtttgatatcttagatataaaattatattgtgaagataaattatcgtgtgaagaccattctacaggaagtgagccaatcctaaagatggacacttcttttttggataatacaatgtcttctcatcataaccaattggctcaatcttctccacaggttcggcttgactcttcagaggtaccttctgatcctatctctgataatactaatgcagatgaaattgatcatgaaattgtttctcttaatcccacccttgataatactaatttagatgaaattgatcatgaaattgatccttgtctgtgtgagaccaccagtacaccaaacattgagtctactactgtccaatataatcttccacctcgctctaattgtggtcaacctccagctaaatatgaaccagacctctaa

SEQ ID NO: 39444 - DNA, 1186 bp, Glycine max
  Peptide Sequence Number=SeqID_156222
atgtggaatgcagctgagtttttccctgatagatcagaagttcagtgtctgcacagatggcaaaaagttcttaatccagaacttgttaaaggaccttggacacaggaggaggatgataaaattgttgaactggtgtcaaaatatgggcctacaaaatggtctttgatagccaagtctttacccggtcgaataggcaaacaatgtcgagagcggtggcacaatcatcttaaccctgacataaagaaggatgcctggactttggaagaggaattgtccttgatgaatgctcatcgtatacatgggaacaaatgggctgaaatagctaagggtaaggctgcgtacaacatccctcccccataccttcgcatagcgaagagcctctggacaatggggactgataatgcaataaagaatcactggaatagttctttgaagaaaaagttggatttttatttagctacaggaagacttccaccaattcctaagaatagtccacaagttcctgtcaaagatacaattagacgttctgctagtaaatcaatacttggttgttcaaataaagaattaaatgcagctgttgaaacatcatctgaaactacatccattagtaagctagatgaccggggcaggaatcagtttgagtcctctggcacagttagagaagttggtgattgttcaagtgttcctgcaaatgaatctgctgattctgactgtgtagaatgcaagcctggatcatcaaacattgatctcagctgtagcaactcagaacaattgtctagagctaattttggaacaacttttgggctaatatctgagaattctggaatcaatggaaactcaaattttgagcattgtacaaacaatggtgacatgagcagtaccaggttaattggaacatcttctcaagaaagccctacctgtggttctttgtgttatgagccaccacagttagatggttcagttcccatagattctctttatttaaattatatttgccagcagaatgagtactgtccgagtccaacaatgtcacctattggtttcttcactccacctcgagtgaagggtagtcaattatgcactgagacacctgaatcgatcttgaaaaaggctgctaatacttttccaaatactccttccatattgaggaggagaaaaactggggcccaaacactcaccagtccca

SEQ ID NO: 39445 - DNA, 493 bp, Glycine max
  Peptide Sequence Number=SeqID_156223
atggtgaaccttgagtttgacaagccttttggagaatcaacctataggattcaccaagggcaaacattggactcgccacatgaagtcgccgggttgaaaggctcgtggttgaacctttgtattgtatcttcttgctgctcggagcttagtaacttcttccctgatcctggccatgtcttggactttgtttgttgtctcgagttctaccctcatgttttcttcattttgctaatgctggaacaacaacctccttgtcaatggttcctcgacttcaatggggatcatggcgtctgtgtcatatgtgagtcgggccctaaggatgactctattggctgcctcttcctggccattggtctagggatgttcaatagaggtgtccttgtcgatgacaatggcgtatgggaggctatacctgcatatgagatgtttccatgtgagctaatgactttgttagcaactaagaaatatgggagtagcgatactccaagcctag

SEQ ID NO: 39446 - DNA, 675 bp, Glycine max
  Peptide Sequence Number=SeqID_156224
atggttgctaatagagtgtgtccgcgtttactagtgtgggatgctagaaagaaaaagggatttgagttgtattacaaagaagagatgcctacaagaaaaatgaagttagattgtgtggatggactctcaaaaacttttggctatgatggaagtgacaatgttgtgcactacaatgttattcgggtgttatgtcctggtaagaagtatcactatgatgatgcttgcattttctttaccaaagatgttgataactactcagtcatacaatgtcttctcaagcttccaaccattcagtataagggcacctacaatttgaaaaagatatcagaggaacagatgctagctgaagcatttactaaagttgtggacgacaccattgtgcgtggggtcatcattgatcttacaaacactataccaagaaaagagcgcaaaaaggtcttttccttggttttcctagaccctagctcgcccaggctaacctttggctcgcctgggccaccaaatgactacaaggttaagaaaccagcacgcctgggtgagctcatgactttaggactaagccatagctcgcttgtgcgagctacaattgccctaagtgacccttttcctataaatgggtgtgctaggggggctaagaaggggttccagcatggagtagtgaaggaaattgagtga

SEQ ID NO: 39447 - DNA, 291 bp, Glycine max
  Peptide Sequence Number=SeqID_156225
atgtactttcagggtcaatggaggcaagttcctaggcttcatgatcacacatcgggaatagaagccaacctcgacaactgtacaactatatcggagatgcatagtcccactaacctcttggaagtccagaagttgaatgacctggaaattcctatgggcctacaagtgaaatccaaatttgatcttcaagaagcaaaggactccattgatgaagaagatccaaggcctacaagctctacatggagctacatcaattcctatgggaaaagacctggaaataagccttcttag

SEQ ID NO: 39448 - DNA, 1923 bp, Glycine max
  Peptide Sequence Number=SeqID_156226
atggacgagtgttgtctggtgctgagagtggtaacctcaataggggtgagaattgcaggttgcttctatcaagttgtccgaggtgggcatgcttttggttttgctagtgaggtctatcgtgtcaggcaagacactcgccatggtgcctctaacaacgaatcctcttccttggagaggttggggtttcacatcgtgctggtggaggcacttctcgcctctacaggagggcgcaaccttctactgcttcccagagcaaggaagagtgatgatggggatgttagggcgtccctccgcgtgcaacgtagccatagtgttgggtcgccatcgtttctccctgtcattgctagctttgagtgggtaaaggacgatgtcctgaagtacaattcctccatcacctttgcggcgagtgtcacaacactgcaatgccaagtaaaatttgtaaaccatgagaacttttgcaagatagtcgtccaggcttgcaggagtgacgaatttcctttcctgagagctgcatcggatatgttcttgtatttcttccaaatgaagctgacaggcaagattggttgggtctctttgaataatgtgtccaagaagatgtttgagtttgactcaaacgtctttcgcaatttcaaggaccgtttcttcaaggtcctagctactgacatcgtggctgatgcctcgttggacgcgcgtgccattctacttctcccctcaatgagcgatgcccttgttgccatggacaataaatgtattatgggtgactttgcttggaggccacttgtgaagcaggttggacctattggtggggctgtgccatcgtccattgtcactcctactgctggagaaaggggtcaacctgctgttgaggttggccttgttgctagtgttgttgtcatcgcccccgatactctttcctttgttttggctaagaggaagcgagatgaggcattggggcaagtggtaggattgacccctcccccgtcaattgaagtttctactcctgctgttgttgttgttgttgttcctattgttgcttttgtttcttctcctccacctccttctgtcacgcctgctaaggagaatgctctggctgctgaagttcgtgctctggctacttcaacagacacaatcatggctactgtgtccaccattgttgcacctttactgagtgctagtgtgacaaccacaagtgctcatgtgatgtcgccttttctttctttgggtccactggttcctccctctagcgtgttggcgtcgacgtcgacttccacctctttcacctccatgtttccttggaccacatctacgcctccaacaatgttgattccctgtgagggtgtcgcatgccacaaattctgccaaggtgtttcttcaacaaagtttggcaattgtggaggagaatggacaactgcaccaagaggatttatgcaaagtggtgtccttggaggtgaaggtcgccaaatagaggctagtgccatcgtcgccttcgctgaagctatgaagttgaaccaccaatcgtcttccaaggttggcagtgttttggccaagttactgcgcaccgggttggacggtgatgaactgttcaaacactgcaagaacttacataaggagaaaaaggacttggctggcatggtggaaggaattgcggcggagaaggatgagcttgccaaggctaaggagtctgagctgcgagcaactatggagaggaaggccaatagggagcttgaagaggagctgataatgtacaaggaggctatggagcatcatgaaaaggactttcaaaaatccgttaggcaagccgggttcttcgccaaggactttgacttgacttttttttaccctttcaatgacgtgaaggatgatgttttgcttaacgaggaagatattgttgctgaggaggatgctgatgatgccaatgtttag

SEQ ID NO: 39449 - DNA, 345 bp, Glycine max
  Peptide Sequence Number=SeqID_156227
atggctgaggtggtgaaatcagaggagtgttgtcaggagaataagcaatctactgctgcttcttgctcctctgtatctgaaggcagtggcagtgcaattcacaagtctccggcgatatgtagccccgcatccacatcaccctcacatcggaggaccactggccctataaggcgtgctaagggtggttggacagcgcaggaggatgaaacattaaggaatgctgttgcagtttttaagggaaagagttggaagaaaataggttggatagaattctcatgtggagctggagctgctcaaccccttggtgacgatatgcgtgagttgtccttgagtgggcacatgtag

SEQ ID NO: 39450 - DNA, 276 bp, Glycine max
  Peptide Sequence Number=SeqID_156228
atggaggttgagaagatggtgatgaagatggaagaggtggtggtattagagccaagggcattggcattcggcaaaggactccaaggcttggccaatcatatcttggacttgatcatgagtgacagtggcaacctacccttcgacgagcgactccaaaaggattgggctagagctgctaaagaaggccctggggttttcatgaacctcaagctaagctctagcttctctaggaatcttctcaaggaagcttctcaaggaggtgaacttagttattag

SEQ ID NO: 39451 - DNA, 234 bp, Glycine max
  Peptide Sequence Number=SeqID_156229
atggtatcaagcatacctctcggcgcaatccatatgttttggtggaggctaagtttttcagaccaagggttatctaagcctaaaatcagcataaacgaagagatggaaagcatatccaagcgatttcaagagcttgatgtttgtggcaaaattactctaaagagtaaacttcgagaaattgcctaccttgatgtaaactctatgagtgctccttcagaaaaggtcaaaacataa

SEQ ID NO: 39452 - DNA, 912 bp, Glycine max
  Peptide Sequence Number=SeqID_156230
cttcagcccttcctccagcagcaggaaggccagcgccccggcgaccgggccgaccactgtgcccagtccgcccagcgccaccatcacgatcagttcgccggaggtggtccaggccaggtacgaaggcgatacgtacagcgtcaggttggccagcagcacgcccgccacgccgcataccatcgccgacagcacgtaggccgccaggcgatagcgcagcgtcgcgaagcccagcgcgcgcatgcgccgctcgttggcctggcagccgcgcaggaccatgccgaacggcgcctgcaccaggcggcgcagcgcggccagcgccagcagcagcacgccgaacgcggtgtagtacagcgccagcggcgtatccagccggaacaggccgaagtcgctgccggcgaacagcgacatgccgtcgtcgccgccgaaaccttccagcccggtggccaggaaatagaacatctgcgcgaacgccagcgtgatcatgatgaaggcgatgccggacgtgcgcatgaccacgtagccgctcaccaggccgacggccgcgcaggcgcccaacgcggccagcaggtgcagccagccgttctcgatgccgtagtggttcagcacgccgaccgcataggcccccaggcccaggtacagcgcgtggccgaagctgaccatgccgccgtagcccagcagcaggttcagcgccagcgcggcgatgccgtacaccagcacgcggccgaacagcgccagcaggaagggttcgccctgccattgcgcatacagcggcaccagcgccaggagcagcaacagcgcgccggcggcgaacgcgcggggagagagtcgaagcatgtgttggcctccttgggcgctagccgtgccgcacgggaaacaggccctgcggccgcagcgccagcaccagcgccatga

SEQ ID NO: 39453 - DNA, 270 bp, Glycine max
  Peptide Sequence Number=SeqID_156231
atggaacacgcattccgcgagtcacgcgtcgccctcccgtcgaagggtaggttgcgacaggttgtcctagtaatttcattgatatggtatggcattgtctctcctcctttagaattagaatgtcgtggaatggtgatgttcttggtgagtttaggctggggagaggagtcagatagggagatcttatatctcctgtttgtgctttatattgaaagattatttcatttgatccagattgaggttgaggctaataagtggaagcctatttag

SEQ ID NO: 39454 - DNA, 495 bp, Glycine max
  Peptide Sequence Number=SeqID_156232
atgggtccagaactgaccggctcgcacgtgattggtctcgagcgtggctcatccaccatttatcacggcgaagtcggcatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 39455 - DNA, 714 bp, Glycine max
  Peptide Sequence Number=SeqID_156233
atgaacggccctggtacaaagaaggaaataggccaacctagtgggaccggcaaggatgcagatcatgatgaaattctgaaactgatccagaagagcgagtataaagtggtagaccagctgctgcaaactccctccaaaatatctatcttgtctttgctgttgaactcagaagcacaccgtgaggctctaatgaaggtgttagaccaagcttttgtggaaaaggacgtgactgttaatcagctggacagtatagtaggaaacattactgcatgcaataatttaagtttcagcgatgaagagcttcctgaggagggaagaaaccacaatctggcgttacacatatcagtgaactacaagtctgatgctttgtcaaatatacttgtggacacttgttccgcattgaatgtaatggccaaaacaacattagatcaactctcctaccaggggccttccatgagaagaagcggggtagtcgtcaaagcttttgatggatcaaggaagtcagtcattggggaggtcgacttacctattataatcggaccatctgttttccaaattacattccaggtgatggacatccgtgctacatatagttgtctgttgggtaggccgtggatccatgaagcgggggccgtgacatcaaccttgcatcaaaagctgaagtttgtcagaaatgggagattggttattatgagtggagaagaagctttgctg

SEQ ID NO: 39456 - DNA, 645 bp, Glycine max
  Peptide Sequence Number=SeqID_156234
atgccatcgccgcatcgtcgagactcgcgccgagctcgacaaccaccggctgctgctcagccgtttcgccgaccacgccagcgacgcggcgccggccatgctgttccagttgcagggccgtattctcgacgtgccgccgcaggatggcgtgggcgaggccatggaacggtccatcctcgacctgatgcgggaacaggcgcagcggctgcggcagtcggacgatgcgctggcgctggcccgcggcgcgctggaggaacggcgccgcgtcgagcgcgccaagtggttgctggtcagccgccacggcctgagcgagcaggccgcgcacgatcaattgcagcgcgtggcgatggaccggcggcgctcgctcgacgacgtcgcgcggcaggtgctggccgagctggacgaggccccgggctgaatggcggaaaggcgcgctgcgcggctacgccgccggcacctcccacagcgcgtcgggcaggaagccgtcctgttcgcccttcctggcgtagcccagcggattggccaccacgcggcagccgtccttcacgtagtccagcggacagtgcaggtggccgtgcatccagacgtccgccaacggtagcaggccgtccagcgcattgcagaagccggccgtgcccggcgtga

SEQ ID NO: 39457 - DNA, 138 bp, Glycine max
  Peptide Sequence Number=SeqID_156235
atggacatgatcatggaaattggaacatactcttcttttgagttgaattcaagcggagccagaacttcttcagtggagagacaagggattgcagccaccccatttggtgaagaagtgggtgtgactcatgcagaagaa

SEQ ID NO: 39458 - DNA, 810 bp, Glycine max
  Peptide Sequence Number=SeqID_156236
atgctcaaccccaggcaccgcctgtggagcgacggccgctggaacaagctgaccgtggcgcatggctgttactggaagaagtgcagcttctgtgatgtcagcctggactacattggccgttacgaaggcgcctcggccacggtgctggccgaccgcatcgaggccatcgtgcaggaaaccgggcagacgggatttcacttcgtcgacgaggccgcgccgcccaaatccctcaaggccctggccacggaattgatcgaccgcaacgccggcatctcgtggtggggcaacatccgcttcgagaagaccttcactcccgagctgtgcgaactgctggccgacagcggctgcatcgccgtctccggcggcctggaggtcgcctcggaccgcctgctgaacctgatgaagaagggcgtatcggtcgaccaggtggcgcgcgtcacgcgagccttcaccgacgccggcatcctggtgcacgcctacctgatgtacggttttcccacgcagaccgtgcaggacaccgtcgacgcgctggaatacgtgcgccaactgttcgaaaacggctgtatccagagcgggttcttccaccgcttcgcctgtacggtgcattcaccggtcgggctgaaccccgaggaatacggcgtgacgctgcggccgctgccggacgtgacgttcgccaagaacgacatcggcttcgacgacccgaccggggtggatcacgacgcgctgggacgggcgttgaaaaaggcgatctacaactacatgcacgggatcgggctggacgaggacgtgcgcagctggtttccgttcaag

SEQ ID NO: 39459 - DNA, 819 bp, Glycine max
  Peptide Sequence Number=SeqID_156237
gttatcactggcatcgcacttcctgttggatccgacaaactttattctggcagcactgatgggacagttaggatatgggactgtcatactggtcaatgtgctaaagtcatcaaccttggtgctgaggttacctctttgatcagtgaggggttatggatttttgttggtctgcaaaatgctgtcaaggcttggaatatccagaccatgtcagagtttactcttgatggacccaaaggccgagtccgtgccatgactgttggcaacaatacactctttgctggtgcagaggatggtgtcatttttgcttggagaggaagttctaaagccgattctccttttgaactggttgcgtcactcactggccacactaaagcagtggtttgtctggcagttggatgcaagatgctgtactccgggtccatggaccaaagcataaaggtctgggacatggatacattacagtgtacaatgacacttaatgatcatactgatgcagtcacatcccttatctgttgggatcaatatctgttgtcaagttcatctgactgcacaattaaagtctgggcatgcattgaagcaggatctttggaagtgatatatacacacaccgaagaaaatggtgttgtttcactctttgggatgcctgatgcagagggaaagccaatattattttcctcgtgcagagacaattcagttcacatgtatgaattgccttcattttcagagaggggacgtttatttgccaagaaagatgtggcattgattgagttaggtcctggtggcctcttcttcactggagatgagagtggtttgctgatg

SEQ ID NO: 39460 - DNA, 162 bp, Glycine max
  Peptide Sequence Number=SeqID_156238
atgaaagtaagaaaagaatatttgaagttccatgacgataatctagagggctcgatggaaacaaatggagatggtttaagggtgggaagggtcagcaggagattctcaagtattgtgagatgctttgcatcgtcaaaactgtctccatattccaaatggtaa

SEQ ID NO: 39461 - DNA, 616 bp, Glycine max
  Peptide Sequence Number=SeqID_156239
ctgcattcccaaacaactcgactcgtcgaaggagcttcacacgggcgcggacaccccatcccagacgggattctcaccctctctgacggcccgttccagggcacttagacaggggccgcacccgaagcatcctctgcaaattacaatgcggaccccgaaggagccagctttcaaatttgagctcttgccgcttcactcgccgttactgaggcaatcccggttggtttcttttcctccgcttattgatatgcttaagttcagcgggatcggacgcggtgccgccgctgcctttggggcccgtcccccccggagaggggacgacgacccaacacacaagccgtgcttgatgggcagcaatgacgctcggacaggcatgccccccggaataccagggggcgcaatgtgcgttcaaagactcgatgattcacggaattctgcaattcacactagttatcgcatttcgctgcgttcttcatcgatgccggaaccaagagatccattgttgaaagttttaactgattgcgatacaatcaactcagacttcactagatcagacagagttcgtggtgtctccggcgggcgcgggcccggggctgagagcccccggcggccatga

SEQ ID NO: 39462 - DNA, 663 bp, Glycine max
  Peptide Sequence Number=SeqID_156240
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccggggatgtga

SEQ ID NO: 39463 - DNA, 237 bp, Glycine max
  Peptide Sequence Number=SeqID_156241
atgaagaacgcgttcaacaagaaggtgcgctcgcgcaagttccatgagggggaccttgtgctgaaaaaggtgtcccgcactgttaaagataatcgagggaagtggggcccgaactacgaagggcctttcattgtaaaaagggctttctccaaaggagccctggtgctcaccaacatggatggcgaggagctaccttcaccagtgaactccgatgttgtcaagcgatactacgcttag

SEQ ID NO: 39464 - DNA, 462 bp, Glycine max
  Peptide Sequence Number=SeqID_156242
atggaggaaatgtgtgaggaattaaagatccaacaccacaattccacaccctataggcccaagatgaacggagcggtagaggcaaccaacaagaatatcaagaagattattcagaagatgaccgtgtcatacaaggactggcacgagatgctccctttcgcgctacatggttaccaaacttcggtgcgcacttcgaccggggaaacgccattttcattgagacgggtgaagaatgctttcgacaagaaggtacgctcgtgcaggttcagcgaagaggacctggtgctgaagaaagtctcccaagccctgagagacaataggggaaagtggtccccgaactacgaagggccctttgtggtaaaaaaggctttctccaggggggccgttgtgctcactaacaaggatgacaaggaactaccttcacctgtaaacgccgatgtcatcaagcgatactatgcttaa

SEQ ID NO: 39465 - DNA, 523 bp, Glycine max
  Peptide Sequence Number=SeqID_156243
tacacgagggttagattggctctccaagttgaaaattatcaacgaagagatcttcgaagctccggaagaggatgaagaagtccaagctctaaaatcagagctaggaagggcaagactcgccaaagaaaagttcaagacagccgctacaagcatccagaaagagtgtgccgagttacgagaggaaaatgcagctaccgcaaaagcccttgaacaagaaaccaagagggctcgcaaggaaggcaacaatgagctcaagctccgaagagaggaaaaagaccagtcacgagtacatggcatgatcttgaaggaagagttagctgcttgctcaagatccaagaggagtttggcccaacacttagaagccacagagcaaagcatgctagctataatagggcagtacaaagaagaggggattgatgcattgcatcaagaagcgaccatgtggatggataggttcaccttgaccttaaatggaagtcaagacctcccgccactactagccaaagcaaaggccatcgccgaa

SEQ ID NO: 39466 - DNA, 569 bp, Glycine max
  Peptide Sequence Number=SeqID_156244
ggagcattacaaggacaattgttatctatattccacgaataattctaggtggagacaggagttaaatccttacaatcaatatgaaaaggaaagagcctttgatcttgaaagtgtgtttgcagaattcatggcatatcatgctagctctaaagctaatcatgattcaatacaaaatcaggagattcaatttggcaagagctattttttagaaaattatcaaggggaaccagagttacaactttgctatcaaaatgaagcagaaagaggttccaatttggatactttgttaattcaagtcaaggatacaattggatctattcaacgagcatttagaagtgcaaaaattcaggttggtaagttggtagaagaagtgactcaagttatgggcagaagagaagaagaatgtgtagaggttgaagctcaagagggaagccctgtaaatgagcatgatttagaagaagatgaggagaaagtgcaacaacgggagcagcatgaagaccatgaggttccaatcattctgggacaaccctgtctgtcaattgctagttgtgtattagatatgggtaaag

SEQ ID NO: 39467 - DNA, 129 bp, Glycine max
  Peptide Sequence Number=SeqID_156245
atgaggataaaagagaagaggattgaaaatgctggagaagctcgtgggtggcagagcgtgatagatggtgctgtttctggcttaagattcagtcgctcaagaagcgcgtggaagaggcttaacttgtga

SEQ ID NO: 39468 - DNA, 1204 bp, Glycine max
  Peptide Sequence Number=SeqID_156246
atggggcgcgaagccccgctgctctggctcgtcatcggcgcgggagccctcgccgcagtcaccctgatcgccgccgtcgggttctcgctcgtgcgacgtgacgggtgggcgttcttctcgggcatgctcaccgtgatgttcgcggtcgtcatgctgttctgcgcgctcttcccgtacgtgatgccgtccacgatcgacccggcgtacagcctcaccatcgcgaacgcgtcgagcaccccgtatacgctgcagatcatgagctggaccgccctgatcgcgatgccgctcgtgctggcgtaccaggcgtggacctactgggtcttccgcaagcgcgtcacccggacctccatcgagggggccccggcccacgcgtgccgcgaggctcttcctcgcggcatccgcgctgatcggcgtcctccagaccgcggtcacgatcgcgttcgcctggctgctgacgcaggcgatcatcggagcgctcgccgggagcggcgacctcaccgcatccgtgctcggtctgctcggcgccgcactcgtgcgcggagtgctgatcgccgcctcggacgctgcgggtgcgcgggccgctgcgaagaccgggatgcagttgcgttccgccctgatcgccgccgtcggccgacggggaccggggtggctggcacggcgcaaccaggcggagctcgccgtcaccgccggtcacgggctggaggcgctggacgcctacttcgcgcgctacatcccgcagctcgtgttgacggtgatcgcgacgccggtgctggtggccgtgatgtggtggcaggactggccgagcgggctcaccgcggtcatcaccctgcccctcatcccgctgttcctgatcctgatcggcatggcgacccgcacggtgcagaagcggcagtggcagacgttgcagcggctcgcggcgcgtttcgccgacaccgtgcagggtctgtcgacgctgcgcctgttcggtcgcgatcgacgtgcggccgaccgcatcgagctcactgccgacgcctaccgccgcgagaccatgaaggtgctgcggttctcgttcctctcgggcttcgcgatggagctgctggcctccatcgcggtggccctgatcgcggtgtccgtcggcttccggttgctgtccggcgacctgaccctggaggtgggtctgttcgtgctgctgctcgcgcccgaggccttcctgccgatccgccag

SEQ ID NO: 39469 - DNA, 3981 bp, Glycine max
  Peptide Sequence Number=SeqID_156247
atggcttggactaccctcaaaggttctcccagaatgtcttctcatccaaggcctctttcttggattgtggttatggtgggagcacttgcatttttcttaatttatgcttcctgggttcttgtatcatcccctattggtgccacggtccagggttatttttatagtgtaggtagttcagagaagttagatttgcctgtgtcttcagtgaatggagcttctattaatgatggtcactcgaatgtgagtttagatcttgttgataaaaaaccaccctctgaggatctacaatcttccacaatttccactgaggtgcctagtgatagtaagacagaacaaactgatactacatcaaactcacaagtggactcgggtgagtctacttcagtgaaccttccaatgaccaaggaagtgaatagcgacacgacagttttgaattcaggagaactagggactttgtttggtgaccgttcagatgtagccaatagtagctcgcctactcaagacaattcacaagttgatttgaattcaaaaacaactaagccattggtaggtaccaattctttcaatgagacaggtaatattagaatggaggaacccacttctgtggctttgatcaatcagtccagtgctgtaactacagcatcaaatgagacctctatctcttccggtgattccacttcaactgctgttccagaatcagcagagaagctaaataacacaccctctgctggctgtgatctgtaccatggaaattggatacatgatccactgggaccattatacacaaacaattcatgccctgtattgacacagatgcagaattgccaggctgatgagagggaagactttggctttcattggagattcagtagcccgaaaccagatggaatcaatgctgtgcattctgtggcaggtcaaaagttgtcttcatgtggccttggtgctgcagctgctgctgcaccatgccatgttcagaataaaatggtttgttgccggatatggtcctcgtggcttgtcaaactaacatctgaaccatttgactatgctccagctggtgtggataagctccatcttgatgcccctgatgagaagttgatggaacacatcccaaactttgatgtggttgttctttcttctggtcattggttcgccaagcagtctgtgtatattttgaacaatgagatagtgggaggacagttgtggtggctggacaagtctcggaagatgaaggttgacagtgttaaagcatatggcatatctgttgaaacaattctaactgctattgctacaattccaaattacaaagggctgacaattgtgcgttcctactcacctgaccattatgagggtggagcatggaacaccggtggatcatgcactgggaaggttaggcctcttgcacctggtgaactggtgaaaaatatgcacacaaatataatgcatgaacaacaggtgacaggttttaaccgtgcagtggaaagggcaacaaatggatcaaagttgaggctaatggatatcactgaagcctttcaatacaggcatgatggtcaccccggcccttacaggagtcctgatcccaataagattacgaaacgtggccctgatggaaggccaccaccacaggattgcttgcactggtgcatgccaggccctgttgatacctggaatgaacttgtgtttgaaatcattaggagagaatatgaaggccgtgacttgtgtagaaatgtgactgtctgcggaggaggggggaaagtcactcatgtagtgtttctcttaagctgctttgccgagccattcactgggtttatccttgtgattaagaatgtctctggcagatacaagagccccaaaatgtccaaacctcaaaatgatccccttgtgcaatcggaaacaacttgtggaacacttctctatgaacttcagataatatgggatgaagtaggggagtctgagtctgacagagatagaatgctgtttgagcttgaacaagagtgtctagaagtatacagaaggaaggtagatctggcaaatcggtctagagctcaattaaggcaggcaattgctgattgtgaggcagaacttgcagccatttgttcatcaatgggagagagaccagtgcatattcgacagactgatcaaaatgctggaagcctgaaggaagaacatgcaagaattcttccacagttggaggagatgcaaaaaaggaaaattgagcgtagaaatcaatttatagaaattcaagagcagattcaaagcatttcaattgaaatatatggtcctagagagtatattcctgctgtcgaagatgaaactgatttatccttgagaaaacttgaagaattgcacaggcagctacatgcacttcagattgagaagacaattaatggaattcatcccagtttagtggactcaaaaggatctaagagtgtaagtaatgataccattcagcaattagctgttgctatacaagaactgcgggaagttaaattacagagaatgcagaagctccaagatcttgcgactacaatgttggagctctggaacttgatggatacccctattgaagagcaacagatgtttcagaatgttacatgtaatatagctgcttcagaacatgaagtaactgaaccaaacaccttgtccgtggacttcatcaatttggttgaggtggaagtagctaggttagaagcgttaaaatcaagcaagatgaaagagcttgtattaaagaaaagaacagaactggaggagatttgtcgaaagactcatttgatcccagaaatagataatgcagtggaatctgctgttgaggccatagaatctggatctgtggaccctgctttcgtgcttgaacaaattgaacttcagatttcccaagtcaaagaggaagctttgggcagaaaagagatacttgaaaaggttgagaaatggttggcagcgtgcgatgaagagtcttggcttgaggagtacaacagggatgataatcgctacaatgctgggagaggtgctcatcttactctcaagcgagctgagaaagctcgtgccttggttaacaaaattccagcaatggtagatggtctgacttcaaaaactatttcatgggagaaggaaaaaggcattgagttcacatatgatggtattcgtctactttctatggttgaagaatacaatatattacggcaagagaaagaacaagaacgtcgtaggcagcgggatctgaagaaactccagggacaaatgatagctgaacaggaggcactatatgggtcaaaaccaagcccttcaaagccccaaagtgttaaaaagggacctaggatgtcgaccggaggaggtgcagctagtagaagagtctctctgggaggagcaatgcttcaaactcctaaaccggattcaaaatctactcactcacgtgccatgagaaaggttgataaagtgcaccaaattgagcatctaaattacctggatgatggcatttcaggtttatcagcagcagctagaagagggctggatattgctggcgctcctgttaaaaagcactcatttggtgctgggactcaaatcatagaatctcctctgatacgacaacctttttctcccatctcttctaacagtgtatcttcaaaagctaatgtggcaaatgctacagatgaactgagtaaacagaatgagaagttgcagagaacagtgtcgcttaacaatgggccatttactactccctccaagacagttcctactgtggtagatgaagagaataggactccaaatattcctgccccagctaccccttcgacagtatcagttccaatgaatatggccatgactccagttccttcttcaattttgaagaacgtaagcttgaattcaactcccatatcagttccttatggaaataatgacttggttcaggagttacctgtgatggataatcataagtcaattgtaattggctttctgattgtgtacatttggagaagtggagggtag

SEQ ID NO: 39470 - DNA, 819 bp, Glycine max
  Peptide Sequence Number=SeqID_156248
atggagggaagagagaattttggtgttgtggtgggtgatgaggccccagagagcttccatgtggctcctagaattgagaacaacttggacttttcaagggccaccgtgccggcgccggcgccggcgacggaggggaagaagaagagagggaggccgaggaagtatgggccggatgggaagccggcgttgggggcggtgacagcgctttcgccgatgccgatttcttcgtcgattccgttgaccggcgagttctctgcttggaagagtggtagagggaggcctgttgaatctatcaagaagtcatcgtttaagtttgaggttgaaagccctggaccaggttttactgttacatctgttgctaagggactgtttgagattctttccttgtctggttcctttatgccaactgagaatggagttacaagaagtagatctggtgggatgagtgtctctttggctggtccagatggtcgagtaatggggggcggacttgctggtttgttggtagctgctggtccagtgcaggttgtggtggccagttttcttcctggtcaccagttggagcataaaaccaaaaagcaaagggtggagcatgtatcaactattagcccttcacctgttaatcttatcactagtgaggaaataaaagtaagttttggtggagtaaagcctattatgacccctgctgcttttcaagaagagaatattgcttcttttaacaatgttcaagactctaggaactcatctgctgatgacaaagatcctttgcctgaaaaggagtctaacctaagccaatcaaatgctgaggctgcatgctaa

SEQ ID NO: 39471 - DNA, 372 bp, Glycine max
  Peptide Sequence Number=SeqID_156249
atgctgcaacgtgtgactttggtcatacaaccacttgggaaaagattcaagctttggtgttttgaagcaaaaggggtacagagggaccttgttcacttccctctcaatgtaggtttgaatctctataatcttcttctccggcatccgcttcagcgtggacgacaccgttttgttggtgatgttcacattcttcgaggcattgtgctctcgacgaaggcgtcgagcaacaagaggtggagccgcgagttgaaatcggagagagaggaatcggaggtcgtcgacggcgaggatgaaggccttgcagatgaagagataaggaagggatgggtattggttactttgttgggcaggggtaatttggaatttcaataa

SEQ ID NO: 39472 - DNA, 1167 bp, Glycine max
  Peptide Sequence Number=SeqID_156250
atggtgaatgttgcttgtcaggttcaggggttcatgggtttgatcaaggattttagcatcggggtaccacttttcagggttgtcattgagaattgtctcaaggttgctaatttcatcaacactgagtctcaggttaggagtagtttcctcaggtacaggatgcaggagctggagtgtgctgcgctggttcgagttccctcgccaaagtgtcatgtgttgaaggactttacatcggtatttccaatgctggaggacatcctgagctgtgctgcagtgatccaaatggtggtgttggaggacacgtttaaggtggtgtgtatggaggatccactggccagagaggttgctggaattgttcagagtgaggggttttggaatgaactggaggctgtttattcgctggtgaagctaatcagaggagtggttcaggacattgaggcggagaggccgttgattggtcgttgtttgccgctttgggaggagattagaaccaaggtgaaggagtggtgtgttaagtacagtgttgtggaagaacctgtggtggaaatatttgaaaaacggttcaggaagaattatcaccctgcatggtctgctgcattcatacttgatccactttacttggttaaggaggccagtggaaagtaccttcctccgttcaattgcttgactcgtgaacaagagaaagatgtagataagttattgacaaggctggcttcccgagaagaagctcatgttgtgttgatggagctcatgaagtggagatcagaagggcttgaccctctatatgcacaggctgtgcagatgaaacaacgagacccggttaccgggaagatgaaggttgctaatccactcagcagtagacttgtttgggaaacttgcctcagcgagtttaaatccctcggaaagcttgcagtgaggctcatttttttgcatgcaacttcatttggatctaagagtaattgttctttcatcaagaagatttctgcaaataaacattcgagagtttccttggaaagagctcagaaaatgatatatatcgcagctcatgccaagcttgaaagacgagacttttccaatgaggaagagaaagaagcagaactacttgccatggaaggtagtgatgatggcatgctggctgaggtctttgctgatgcacccctaatgtaa

SEQ ID NO: 39473 - DNA, 1059 bp, Glycine max
  Peptide Sequence Number=SeqID_156251
atggtttcaagtttcaacttcaaggacgtactttcagctgcagagcgaccccatcctccatccacccccaacttcaagcctagtagtaaattaaaggtgcaaaccctaaacactaacccaactcacttcaacccacaggtcccacccctccgaaccctctcgtcctcgaagcgcttcgaggggtcctcggagttcgtcaagctgaaataccacatggggccggtgctttcatctccgatcaatatctacctcatctggtacggcaagtggccccaatcccagaagctcctcatcaaggacttcctcaactcaatctccgaccaccgcgccgccccctccccctccgtctccgactggtggcgcaccgtctccctctacaccgaccagaccggcgccaacatctcccgctccgtctccatcgccggcgagtactccgacctccgctactcccacggcacccacctcacgcgcctctccgtgcaggaggtcattgccaccgccgtccaggccaagcccttccccgtcgaccaccgcaacgggatctaccttatcctcaccgccgaagacgtcaccatggaagacttctgccgcgccgtctgcggcttccactacttcaccttcccgtcgaaggtgggctacacgctcccttacgcgtgggtggggaactccggaaaacagtgccccgaggtttgcgcttatcccttcgccgtccccgggtacatgggcggcggcggacccggccacctcacgccgccgaacggagacgtcggggtggacggcatggtgagcgtgatcgggcacgagctggcggagctctcgtcgaacccgctcgtgaacgcatggtacgccggcgaggaccccaccgcgcccaccgagatcggagatttgtgcgagggcttgtacggaacgggtggtggcggcggctatattggttccgttatgaaagacggcgaagggagaacgtttaatcttaacggtagaaatggacggaagtttctggtgcagtggatttggagccccgttttgaaggcctgtgctggtcccaatgctttggattga

SEQ ID NO: 39474 - DNA, 563 bp, Glycine max
  Peptide Sequence Number=SeqID_156252
acagattatgcgccctttatcatttaggaacaacaaggtgggtggtaaatgtgcaaagacagattttgtgccctttatcattcaagaacagcaacctgagttggtaaacgcgcagagacatattctgcaccctttatcattcaggaacaacaagttgggtggtaaatgcgcggagacaaattatgctcattccttgcaccttttcgccatccagaggcgatcgtgtccgatggcacgcagagacaaattatggtcattctgtgtctcaccgcccaggctcaatcgtgtccaacaaaacgcagagacgaattatggtcattctgcgtcttgtattaaccaagaggaacatacatcaagacgatttatgtcttgttcttatgttgttgctcctcgtaagcatgctcaccatgagtatagcaactgcatacatcacgtgtatatgttggaaagtgtctccaacatatacagaggattatttggggaattgcataatgaagtgtattggtcaccatatcacgagccaaggatcagccctgacccagagaagaaaagaaattctaaag

SEQ ID NO: 39475 - DNA, 1203 bp, Glycine max
  Peptide Sequence Number=SeqID_156253
atgaagcataaggttgaggagtactttgctttgacaagaacacttaaggcagagaggctaccaagggccataaaggctcttagaggccgtgctttcaactggaagcttcggtggaagttgagcaacccccaagcaactttgtttgagtttgattggttagacattgattttggtatttctgagggtgttgattttattgctatttcatttgtcaagtctgctgaagttattactcatcttaaaagctatattgctgcacgatctcgtgatagaggatctaatcctcctggtgcttcttgccctgtgcatttggcatgctttttgaaccttttaacgagacttcctttttgtcttgaataccacatcaatttcactgaggtgcaatgtctatcaccttacctgaaccccaaaaatataaggtgtgatatttctgtcattgcaaagatagaaagtattgactcattgaagaacttagaagagatcgttctagcggcagacggagctatggtggcacgaggagacttgggagctcaaatacctttagaacaggttccatctgctcaacaaaggattgttcaggtttgcaggcaattgaataagcctgtcattgttgcctctcagctacttgaatccatgattgagtaccctacacctacaagagctgaagttgcagatgtttctgaagcagtcagacaacgagctgatgctttaatgctttctggtgaatcagccatgggccagtaccctgacaaggccttaactgttttaaggagtgtcagtttgagaattgagagatggtggagggaagaaaaacgctatgaagctatgttgctcccatcagttgggtcttatttttcagaaaagatatctgaagaaatctgcaattcagctgctaagatggccaataatttagaggtggatgcgctttttgtgtacacaaagacagggcacatggcgtctctattgtctcgttgccgtcctgactgcccaatctttgcttttactaccacttcatctgtgcgtaggcgactgaatcttcagtggggcttgatacctttccgcctgagcttcacagatgatatggagagcaatctcaacagaaccttttcattgctcaaggccagaaatctgatcaaatctggtgaccttgtcattgccgtctcagacatgttgcagtcaatacaagtgatgaatgttccttga

SEQ ID NO: 39476 - DNA, 324 bp, Glycine max
  Peptide Sequence Number=SeqID_156254
atggcgacgatggtaggacagacgtgcattgctcatagaaagagaagagagtttcgccggaatgttcatttccccggcgagatccccgtcgccggcggtgagtcacggtgtaaggcgtgggtgggattggtatttatagcgaagaggcagagttgctggcatggctgtatctgccacgtgggatccgacgtggcgtgggtgattatcgtgcgcggggaggaaattacggtggtgacctcggcactaggtggaatatcgggtagatgcccctggtgttctggagttatggcagagagagcagcgatcgtggcgattatgcattag

SEQ ID NO: 39477 - DNA, 619 bp, Glycine max
  Peptide Sequence Number=SeqID_156255
atgcctccgatgaagatccaacccatcgacgtcgattcgcagaagctcgcggtggttcgaaacgaccccgttaagccggtgttgaagtcgcgcctgaagaggctctttgtgttcgaccgtcagttctcgaatgtgctgaagacttcgtccttctcgtcggagaaacccgccgccggcgaggctcctcagtccaacaccaaagacggagccgcggagtttgaaccgagctccgtttgtttagacaaaatggtgcagagtttcatggaagagagtaacgagaagcccgcaccggccaccgcgaaatgcggccgcaaccgctgcaactgcttcaacggcaacagcaacgacagctccgacgaggaactcgatatcttcggcgattcaatttcctctggctccttcagcgacgccagtgacgcgctcaagagcttgattccttgcgcgagtgttgtggagagaaacctcttagctgacacatcgaagatcgttgacaagaacagcaaggtttataagcgaaaaggcgatttgagaaagatcgtcaccgaaagcctttcctctctcggttacgattcttccatttgcacatcgaaatgggacaaaaccccaacctaccctgccg

SEQ ID NO: 39478 - DNA, 180 bp, Glycine max
  Peptide Sequence Number=SeqID_156256
atggaatccggtgggcctgaatccgcaagccccatgacccacagggttcagtctctgtcttccgcagatacaagagggaaacataggatacatgctgaactcaaacgcttggagcaagaagcacgattcttagagagacaaatgctatctgtgaacctgatgacgttgcctacaaattaa

SEQ ID NO: 39479 - DNA, 288 bp, Glycine max
  Peptide Sequence Number=SeqID_156257
atgggatatgaaaattctaaggacatgaaaactctttcatgcttattttttgaggctaggtgtgaccgagttcaggagggggatggtaggcataggattcaggtaaagcagcttgcccaggattccatcctgggatctagcgcttgcagattaaattccgtagtctttgatgaaaatgtatgggaggaagagctggaacaacttgaaaggatggagaaagcatctacatcgtgcaaaataatgctcatcaatgtggaaacaaaacctgatccattactaccatcgtaa

SEQ ID NO: 39480 - DNA, 321 bp, Glycine max
  Peptide Sequence Number=SeqID_156258
atggtgggagtgcaaggacaatggtcacttgttgaagttgtggtcactaacttcaatggtggttctatgttgtcaatttgcgattatggtggttttggtggtgggtggcattatttgatggatgatgaatttcaattatggatgagttttagtttaaagttgttatcaaagcttgtgggatggagatgcaaaatatttaacgaggaaggtctgttctgcatggaagtcgcaattgcgattggcgatgaaggcggaatcgccatcgccgttggcgagaaagaagatgacatggacgtcccgccaatggtgatgacgagttag

SEQ ID NO: 39481 - DNA, 312 bp, Glycine max
  Peptide Sequence Number=SeqID_156259
atggaattgaaagcagaagcagaagggtgggttcagaaaacaatagagcaggatctaagcgtactgaaaacgcagagacagagacaggtcacaagggcgttgtgtttggtgaacaaagaatataagagagagaggttaaggggtgtttggagtttgaagagtgtattgagagttggagcggaaaatgggggtgaaaaagaaaacttgtttcaagtgttgaagtcgaagttgtcgtttttgggtgctgttgttggaattcgaacacaacatcaaagctggtgttgggtcgtggattatctaaaactcccttaa

SEQ ID NO: 39482 - DNA, 1065 bp, Glycine max
  Peptide Sequence Number=SeqID_156260
atggacccccgccagcacagcacattaaaggaaaggagacagagctggcacctcgtagtctccgcagttgggtttagagacaactgcaactccgttaataacaacactcaaaacccaaacgcacttagatttctattttctactttcgaactcgcacctcatttccctctctatctctccgccacgcgccaccatgtcagtctcacactccctccacctccgcctcttcacccctccccccaccgccattcccacccacctcccaccccctatttcctcctcccgcgctccgccgcccaccgccgcctcccctccctccgcgcctcctcctccccggaaatcctggtctccgacaacaacggtgccccctccccgcccccctccgatccgagctccatcgaggtggacgccgtcacggaggccgagctcaaggagaacggcttccgcagcacgcgcaggaccaagctcgtctgcactgtgggccccgccacatgcggcttcgaccagctggaggccctcgccgtcggaggcatgaacgtcgccagaatcaacatgtgccacggcaccagggagtggcacaaggaggtcatcgaccgcgtccggaggctcaaccacgagaagggcttcgctgtcgccatcatgatggacaccgaaggcagcgagattcacatgggtgatctcggcggagcttcctccgccaaagccgatgacggtgagatctggactttcagtgttagagccttcgattcggcgcttccccaacgcaccatcaatgtcaattatgaaggcttcgctgaagatgtgaaagtgggggatgaacttttggtggatggaggaatggttaggtttgaggtgattcagaaaataggtccagatgtaaagtgccgttgtactgatcctggcttgttgctgccgcgggccaatctcacattttggaggaatggtagtttggtgagagaaaggaatgccatgctccctactatttcttccaaggttgccaattcctcctttgccttttgcttccttgcattgcatctctttattgctatattttttggagtataa

SEQ ID NO: 39483 - DNA, 327 bp, Glycine max
  Peptide Sequence Number=SeqID_156261
atgtctgtgaagatgcggactacctgcacctggacagaaagaccctatgaagcttcactgtttcctgggattggctttgggcttatcctgcgcagcttaggtggagggcaaagaaggcctccttctgggggggccagagccatcagacctacgggccgagggacagtctcaggtagacagtttatatggggcgtaggcctcccaaaaggtaacggaggcgtgcaaaggtttcctcgggccagacggagattggccctcgagtgcaaaggcagaagggagcttgactgcaagacccacccgtcgagcagggacgaaagtcggccttag

SEQ ID NO: 39484 - DNA, 866 bp, Glycine max
  Peptide Sequence Number=SeqID_156262
ggctacacaccctcaccttcagaggactacacgtcctcgcctccagaggactacgcgccctcaccttcagagggctacacgctctctcctttagaggattacatgtcctcgccttcagagggctacgcgccctcgcttttgtagggctacatgccctcacctttaaaggactatacgtcctcaccttcagaggactacacatcctcgtcttcagaggactgcacgtcctcatctttagaggactacacgtcctcgccttcagagggctacatgtcctcaccttcaaaggactacacgtcctcaccttcagagggctgcactccctcgccttcagaggactatacgtcctcgccttcagaggactatacgtcctcaccttcagagggctacacgtcctcaccttcagagggctgcactccctcgccttcaaaggactgcacgtcctcgtcttcagaggactacacgtcctcacctttagaggtctgcatgtcctcaccttcggagggctgcacactcccccgcctttagagggctacgcgtcctctgcccttaaatgcttaaccgagactcgcgctcccggagaattccaacagggccctggggtttccagctctggttacgggcctctgtcaatcctacagggtgcccgttccccccagcaaggacacccagtggacccaaagaagtccaacagggtcctggggtatccagctatgattacgagcctctgtcagttttacagagtgtctgtcacccccaacaaggcaggtagagggcgagacaccacaacagcctggggatggccagcaacaggcaaaaaatgcaccgacgccacctctagagcccctcagctcatccacagaaag

SEQ ID NO: 39485 - DNA, 354 bp, Glycine max
  Peptide Sequence Number=SeqID_156263
atgaaatcatacctttctgcattcctattattccttctcctccttaagcttgttgataaatccatctctgcacgtgttcctccttcttcaaccaaagtaatattcaagaagattggtgagaattcattggacaatgtcaaacaaaagttctctccccaacagccaaactcaccaccgaagcaaatcgaaggcctatctttcttcaaagggtacttatctaacttcggctacctccaatcctccgagccattcaacgattatttggacgaggaaaccataacagctattaagacctaccagcaatatttcaatcctcaacctactgttgacataaacaacgagacacttcattaa

SEQ ID NO: 39486 - DNA, 990 bp, Glycine max
  Peptide Sequence Number=SeqID_156264
atgaaatcatacctttctgcattcctattattccttctcctccttaagcttgttgataaatccatctcttcacgtgtccctccttcttcaaccaaagtaatattcaagaagattggtgagaattcattggacaatgccaaacaaaagttctctccccaacagccaaactcaccaccgaagcaaatcgaaggcctatctttcttgaaagactacttatctaacttcggctaccttcaatcctccgagccattcaacgattatttggacgaggaaaccataacagctattaagacctaccagcaatatttcaatcttcaacctactggtaacataaacaacgagacacttcatcaaatcttactaccacgatgtgctgttcccgacatgaatttctactacaacttcaccgacctcaagtcgtggcccaaagccgggaaccagtggttccccatgggcaagagcctcctcacctacggttttcaacccatgaatgaaatgacagccgaaatgaagaaggtgttcacagatgccttcacgcgctgggtgcgtgccacagctggagttttgaaactcacggagacaacctatgacaacgccgacatcaaggttgggttctatagattcgatggccgctttaagaatttgttgtttggtggcagcgttatcagatatcaacctgattctaatgtcaccacaggtgagattcgtctcgaccttaccgatttatgggccctgcctagagaggaggatatgctgtcacaggatggtgttttggacttggagagtgcggcgatgcatcagatagggcatcttctagggcttgaccactctaacaaagaggactctgttatgtacccttacatgttgccctcacagaaacggaaggtggagctttcggtttctgacaaggacaacattctacaacagctattaggaacatcaacatgtttggattttgttttggtgtttcaaactcagtttggagcataa

SEQ ID NO: 39487 - DNA, 501 bp, Glycine max
  Peptide Sequence Number=SeqID_156265
atgagggaagagaaaaagttagatagagagaaggagaaacatggtgaggatgagggatggaagcaagtgactaacggaagcagatacaatacaaacgcaactcagtcttcagaggttatgagagtgttgttcgagacacgtgactataatgttgtaccaacgacaacggaagagcaagagttgggtgagatatggcttcgtgagatttacaagagtacaagactcagaatggttggagagggaactggacaacatttttataggttcatgaagctgcacgtcaattttcctaggtttcaaaggtcaagaaagtttgaagatcatagggctatagggagtcaacgaagtcaccatgaggtcggtacgagacaaacaaacgaatatgcagaaggtaaagaaatgagacaacactcttcatattctcacatggagataaaagtgaatcaatataatatggagtggcaaggattcgtgatctcagcttggttccaactattctaa

SEQ ID NO: 39488 - DNA, 285 bp, Glycine max
  Peptide Sequence Number=SeqID_156266
atggagcacggcgccgccgggggcggtgaactcgagggaggcttgattatcgtaaaagcaggcgcccttccactgaagggaaccgttgtcgggcgtgacggcgccgacgaaggaagggagcaagtcgacggcgctgtggaggttgttgaggaggggccaggagattccgtgggggagaacggggagaacatcgttgactcggaaggggagtttaagggcgccacggcggagagtggttacggcgccggtggggactcacggacacacgtggaatgcaccggatga

SEQ ID NO: 39489 - DNA, 1104 bp, Glycine max
  Peptide Sequence Number=SeqID_156267
atgtggagtagcaacttcggcaagaatgccaacttagatttcctaaagaaacacatgggagctacatttgagaagcgcaatcagccttggcgtgcaactattgatcctgcagatgttcattctggagattttttagctgtgtcaaagatccgtggtaggtggggaggttttgagacactagaaaagtgggtaactggtgcatttgctggtcatacagcagtttgcttgaaggatgaaattggaaatttatgggttggtgaatctgggcatgagaatgaaaagggtgaagaaataatagtggtaattccctggcatgaatggtggacattagctcttaaagataattccaacccacagatagccttgcttcccctgcatccagagctgcgtgcaagattcaactcgactgctgcatgggaatatgcacggagcatgtctggcaagccatatggttatcataatatgatattcagttggattgacacagtagctgacaactatcctccacctcttgatgctcacttgcgtttgtacttagaatatgcttgtattacgaggaggctactgtattattttatactaagggggttctggttccaagagcaatggaagtctgtttctgaatggcatgttccagcttatgctgcaaacatgtggaatgaagcgctgaacaagcggttagggactgaggatttggatttgcacgacattctaattgagactgagaagcgtgggatagcttttgatcaattacttacaattcctgaacaagatgaatgggtatacagtgatgggaaatcaacaacatgtgttgcctttattctttcaatgtataaagcggctggaatattcggccctatttctagctccattcaagtaactgaattcacaattcgtgatgcatacatgcttaggatttttgaggataaccaaacacgtctaccaagatggtgcaacaatgagaacgatcggcttccattctgccagattcttggtgaatataggatggaattgcctggctataacaccttggatccatatgccaatatgaacgagcactgtccttcccttcctccaacttatgataggccattgaaatgttag

SEQ ID NO: 39490 - DNA, 270 bp, Glycine max
  Peptide Sequence Number=SeqID_156268
atggcagcagagagaacggtggaaattccaaagaaaagaataaaggggttctcatttggagaacaattttctgttaattcaacgaatttgaatcaaagaatgaacaagttgtctaagccaaatgttgatcattatagtataaagcacaaagcaatgatagctcctacaattcatgacagtaagagtttggtgaagaaaaccaagaagcagtggagatgcgacttatgtccaattgctactagggagaaagggttcaatgatcatctttag

SEQ ID NO: 39491 - DNA, 356 bp, Glycine max
  Peptide Sequence Number=SeqID_156269
ccctctcaaggcgaggacatgtagtcctctggaggtgagggcgtgcagtcctctgatggtgaggacgtgtagtcctctgaaggtacatgaccctttgaaggcgaggacgtgtagtcctctgaaaggtgaagccctcttggtggtgaggacgtgtagtcctctcaaggcgaggacgtgtagtcctctgacggtgagggcgaggacatgtagtccatctggagtacccaaggtgagggcgtgtagccctctcaaggcgaggacatgtagtcctctaaaggtgagggcgtgcagccctctgatggtgaggacgtgtagtcctctcaaggcgaggacgtgtagtcctctcaacggtgagg

SEQ ID NO: 39492 - DNA, 264 bp, Glycine max
  Peptide Sequence Number=SeqID_156270
atgcatgagaacaaatggcacggagtgtgtttgctctttgccccaacaattcataactcacacggctgctttctagagtggagtcgccaactgtcgcaacgtgcccttcacgggcgagcgagggcgaggctcacgggtgcacttcccaaaggaggaaagatgcgcggagtcgccaccaacgtttatttgtggaaaacgtcgggaaaaccaaaggaaaccggtaaaaaagaaaattctaagttcgggagttgtatttacgcttga

SEQ ID NO: 39493 - DNA, 720 bp, Glycine max
  Peptide Sequence Number=SeqID_156271
atgccactgaagggaaagcagttggtggtgtacccctacaaaacactttggagagcactcaatttcgcccctaaatcacaacccttgcattccgcagcgggtaaaatcccacctgttatggcaaaaatgagaaagttggatcatctagaggaaaggctcagggccattgaagaaggcaaagattatgcctttgctgacatagaagagttgttcctagcacccaacatggtcattcctccgaagttcaaagtgctgaagttcgataagtacacgacaactacttgccccaagaatcatttgaaaatgtactatcgaaaaatgggggtgtacgcgaaagatgaaaagctgctgatgcatttgtttcaggagagccttattggggcggttgtcacatggtacactaatcttgaaccttcccgagtccattcttggaaggacctaatggtttccttcgttaggcagtatcagtacaactctaagtacaactctgatttggacttcgccagcaaaaagatcgaagtggatctgaaaagaggcaaatttaatcatcctgcttggacgaatgagaaaactggggcaaataaagagggtgaggacgagggagaaacccatgctatgactgccattcctgtacggccaagtttcccaccaacccaacaatgtcattactcaacccttctccttacccaccacccagttatccacaaaggccatccctaa

SEQ ID NO: 39494 - DNA, 834 bp, Glycine max
  Peptide Sequence Number=SeqID_156272
atgggttctccacctgcctccactactcctcctccttctcctccttctcctccttcacctcctcctcctcctcctacttcggatgcatcggcttcgacgtctgctgtgaagcagacacgcaaagcctcacgtctacgatcgttgtccactagaccacctggtgttgagagaccagtggtgcatgttgatcctgctacagggaagaccgacggtccccacaagaagaaattaataacatatttggggattgtggcacgtgataaggtggacatcacctacgagaactggaaggaggcggaatttgatatcccagaggcttttgacagtaggatgaaaaggaagttactacagaccgtgggggagagatggaggcagtttaaatcagacctcacgaggaaatgggcccttgcagccgatcaggacgatgtcgaggacactgtctgtgacaaatacggcatcagcaaggaaaagtgggcccagttttgccagactcacatagacccttcttgggaggatgcgcgcataaaggcacaggccatccagaagcacaatactgcctcccacgttttgtctcgtgggggttatgattatttggagcagaagcttctggctgagaagaccaagaagaagatgcaggaagctgcacagtcaggaagcgttgatggcatcatcgaccctccatccccggtcagacgccacgtgaagtggaagatggcccgcacgaagaagacaggggagatgacgactgaggccgcaaaggaaatcgctgagaagattgattcgtttgaggagcaggccacacagggattgttcgtcccccatggacgtcaggat

SEQ ID NO: 39495 - DNA, 231 bp, Glycine max
  Peptide Sequence Number=SeqID_156273
atggtggttgctactggacggcgaaatgggttttggaatttattaacattctccaaaaagggtactgttaataatcctaaataccattcgggtaatatttccaaaggagttgcaaatggatccgcgggttccccaatcatggatggttctagaaccgctaagcctacgttacaggcaatagtacctagaattactactggaaaaatatataaagatcgttgggccatgcag

SEQ ID NO: 39496 - DNA, 597 bp, Glycine max
  Peptide Sequence Number=SeqID_156274
cgctcgtcttggcgtgcctcggcacctgcgcgctcctagcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagagaaaactctggtggaggcccgcagcgatactgacgtgcaaatcgttcgtctgatttgggacgggtgcggctgctctgttgagccgcgccatggaatcgagagctccaagctgggttacggtgcccacctgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 39497 - DNA, 283 bp, Glycine max
  Peptide Sequence Number=SeqID_156275
ctgctctactacctttgctgctagaggatttggaactaggccttatgctgctggtggaggtagtggtggggaagctgtggttgtttcacccagagccggagtagattcactcatagcagatacattggttattgatatggatgagactgatctccctaacgcgctacaccatcactacactatagataggtatataggcagcgggaacactggtagaacgttcccatcaggcaacaacggaagggagcctctaacttgcctgaccaaaggagaagaggagtag

SEQ ID NO: 39498 - DNA, 715 bp, Glycine max
  Peptide Sequence Number=SeqID_156276
taccctcacctttagaggactatacatcctcggcatcagaaggctgcacgccctcaccttcagaggactacacgtcctcgccttcagagggctgcacgccctcaccttcagaggactacatgtcctcgccattagaggattgcgagtcctcgccatcagagggctgcatgccctcaccttcagaggactacacgtcctcgccttcagagggtcatgtaccttcaccttcagaggactacacgtcctcgccttcagagggctgcacgccctcaccttctggggactacacgtcctcaccttcagaggactacacgtcctcgccatcagagggctgcacgccctcaccttcagaggactacacgtcctcgccttcagagggtcatgtaccttcaccttcagaggactatacgtcctccccttgagaggactacacgtcctcgccatcagaggactacacgtccccaccttcagagggctacacgccttcgccttcagaggactacatgtccccctttccaaagggctacatgcccttgcccttagagggcgatacgccctcacctttagaggactacacgtcctcgccatcataggactacactccctcgccttcaaaaggcgacacatcctgaactttagagggctgcacgccctcgcctttagagggctacgcgtcctcactttcagtgggctccatatccacaccttaagataa

SEQ ID NO: 39499 - DNA, 535 bp, Glycine max
  Peptide Sequence Number=SeqID_156277
atgggtgaagtagaggaggtgcaaaagcagatgaaggccgacatggaggccatgaaagagcaaatgaccacaatgatggaggccatgatgagcatgaagaagataatggaagccaatgcggttgcagttgctgctaccagcgttgttgctaaggtgaacctgatgccctcatctggcctcaaccaaatgaatcatctaacctcagctatggtaggaaaagatttgggaatatcacccacaaccacacccctcacatccacagcgattaaaaaccctcatgctatggcagaaatgggaaagttggatcatctagaggaaaggctcagggtcattgaaggaggcgaagattatgcctttgttaacctagaagagttgttcctagcacctaatatcatcacccctccaaagttcaaggtgccagactttgacaagtacaagggaactagttgccccaagaaccatctaaagatttactgtcggaagatgggggcatacgcaaaagatgaggaactgctgatacatttcttccaagaaa

SEQ ID NO: 39500 - DNA, 270 bp, Glycine max
  Peptide Sequence Number=SeqID_156278
atgtatacgcaagcactcagtggaatttccctacaaaggattctagccctccattacaagggagtacctttcacaaataggagaagggtttcagggaaaatttcagattacaaagcaatagggatgcttaaaaagggctttttgtccatgaaggagagcttagcgccaacttcgcgcttagcgcgactaagtgaaatttggcttagcgcctttctcgcgctaagcataaaagagacagtcttctcgctgaatgagatgatgacgcactga

SEQ ID NO: 39501 - DNA, 210 bp, Glycine max
  Peptide Sequence Number=SeqID_156279
atgaaacacagctccaaactcgaaagtggaggacgcatgaacgaaaacgcaattcaggggctccgaaaaggggggagaatggatgattgccttgagggtccgcacttaggcaatgatgaaacacagctccaaactcgaaagtggaggacacatgaacgaaaacgcaattcatgggctccgaaaaaggggaagaatggaggattgccttga

SEQ ID NO: 39502 - DNA, 198 bp, Glycine max
  Peptide Sequence Number=SeqID_156280
atgtatgtttgtaatcaagcaactgcctatccactagggttgcacatctcaaagaccaccaagatcaaaattgttacagataaggtacaagctgctacaatccaagttgaagcttctactaaagttgtggatgacaacatcctgggtgaggccatcattgaccttacaagcatgtgttccatggacgaaacaccatag

SEQ ID NO: 39503 - DNA, 342 bp, Glycine max
  Peptide Sequence Number=SeqID_156281
atggcgcaaagtggagtttacgaaagaggaggagggaagattctaactctgggatctttcaacaacaaggctttcatggcaacaatagcgcaaatttggaaggtgggtgggggtgtagaaatcaaagaagcaggaaggaatatttacaccttgaggttcctaaatgaaaaggatcgagcacatgttgaagaagtagggtcatggtgcttcgatagaagattggtggttctcaattcaatgagtatagaagaaaatcctggggaggtcaatcttaatcattgtccattttggattagggtttatgattttcttgtgggtttcagaacagaggagatggcataa

SEQ ID NO: 39504 - DNA, 360 bp, Glycine max
  Peptide Sequence Number=SeqID_156282
atggctgaatgggaggcaagtaagcaacaatccagaaaaagccaaaccaaaaacacacacacttgttcttctatggctggccttcaacaatacaacttcttccccaccgatctcttgtaccctcgtccacaaccacaacaagcttctcctaagcccactgtgcttcccctccaaacccctaatgttcaagatcacactcagcctcaacaaccacctaggaccaatgccaccccttctacctctgctgttctttctagccaaaagggtcattctattgctgccgttgacaacaagctctccaaattctcatcagacccactttcttgcttgctttggatcactgatgatgaagatttttga

SEQ ID NO: 39505 - DNA, 1044 bp, Glycine max
  Peptide Sequence Number=SeqID_156283
atgacaacacatatcaaatataaatacacaagttttccagtatcagaatccaaacagctttttggtaaaacgagggagcaaaaattgggaagtagcatcatggggtcagaaagagagtgtcaacttcctctacctgttgttgatttctgtgatgaaaacctcaaacctggtactgacacatgggtttccgcttgtgatgttgtgaggggtgcattagaggatcacggtggatttctagcactctacaacaaggttgatccactgctctatgactctgtcttctctgcaatggaacaactctttgatcttccattagaaaccaaaatgcaacacaccactgataaacctatctatagctatgcagggcaacgccctgatattcctttgtatgaatccatggccatcgccaatccgttgaatgataaagattgtcacgagtacacaaatattatgtggccacaagggaatgaccaattcagtgaaagtgtgaattcctatgcaaagaaagtggtggaactggattatcttgttaagagaatggtgtttgagagctatgaattggacaataagaaatttgagtctttgcttgaatcaaccgattatattcttagatgctacaaatacagaacatctaaggggggtgagaccaacttaggagtgcatccacatacagattctggcttcctaactatattgaatcagaagttaaatggcttagaaattcaattgaaagatggagagtggttcaaggttgatgcctcacccaacatgtttgctgtcttggctggtgatgcattcatggtatggagtaatgacagaatacggggttgtgtacaccaagtattcatgaattcaaaggtagacagatactgtttggggctactttcatatgctggtaaggtgatggaaccagaggaagaattagtggatgaggaacatcctcttcgttataaaccatttgaccattatggatatcttcgtttcttcctcacagaagaagctgtaaaatctgcttctaggatcaaggcatactgcggtatttga

SEQ ID NO: 39506 - DNA, 711 bp, Glycine max
  Peptide Sequence Number=SeqID_156284
atgaagcctggcaccgatgcatggctctcagcgtgcagtgttgtgaggactgaacttgagaacaatggttttttcatggcacgctatgataaagttggcaaagagctatgcgactctgttgtatttgcagtggaagagttttttggtctcccagtggagacaaaagcgcaaaagactagtgacaaacctttccatggctacttagggcaagtctcgtggcttcccttgtatgaatctgtgggcattgatgatccgttgaccttacaagggtgtcaaaaattcgcccacataatgtggccggaggggaatggtcgtttctgtgaaagcatcaatgagtatgctaagttgttaggagaattagaccatatggcgaagagaatggtgtttgagagctatggtgtggacatgcaacgatgcgattctttcatagaatcaaacgattatctacttcgatgcatgaagtatagaacaccccagatggatgaaaatgatttgggactgcaacctcactcggacttgaccatcacatccattgtacatcagctgaataatctgaatggcttggaaatcaaactgaaggatggggaatggaaagagattgatgcttcaccttccttgtttgtggttatggcaggtgacgcattcaatgtgtggagtaatggcaggatacggccatgtgaacacagagtgacgatgaatggaaagaaataa

SEQ ID NO: 39507 - DNA, 216 bp, Glycine max
  Peptide Sequence Number=SeqID_156285
atgttgctaaatagcaacgtcatccacgtcagggtggtcatgttggtgcgcatgatccacactcatctttttgcagcggcacgggtgaaatcttgccccggtatgcatagtagatgcgtgatagcctccctctctggatgtgctcgcacagttggtcgccctctaatatcagggggtggcccaggaactgataaaaggaaactactggccccttaa

SEQ ID NO: 39508 - DNA, 660 bp, Glycine max
  Peptide Sequence Number=SeqID_156286
atggcggaaccatcaaagaagctcaaaggttcttcaagtagaagtcaacggcattccgaggttcaggatactccaattcattcctccatttcctcctcctcattgttctcattggaagaacaacgtatacgatacacaaacctcttctcctctcgttctatcatagaccctaagttcatagatatggatttcttttccgatgagagtttcgaatgcattcaatcatttcaaaactcaaatctcattccctttatgtctctaaaattgcctgtgtattctgaattggtaaaagctttttattctaatcttgaaattcaagaaagtaccttgatttcagatgtttatgggataaagatggtcattgaccaatcacttttctatgatttgactcaattgactagcgaaggtgtaccatttgaaggtacactagatgatgattggaaatttgatttttccatgcacgatgctcgccggttggtttgcaccaaccaagcggatatgaccggaagattttgggcccatgggctaagtatgagtccgcttatctatctaagctctagcttctcaaggaagcttctcaaggagcttctcaaggaagttttctcaaagaagcttctcaaggaagttttcttaagaaagcttctcaaggaagctacctag

SEQ ID NO: 39509 - DNA, 384 bp, Glycine max
  Peptide Sequence Number=SeqID_156287
atggaggccatgaaagagcaaatggccacaatgatggaggccataatgagcatgaagaagataatggaagccaatgcagttgcagctgccgctaccagcgttgttgctaaggtgaacccgatgcccctatttgatattaaccaaatgaatcatccaacctcagatatagtaggcaaagatttgggaagtacgggcggccccttaatgtgcaaattcaaaatgagcacgccttcccgccatatggcttgcctcccaactatacaccacccaatgcggcatacactcccaatgagaatatcaataactccactcctatacccattgagagccaacaaccccgaactatcatgcaaatgtctcttaacccatgggggaggcacatga

SEQ ID NO: 39510 - DNA, 3459 bp, Glycine max
  Peptide Sequence Number=SeqID_156288
atgaaggttgaaattgaaggcagccacagtgattatgctgaatctgtttccagccaaccagaaaatagaggaagattggaatccaagaagaaactgaagaaagtgaggtcaataaggcttgtaagattgccaagcaagagatcatccaccagaggagggagaccccaatatgaccctctttccattgatacaaaaagtttagaggggccaacaccaattgaaatggcagatgcatcacctaattacatgaaggctaccagcagttctcatgcaaaggatagttttcagaatacagaaagaatactattcacaaagaagactttgacaagaatgtctactgctttgaaactgaagagaagtctgactagaaagatatctggaaggactgaaccaaagaggaaactgaagtcctcaagatcagtcaggtttgcagctgtcaagggccaaaaatcaaccagaaagttttatgaatctagttatggaagtgatgaccagaattggagaagtgcaagtgatgctgctaacaaaccccagagagtcatgaccagaagattaagcttgaagcctgtgaggatcttaacaaagatgcctactttcaaatcaaataattcttccatggagagtggccatcagatgtctcaatccccagacacaagcttgcatagagccacttgttcttctgctctcaaggattcccattttcctgatcacattgatctccctcaagagggaagtgactctcaaggagtatcagctgtgaaggtttgtccatattcttactgctcacttcacggtcactgccacgccaatctgcctccactgaagcgctttgtgtcaatgaggaggcgtgcgttgaagagccaaaagccaacaaaaatggatcgtcaacctgttactagatcaaagcagattggtaatgcaaagaaggccgctccgaaaactcaaactatccatggtgaagatggcagatctcattttgagaacaagaaaaagatggcaaggggcttatggattaggccacatggcactccagcatccacagtttctgaaggtgtggaatcaacatcaacagatggagtcgagttttctgctcctgatactgagatattggatggagaagtaaccaacactggaatcacaagcaaaaatatggagccggattatgaagtactgacgatgagttctgtacagaaagagcctactgatatggcatgtggaatgaaggaaagagataaaaaatatgccaaaatgtggcagttgatgtataagcatgctgtattgagtaccacaggtgaaaataagcagcaatttgatgggaaggacaaggaaggaagagatcaagattcccttgcaactaatgaagtgaacaaatcttgtagcgatggttgcgatacagaccaggacatggatgatgaaaataaggatgcaattgagctggtgcagaaagcatttgatgaaatccttcttccagaacctgaagacttcttttctgatgatcaattcaaatctgaaggcattgattcagatgaggcacacttacaaaagagtgaagctgagagagaaaggaatacctcaacatccacacaatctccaagagcacagaggatggggaccaaacctgaccaaagaggtccaaaaagctggagcaatctgaagaagttaatcctcttgaaaaggtttgtgaaagcattagagaaggtaagaaacatcaacccccaaagaccaagacattttccttccgatgctaacttagaaatggaaaaagtttttctcaagcaccaaacagcagaagagaagaagaatgctgaggaatggatgcttgactatgcacttcaaaaggttgtttctaaacttgcacctgctcaaagacaaaaggtggcacttctagtaaaagcttttgaaacaattcttccatttcaagatgctgaaaatagtccacggttttctgcaacgatggaacctcaagcaaatccagttcaaccccttgatgattcctcaaatcatagagaggaagaaacatcattttttcatgatagtagtatggaaatggaagataatgatagtgatgatccaattccagaactgcacaatcctactatgctcaaagaaagatgtcttgactatcctggaactgagacagtcaagaacaagccagcatttggagctactgaagaagacttgactggaaagcaaagtttagctggcagttatggtaatggggagaagatatcaagtgacactgataatatttatctaggggagatcaaagataccacatcaagttccttaaatgagccagttgaaattataagaagcagtcacgaggaggctccaaccgatgaaatagtcaatgatgttccagaagatttgctatccagtgtgaatacagaaaatccagatatgaaatctgagtcacctggaagagacgttgaaaccaagagtctgaagggtgacaatgggcgacaattttccatgtccaaaagtttagtcctagaaggtctagttagatcactcagatctaatttgatcggttcaggagcaccagcaaatgaagcagctgctgaaagaaaagaagaaattgaaaatgttaatatgggaattgagactcttgaagagttccctacaaaggaacaatctgaagctcctacaagtgcggttgtagaacctgagacccctgtagagaaacaaagcaacacaggattgtggtacttggtgtataagcacatggtatcaaatgtggcggaaaacaactctgagtcactaattgatggggcagacgagaaagagtcagggttggatgacatcagaacaggagtaacttctaatgcttatggaaatacacctatgaaggatcaagagatgcaattcaaggatcacgttgtagttgatccagaagttgcacgccaacagattgaagccatcaagatggtagaagaagcaattgattcaattcttccagatgatcaggatgacttagcagacaaggaatcactcacagacagcacaatttctgacaacgccaaacaatccgacagaactgagagaatgcacagtgaagacctgaaccaaaaagaagaaaagatggaatccgggaatggaatgatccaaaaacaagaagaagaatcagcaccaaaggagcaaaacaaaacaaaccagaaaatgtctagaagctggagcaatcttaaaaaagtgatcctgcttaggagattcatcaagtcattggaaaaagtaaggaaattcaacccaagagggaccagatatctacctctagaacctgattcagaagctgaaaaagttaacttaaggcatcaagacatggaagaaagaaaaggcaccgaagaatggatgcttgattatgcacttcgacaggttgtttccaaattaacccctgctaggaaaagaaaagtggagctgctagtggaagcttttgaaacagtcatgccaaccataaaaaattga

SEQ ID NO: 39511 - DNA, 471 bp, Glycine max
  Peptide Sequence Number=SeqID_156289
atggcgagaatagccaaggtggtcaaagtctcagtgcaagaattggaccgagtaaaacaaaatagaaatggggtggtcggaataccaaggaagaacttggagcagaaagaaaaggctttggtggatcaagcatcctctccaagcttcttatctaaggcacattcttggtggcgtagctccttcttccatggcttattccctagtggatggtgccttccctctcctcttctcctttgtcttccgctgcatctccatggtgaaaaatcgccattgaaggacctcattgaagctcaaaatccagcctccatagaagttccacaagcaagcttccatcatgaagggttcacaaacatcccattgatgggaacaaggggttgtatcaattataatcccgtccttgccataagacaacttggctatcccatgagaggagcaccatcagaagaaagtatcgcgcctttcattgcatga

SEQ ID NO: 39512 - DNA, 1434 bp, Glycine max
  Peptide Sequence Number=SeqID_156290
atggatcatattagtaatgaggctagtattgaccgttttccaattggtccttctgacattcttggtaggacaattgctttcagggttcttttttgcaagtctatctcacattttaggcaccacatatttctagtgttgttagatctcttctatagatttaggggggggttggcatcctttatatcatggttgcatcccaggaaccctcaggggatattggcaatgatgacaattgttgctttcttgttgaaacgatacacaaatgtgaaagcaagggctgaaatggcatataggaggaagttttggagaaacatgatgagaagtgctttgacctatgatgaatgggctcatgcagctaagatgcttgataaagagacaacaaagatgaatgaatcagacctttatgatgtggaattggtgaggaacaagcttcaagagctccgccaccgtcggcaagagggatctcttagagatataatgttttgtatgcgtgccgatcttattagaaatttaggtaatatgtgtaaccctgaactgcacaagggtaggcttcaggtgcctaaattaatcaaggagtacattgatgaagtaacgactcaattgagaatggtctgtgattctgattcagaggagctatcattggaagaaaagcttgctttcatgcatgaaacaaggcatgcatttgggaggacagctttgctgttaagcgggggtgcctctcttggagcttctcatgtgggtgtagttaaaacaatggtagaacataaactcatgcctaggataattgctggttcaagtgtgggatccattatgtgtgctgttgttgccactaggacttggcctgagctccagagcttttttgaggattcatggcactcgttgcaattttttgatcaaatgggtgggatttttgcagttgttaagagagtcacaacattgggtgctgttcatgagatcagacagttgcaaatgatgttgaggcatctaacaagcaatcttacatttcaagaagcttatgacatgacaggtagaattcttgggattacagtttgttccccaaggaagcacgaaccacctagatgtcttaactacttgacttcaccccatgtggttatatggagtgcagtcaccgcttcttgtgccttccctggcctttttgaggctcaagaattgatggcaaaggatagaagtggagagattattccttaccaccctccttttaacttaggtcctgaagagggctccacaccagcacgccgttggagggatggtagcttggagattgatttacctatgatgcagttgaaagaactattcaatgtcaatcattttatagttagtcaggccaaccctcatattgcaccattattgagattgaaagaatttgtgcgcacttatgggggcaacttcgctgccaagttgattctgaaatga

SEQ ID NO: 39513 - DNA, 1212 bp, Glycine max
  Peptide Sequence Number=SeqID_156291
atggggactgttgcctcttacaagttacaaagcctttctccgaagaattcattgtctctttttgtcaaatgggcattcaaaaacgaaggcgaagaggaaaaacatcctcatttggtaaatatcggaaaagaaattgtgaacaaatgcaaaggggttccattggctgtgagaacattggggagtttactattttcaaagtttgaggcaaatgagtgggaatatgtgagagacaatgaaatttggaatttgccacaaaataaagatgacattttacctgcacttaaattaagttatgatttcttgccttcctatttgaggcaattttttgcattgttttcactttacccaaaggattatgaatttgatagtgttgaggtagctaggctttgggaggcacttggtgtccttgcaccaccaagaaagaatgagacaccggaagatgttgccaaacagtatctggatgaattactgtcaagatctttccttcaagattttatcgatggtggcactttttatgaatttaaaattcatgatttggtgcatgatcttgctgtatttgttgcaaaagaggagtgtctagttgtaaattcccacattcaaaatattcctgagaatattcggcatctgtcttttgctgagtataattgtcttggaaattcattcacctcaaaatcgatagctgtgagaaccataatgtttccaaatggtgcagaaggaggcagcgttgaatctttgctaaatacctgtgtgtcaaagttcaaattattgcgagttttggatttaattgattcgacatgcaagactttgccacgttccattggtaagttgaaacacttgagatatttcagcattcagaataatcgcaacatcaagagactccccaattctatttgcaagctccaaaatttgcaattcttggatgtttcgggatgcgaggagttggaagcattgcccaaaggattaagaaaattgattagtctacggtatttggagataactacgaagcaacctgttttgccttacagtgagattgccaatttgatctcgcttgcacttctgactattgaagttaccctggagctgcttctgcgtcatgggagaatcaattctcagatttcaatgttgggtttttccattgtccatcaagactatagtgttatttcgtggttcataatgttgattctttgcccgtacaggaaagatagtggttaa

SEQ ID NO: 39514 - DNA, 1024 bp, Glycine max
  Peptide Sequence Number=SeqID_156292
tggcgagagcatatcgggaactattgatgggttgatgaagaatgacccaaacatggatctagcgtgggaaattaaagctttgtgcatctcccaccgtgtaagaggaatcaacgcatcttgtcggccatttctttgtctccctctatcagaagagagtggtaattactgtgtggaacatttttcagaggaatctacctacattgagttagggttagttagcagtctcaaccgtgagagacagggtacgatttggaacaatggcgcaaagtggagtttacaaacgaggaaaagggaagattctaactcagggatctttcaacaacaaggctttcatggtaacaatagcgcaaatttggaaggggtgtcagggtacagaaatcaaagaagcaagaaggaacctttacacttcaagtttctaaatgaaaaggatcgagcactggttgaagaaggaggagatacgaaagacattgatctagatgatttaccctatgggacatggatgaaatcatctcccatgagagcaaacatggagactggaattaggaatgaggtaaagattgggatctttagaaggaggatatattacttggacaagggctcgattactaggaaagaaaaggagacaaaacaggccataccactgatgatggtgaaggtaattcttgaatccctatgtctaagtgtgattactgatggaagcgaatgtgttgataaggaaaaagggaatgaaaaaactactaaaaatataacaggccttgtgatagaatggaaaaatgaagataacacgaagtctctagaaataaaggagatcaagaatacgaataataatggtggtatgaaatggaagagaagggctcgggagaaaggaggggagggacaaaatactattatttgggggaacccatgggcagtaaaggctttcagaaatctcttaagtattgaaggttttggaaagaaaagagcaggtggtttaatggtcctttggaataatagtgtggagattgattacaaagttggtccatga

SEQ ID NO: 39515 - DNA, 384 bp, Glycine max
  Peptide Sequence Number=SeqID_156293
ttgacggcgaactcgctttgggaaaaaacgtcttagtagcttatatgccatgggaaggttacaattctgaagatgctgtactcattaatgagcgtctggatatgccttatttgcaagatggaagacccgttgatatggtcttcaatccactaggggtaccttcacgaatgaatgtaggacaaatatttgaatgctcgctcggggtagcaggaggggattcttttaaacagcctgctataatgggaaaaccttatatttttgaaattattcatcaagttgatgataaaatacatggactttccagtggacattatgcacttgttacacaacaaccacttagaggaagggccatgcagggagggataacggggaagctaattgtag

SEQ ID NO: 39516 - DNA, 372 bp, Glycine max
  Peptide Sequence Number=SeqID_156294
atggatgatttgagtatctcaaaaattcctcaggacacactgtatgttcctcagacaatcaaagataaacacaattttgattatgtaattaataatgtagaaaataatattcctttaggacaagacatatgggaagaatttcatttactctcaaaaaattcaattttcgaacataatagaaaatacaaatacctccagataggatgtgtccaagtagcaatcaaaccattaatagacataggtatagatgccacaatcttaatgtgtcttagagatattaggcacaacaaatttgaagattctttaataggaatagtcgaaacaagtctaggacaaggaccagtctatttcaactgttacccaaacaaaaca

SEQ ID NO: 39517 - DNA, 246 bp, Glycine max
  Peptide Sequence Number=SeqID_156295
atgctccacccaaactgtcgttgcttcctagcccgtgttctttctgatccatttcaaagagtcagaaccgccatggacgacagtggtagaaacaaaacggaggcggtgcattcgtatcaagcacctcatgatggtgatggacacactattgtgactaacatgagatcctccaaaacctctactacacaacgtcgaccagatcactgtctaggggaagaggttgcggtgaagattttgaatatctga

SEQ ID NO: 39518 - DNA, 303 bp, Glycine max
  Peptide Sequence Number=SeqID_156296
atgaaacaaaaaggcacacttaggataagagagtgggtgaggagaagaagagatagaaggagagtgtctgggtacgatgagactggggatgggaggaaagagaaaaaggaatgggaattcaaggctgttgcttcctgcacctccaagttgtttcctgcatcctttccggattggtcatttcggaataaaaaaaaagagtgcattctagaatgtaattttacattttggattgaccaaaaagaaggtgcaggaagcaacagctggaattcaatactgaccgggccactactccattggtggtga

SEQ ID NO: 39519 - DNA, 354 bp, Glycine max
  Peptide Sequence Number=SeqID_156297
acaatgatggtgtaatatttgaaggcagtaaaaaagcgattcagattaaacgtggaattagtttcaatgctttgaagaaaaaaattggagacgttgaaacaatgctggaaagttttaaacaacaagaccaaatgtcagttctagaattgtacatagaaaaggatgtggctagtggttcaatgtttcattctataaattcgcttacatcatgtggaaattatttatctaatgatgagacacaaccgccaacaaatatgagcaatttaaatattgacgaagacgatgatgatgatgattatcttgtgtctaactcatacgttgaagagtctttagacgaagatgacagtgttgacg

SEQ ID NO: 39520 - DNA, 752 bp, Glycine max
  Peptide Sequence Number=SeqID_156298
ggctacactccctggcattcagaggactagacgtcctctccttcagaggactacacgacttaaccttcagaagactacacgccctcgccttcagagtgctgcacaccctcgcattcataggactacacgctctccccttaaaaggactacacatcctcgccttcggagggctacacgtcttcgccttcagaggaatacacatcgtcaccatcagagggctacacgccctcacctttagaggaccacacgtcctcgccttcagaggactacatgccctccccttcagaggactacacgtcctcgccatcagagggttacacgtcctcaccttcagaggacttcatgtcctcgcccttagaggactacacgccttcgccttcaaagggctgcacgtcgtcgcattcagaggactacacgtcgtcgccatcagagggctgcacgccctcaccttcagaggactgcacgtcctcactttcagaggactcctcgtcctttccctcagaggactacacgccctcgccttcagagggctacacgtcgtcaccttcagaggactacacgccctcgtcttcagaggactgcacgtcctcgccttcagtggactacacgtcctcctcttcagaggtctacacgccctcagcttcagaggactacacatcctcacctttagagggctacacaccctcgccttcagaggactacatgacctcgccttcagaggcctacactccctggcattcagaggactagac

SEQ ID NO: 39521 - DNA, 924 bp, Glycine max
  Peptide Sequence Number=SeqID_156299
atggattgggaccagctcttggccgggataggaagtagaacaatcagttggttcccccgatggaaggaaggaaaagaaggagtccttttctcatgtggaagatacccaaacattccgctgataggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgagagaatgaaactaccgcaagagcccttgaacaagagaccaagaaggctcgcaaggaagagtatggccgtaacaaatttcgcggagctctatggggtagcaacaatgaactcaagcttcgaagggaagagagggaccagtcgcgagcacatagcatggttttgaaagaggagttagttgcctgttcaaggtccaaaagaagcttgtctcagcatttatgcgagacggagaccaacatgctagctatcatcgccaagtaccaagaagagttaggtctagccacggcccacgagcataggatcgcggacgagtatgcccaagtatacacggaaaaagaggctagaggaagggtgatcgactctttacaccaagaggcaaccatgtggatggatcagtttgctcttaccttgaacgggagtcaggaacttccccgattgttagccaaggccaaggcaatggcgaacacctactccaccccagaagaaattcatgggcttctcggctattgtcagcatatgatagacttaatggcccacataattagaaatcgctag

SEQ ID NO: 39522 - DNA, 282 bp, Glycine max
  Peptide Sequence Number=SeqID_156300
atgactgttgcagacagtattaagacaactctccctaaaatcgaaagtgctaaaaggtttataggattagtgggagagtattctcaaacggctgataagtcttttgtagggacattaatgagtacattgaccaccatgaagtttgatggttcacgtactatgtatgaacatgtcattgagatgacaaacattacaagattccttacaatccaaaccataagcccaaatgagaagttcatttttatggggtatgaagtgaaagctcacagtggaaatagttga

SEQ ID NO: 39523 - DNA, 789 bp, Glycine max
  Peptide Sequence Number=SeqID_156301
atggccaagttcgatccatatatagtcctcgagttttacgccaatgcttggcctacaaaggggggcgtacgggacctccggtcatgggtgaggggccagtggattcctttcgatgcagacgccctcagtcagttcctgggatatatgcttgtattggaggagggccaggagtgcgaatatagtcagaggaggaaccgggccgatggatttgatgaggaggccatcgctcagctgctatgcataccaggtatgccacctaccaggcaccctctagacccagataagtctaacagggccctgggttttccggcattgatcacgattctctgccagtcgttcggagttcctgtcacacctagtaaggtgattcgaccgccgatcacccgggctttcatagagaagtattgcacagctagacaggcacagggtggtgacccgcaggccccagacgcaccgccgccacctcctcaggctgatccagctgggtcatttgacacggagcggtatttacggcatttggttcgccagcaggcggccaaccacagggcgcacgtgcagacccatgactacctctaccagctcagccttagcctgcagagccagggtttccctccatttccatgccctactctggatcagttcagggcagaggtcgcatggcccgaagattggcctgaggcccaggcaggggaggcacccgcagaggctcccggcgatgcagatgaggcccgcatggacgaagagatgacaaatttgctcgatttcttgggagggagcggagtcacataa

SEQ ID NO: 39524 - DNA, 469 bp, Glycine max
  Peptide Sequence Number=SeqID_156302
tggcttctgtttctatcagctgtccctcctgttcagctactgcggggtggtgcgtaacggcaaaaagccccccggacatcaagcgctggcaagtgtagcggtcccccctgccgcggcgatcggtgcgggcctcttcgctattacgccagctggcgaaagggggatgtgctgcaaggcgattaagttgggtaacgccaggggacgctgctccgtttgctttgctttggacactttctcgtccacccttggtttctttggtcattacgctgagattcttgatgattttgggtccatcttaggtatggtacatcatcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactgggcttactatgttggcactga

SEQ ID NO: 39525 - DNA, 324 bp, Glycine max
  Peptide Sequence Number=SeqID_156303
atgacaattaaccatgaccttcctgtttggcgtccttcatgctgtagtggaggtatttttcgggatcatcatggttttgttttgggtttcttttccgcttatcttggtatccatagcgccttgtatgcaaaatgtgttgcgattattcttgctttggagaaaaaattggagacagggaagggaatacctgtgttgatctgcttgctaattatggggctgcttcaaggacatgttttttttttttttttgtgggatcatgctccaagttttgttagtgaatccctgcccaacagagttagtctcccttcttacgaattcacctga

SEQ ID NO: 39526 - DNA, 976 bp, Glycine max
  Peptide Sequence Number=SeqID_156304
atgagtactgtggctatatttctgatctttttacttttgctatcaagatcaaaagcatcaagcaacattggtgtgaactatggccaacttgggaacaatctaccctctccacatcggtccattgagttgctaacaacaatgaaagctggtcgtgtgaaaatatatgatgccaacccagagattttgaggcttttatcaaataccaagctcaaagtttccatcatgatcccaaacaatgagatctcaggcattgctgcaaaccaaagcatagctgatgaatgggtgaggaacaatgtcctaccctactaccccaacaccatgatccgctacctactcatgggaaacgaagtgctgagctacaattcagagcaaggccaccaaatgtggcgcgatcttgtcccggcgatgcgtagcatcgagagatccctcagagctcagaacatcagagacatcaaaattggtaccccattagccatggatgtgttacaatcaacattcccaccatccagcagcgcgttcagatcagacataagagacagcgtgatggtgccaatgctgaagttcttggaccaaaccaagtcctttttcttcattgatgtatatccctatttcccttggtcaatgaactcctacaatatcagccttgaatttgctctattcaggggaaattccagcagaacaagagaccctggcagtggcttggtttataccaacttgttggaccaaatgcttgactcactcatcttcgccatggcaaaactcgggtaccctgacatcaacctcgtgatatctgaaaccggttggcctaattccggtgacagggaagaacttggagcaaacacaatcaatgcagccacatacaaccgcaacctcattcaaagaatgacaacaaaaccaccaattggaaccccggctagacccggggttgcaattccaacattcatcttctcactgtttgatgaaaaccaaaagcctg

SEQ ID NO: 39527 - DNA, 603 bp, Glycine max
  Peptide Sequence Number=SeqID_156305
acattgagtcaattcaggcatgagccaagaaagcctcactgggatgctgcattgagagtcctcagatacatcaaaggcacacctggacagggcttactattttcatctgctaatgaccttaccttaaaggctttttgtgattcagattggggaggttgtcatgccactagaagatctgttacaggattttgctttttccttggaaattctctcatctcatggaagtctaagaagcaagttgttgtctctagatcatcagccgaatctgaatatcgagctatggctaatacatgcttggagttgacctggctacggttcatattacaagatttaaaagtcccacaagatgctccaacaccattattctgtgacaaccaggcagctctacacattgcggcgaatcctgtatttcatgagcgtacaaaacatattgaaattgattgtcatatagtacgggaaaaactacaagctgggatgatcaatccttcttatgtgccaacaaaattccagctagcagatgtgtttacaaaagctttgggaaaagatcaatttgtgacattgcgcaacaagttgggacttcacgatattcactcaccaacttga

SEQ ID NO: 39528 - DNA, 1791 bp, Glycine max
  Peptide Sequence Number=SeqID_156306
atggcgccaaaacgaaaaccttcgtctccaatctccatcggcaactgcgagattacggtggaggccaaccgcttcacctgcaactccgattcaaacggcgtcgtaatctctcttccccgaagcggaaagatcaaagtgtctgcagcagtggctgcaaaccgtggaagcgcttctgaggattttaggtccggtgataaagaacacgagtttgtgctagttaatcctaaagatgttgatgctattagcaaatcctaccttcaggaagtattacaaatgtatatgacggagctacctggaatgaattatgctgcaaatacgggaaagcaatcaaagtttcttgagagatgtgtgactaatgggaaatatcgtacactacttatcaaatccacttctgttggaatttcaggaaaggttatagctgcaattacataccaaatcatccctgcagatacagaatacgctgagatcccacttgcagctgtcaatgcattctatcaacggaagggttttggtcatctattgtttctagaactaaggaagagactccaaagtgttggtgttcgttctattttatgctggggggacaaagaatcagaaggattttggcttaaacagggttttgtagaaatagcacaggtgggtacaaaaggaagggcccgcaggttacccgtaaaagctgatattcaaaaatcattatgctttcttggtggttcaactctcatggtttgccaccttgggaaagaattcttagctgacgatgctaacactgtgaagtatctcccctcacagtttcatcagaattcctttgcatctgccattgctggagatgaacagctagaattttcaggaaagttacatgtagatttgaaatttccagataaatcttcccatagaatagaatcagaatttgacaggcacaatgctaaggcatgctgcactgccattgctccttttgccaaaataattgataatagacaggccagtgcagaaagttcacaggatggaattgatgctaatgtgaagtattcttctcaatctacaaaaggttcaaagagggcctgggaagcctctttatcttcattgaagtcaaaaagggtgaaggggagccagatggttgactatcaaccagattctagctgcagttttatcttagagactgataaggccaatccttgttttgaagaagtccctcatgatccttcaattacaaaaagttctgaaaaatgtatcggggatcatttgccatcagctaaacaaagctttagaattatgttgatgaatattgctgatgatgctaagaaaacacaacttacaaaggtgattgaagaccttggtggaactatatcccatgatggaagtatgaccacacacgttgtcaccggaaaagtgaggaggactctgaatttctgtaccgccctctgttcaggtgcttgggtgatttcatcaagctggttaaaagaaagttttcgtgaaggcagatttgttgatgaactgcctcacatactgaatgatacagattatctgctgaagtacaaatctgatttaaaaagtgcaattctccggtcaaaagttagccctcatgctttgtttaagggtggtaatgttatcagtggactcgaaaaggtaaacgaaacatcaacaaaaatctttgtggcatgcgaagaagacacagaagaagcaatgatagctgcacagaaaggtatatggactttcagtagcgagtggtttatgaactgtgtcatgagacaagagcttgacttggaggcctcccagtttgcagcgtccttataa

SEQ ID NO: 39529 - DNA, 912 bp, Glycine max
  Peptide Sequence Number=SeqID_156307
atgaacccttctggaagtggcagtgctactgttgttgtcatggtcgtggattgtattgattgcgatggttcgttccctagaactgcggtgaagtcattgtttcaagcgttggaaagaattcaggataactcgaagcgggccaagaagctaccgaagattgttcttgtggcaacaaagattgatctccttccgtcgcaggtttctcctgcgaggttggatagatgggttagaaaccgtgcaagatctggaggagcacctaagttaaacggggtttatatggtcagttcaaagaaggatttaggtgtgaggaatttgttgtcgttcgtgaaggatttggctggtcctcgtgggaatgtgtgggtgattggggctcaaaatgcagggaagtctactctgatcaatgcattggcaaagaaacaaggagctaaagttacaaagctcacggaagctccaattcctgggacaacacttgggatcttgagaattgcaggagttttgccggctaagactaagatgtttgacactccagggcttttgcacccatatttaatgtcaatgagattgaaccgggatgaacaaaagatggttgagatcaggaaggaacttcggcctcggacatacagaattaaggcaaattctgatcctcaactatgcatattgaatcaagtttgcatggtagggcaggctatacaaattggtggcttgacaagacttgaccttgttgaagcctctgttgaaacaatatatgtcatagtttgggcatcagcaaatgtttctcttcacatggggaaaatagaaaatgctgatgaggtttcgagaaatcatgttggtatcagactgcaggtgaaaactagatcggttaaccgaaccggttttgtaaaaacaattcggttaatcaaactggttttgtaa

SEQ ID NO: 39530 - DNA, 465 bp, Glycine max
  Peptide Sequence Number=SeqID_156308
atggagactggaattaggaatgaggtaaagattgggatctttagaaggaggatatattacttggacaagggctcgattactaggaaagaaaaggagacaaaacaggccataccactgatgatggtgaaggtaattcttgaatccctatgtctaagtgtgattactgatggaagcgaatgtgttgataaggaaaaagggaatgaaaaaactactaaaaatataacaggccttgtgatagaatggaaaaatgaagataacacgaagtctctagaattaaaggagatcaagaatacgaataataatggtggtatgaaatggaagagaagggctcgggagaaaggaggggagggacaaaatactattatttgggggtgggggaagacaagaaagggagaacaggagatggaagttgaatattgcacgagtccaaaaaaaattcatagacacaacggtggaggctgttaa

SEQ ID NO: 39531 - DNA, 849 bp, Glycine max
  Peptide Sequence Number=SeqID_156309
atgagaagacactgtaggctttggtggccaaagcaacttttatcaaataaagaatcatcatccagtattttgttggggtggtttgtcacctgctcaccatcatcccttgacattattgcagcctttacttgcagtgaagtcttgctttctagttatagtcctggcattcagatggtttctggaatgatccagtgtaatgagggaatcatttatggcacatgggggagcatgccttcagttcttgaggataagtccaagttctctgtgcttggtctgtgtgtcactgaccctactactagtaatggtttgatgaatgggaaagaagatgacaaaaagaagttctctgagtatggcaatgctttgcaagagggaggtacagatagaaagaataactctaggagttgtcgttgcttccagttagatggttcattgaggaaaagtagccaatatgttcttggaagaagtaattgggttctggtcatgtttgattctcctgaacagaatgatgtaggaatacacaggcttccaaaattgcatcacattcattggaatggactaactatgtcacaatatgatgttccggtacgctttatgttgtcatggggcacctgttttccaaattttgggcttcgatctccaccatgcactggcaactttacacatttcaactcttcattggttcatttcacttgtatattcatcacagatacaggcattagcagccttctggcggcttttcagatacacaaatattttgcacgcatgctcttctttctcgcatattttcatgaagttgctggctattttggcagtggtcggaaatggaatcctgaggcagtggttggatag

SEQ ID NO: 39532 - DNA, 1119 bp, Glycine max
  Peptide Sequence Number=SeqID_156310
atgccggtagaccttgctgttggccggctcgaacaagggatccttgtcgcccgggctgctggcggaaatgtcggaagcccgcaccacccagatgctcaggccttcgttgcggcgggtgtagacgtcgcgggcgtggttgatcgccatttcggcgtcgggcgcgtgcaggctgccgacgtgcttgtgcgccaggccgtgctggctgcggatgaacacttcccacagaggccagagttggaaggccgggcgccgcccggccaaggctcaggccgccttgcgctcggcctgcttgtcggcgtaggcgaccagcgcctcgcgcacccaggcgccgtcttcgtgcgccttgacgcgcgccgccaggcgttcgcggttgcatgggccattgcccttgagcacggcgtagaactcgctccagtcgatctcgccgaagtcatagtggccgcgctcggcgttccacttcagttcgggatcgggaatggtcaggcccaggtattcggcctgcggcacggtctggtcgaccatcttctggcgcagctcgtcgttggagaagagcttgatcttccaggccatcgactgggcgctgttgggagagtcggcatccgacgggccgaacatcatgagggccggccaccaccagcggttcagcgagtcctgcaccatcgccttctgttcgggcgtgccgtgcaggcacatctgcatcagcaggtcgtagccctggcgctggtggaaggactcctccttacagacgcgcaccatggcgcgggcgtaggggccgtaggagcaacggcacagcgggatctggttgatgatggccgagccgtcgaccagccagccgatcatgccgatgtcggcccagctgagcgtggggtaattgaagatgctggagtacttggcgcggccggcgtgcaggtcgtcgatcaggtcgtcgcgcgatacgcccagggtttcggcggcgctgtacaggtagaggccgtggccggcttcgtcctgcaccttggccagcaggatggccttgcgcttgagcgacggagcgcgggtgatccagttgccttccggcagcatgccgacgatttcggagtgcgcgtgctgcgagatctggcgcaccaggtcttgcggtag

SEQ ID NO: 39533 - DNA, 99 bp, Glycine max
  Peptide Sequence Number=SeqID_156311
atggcatgggtgacaggagatcctctagggctcatcagtgaatttactgctcagacaaataaattcatccttatcgccatctacttcaagaggaaatag

SEQ ID NO: 39534 - DNA, 393 bp, Glycine max
  Peptide Sequence Number=SeqID_156312
atgacgttgccacttagcaacattctgcccagcgaccacaatgccgatctccccctacggaagtatcagttggggtcgtgcccacaagacgcccaatggacccggagaagtccaacagggccctggggtttccaggtcgggttacgggcctctgtcagtcctacaggatgcccgtcccccccagcaaggtcataccatcgtgacataggtaaggatcgcacccgcaagacacccaatggacccggaaaagtccaacagggtcttgggttctacgaagcgtccgttgcccctaacaaggtcattaggccccccattaatcgggctttcatcaagaagtactgcacccccaggcaggcacagggcgagacaccacaacagcctggggatggctga

SEQ ID NO: 39535 - DNA, 131 bp, Glycine max
  Peptide Sequence Number=SeqID_156313
atggtagggagagcttgcatgaatgttctctctacttgtgctaacttgagaaatcaagagattttcatggcagcgactgaatggaaacatccatgcttttcggtgctggaaggagaggcatgggctttatg

SEQ ID NO: 39536 - DNA, 240 bp, Glycine max
  Peptide Sequence Number=SeqID_156314
atgggcgcaccgccaccacctcggcagaccgatccgactgggccactgggtgtggatcgttatccacagcatttggttcgccagcaggcggccaaccaccgcggacaggtgcagatacatgagtgtctctatcggttcagcctcagtcagcaagggcagcgttccatcccttttgcatgccctaccctggagcagtttggggctgaggtcgcatggcctggagactggcccgatgcctag

SEQ ID NO: 39537 - DNA, 699 bp, Glycine max
  Peptide Sequence Number=SeqID_156315
atgaaccggaagctgggttacggtgcccaactgcgcgctaacctagaccccacaaagggtgttggtcgattaagacagcaggacggtggtcatggaagtcgaaatccgctaagggagtgttcgatcctaagggacgggggaagcccgtctgatagcgctctgtgcgcgtactccgaaaggaatcgggttaaattcctgaacgggacgtggcggctgacggcaacgttagggagtcggagacgtcggcgggggccccggaaagagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 39538 - DNA, 171 bp, Glycine max
  Peptide Sequence Number=SeqID_156316
atggccggtgtcggtcgttatatggccccgactgatatctttcagcctacattgcgcaatttcttttacaaacgctggccgataatgacggctaggtttttccgtgcgagctcaaccgagggttcattccgaccgacactggcatgttgttcttctcatttaggaggataa

SEQ ID NO: 39539 - DNA, 1575 bp, Glycine max
  Peptide Sequence Number=SeqID_156317
atgaacgccgagctggccaacctgggcaccaagttcagccagaacgtgcagtcggaagtgaacgcttcggcaatcaccgtcgacgacgtcaaggagctggacggcctgtccaaggagcagatcgccgccgctgccgaagccgccaaggcccgcggccaggacggcaagtacgtgatcaccctgctcaacaccaccggccagccgccgctgaccaacctggccaaccgcgccctgcgccagaagatctacgaagcgtcggtcagccgtggcagccgtggcggtgagttcgacaacaccgcgctggtctcgcgcatcatgcagctgcgtgccgacaaggccaagctgatgggcttcccgaacttcgccgcctacaacctgaccaaccagaccgccaagaccccggaagcggtcaatgcgatgctgggcaagctggccccggccgccgtggccaacgccaagcgcgaagccgccgacctgcaggcgatgatcgacaaggaacagaaggccgcgcgcaagccgaccttccagctggaaccgtgggactgggccttctacagcgagaaggtgcgccaggccaagtacaacttcgacgagtcgcagctgaagccgtacttcgaaatgaagaacgtgctggagaacggcgtgttccatgccgccaacctggaattcggcctgaccttcaagcagcgcaccgacctgccggtctaccacgatgacgtcaccgtctacgacgtgttcgacgccgacggcagccagctggcgatcttcatcttcgacccgtatgcacgcgcctccaagcgcggtggtgcgtggatgaattcctacgtttcgcagtccaagctgaccggcttcaagccggtggtcgccaaccacctgaacatcccgaagccgccggccggccagccgaccctgctgacctgggatgaggtgaacaccaccttccacgagttcggccatgccctgcacggcatgttctccaacgtgaagtacccgtacttctcgggcacctcggtgccgcgtgacttcgtcgagttcccctcgcaggtcaacgagatgtgggccgacaacccggtcatcctgaagaactacgccaagcactaccagaacggttcggcgatgccgcaggcgctgctggacaaggtgctggcggcggccaagttcaaccagggctttgccaccaccgagtacctgggtgcagccatgcttgatcagcgctggcaccagatcggcgccgaccaggtgccggccgccaaggacgtgatggccttcgagcgcgccgcgctggagaaggacggcatctactacgcgccggttccgccgcgctacaagaccccgtacttcagccacatcatgggtggctactcggccggctactacgcctacatctggtcggaagtactcgacgccaacacccagaagtggttcaaggacaacggcggcctgagccgcaagaacggcgaccacttccgcgccacgctgctgtccaagggtggcagcgaggatgccatgcagctgttccgggatttcgccggccacgagccgcagatagaaccgatgctggaaaagcgtgcctga

SEQ ID NO: 39540 - DNA, 351 bp, Glycine max
  Peptide Sequence Number=SeqID_156318
atgatgtacctaagcaggcgagctcctggcagtcaacagataaaaggaacaaagaccataaagcaaggaggcttgtggtggctggccagctgtgaattttgtgtgatatgtggattatggcctctggtaatcgattaccaagggcttgaaaacgaggtcagaaaactaggggagcttctggtaatcgattaccagggagatgtaatcgattaccaggcttcagaaaggaactggaacactgtggaggcctctggtaatcgattaccagcctgtgtaatcgattacacagagggatgggtcactgcctctggtaatcgattaccagacttggtaatcgattaccagagatga

SEQ ID NO: 39541 - DNA, 1455 bp, Glycine max
  Peptide Sequence Number=SeqID_156319
atgatgtacaaacatgaacaggggatcccgatgaagattggaaacaaccggccattgcacggcagcgtgctggccggcgtggtaggcgtgctgttgctggccggttgccagcgtgagagcgaaccggcaccggtggccgacggggcacctgccgccgagaccaccgccgcaggcgaaacgccggccacggaagcgccgctggacctgcgcgacgtgatcgagaacaacgaacgcgaagtggtgggcatcagctacccggccggcatcgaccgctacccgggcctggcacgcgcgctgcaggactatgccaccagcgctcgcagcgacctgcagcaggcactggacgggctgggcaatgacaagccgaccatgccctacgagctgtcgctgagcttcgagaagctgctggaaacgccacagctggtggtggtcagtgccgatggcagccgctataccggtggcgcccacggcgagccgctggtggcgcgtttcgtgtggctgccggcgcagcagcagatgctcagcgccgacaagctggtggccgatgccagggctggaaggcgatcagaatcgctgcgcaatgcatcgcgcatgatcgccgacggtaccggcccgcaggccgacaatttcagccagttccagccgctgaccgacgacaaggggcagatcacggcactgcgctttgttttcccgccctaccaggtgggtccatactcggacggcacccagaccgccgatgttccggcggcggtgctgttgccgcacgtggccaaggactacgaagccggggtccgcatcggcggtacccagccacaggatatccaggtgcatgacccgcgcttcttcgcgcgggtcatgggccaaggctcgctcggcctcggcgagagctacatggagggttggtgggatgccaacgtcctggatgaattcctcgtccacctgatgcaggcgcacctggacgaacgggtgcacggttggcgcgaagtggccgatgcgctgaaggcgcgcctgttcaacctgcaggtggggcagggcagctacgaagtcggccgccgccactacgacctcggcaacgatctctaccaggccatgctcggccagcgcctggtctacagctgtggctactggcgcaatgccgacgatctcgacaccgcgcaggaagccaagctcgacctggtgtgccgcaagctggggctgcgcccgggtcagcgtgtgctggacatcggctgtggctggggcgaagccctgaagttcgcagccgagcgctacggcgtcagcggcgtcggcgtgaccatttcgcaggaacaggccgagtttgcccgcgagctgtgcgcggggctgccgattgaaatccgcctgcaggactaccgggaactggacgaaccgttcgatgcgattttctcgatcggcatgttcgagcacgtcggtgacaagaactacgccagcttcttcgag

SEQ ID NO: 39542 - DNA, 1602 bp, Glycine max
  Peptide Sequence Number=SeqID_156320
atggagacgatctctttttataaatctgtaacctgcaacgtcattggtatgcttaccaatagtctaacaaagacccctgctggctttgtatcatcctttgataaaaatcttatcaggtcagtcgggttccagcatgccacggattctgccaaggctaatgttgctaaatggagggcgaatactcgcactctttggagagtggagcaccctaaggtagctagtgccatcgttgctcttgctgaggctgtgaggtcaaaccaccaattgtcttctaaagttggcagtgtattggccaagttgttgtgcaccagattagacagtgatgaactgttcaaacattgtaaggacttgcaggaagagaaaaagaacttggctgataagagcttgaggaggagctgctcacaggtcaggttcttcgccaaggacctcgacttgagtctcttttaccctttcaaggacgtaaaggacggtgttcagcttgatgaggatgatcttgctggagaggagaaggctactgctcctcccttgatgcttgtgaggagaatgtttgacttgcccttggttgaaggtcttgccaaccagtttaggagtaggttgctagacctttggagtttctcctctgatgcttctcctttaatggttatgaggagtaagtatgacttccacctgattgaaggcgtgcgtaccaaggtagaccttgggttttttggtaccaagggtggaccctggatggaacttagtaacaaaaaggtctcaccaagggtgaacctcgggttcatagagtcttggaccggggatgtgtttgacttgggtttcgacaagcttgtagagtttcatcgaggcttggattttgtgaacctggcggaccttgggttttgcaagccctttggaggattgactagggaattgtctaaactgggttttgggcgccatgctgttgcatacatgtcactcaccatgggtggcacatactgcagacttagtggcgtgctcttgcgtacatggtgtgctcttgcgtacatgtcacttgctgtgggtggtgtgtattggagacgtagtggcatgctcttgcatacatgtcacttgttggctcaccaagggtggtccttgggttttgagagccttggagctacgattatggatgttcctgcttgttgtgaccttggatgggccttccaagttggggccaagctttcctgctcggggatgttttctggcttcacctcagactcgccatacgaggtcattaggttgaaaggcttgtggttgaaccttggtattatatctcatcactgctcggagtttggtagcttgttgtctgtgacaatggtgtatgggaggtcgtacctgcatatgaggtgttttcggtatgtccgttccccacatggcgaaaggccaaggggagctcagaatatgaagattgagtgttggaacaactgcaaactcttggcattgtctgcacctcttggtgaagtcgagggcgtttgccttgagtgttggctagtagtagctagcccgcaccactttagtggcaagttcgccatcaaggatgatggagcagctggccttccatttcaggtggcgagcttcattctcgtctga

SEQ ID NO: 39543 - DNA, 861 bp, Glycine max
  Peptide Sequence Number=SeqID_156321
atgggagaagaatggtgcaaaggtgtcaaagaagaagtggacaaactccttaatgctagcttcatcagagaaatctgggcataccccaaagacgcgtaccctctacccagcatcgacaaactagtcgatggagtgtttgggttccatgtactaagcttcctggacacctactctaggtacaaccagattcggatgcatgctccagatgaggagaaaatgacattcattattgaagatgccagtttttgctataggatcaaatggaacgtcaaggtatatgtggacgacatggttgtcaagtctcaaagcatagcccaacatgtgtcagacctagaagaagtctttgaggagctccgcgagtatgacatgcgcctcaaccttcaaaaatgtactttcggggcaggcggaggcaagttcctcggcttcatgatcactcaccgagggattgaagccaaccccaatgaatgcaatgccatattggagatgtgcagccagaccaatgaccaagaagtccaaatactaaatggtaggctagcatccctgtccaggttcctcttgaagttcgtcgaaaaggtggtgctagcactcattacgttggcccaacgacctaggccctacttccagagtcatctagtggtagtcaaagcgaacaaccccatcaagaaggttctgcgaagcctgaactcgcaggaaggatggtggcttggaagcgggacaagaattatcctcaaaggccctaacaatgtcactctggagcaagcactcaagctcaacttcagagcctcaaataaccaggcaaagtatgaggcactcattgccggtctgaaactagcaacaggagtcagggccgagaagctatga

SEQ ID NO: 39544 - DNA, 996 bp, Glycine max
  Peptide Sequence Number=SeqID_156322
atggattcattactggaacaagcaacacaggggagttttgttccgcatgggcgacaggacatactcaacacgacccttggccgacctgagcatccaggccgtgttcgcgtcgtaggaacaggtgtcacaataagccaatactttggccaagcctcacgtgcttctagcacatcgtcaccatcgatcaaccaacaacaattggctgatatcatcggtgtaattaaggatgacataagaaagctgctacaagatgagataagaaaggaggtacaagatgagataagaaaggaggtacaacaagaacacaagcagcaacaagaggattggatgagggcagttgaagaaaaacagtggcaaaatttggagctgatgaagcaagagttaaaaaaatcattgaaagtagagctatctcatattgcatcacatcagtcagcccccattaaggcaccagaaatacaagctctacttgcacgtgttagtacaaagggtagctgcgctggacctgaaggaagcggattacttaaagagcttttgagtggtggtgacgatctgatgggcttgttcgtagttgttggggaaaatactgtgcttgcgggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggccgttggcacattcgtcacatggccgacccattttgttagggaagtaactaatgaggtggtcgtaggatccgataagcctccatcaaagtctgttggagagccaaacaggttaacatctgtggccacagatgacccactaggagaattggttaagaagtcatatgtggtttacacaaagccaatggagttggcatgggacggggcgaaatttgggttacctaatgcctcaaatgctgtggatgatgtttatgaatga

SEQ ID NO: 39545 - DNA, 657 bp, Glycine max
  Peptide Sequence Number=SeqID_156323
atgaccacattggtctcgacgtgtcaatgggctcgcttgcctttggttgacgaaaggtggcagataaccctaaggtgtctccacgtgtcatcggacttgtcgtctctagatgacgaaggcaatactaaagtagtctcagtcaatgggctcgtttgcctctggttgacaaaaggtgttgataaccgtaaggtgtcttcacgtgtcatcggacttgattgcctccagatgacgaaagacttgccgtctctagatgatgaaggtgagactaaagtagtctcggcaaaggtgcggataaccatgaggtgtctctgcgtgtcatcggacttgccatctctagatgatgaagacttgccatctccggatgacgaaggtgagactaaagtagtatcggtcaacgggcccgcttgcctctggttaacaaaaggtgcaaataaccatgaggtgtccttgcatgctatcggactcgattgtctctggatagcaaaggtgtggataaccatgaggtgtctctacgtgtcattggacttgccgtctctggatgacgaaggagagactaaagtagtcttggtcaacgagctcacttacctctggttgacaaaggtgacggataaccctgaggtgtctccatgtgtcatcggacttgccgtctctggatga

SEQ ID NO: 39546 - DNA, 303 bp, Glycine max
  Peptide Sequence Number=SeqID_156324
atgacatccccggtcaagcaaaagctgcagaggatgaagccagagatgtccctaaaaattaaagaggaagtgaaaaagcagttcgacactagcttcttggcagtggctcgatacccagaatgggtggccaacattgtgccagtccctaagaaagacgagaagatggcaccagaggacatggaaaagactacgttcgtcaccttgtggggaacgttctgctatggtgatgtcctttgggctcaagaacaccggggcaacctatcaatgggctatggtagcattgttccacgacatgatgcataa

SEQ ID NO: 39547 - DNA, 721 bp, Glycine max
  Peptide Sequence Number=SeqID_156325
agggctgcacaccctcgccttcagagggctgcacgccctcgccttcagagggctgcacatcctcgccttcagagggttacacgtcctcgccttcagagggctgcacgtcctcgccttcagagggttacacgtcctcgccttcagaggactgcacgtcctcgcctttagaaggctacacgtcctcgccttcagaggactaggcatcctcgcctttagaggactacacgtcctcgccttcaaaaggcttcacgccctcgccttgagagggctgcatgccttcgccttcagagggttgcatgccctcgccttcagaggactgcacgtcctcgcctttagagggctacacgccctcaccttcagaggactacacgttcttgtcgttagaggactacacgtcctcgccttcagagaactgcacatcttcacctttagaggactgcacatcctcgccttgagtggactacacgtcctcaccttcagagggctacacgtgctcgcctttagaggactacatgccctcaccttcattgggattcatgtcctcgcctttagagggcttcacgtcctcgccattagagggctacacgtccttgccttcagaggactgcacatcctcgccttgagagggctccaggtcctcgttttcaaagggctatacgtccttgctttcagaaggctccacatccgcaaatttagagaactcaaggtcctctgcccttaa

SEQ ID NO: 39548 - DNA, 186 bp, Glycine max
  Peptide Sequence Number=SeqID_156326
atggggttgaaccaagcacatgcctttaaggataggttcatcaagtcaaggaaagaatgcactttacggtgcctttaccgaacgcatgctagagctagagtaatgagtgaagaagaagacaaggtacaagagtggataaaggccgacatagaggccctgatgttggatcgagtggcctcagaataa

SEQ ID NO: 39549 - DNA, 186 bp, Glycine max
  Peptide Sequence Number=SeqID_156327
atggagaacgagcaatttctgattgaacagacttggagatcaactcaggagcgcatgtcacttgaggtggtgtttcgtatcggatgtgcggtaggaggctttgtggttgatttaggggtggcctttgtggatgattgggttgatggaagcttgcttgtggagcttctatggagactagatctttga

SEQ ID NO: 39550 - DNA, 201 bp, Glycine max
  Peptide Sequence Number=SeqID_156328
atggcatgtctagaggggcaaaaagttgcttttggtacatataccctggtggaagaagctgagtcttggtgggagaatactcgccaatacctagaggctgaaggtcaagatgtgacctgggatgtcttcaagagggtatttttggagcaagaaggagatggagttcttggagctcaagtagggaaacatgattgtggttga

SEQ ID NO: 39551 - DNA, 158 bp, Glycine max
  Peptide Sequence Number=SeqID_156329
atggcaataactgaagctacagggctccaaatgaggagttatggccacgagataattctgggcagaggtggattttctggaattgtggtttcaaataacaagggtgaagatgaaaggaaggaaacaatcactctttcctgcaagggcaacacacaaag

SEQ ID NO: 39552 - DNA, 138 bp, Glycine max
  Peptide Sequence Number=SeqID_156330
atgggtcaggatgacactggtgcagaagatgacgtaagtctccgcttgtcaacgggtttccttgcccctgattggcaaaggggtgcagaagacgacgttagtctttgtatgctaccggacattgagtatgacggatag

SEQ ID NO: 39553 - DNA, 612 bp, Glycine max
  Peptide Sequence Number=SeqID_156331
atgggtgtttggtttggttgcttcagcgtagacaaacacatgtgcaaggaagaagagagattgacctctgaagaagcacatgccaaagctgccgaagctgcacagaaaaggctcccaaacgaggtggaaaggctctggctattgccgctaagaccaagcctgtacataactactcggagttcaattcgattagggatttggttgtttgctatcttttttttaatttttattttgaaagtgattttttctgttttgaaatctcaagagaaggtttcaaatctgctgtttgagaagcgtccaaagaagttcagaatcggaggggcgttgcctccgaagagagacttgactcggttcatgaagtggccaaagaatgttcaaattcagaggaagaagaggattctgaagcaaaggttgaaggtttctccagctttggaccagttcaccaagactcttgacaaaaacctaggatattattttggtgatgtgtattttgttactctgagacatgctcctgtttctcattactatagcgggttgagaagagaggttaatggcttcaaagatgctaagaagggggtgcctgatttatccgagtatagggatgtgtactag

SEQ ID NO: 39554 - DNA, 444 bp, Glycine max
  Peptide Sequence Number=SeqID_156332
atggcgaaacaagatattttttcaaagtttagatgtcacatgtcatcatttgatatttcagggtttagcgccagcttcaacccctacaccaccagcgatgagaagaggaaaaagccaaatgacaccacttcgaagatgaggagcttcttggcaacgtcaacgttggcatcgcaaaaggagtggttcttgaggctgcactggcctggagtggtgagggggaggcccatgaagatgatgatcgtgaagaaggatttcacgttcaccaggttggtggtggctgtcacgcgcacaccgacttgctatagtagagggtcatggtggggtcgtgattgtgtgcaagggaggggtggcgatggaaggatgaagaagatgaaccggcttggctggtggtggaaggatgaagaaaatgaatggggtaaggcgatggggctaggggtggattag

SEQ ID NO: 39555 - DNA, 391 bp, Glycine max
  Peptide Sequence Number=SeqID_156333
atgagcggtgcggggtttagggctttaatactgagcagtgtgaggaggacgatccataaattttttcaccaatctgcattatggcctatacaattggagaattggagtgacatgcttgcatcctcaagagtatcactcggccatgaaaaatttacacaggataagacagatgaagctgaaggtatatgcggactagatgtcccagccatcccgtgcggttctcatattggaatcatgaagtatattggaatcatgaagtatatgaatttggatgcttatagattttccatttcatggtctagggtactatcgagaggaaagcttaatgcaggtgtaaaccatgaaggagtgaactactacaacaacctcatcaatgagctcatggctaatg

SEQ ID NO: 39556 - DNA, 231 bp, Glycine max
  Peptide Sequence Number=SeqID_156334
atgggtaaacgagaaaacattgggtgcagtcatgtctgtggtgtaaagaggatatgtgtaagtttggaaaaagtggatgatatacatgaccatattggaacagatagtcataaggttaaaacgaagtctggtaaactgaaagaaacttacaacaatagaggtagatgtggaggtactcatgttgccgtgtgggagtttaaggtgtcacacaaatggaaggagttacaatga

SEQ ID NO: 39557 - DNA, 1923 bp, Glycine max
  Peptide Sequence Number=SeqID_156335
atggctgctactcaaaagcccatcaaatcttgcacccccaagaaactcccgaacgccccaatttcagtttctaaggtgagggtcatcgtcagagtcaggcccttcctcgcacacgaaacctcatcaagaaacggcgttgtttcgtgcatctccgtcctggaccaagatttcgaatctccgcaggacgaggttactgtttatctcaaagacccactaaccagccggaacgagtgctacctgttggactctttctttgggcaagaagataacaatgtgggccagatattctgcggagaagtgagccccttgattccgggaatgttcagcggatgcaattccacggtgtttgcttatggggctactggcagtgggaagacatacaccatgcagggaaccgaggaacaacctggcttgatgccactggcaatgtccatgatcctgtctatttgccagaggactgacagcacagcacagatctcatactatgaggtctacatggaccgatgctatgacctcttggaggtcaaagcgaaggagatttcagtttgggatgacaaagacgggcaaattcacctccggggactatctcaggttcctataaacacaatgtctgaatttcaagatgttttctcttgtggagttcagagacgcaaagttgcacatacaggcctcaatgatgtctctagtaggagtcatggagtgcttgtgatatctgtgtccactctttctgctgatggcacaggaactgttgcatgtggaaagttgaatctcatagacttggcaggtaatgaagataacagaaggacatgtaatgaagggattcgtctccaagagagtgccaagataaatcagtcattgtttgcgctgtcaaatgtgatatatgcattgaacaacaataaaacaagggtaccctaccgagaaagtaaattgacccgtatattgcaggactctctaggcggaacaagtcgtgcactgatgattgcttgcctgaatccaggagaataccaggaatctgttcatactgttagtttagctgctcgatcaaggcatgtctctaattttgtgccttcaggtcacaaacaagagaccccaaaagttaaagttgacatggaagcaaaattgagagcttggctagaatcaaaaggcaaaacaaagagtgcacaaagacttgggccattaaattctccacttccaaaaaaaacacccagttctattgttactcctgctaagagatccattacctttaacagttcagtgaagaagtgggggaaaactgccaacctagatgctcaacatactaatgaaagggcctttgctgtagcttttggaaatttactagatgttgaaggctcttttcattcatgcatggagaatgcaccatctggtgtcaaggacaatgataagaaagagactgagcatgatgccaataaggctgcaaggaaatcatacaaaagtctacctgttgagtcattgagcaagggagtggactcaattactattgatggtaaagatgcagcacaaagtccattaagaaaagccctctcccccatcaacatcaatggtaatgagaaaccccttgaatcacaaacaccttttctggcaacctgctccactaataaaggggcacaaaagaatgacactccacttggcaaattcagcacacgaagttctacactgaagaactgtctagttcaagaatacattgatttcttgaataatgcaagcagagaggagctactagagttaaagggtataggagagaaaatggcagaatacataatagaccttagagaagaaagtcccctaaaatcgttaaatgatttggagaagataggcctctcttccaagcaggcccataacttgttcacaaaagctgcaaaaacgctatttgaagataaagctgaagattcaatactcggttga

SEQ ID NO: 39558 - DNA, 817 bp, Glycine max
  Peptide Sequence Number=SeqID_156336
aggactacacgtcctcgtcttcagaggcctacacgtcctcaccttgagagggctacacgccctctccttcagagaactacaagtccacacctacaaagggctacatgccctcgccttcataggactacacgtcctcgccggcagagggctacacgtcctcgccttcagagggatgcacaccctcgccttcataggtctacacgtcctccccttcagagaacaacacgtcctcgccttcagagggctacatgtccccaccttcagagggcaacacgccctcgccttcagaggactacacgtccccgtcttaagaggactacacgtcctcaccttgagagggctacacgccctatccttcagaggactacacgtcctcaccttcagaggactgcacgtcctcgccttcaaaggactacacgtcctcacctacaaagggctgcatgcccacgtcttcagaggacaacacgccctcgcctttagaggactacacgtcctcaccttcagagggctacacgtcctcgcatttagaggacaacacatcctcgccttcggagggctgcacgccctcgccttcagagggctacatgcacttatcttcagagggctgttcgccctcgccttcagagggctacacgccctcaccttcagagggcttaacgccctcgccttcggagggctatacgccctcgccttcagaggactacacatcctcgccttcaaagggctacatgtcctcaccttcagagggctacacacccttgcccttagtggactatacgtcctcaccctcaagagaactacacgtcctcgcctttag

SEQ ID NO: 39559 - DNA, 213 bp, Glycine max
  Peptide Sequence Number=SeqID_156337
atgggtttgtcattgcttttgatggaacatgttgctgctctagtagaagggcaattgggtgaggtgaacgttcttcagtttgttatgagaagtcaaggatcttcaccatcgtccacttgtggaggtggaaccgtgacttatgtcaaagccttcaatgaacagattaattcagaatacgatggtagagttgtgttcaacaaaaatggcgggtaa

SEQ ID NO: 39560 - DNA, 114 bp, Glycine max
  Peptide Sequence Number=SeqID_156338
atgtatgacccggcatttgagagggctggcgttccaattgatcccattctcaggttgttcaacgcaaattcagcagagaaaccagccgaagaagtgcctgaaaatccgaattga

SEQ ID NO: 39561 - DNA, 600 bp, Glycine max
  Peptide Sequence Number=SeqID_156339
atgaggatatgcttgcttgcaaatgaggttgtgcatgaggtgaagactaagaagagagcttatcttatagttaagttcgattttgaaaagacttgtgacatgcaaatggattggattagtgtgggttgccttcaatcatcctttatttttgttcttgtgaatggtggtcccacaaaggaattcatagcacaaagagggctaggaaaaaattgttcagggtggatactgggaggggtggttgcaatccgggttagggagaggagtgggaggtggaaattaggtgaacttttgggaagcagagtggttaggagacggttgtggagtgtggtgattggtgtgagatttaaatccagtgggaggctgctgattggtgtggtggagtgtggtcatggcatttctcatggagacagttgtggttacaatgggaaatacccattgtgcaacaattggaggaggcttcggagggttgggagccaaagagttttacctggggcaaaggctagatgtgtgtcgggggctgtgatttgcaatgatatggttgttgtggaagcatatgaaccatatcatcttcaacgaagtactaatggggccaaggattga

SEQ ID NO: 39562 - DNA, 246 bp, Glycine max
  Peptide Sequence Number=SeqID_156340
atgagaaaagaagttgtcatcacgggtgaaggaggtgtcattgtgggagtagttcacacaaagaggaaggtgttagggtttgcctatactaaaaacgagcctgttttaatcttgggaactgcttggggcacccagcagtttttcaaaataccaaaaatgtccttatgggtattttctgttacaaatagtagattaggtttttttatttctgcagcacccttttttcctaaaatcgcacttccttag

SEQ ID NO: 39563 - DNA, 324 bp, Glycine max
  Peptide Sequence Number=SeqID_156341
atgacagatcaacgtttggttcctatggttcatattctactctactgcaaaatccaaggtttggttaaaatatctgcgggtccacacctcagccagcaggatacttggattgtaaaccataggaaaatgttgcatggacagcgagaaccaccacgtcgcggtcgtccccggaaacactttgaaccaggccagacatctcttcctccttataagcgccgaaagaggggtaaccctgggaaaacacctttatccggaggaaacaacacttctgatggtgtggtgatcagggaagatcagaacccaagaaacccctcctctgactaa

SEQ ID NO: 39564 - DNA, 693 bp, Glycine max
  Peptide Sequence Number=SeqID_156342
atggacaaggaggatctagatatgggatttgattgggctatggtggaaatcctttgcaatgtttcagctacattgccagactttcccactaatgtttggcagcaagtgaatgaacccaatgttcacgacatggtgggaactgtggttgcaacaccaaacatggcccacaataccgaggaagtaaactcttccagcatgggaggaaaccctccacaactttctgtaaatgattcttatcagttgcccttgttgtctccaaacacttccgctccattattggatccggatgctgagtccaactgttatataccatccatggtgggattgatctcagaaggagtaggttcatcagttcaagcccaagatatcaccatcccgatgaactacaacaatcaatatcctctcatgcaaaacaataatctacctctaaggccggaactgggtcaggtcaacgagaacaacacaagcaatcaactgttggtttcaaatatgttagcaaaccaaaatttcaatgaattcaatgcactgttttcctcttatccatccttttttaagcaaaaccctgtgagtgcgcaggcaggagcatggagttggacaacaaatggacatttcatgactaaccaaacttccccggcatttgctctcaacaaccgtggcatcaaccctcctagtgcgtggaattaccccaggtaa

SEQ ID NO: 39565 - DNA, 321 bp, Glycine max
  Peptide Sequence Number=SeqID_156343
atggctcctaccaaagcttcatctaaggagatggaggatacatcggttggaaaatcaggacactcattttttccttgctacaacaatccatggactcttgccaaggaacttctcatgggattaaaagaacagctagcctctaagtctacacctccccatgtatcttcttcacttttagaaggggggttcgaaacccttgtgcaaaagccatggtggttctgtttcgacttcacgatggtcgcgtgtggtaacgctatgatcaagtgcattgcaaaaggaaacgacaatgatagccagggtgttattgctctcttcctttga

SEQ ID NO: 39566 - DNA, 321 bp, Glycine max
  Peptide Sequence Number=SeqID_156344
atgcagattgtgctttttgggaacgacctagatgagtgcgacacattcaactgtgaggaaggagctaacaagaaacaagttggtggggcagaagcgggttcccaaaatgcgtctttgggaagagatgcgtcaagtggtcggtccaacagagacgagacatgtgtcaatgatggaagtgatcggagcaactttcaatggtgcagattgttccgactctttttgactgaaactgaagagaaatgttgtcccttgaacataatcaagcagtgtgggagggggatgaccatacaaggccgtgaaaggtggcatgtcgatggatga

SEQ ID NO: 39567 - DNA, 621 bp, Glycine max
  Peptide Sequence Number=SeqID_156345
atgggaagaccacttgtgcataatcacactattgaattggcagctacagaggcaatggttgctgccatgagagagcaagcgacatccaccaccaacctcattaaccaagtgttgaggggatcatctggatgtgaatacaactcctcaattgcagagtttggctccaaggagatggataacatctttgaggtggtgccaactactgaggaacagaaaatggtgtatgacacattcatgttgaaggatgaggcaaaaaattggtggaaggacacaagggagaggatgatggccttggagactcctgtcatttgggagaacttcaagatcacattcttggagaaatactttccccacaatcaaggcctgagatccgatattcctaaccaagttgggattttggaaattaggagttatgcactcctagttaacaaatgtctcattgtggaggataacttgaacaagttgaaggcagaccaatgtctagtcctcaaaaggaagagtgaagaaatgacgcatcctcccactatcaagtacaagatggaaggattcaagggcaagaaagtgatgatttttgggactcctaaggtggaggcatgccccaaatgtgggaaaactcactga

SEQ ID NO: 39568 - DNA, 303 bp, Glycine max
  Peptide Sequence Number=SeqID_156346
atgactatctgctatgactatacaactacctgctgcctgttgctttttttctttggtatctcacccaattcctcacagaaacctccaagcctgaacccaactgacccctcacttccagttcagcagtttattctcttcactctcttccttcaccctacctctcctgctatgatcaaactattgtgtagggttatggtgattgacatgcttctcttcaagtatatcatgtttcccaatgttggcaatggacactcacctagatgccatgaatcccttcacagtgtggcgtggactagcttctag

SEQ ID NO: 39569 - DNA, 132 bp, Glycine max
  Peptide Sequence Number=SeqID_156347
atgggggaggcaaattttggaaattacatggaagtgactttcaggaaaaggcaggttttaaaaaagataaaacttccttcaaccgccgaaaaccacctgttcatcaaccgccaaaaaccacctgttctttga

SEQ ID NO: 39570 - DNA, 1794 bp, Glycine max
  Peptide Sequence Number=SeqID_156348
atgggtaatcgaatcagtaatctctgcctctgttcctccggcgacgcctccaggaggttcgagaacagagctttcttcctctccaagcaacaccagaattccctcggaaactccatctgctacgtgagacctgacacgtgccggttctccgttgatgacatcaccctcttgactttccggtcagtgtccggcgccaccgtgagtgcaaacacgtcggcgacgccttcaacttcgctcgatgattcactccaacacagcgtagttttggattcctctgcttcatttgagagctctggttccttcacttccactttagtgccttttcagcatcaacatgctcgtggattctccgtgggaggctctacagaaagagggttgtattggggtcttcgtgatcgtgtggtgaacggtgaagggtctattgagaaaggttattctgaggtagcaatgaagaaggggaaaagaagtaaaagaaatttgaaaaaggttctgagtagagcgtttttaagtattgggagaagatcagttttgaagaaaaatgataacactaatgcgagagtgagttgtagtactggtttgagtttgcaaggtgctgagggtgataatgataactatttggatggtgatgagtgtgatgtgttaatggggtgtgagaatcttcactgggcacaagggagagctggtgaggatcgtgtgcatattgtgatttgtgaggatcatggatgggtttttgtggggatttatgatggttttaatggcccagatgccactgattttcttctcaacaatttgttttatgctgtgaatgatgagctcaaggagatgttgtgtgctcacaacaagtttgaatccatggctatggattcagactctttggagttggaggagaatgtgttgttatcaggtaagggaaatggaggggttgatggtggttgttcttcaagtgaatataaagaaaactatccaattgaaaatgaagagttaaatttggaatgtgcatcagaaggagaggagggaatgaatgggataaatagtcaaaaagtggatttgagtcactcagatgtgttacaagctctttcagaggcattgaggaagacagaagatgcatttttgaagactgttgatgagatgattggtcacaaccctgtgttggctatgatgggttcgtgtgttttggtgatgttgatgaagggtcaagatgtttacttgatgaatgtgggagatagtcgtgcagtgttggccactcacactggggaacctcttcagctcaccatggaccatagcactcaagtgaaagaggaggtttacagaatcaggagggagcatcctgatgaccctttagcaataactaaaggccgggtgaagggtcgcttgagtgtcacaagggcttttggggctgggttccttaagcagcctaagctaaacaatgctgtgctagagactttcagagtgacctacataggggaatctccatacatcacatgtttcccttcactccaccaccacaagctcagcacaaatgacaagttcctcatactatcttcagatggactttaccaatacttcaccaatgaagaagctgctgccaaagtagagtcattcatcaccatgtttcctgatagagaccctgcacaacttctcattgaagaagcactaggtcgagcagcaaaaaaggctggtatggagtttcatgagttgcttgatattccacaaggggaacgccgtaattaccatgatgacatttccattgtcataatctccatagagggaaaaatatggcgttcattggtgtaa

SEQ ID NO: 39571 - DNA, 405 bp, Glycine max
  Peptide Sequence Number=SeqID_156349
atggcccagaggagcttatgggccaccaagacgttgagcaaggaagttaaggtagcaatggacgtgaaaagggtgatggaagggagcaagagcaaaaatgtttctctggggattgtgagggatgccaaaaatctcatcttgggacatgagaaagttggggaggaatcaagaatcagagaaggtgtggtggaatcaaatcttcaaaggagttgttgtaaggaggaagaagaggaggggagaccagttagagtcacactattttacgagaatgctccaaccatgtgggatcaacataggcttaaaggagtactcaaatcgggtgtatttacccccaatgcctacactctgaagagtccgtcagggcctctccctcctgattcaagtccaacccagaaaacattttag

SEQ ID NO: 39572 - DNA, 426 bp, Glycine max
  Peptide Sequence Number=SeqID_156350
atgttgttggcttgggataaactaactgtcccaaaggaagttggtggactaggttttcgagagcttcatgtcttcaatctagcaatgctagggaaacaaggtagtgttaaaggaaaggttgcaaaaaattttctgaatggtgcaccagatattgttctaagggagaatcgtgcagtatggattgctccaaacaatggcatggtcaaatgcaatgtggacattgcatttatgaagcttgaaagtaaaacaagatggggaattttccttcatgattgtcacgagcactttgttgttgctaaaacagtagctgagaatgtctatcatgatattatgcaagaggaaaaacttgaggaatctcaggaaattgctagagatgccgctatcgctgccggaacacatgtgagctcgcttagaggtaagggatga

SEQ ID NO: 39573 - DNA, 216 bp, Glycine max
  Peptide Sequence Number=SeqID_156351
atggttggagcattctcgcaaaacatcgtgaccctgactggtctccctatgatcttacttagtgagagtgacctgacaaacccattgtgtggtgtgtcttgttatgtactcctaagcgccccagggtggtttttcactgacatgatgaataggtggatgactatgaagaacctcatgctagaggacacgggaacaccacgctctgataggatgtga

SEQ ID NO: 39574 - DNA, 213 bp, Glycine max
  Peptide Sequence Number=SeqID_156352
caaggagcagaatcgtctcaggtcacagttagaagtcaagacaagttggctgcggaaatcaaccaaggtacatggggacggatgcaagtggggatagggtcacgaccgaccaagcgccaccccttcccggcgctaaacaagcagaggacgtcgctgcaaggcagcccagtatcctttgcgttcgcagtttcttttactattgttttgttttaa

SEQ ID NO: 39575 - DNA, 1010 bp, Glycine max
  Peptide Sequence Number=SeqID_156353
atgtcggcggaactgagtgattacttcaacagcctggcggatatcgcgctgcgcagcgaaggcattcacgcgcgcgagcagctgttactgaccgccggcggtgagcgggtgctgcacacccgcgccactaccatcagcggcaaagacatgcggcagaattacgtgatgctgattgtggaagatgtcaccgatcagcgcgaagccgatgcgcgcattcgtcacatggcgcatcacgataatcttaccagcctgccgaaccgcatcctgtttcgccagaagctgagcgaggcgctgcgtgtcgatcagcagcagggccagaccagcgccacgctgtgcctcgatctggataacttcaagaacgtgaacgacgcgctggggcatcaaatcggtgacgatctgctacgcgtggtggcgaagcggctgcgcagcgtactgcgcgatcaggacacgctggcgcgcatcggcggcgatgagtttgccatcgtgctgcctaacgtgcggaatgccgatgaggccgcgatcgtggcgcagcgcctgatcgaggcgatccgcccgccggtgaatgttgaaggccacaacctgtcggtcgggctgagcgtcggcatcgcgctgacctcgcaggccaccaatacgccggaacacatgctgcgctgcgccgacatggcgctgtatgaagccaagcgtaacggccgtaaccgttatgagcactttacgctggagatggataatgtggcgcgcagccgccgggtgatcgagaacgatctgcgcgaggcaattaccggacggcagctcaagctctactatcagccgatcaccaacgaaaccggcatcattggctatgaggcactgatgcgctggcatcatccgatcaaaggattgatcatgccgaatgacttcattccgattgccgaagagaccgggctgatccatatgcttggcgcctatgcgctgtacgaagcctgccgcgaggcgcagagttgggaaaccgaacagtcggtctcggtcaacct

SEQ ID NO: 39576 - DNA, 471 bp, Glycine max
  Peptide Sequence Number=SeqID_156354
gaggggaaggcggtggatgcgaggggcgtgttggatgagcaggagaaaggggaggttgcgagttcactgacctataacacattgattgcggggatgtgcgagagaggggagctttgcgaggcagggaggctgtgggacgagatggcggagaagggtcgcgctccgaatgcttttacttataatgtgttgattaaggggttttgtaaggttggtgatgtgaaggagggtatcagggttctggaggagatggtgaagagtggatgcttgcctaacaaatcgacatactcgatattggttgatgagatttctctttctgaaggaaagaaagaggaaattgacaaggtagttttgttggccatgacgaccggagttgatggtgaattgtgggatcttttcttaaaacttgttgtggataatttagatggcaatgctgctgagcttgataggatattaacagagaatttggtgtga

SEQ ID NO: 39577 - DNA, 351 bp, Glycine max
  Peptide Sequence Number=SeqID_156355
atgtctccaagtacacgagatgaaagcggtggcatgacttcatccaccacattcaactatgcactcggagaacaaactattcaagtgcggaacaccagcaccaggcgtagtcattttgggttgcagtacataaattacgagcccgacatttatcatgcacatggcatatgtttgttcatgaattatttaggaggatacggagctgaagaaaacaaaaacatcgacaagcttgcggtggttcgaacaacacgcgacacagaggtgacggaggtgcgacaatgtacgcttccttctgcggaggctgtcacggtggtgcaagggagatttaggccaacactcaacggcggctga

SEQ ID NO: 39578 - DNA, 429 bp, Glycine max
  Peptide Sequence Number=SeqID_156356
atgtcgagtggtagtgatgcttctgcgtacgaagagcccattcccaagatagacacaacctctgttcacactgagggggttctacaacgatattcaaactatccacccagagctgatcagaatcttttggtgaaaggctcaattcaaaatgtgctggctggtgaagatgatgccgtgtctcagtttggcattgccaacaagatcatgtttaagcaagccaacaggaagcagaccaaaaggcaagaacggaagtctaaggaggaggcagaaatccttagaaaggagcaatggacaaagaaaaagcatgagcctgcacccgtgtccaatgtctctagcaggcgtctaagggctactacttcaaagagaagtccaaagaagcaagctgtggatggatgtaaataccaacaccagacacagagacacgaatga

SEQ ID NO: 39579 - DNA, 558 bp, Glycine max
  Peptide Sequence Number=SeqID_156357
atggcaccaaaaagactgtcatttaccccttctggaatgccatcaagatcgtttaaaatgccaaagtctgaaatggaaggttccaaaggtaacccaggaaaagaacatcacatgaaggaaatgaaggagactgtaactaaaggaggtgtgaatttagtgcctaagaagctggacacaagtcgcccagaaaaattgttcatggttggtaacaatatgggtactagattcaactttgagtctttgtgtcccccaaggatgataaaccctaagattgttttatttacggcagtaagggtcatgcactctcaaatgaacagacctcgtaagactgtttggtgtctttcacctgcatttgaagcagatgttattgttgaaaaactcatagattattatgaaaaagattggttgatcccttttccatacctaaagctggcagaatcgatggccagacttttgggaactatttttgaatttgaagtttttcatggtggagatagagagtttgggttatggaacattatagagccgaggggaattcccaattatgccactaggtaa

SEQ ID NO: 39580 - DNA, 420 bp, Glycine max
  Peptide Sequence Number=SeqID_156358
atggctaaggcaaacacaaggaaagtctatgttgttcttcagggtcgagtaccagaggctagtaaacaaactttacggttcagttcgaatgcccatcgtggatttaactcttttgaggaagttgaacatgcttggattgatgtcttgacaatggcagagacgagttttacgcgcgttgccatattcatcagcgagaccaaaatgaatcatctagtagtggttgttcagaagatgtgcataacatgggcgctaaaaaggttttccgctttgtatgtgcttaaaaacacaaacatcctatatatatgggcccaggtggcactgccaaaacctcaagctgcaacagaatccaaacgcgtcgtagcagatgatactgacattaaggatacgttaagagaaccatggttaaccaatgacggatga

SEQ ID NO: 39581 - DNA, 702 bp, Glycine max
  Peptide Sequence Number=SeqID_156359
atggagtcgatgggtttgccatgcgaccacatcataattgtccttattagtttgaactttatagaaatgcttgagagcttgatcttagatagatggccaaaggatgctaaagatgcaatcaaaggttcttatgttgagggttatggtttttgggattatgagttaatgggtcaatatgtcacattagctcatatttctagagagctttgtgatttagctcaccatgatgaggaagactatgaagctaagtataatactactggtaattcaagtgctactaacaatgaatctcaaccttcatatgctaatatacaagatcctgctcaagtacgaagcaaaggatgtgattctagtacaactaatgtaatgggaacccgaaagaggactctaaattgtggcaagtgtggtggagacggaacaataagcatatgtcctaccttgagtcaaggtgttagtgctgaagatagaggtagtggtgttcctaaatttgctgatgacattgtctacaacactcaaatgttgctttcgttagcttccattagcctctttttccaagcgttttttgtctccggtggtgacgtgcgttgttcaggagtatatggtgaagttgggttgttatttgtcactggagaagaagagccatatggattgtcaatccgtatggtcatatggattgtcaatctgtatggccatacggattga

SEQ ID NO: 39582 - DNA, 1257 bp, Glycine max
  Peptide Sequence Number=SeqID_156360
atgagaacaaagggaaaggtttccggtgaactccttttaggatccttttacaggaatgaacaccacatcttcagaggctgggcagataaacaaacaatccctattgaaaagtggtggtttccagcaaaacggagcataaccgagattgacttcacagttcagttcacacacacttttgttgttgccatttggtatttgccaatgctccactccatactctcaagccctccccggcgccacctccacccattctccaccgcggccgccgccgccatcgccgctaacagcgtccccgccgccgcctccctcccctcctcctccttcacaatccagcccccaatccacccctggccccgccgcctcacccctcacaacctcgcctccctcatctctcgccagcacgatcccaacctctccctccaaatcttccaccatgcccacccctcactctcccacgcgctccagcccctccacgcgctcttcctcaaactctcacgcgcccgcctcttttcccacctcgagtccctcctcacgcgcctccccacccccccaccggagccccctctcaccaccctcatccgcgcctacggcgtcgccggaaaacccctctccgccctccgcctcttcctcaaattccaacccctcggcctcagttccctcaacgccctcctcaacgcgctcgtccagaacaaacgacaccgtttggcacactccgtgtttaaaagttccaccgaaaaattcgggcttgtaccgaacgttgttagctgcaacattctgctcaaggctctgtgtaagaggaacgaggttgatgtcgcggttagggttttggatgaaatgagtttgatgggtttggttcccaatgtggttagttacaccactgttttgggtgggtttgtgcttaggggcgatatggagagtgctatgagggtttttggtgagattttggataaaggttggatgcctgatgtaacctcgtacactgttttggtgagtgggttttgtagattggggaagttggtggatgcaattagggtaatggatttgatggaggagaatggggttcagcctaatgaggttacttatggtgtgatgattgaggcttattgtaaagggaggaagccgggggaggcggtgaatttgctcgaggatatggttacgaaggggtttgtgccgagttcggtgttgtgttgtaaggtggttgatttgttgtgtgaggaggggagtgtggagagggcttgcgaggtgtggagggggcag

SEQ ID NO: 39583 - DNA, 684 bp, Glycine max
  Peptide Sequence Number=SeqID_156361
atggcacgtcgtagggatttcataagggatatcgataacacaaaggataccttgaagcttgcagttagaatcatagacttgtggtttgttgaaactaaagatacatctaaacaagctgaaatgattattatggatgaaaatgttgccttatttaactttcttatgttgttaattgatattgctgaaaagattcatgtccttataagaaaagaggagttaaagacatggaaattgactcaaaaggagaacaacacttatatgatgcacaactttaaaattgacctgcctaatattcctttaaaggcatatgagtttgttaattttgctgatatctttgctagaacctaccgacgcgatcaattagttgatgtcattggtgttgttcatgagttgacatcgcaccatgttttaagcagtccaaaaagagtcctctttaccatgaaagatctaagagttggtgttagcttgcctattggggttctaacgcaaagctcttcacaaaagggttgtagtttgtcacaatcttctggatcatcacaatatttagagaaagaaaagttcttttacaaagcagaggtgaagagtctctttgaaatcaatgacattaccatgattgtgttactgttggcactatcgaaagaattattgtggagaatcatggatggtgttatgcatcatgcatga

SEQ ID NO: 39584 - DNA, 405 bp, Glycine max
  Peptide Sequence Number=SeqID_156362
atgacgtttgttggtggtgataaaagcattaatgtgttcccagatccactcgacaatctcatgggttgtactcttgcatttaaaatcaaggtccagcccaaatacaggaattcatctgtgaaaaaaatatctgatgatcctgaactgatgcaaccaattatggacttactgcccgatgtggagcaatcactcttcgcgacatcagatcataatccaaaggttacaatggctgcaactctaaccaagaaagttgtggatgaagtacctaaccatgattcacaagctgaaatgcctattactccagccaagcgtggttcaactgaggtctttccagatgataatttgtctaaacaatttctttatgctcagctctcaactactaagaagtatttcaagaatgaatga

SEQ ID NO: 39585 - DNA, 306 bp, Glycine max
  Peptide Sequence Number=SeqID_156363
atgttgcgaccgaaacatgtcgtcttccattttggttaccagtttactaaaaacagctacatgaaaatgataaagagaacaacttacctcaaaggagaacgaaaatgcatcgagccaatgaatggaaaagaagatgaaacaccacagcgaagaagaagaagcttaatgcgcgaatggaagcaaggaagaacagggaatgaagaagaatgtgtgaagaagagaaaaggtaaagggcattttagccttttcaccttagttgttgggtgtcccagcaaaaatattgggtgtccaaagcaattgccttaa

SEQ ID NO: 39586 - DNA, 255 bp, Glycine max
  Peptide Sequence Number=SeqID_156364
atggctagtgaagaacccataataagagataatattagcaacttcggtgatgacaaacaacaatacgatgttcatggacatggagaatcaagcaataaaagtgagtcatcttcatattttgagactattagtagccaactttcagaaaatcaagagtactcaaattcttatcagaacaaggggagtgctagtacaaatgacctttacgaagggcgagagtatcgttcagcaaaatacacaagagttgggagttga

SEQ ID NO: 39587 - DNA, 597 bp, Glycine max
  Peptide Sequence Number=SeqID_156365
atggattcttttcgagacatggtaaagaatttgattgaagctcagaagtgggcagaagggataagaggctgcgtaacaaaaattgagttatggttgtgtcatcgggactctaatgacaagaaagttaatttagaattcattgatgagttactgaaatttactcctgcaccatgcaatgaacctctttatcataaattgaaggactatgcagaggaagctaggttgttaattcaggatattgatactgctttgtcaatgagttcaaatatgtctgagttggaacttttatactccaaagcttgtggcctacccatctacatgaaagaaattgttgtgctgaacggcctcgctgatttcatcccatccctctctccctcgggtctctggaccgctgttgcttcctacggcacccccaacggttgggccggagaagttgaagatttccccactcacatctatgtcttcctcacccgcgacagaactcaccgtgtcaaggttgccagtcatcgtccaacgagtcaccccaccgggtctccacgcgttcaccccctgccacctccccaggcaacaacaacttcaacgacggtgcttaagtaa

SEQ ID NO: 39588 - DNA, 1176 bp, Glycine max
  Peptide Sequence Number=SeqID_156366
ggaattggcgcagccattgctaaacgcctggcggcggaaggcgccgtggttttcattaactattcccgcgggcgtgaagatgccaaccggttggttaaagagatcaatgagcagggcggcgtcgcttttccgctgcaggccaatgtcggcattgaggccgaagtcaacggcctgatgcaaaacattgtcgagcagtatggtcgcctggacgtgctggtcaataacgccggggtttatgccaccaatagcctggaagccttcagcgacgcggaatatgaaaggcacttcaatttaaatgtcaaagggctgatttattgctgcaaggcggcggtcgccgctatgcctgaatcgggcggcagcattgtcaatatcagctccagcgtgacctcgtttacgccggccaattcgctggtttataccgcttccaaagccgcggtggactcgatcaccaagacgctggccaacgagcttggcgggcgcaagatccgggtcaatgcggtcaatcctggcttggtcatcacggaaggcgtacatgacagcggctttttcgataccgatttcaaaacgcacattgaatccatcaccccgctggggcgcatcggcacaccggaggatatcgccccggccgtggcctatctcgcctctgacgaggcgggttgggtgaccgcgaagaatggaacagaaatgacattagacaaagcctacgggccactgattaacggcgtattcgaactggatggcacggacattcatcccgttatttccccctcgagcggggagcgcctggcggatttgcactactgcaacgaacgggacgtcgagcgcgccgtgttggcggcggaagcggctttccccgcctggaaggcattagggcagcaggcccgcgctcgcctggtggcgcagctggcggatgtgctggaaagcgatctggaaagaatggcgcaaatcgacgcgcgggatgtgggccgctgtatcagcgaagtgcgccgcgattatcaaacggcggtcagacactatcgctatttcgccgcggttgtcatggggcacgaagacagcggcagaagcatcgcggacggctacagcctggcgaaacgcgagccgctcggcgtctgcgggcaaattattccctggaatgcgccggcgatcatggcggcgttcaagctggcaccggcgctg

SEQ ID NO: 39589 - DNA, 312 bp, Glycine max
  Peptide Sequence Number=SeqID_156367
atgccactgtacataaagttcttaaaagacctcctcacaaaaaaagggaaagtatatcagcaacgaaactgtcgcaacgtgcccttcgcgggcgagcgagggcgaggctcatgggtgcgctttccaaaggaggaaagatgcgcggagtcgccaccaacgtttatttgtgggaaacgtcgggaaaaccgaaggaaaccggtcaaaatgaaaattctaagttcgggagttgtatttacgtttgaggaaggtcgacaaaagcggggcttttgctcctacgtaccctcctttggagagaaaatcagacctacgtag

SEQ ID NO: 39590 - DNA, 582 bp, Glycine max
  Peptide Sequence Number=SeqID_156368
atgggtgaaatagagaaggtgcaagagcggataaaggccgacatggaggccatgaaagagcaaatggccacaatgatagaggccatgatgagcatgaaaaagatattggaggtcaatgcaattgcagttgacgcggacccgactcccccatctagcctcaaccaaataaatcatccaacctcgaatatggtaggtcaggggggaaaagaattgagaagtacgggtggcccccattttgtgcaagttcaaaacaagcatgtcttcccaccacatggcttgcctcccaactatacaccacccattgtggtgcacactcctgatgagaatgtcaataactccacccccattctcgttgagagccaacaacctcaagctgatcatgcacatgtctctcaacccatgagggaggcacatgaaataccccaccacaatctagccaacttcaagccttgcctcggatacgccactaaggggcaagcagttggtggtatacccctgccaaacactttggagggccctcagtttcacccacaaccacaacccttgcatttcgtagtaggggagtccctcttgctatggtag

SEQ ID NO: 39591 - DNA, 282 bp, Glycine max
  Peptide Sequence Number=SeqID_156369
atgaaaccccgagcgtggttcagagaaatttccaggatatcacagcaggcgtcatgcggtttcttcgttgccattgggcgaccagaacaccgtagtcatgtaggtgttgttggagttggtctcacgatcaagaaatactttgggctggctccaaggacctcccgtatgtcttcctccatggctcctgaagacctggagcaactaatgcaacaaattagggaccagttggaggagtcgatcactgaaaaagtgactcaacggctaatgttatccttcagctag

SEQ ID NO: 39592 - DNA, 213 bp, Glycine max
  Peptide Sequence Number=SeqID_156370
atgaggctcaaacttagcccatgggcccaaaattatcctaaggctcatgagaaccctagggccttctcttgcatcactggctcaatcttcttggagtcttctatccaatgcccttgcggggtagtattacatcattccctcccccttgaaaaagatttgacctcaaatcccgaggttcttgaaactctgggattttttcctcaacaactgtaa

SEQ ID NO: 39593 - DNA, 297 bp, Glycine max
  Peptide Sequence Number=SeqID_156371
atgtgggctttccttaccggtcgtcagatcgactgggctcacttggttaggtaccgaatgcataaggcattacgggccaatgcacctcttccatatcctcaattggtcaccctttttctccatcattttcaaattcctcttgacgatgaaccttttgttcaagtcaggcgatcctttgctataggtgctggtgcaaattatgaggcctccacacctatgttggtgaacaatttgattccttggattgtcgctttgaaggcatggatacctacatcactcagcttgaagaggatgtga

SEQ ID NO: 39594 - DNA, 733 bp, Glycine max
  Peptide Sequence Number=SeqID_156372
cggcagaggcgtgctggcggcgatctcatcggcgatcacaccggccagtcgtgcctgcgcagcatccagtggctggtggggccatcgcagcgcacgtgttgtcgccgcccgcagcagtgcattgggctggaaaatgcgcggtgtggcgggcaggccccaggcaggcctcggcgttgaagtacaggctccagccatcgaacccgtctgcgctcagcagcgcgtggggcagcaagggcggtatccaggcgacgtgacctgcgggcagcagccagtgcaggtcgtcggcggcgatgcgcagcagcccttggtgtgcacccagcagctgcccacgggcatgccggtggcgcgctgtgcgacgcataccgcgttggtgcagcccggccgccagcaccaccggtccgtcggcggtatcggccaacgtgggaaacgtcgcgtccgcgtcccgacactggagcctacttcaacggagcgcttccccatgcagccacaggacattcttcccgaccatcagaacgacgtgcaggtgaacggcgtcaccgtgcgcaagggcagcgtaggtgctttcctggccagcgttcgtgactggcaggatccgtccagcgatcccgccttccgcgccactgccgaagctgacctgcgtgcgttgctgcctggcctgcatgcgctgggtctgttccaggtgctggtcgcgcgcgatcctgccctgcagcacctgattgatggcgcggcctga

SEQ ID NO: 39595 - DNA, 408 bp, Glycine max
  Peptide Sequence Number=SeqID_156373
cagatcgccgcgcagcaggatgccgcacgccgcgacaacgagcgccaggaggccgagcgccaggccgcggcccgtcgcgatgccgaacagaagcagcagcaggccgccgcccagcaggccagcgccgcgcgccaggcagccgccgccgcagctcccaccctgcgcccggtcagtacgccagcgccgcgctatccggccgaagccctgcgttcgggaacgtcgggggaagtactggtggagatcaccgtgggcaccgacggctcagtggtcagcgcccgcgtgctgcgcgcaacgtccggacggaccttcgaccgcgaagccctgaacgcggtcaagcgctggcgcttcgagccggtcaacgcgccggtcaccacccgccgcaccctggtgttcgcgccgggcggctga

SEQ ID NO: 39596 - DNA, 276 bp, Glycine max
  Peptide Sequence Number=SeqID_156374
atgtggatggaccaatttgctcttactttgaacaggagtcaagaacttccccgattgctagccaaggccaaagcaatggcggacacctactctgcccccgaggagatccacggacttctcagctatttgcgaatcaagtcactcccgcattttatctctagcatgcattgtacgttggtctcgtcctttgtcacgggaagccggaaggtccatatcaccttcttaattgtacacatggggcactgcgcccccaaatgcgcaagtaagaagagataa

SEQ ID NO: 39597 - DNA, 887 bp, Glycine max
  Peptide Sequence Number=SeqID_156375
cccagtcgtcgccattttggccatgtatgacatgttcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggggttgtattaattataatctcatcctcgccataagacagcttggctaccccatgagaggagtgccatcagacgaaagcatcacgcctttcatcgcacggggtttcggtgaccacaacgcgagggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaagaatcatcacgggtcaaaggcatgatctccgaagaggtgaaaggaatcatcacgggtcaaaggcatgatcttgaaggacgagctaaagagaagctaaatctagcggcgactcacgagcaaaggctagaggatgagtacgccaagatatcagtagaaagggaagcaagggaaagggtaattgattcattgcaccaagaggcaacaatgaggatgggcctatttgctcttactttgaacaggagtcaagaacttccccgattgctagccaaggccaaagcaatggcggacacctactccgcccccaaggagatccacggacttcccagctatt

SEQ ID NO: 39598 - DNA, 255 bp, Glycine max
  Peptide Sequence Number=SeqID_156376
atgggtgtcattgaattgtgcgttgaagtagatgttgctagtgcttccacgttgaatgtgaaaaattcactactatcatgtgggaataatatagctgacaatgaatcaaaagttcaaagatttacaataaatttagatgatgattcttacgatgatgattacatgatatctaattcatatgttgaggactcgttggatgaggaggaagatatcgatgatatatctgacacagatgaaaaatgtatatttaattaa

SEQ ID NO: 39599 - DNA, 333 bp, Glycine max
  Peptide Sequence Number=SeqID_156377
atgtcatctagcaaaggtccccggacgaaattagggtatgacactaggtccaacaaagataggagaaaatcactcaaagtgtatcaatctcacacagtgcgtggcgagaaagtcgctagtgcacaggattttgtcggcaatcaaagggagaggaccactttaggtcgtggtttcctttttcttgtttacttggtcaaggtttatgataagttgggattttggatcaaggcttgtagaacgggtggtcatgatatatgtcagggtttggccaacggttcggggataaaggggatgtcctacattatttccatgatacacatgcaacaatgttga

SEQ ID NO: 39600 - DNA, 492 bp, Glycine max
  Peptide Sequence Number=SeqID_156378
atggctagaggaaagatccagatcaagaggatagagaacaccaccaagaaggccaacgagctcaccgttctctgcgatgccaaggtttctattattatgttctccagcactggaaaactccacaagatcgagcaatcaacaaagcagttcttcgatcaataccagatgactctgggagttgatatttggaactctcattacgagaatatgcaagagaacttgaagaaactgaaagaggtgaataggaatcttcgtaaggagtttaggtatatatatctttcatcacttcgatcgatctctttgagaatgggagattgtctgaatgagctgggcatggaagatctcaggctccttgaggaaggaatggacaaggccgccaaggttgttcgtgagcgtaagagatgcatagcagcacttacttgtgtctgcggcaaacacaaaggcgccgcaacagagtctttgaattcgtatgttaggtggggaatgatttaa

SEQ ID NO: 39601 - DNA, 349 bp, Glycine max
  Peptide Sequence Number=SeqID_156379
atggatgaacacttgctactgaggacaagtgtgggagcgggtgtggcagaggcaatcgaaggaggtgtagaggagaaccaagcggaaggaggaatcggcggtgctcccccggcaatcgctcatcggcgccggcgaacttcagatcgcttctcttgcttctccggtaagtcggtggatcatcaccgccgcgttcttctgtttcctcacttcgtggatctgcggtttctgttgccgattgtcgcgtttctctatcgttcgcgtcggtttggtgtttacggattagaatctggtggatgtgttgtgttgtttagggaatatgagtatgttcttgtttttgttgcggattgtg

SEQ ID NO: 39602 - DNA, 300 bp, Glycine max
  Peptide Sequence Number=SeqID_156380
atggcgcaggaattgcagaagtcacagctgttggaagcattgtctagagctaagggagggctacagaacgttttgaaaacaaacatgttgaagaagctacatgggaagaggcctttaccatgtcagccttggggacaaggcttcaaaagagagggcaatgttagggccagcgaatttagaaacccaatcgaagcaacaggacatggggtggtaaaactcattcacaagcctatgattttgcaagtatatactaaaaggggtaggaagggaaatgctagtaggctgagctgtcacagctag

SEQ ID NO: 39603 - DNA, 894 bp, Glycine max
  Peptide Sequence Number=SeqID_156381
atgaatggtgaactgtctgtcaagcataaattgtctggtcaccagaaacctgtttcttctgtttcatggagtcctaatgaccaagagctcctcacgtgtggtgtggaggaggctgttaggcgttgggatgtctctaccggtacgtgcctgcaagtttatgaaaaaaacggtcctggcctcatctcctgtgcatggtttccaagtgggaaatatatactttctggcctcagtgacaagagcatttgcatgtgggatttagatgggaaagaagtggagtcttggaaaggacaaagaacccttaagatttctgatttggaaataacaggtgatggggaacacatgctgagtatttgtaaagacaattcaatactgtacttcaacaaagaaacgagggatgagagatatattgatgaggaccagacaataacttccttctctttatcaaaggatagcagactcttgttggttaatcttttgaaccaagaaatacatctttggaatatagaaggcgatcctaaacttgttggcaagtacagaagtcataaacgcagccggttcgttatcagatcttgctttggtggtcttgagcaatcttttattgctagtggtagtgaggattctcaggtggttcgattttcaaatctcgatgttttgctatgcattattcatgcagtttacatatggcacagaagctcgggggatttaatagagacattgcctggtcattctggagcagttaactgtgtgagctggaatccagctaacccacacatgttagcctccgccagtgatgaccggacaattcggatatggggcctaaagcgcctgaatgtaaagtaccctaatgtacgcaccaatggcgtccattactgcaatggcggcgaatttagatga

SEQ ID NO: 39604 - DNA, 1239 bp, Glycine max
  Peptide Sequence Number=SeqID_156382
agcaggaagccaagcacggtaatggtcgggaaatccagggacatgcggcgctcatcggccggggcggcgcgcgcatcttagcgccttgtggtgcgatccccccggcgcttcccgccccgatggcgatgcggggtctgaaaacggcgagcacggcggccggcgtatgcgcagaatccgcggaaaaccaaggagacgctcatgcaagcgtggtacctcggtggcatcgaccaccgcccgttcctgcacctgttcgagaagagcgacaccgcgctggctgcgctgggcatccagcgtcgctgggccggcgaaacaggaggacacccctgccggatcagcctgagcgatccgcccggtggcagcgagctgctgctgttgtcccatgtgcacctgcccctgcactcgccctatcacgcctcgggcccgatcttcgtgcagcgtggcgtcacccgctgcgtgctgccgccggagatcagcgcgggcacggacgtctccgctcggctggacgcgctgtttgccgatcctgccgtggccttcgtgcagctgcacaacgcggcccacggctgcttctcatgccaggcgaatcgcgtgggtatgacgccgacgtagcacgatctccacgacgtgatcgttgccacgccgaagacgtgatcgccagcgcatccgttcagtcccgcgtgaagcctgcgggaagggcttcacacccacagtcacggatcggcatttccatggttccgcaccctgcgctgcgactcgatactcgccgtggtgccgccgaaagtccgccgtgcagcgcagctcctgcggccaccgctctctttcgacgaccacaaggaagcgccatgtcattccgatccacaccgctgttgctggccacttcactggccgccgctggactgctgctggccggcgatacatttgcccatggcaccatgaccacgccgatcagccgcgtctatgcctgcttccagggcaatcccgagaacccgaccaacccggcctgtgccgcggccaaggccatcggcggctcacaggcgttctacgactggaacggcatcaaccaggccaacgccaacggcaaccaccaggccgtggtgcccgacggcaagctgtgcagcggcaacaatcccaccttccgcggcctggacgtgaaccgcagcgactggcagaccacgcccatccacgccgatgccaatggcaagttcaccttcgtgttcaaggcgaccgcgccacatgccacgc

SEQ ID NO: 39605 - DNA, 336 bp, Glycine max
  Peptide Sequence Number=SeqID_156383
atggcaccagctgatgtagaggacactggggcagacattcctgcagacacaggcgcgcaggctgctgaggatgagcatgagggatttccgggtgctccaagcgacccatccgtgctgacccagtatgcggatcacgttgcttgcagtgtatgtacgggagaggagcgtcctgagttgaagttatcctttcatgggaggaaggcccatagtttaggcaggcctgtccctgccattgagggactaattgctaggacaggactaagtcctctgatcgtgtgttcggtagacaccgacgatcggggactgttgtcctcgtttgtcgagtggtggcactga

SEQ ID NO: 39606 - DNA, 243 bp, Glycine max
  Peptide Sequence Number=SeqID_156384
atgagtaatcgttcatctagtgataatggtgaaggtactagtcataaggaccctctatttagaatcttagatgagttaagttccctcaagttatggaaagaaaaactagaaagaaaagaaaaaggaaaagagagggaacgcataggttacgtcttagacctcactcccataggagaggaaaggaaagaaagccttaaaaggctaacattaacctcccatacttccatgggaaggacaatgtag

SEQ ID NO: 39607 - DNA, 204 bp, Glycine max
  Peptide Sequence Number=SeqID_156385
atgtacacacaaaacaaggccaatgagaggaagccacttataggttgggaagaagcagcttcaattcagagagtgagtgctttttctctggcccatgagattccatggcttcatttggtgcagtcaattacaaattcttcttgtgcctacttctatggctctggaactttctacctctatctcaagcaacttgccacatcatag

SEQ ID NO: 39608 - DNA, 319 bp, Glycine max
  Peptide Sequence Number=SeqID_156386
ctcgcccaggcaagctggtttcttaaccttgaagtcattcggtggcccaagcgagccaaaggctagcttaggcgagctagggtccaggaaaaccaagaaaaagacccttttcccctcttttcttggtatcttttgccttcctgatcgaaacaccaaatggttccttgctttgcactgtaactggcgttcagcatcaaataaaatggaagtaaagataaggacactaatgtcgttcgagcgatcttgctattcgaccgggcaactggcaaaaaccaaggaagtgaaaccgaaaaaacaagaggacattaaagttttataa

SEQ ID NO: 39609 - DNA, 519 bp, Glycine max
  Peptide Sequence Number=SeqID_156387
atgccatccactatttgcaaggatcgcgtccacaagacacccaatggactcgaagaagtccaacagggccctggggtttccagctctggttatgggcctctgtcagtcctaccggctatctgtccccccctagcaaggtcacgccatcgtgacataggtaaggatcgcgcctacaagacacccagtggacccggagaagtccaacagggccctagggtttccagctctggttttgggcctctgtcaatcctaccgggtgcccgtcccccccagcaagggatcgcgcccgcaagacacctagtggactcgaagaagtccaacagggtcctggggtttccagctctgattacgggcctttttcagttctacggagtgcccgtcgccctcaataaggtcatcaggccccctattaaccggctttcatcaagaagtactactccccccaggcaggcgcaaggcgagacaccacagctgcctggggatggccagcagtgggcaatgcaccgccgccacctctag

SEQ ID NO: 39610 - DNA, 1648 bp, Glycine max
  Peptide Sequence Number=SeqID_156388
gcacaggccattgtttttggttagtatatttgatagtgagagactgagagtgcaaccactaggtggacaccaaactttagattgtacaagcgccaggttgctcactcttggtggggatggtccttcagtcttcaaatcacaacctcctttctcctcaccaaatattaaggatattcatgcccctgcaactgcaccatcaccagcaattctgccaggtcatctggatgtaccctctccttcacctagaatttctcctctaggctcatcgttgaagaagacaaagactccaccagcagcatataccttgattctgccacctccacctcctaataaggattgcttatcgacaacttgcttggagcccttgacatatacacctcctgggtcaccttgtggttgtgtatggccgcttcaggttaaactccatatcaacattgcaatatacaagttttttccgttggtttcagagctagccaaggaaattgcagcaagtgttctgctgaaccatacccaggttcgcattgtgggagctgatgcagctaatcagcaactggagaagaccactgttctcatagacttagtacccaaaggagtaaaatttgatgataccactgcatttttaatatataagaaattctggtacagggagattctgatagatgcttccgtctttggtgcttatgaagtactctatgttcattctccaggtcttccaccatctccaccttcaactccctcagatgcttctggtatagatgatgggccaaatccaggacatgacaacaatggaacgataatgaaacctttaggagtagatgtcccaaagaagaaaaaagaagggaataatggaagaatgattgttataattgtgctgtcatcagttaccgcttctgttgtattcattggtcttgcttggctttgtctgctgaaatgccgtacctatgttcatgaacataaaccagttccagatggttttatttcatcctcttcaaaacaatcaatcttagcaggggctgctaggtcattgactcaagggatcaggctaggctctggatcacagtccttcaattctggaacaataacatatacagggtctgctaagatttttactttgaatgacttggagaaagcaacaaataactttgactcttcaagaatattaggagaaggtggctttgggcttgtttacaaaggtattctaaatgatgggagggatgtagccgtgaagattctcaaaagagatgatcagcgaggtggccgtgaattcttggcagaagttgaaatgcttagccgtctacatcatagaaatttagttaaattattgggtatatgcacagagaaacagactcgctgcttagtttatgagcttgtccctaatggaagtgtcgaatctcacttacatgctgacaaggtaactgatccactggattggaattcccggatgaagattgctcttggtgcagctcggggattggcctatctacatgaagattcaaatccatgtgtcatacatcgagacttcaaggccagcaacatcttgttggagtacgattttacacccaaggtctcagattttggattggctagaacagcactggatgagagaaacaagcacatctccacacatgttatgggaacatttgggtaa

SEQ ID NO: 39611 - DNA, 114 bp, Glycine max
  Peptide Sequence Number=SeqID_156389
atgaaagtggtattcacactggcaagagatgtccttgcagtagagcttttacagaaggatgcacgacttgctgctagtggggagttgggaaaagcatgtcctggtggaacgtaa

SEQ ID NO: 39612 - DNA, 633 bp, Glycine max
  Peptide Sequence Number=SeqID_156390
atgggactgcagctgattttcttgctaattgagctgcatttagttttctgcactcagcaggtccatgaatatgcagccaccaagctgcaacattccagtgacagaagccattttagtattgcaatcccaccatcaaagtcatcttctgaaggtcattcaagtattgcacacccaccttctgagtcatcttctggtgtacctgcaagtattgcactttcagcttccaagtcaattcacaaagctcctacaattatatggacacatagttctgtggattctcctatcttacatcataagcatcacttttccaaaagaaagttctccaatccaactccagtggcagcgccaacctatccagtccaggctcctacatacagtcatcaaggtccttcagtcttcgaatcacaacctcctttctcctcaccaaatattaaggatattcatgcccctgcaactgcaccatcaccagcaattctgccaggtcacctggatgtaccctctccttcacctagaatttctcctctaggttcatcgttgaagaagaaaaagactccatcaccagcatataccttgattctgccacctccacctcctaataagggtaatctaataataatcctgccattgtattag

SEQ ID NO: 39613 - DNA, 267 bp, Glycine max
  Peptide Sequence Number=SeqID_156391
atggtagaaacccaaagtggctacaagattcaatttctaagatcagacaatgggaaggagtatacattagcaaagtttaaccaattctatgaaaaagctagcattgaacatcaactcatagctccatgcactccagagcaaaatggagttagtgaaaggagaaacagaattgtgatggagatgcctaggtgcatgttgtatgagatggagctgcctaaaacattttgggcagagacaactaatacgactattttttataactgctaa

SEQ ID NO: 39614 - DNA, 174 bp, Glycine max
  Peptide Sequence Number=SeqID_156392
atgactgacgaaaatggcgacttccacttccccgtcaaaaccttcacttgcttcttgacttccattgcggccatgagattcttccactgcgggaagccgacatcggcagctgtggctgtaaggaagcactgtggaaggggaactgagatctttggttttgtgattcaaggatga

SEQ ID NO: 39615 - DNA, 2940 bp, Glycine max
  Peptide Sequence Number=SeqID_156393
atggctgcttctaattctgccgctgttgttggtaatgcttcttcctctctctctctctctgttaccaaaaagtatgatgttttcatcagctttagaggagaggacacccgcggtgacttcacaagccatcttcatgccgctctcggcagaagcagcatcgaaacctacatagactacagaatccagaaaggagaggaggtttgggtcgaactcgtgaaagccatcaaaggctccactctcttcttggttatcttctcagaaaactacgcaaattctagttggtgtttgaatgaactggttgaactaatggaatgcagaaaacaagaagaagaggttcatgtaattccagtgttctacaaaatagacccatcgcaggtacgcaaacagactgggagttatcgcgccgcagtcgcaaaccaaaagtggaaggacgctctctatgaagcagccaatttatctggcttccattctcacacatacaggactgaaactgacttgattgaagatattatcaaagttgttttgcaaaagttaaatcacaagtacacatatgactttagaggccttttcatatctgatgaaaactatacaagcattgaatctttattgaaaattgattcaatggaagttcgagtcattggaatttggggcaaaggaggtattggtaaaacaactcttgctgctgctatttttcataaagtttcttttcagtatgaaggcacttgcttcttagaaaatgtggcagaggaatcaaaaaggcatggactaaattacgcatgcaacaaacttttttctaagttactaagggaagatattaatattgacactaataaagtgataccctctaatgttccaaaaagactcaggcgtaagaaagttttcatcgtactagatgatgtgaacactccacaacttctagaaaatttggttggagcaggtgctgagtggctaggagctggtagcagagtcattgtgacaaccagagataggcatgtacttaaaagtagaggtgttgaaaaaattcacgaagtcaaggaaatgaactttcataactcccttaaacttttcagtttaaatgcctttggcaaaacctatcctacagaggaatatgaggagttatcaaaaagagtaatggtttatgccaaaggaatccctttagctttgaaagttttgggatcatttcttcgttccaaaagtgaaaatgaatgggatagtgcactgactaaattaaagaagattcctaatcaggaaattcagacagtgttgagattgagctatgatggattagatgatggagacaaaaacatttttctagacattgcttgtttttttaagggacaaaaaggagacagtgtgacaaaagtgttaaatgcctgcggtttttctgcagatatagggataaaaaatcttttagacaaagctcttatcactactactacagatatgcatgattctactacagatagttgcatagatatgcacgatttgatacaagaaatgggtagaggaattgttcgtgaagaatctattgacaatcctgggcagcgcagtagattgtgggatcctgaagaagtcaatgatgtactgacaaacaatacaggaactggtgcaatccaaggaatatggttagaaatgtctcaaattcaagatataaagctaagctccaaatcattcagaaagatgccaaacttgagattacttgctttccaatccctgaatggaaactttaaaagaattaattcagtgtaccttccaaagggtcttgaattcttacctaaaaaattacgatatttggggtggaatggatgtccattagaatctctaccatcgactttttgccctgagaagcttgttgagctttccatgcgatacagcaatgtgcaaaaactttggcatggagtccagaatttgccaaatctagagaaaattgacctttttggctgcataaacctaatggagtgtccaaatctgtctcttgccccaaaacttaaacaagtatcaataagccactgtgaaagcttgtcttacgttgatccgtcaattttgtccctcccgaagctagaaattttaaatgtgagtggatgcacgtcgcttaagagccttggcagcaatacttggtcacaatctctccaacatttgtatttagaaggatcaggtttgaatgaactgcccccatcagttttgcatataaaagatctaaaaatctttgcctcttcaattaattatggtcttatggatcttcctgaaaacttttccaatgatattgtactctctgcaccaagggaacatgatcgtgacactttcttcaccttacataagatactgtatagttctggcttccagtcagtaacaggtctaactttttacaattgtcaaagcttgggcgaaatcccagacagcatctcgctgttatcgtcattgctattcttaagcttcttgcatagcaacatcataagcttacccgaaagcctgaagtatcttccaagactccatcgtctttgtgtcggtgaatgtaaaatgcttcgacgtatacctgcacttccacagtccattcagtgcttcctcgtctggaactgccaatctcttcagacggtgctaagttcaacgattgaaccattggaatcacccaacggcacttttctgcttgctaactgcataaaattggatgaacattcatttgatgcaataattggcgaaccaccaccatcagaagtattagaagatgcattcacggataattatatttatcaaacagcaaagctttgctactctttaccagctagaagtggcaaagttcgagagtggttccattgccacttcacacagtctttggtcactgttgaaattccccctaatctgttgggtttcattttctacttggttgtttctcaagatgtgaatgctctttggaaaccagccagaatgaaaggatcagtataa

SEQ ID NO: 39616 - DNA, 216 bp, Glycine max
  Peptide Sequence Number=SeqID_156394
atgtcgaagcaaagctcaccttcaatggtgtcggtagcacaagctacatgccagcaagaacctgcttcaaagttgcggcgtcataagggaaatggaaggggaggtgttaaggttttgagcgtaggaagaggaggcttatgggccaaacattgtagcgaaaggaattttccagaagccaaacaaaaaatgctcagcggattttcttcctgcacctaa

SEQ ID NO: 39617 - DNA, 189 bp, Glycine max
  Peptide Sequence Number=SeqID_156395
atggatggtggcgcgattctgtttgattggggttgggccgggatttggtcagctagagtgaggtggcggtgtggtgttgggcacaatggtgtatgggtggaggtttggtggaggctagaaagggaaggggagatcatatttgttcattcaagtttcatatggggtccaggatgtaaaagccctttctaa

SEQ ID NO: 39618 - DNA, 261 bp, Glycine max
  Peptide Sequence Number=SeqID_156396
atgatgatttggaaacaacgtgcaaaattagtcatggctacagctaggtgggtactcaagcatccagattatggcattgtgatactaaggcttgggatttacacaagtagacccaatatttccaaattatgttctttcatcggttcaatgaatccatccattcttatctcggttattctggaaaataaactcttagcgacaacgttcctaaaggaaaaccctacaaggttccagaacttcaacaaacattatcaacaataa

SEQ ID NO: 39619 - DNA, 387 bp, Glycine max
  Peptide Sequence Number=SeqID_156397
atgttcaaaaacaagatcaatgaagaagcagaagtggtcagaaacaaggctataatggtctctctagggtacaatcaaagggaagagattgactatgaggaaatcgtggcaccagtagcaagacttgaagctattagaatactcatagcctatggagcacacaaagacatcaaattgtatcagatggatgtcaagagtgcatttctgaatggattcataaatgaagagaagaacttctccaagaaggtgttcaatgaaaagaaagacaaagataaaagctccatcattgctatgagtgcaaaaagcctgaacacttcaagtctaagtgcccagatctggagaagtccaagggaaagcatgaataatacaattccaaggctagtgtaa

SEQ ID NO: 39620 - DNA, 314 bp, Glycine max
  Peptide Sequence Number=SeqID_156398
atgatggagctgcgagaacaaatgtggatgcagatgggacagatggaataggtgttggagctgaggaagggggaacctcagaagatgggggagcctcagacctcttccccttggccttgctaggtcctctgaaagttactgttggatcatcaagattccaacaattcttcttaatatatgccaaattaattataggacttaatttctcatgggtcaaggaatcagagtggactccccgagctttacataaagcagtgattagggcaggaaagccgagcctcgaggagtcgtgctgggctatgagtgtaatctga

SEQ ID NO: 39621 - DNA, 441 bp, Glycine max
  Peptide Sequence Number=SeqID_156399
atggctggacaagctctaaccgtgtttatacctgaagatgcttcaaccaacaagccttcttgctttgatggacaagacttctactacaggaaaggcataatgaatttgttcctagaatctaaagatgttgatctatcagacattatagagattgatgagaaaaaacatgagtctataaaagagatgttcactagattcactactttggtgaatgagttgaatgttctgggagaaaggtatgcaacacatcaaagaatcgaaaaaattctgagaagtctacccaaaattttgagacaaaaagacacttccataacagaagccaaagacttgaaaaatctggctatgaatgaacttactgggtcactaaaggttcatgaagaagagttgatggatgagctacaactacctaagggaaaagcaataacactaaaagcttcttag

SEQ ID NO: 39622 - DNA, 216 bp, Glycine max
  Peptide Sequence Number=SeqID_156400
atggatgagatgaaactacttaaagggaagattataactctcaaggcttctcagaaaaccaatataatgcatcagtccaaagcactaagctcaatagaagcttctgatattgagaatagtgatgttgagttttctaaggaagatgaagaagaactggcattcctaaccaaaagagtgaaaagattgctcagaaaaagaaaagggccaagagtgtaa

SEQ ID NO: 39623 - DNA, 150 bp, Glycine max
  Peptide Sequence Number=SeqID_156401
atggcgaacaccgatgaacccaatctcataaacttctcctccgttggtgaaccctcgaaggttctcatggacaagaactttggctcaatgagacccgaggtatgccacaagctccggttttttgggccggctacaagactaatggagtaa

SEQ ID NO: 39624 - DNA, 432 bp, Glycine max
  Peptide Sequence Number=SeqID_156402
atggaaaacccatgtgagatatccttgtggaatggcctgatggcaggttacactaagaattacatgtatgtggaagccctagagctttttgagaagttgttacactacccttacctaaaacctgatagttatacttaccctagtgttcttaaggcttgtggggggctgtataaatatgttttgggaaaaatgattcatacatgtttggtaaaaactggtttaatgatggacattgttgttggaagctctcttgtgggtatgtatgcaaaatgcaatgcatttgagaaagccatatggctgttcaatgaaatgcctgagaaggatgtggcatgctggaatacagtgatttcttgttattatcaaagtggaaacttcaaagaggccctagaatattttggcctaatgagaagatttggatttgagcctaattcg

SEQ ID NO: 39625 - DNA, 1440 bp, Glycine max
  Peptide Sequence Number=SeqID_156403
atggaaatccatgaggagttgatcaatagtgggtttctgctggacagtttcattagctctgctcttgttgacatgtatggaaaatgtggtcatctagaaatggccatagaggtttttgagcagatgcctaaaaagactgttgttgcttggaattccatgattagtggatatggtttgaaaggtgacagcatatcatgcattcaactttttaagaggatgtacaatgaaggagtcaagccaactttgactaccttaagtagtttaataatggtttgttcacgatcagcccgactactagaggggaagtttgtgcatggatatacaatacgaaacagaatacagtctgatgtttttattaatagttcactcatggatctatattttaaatgtggaaaggtagagttagctgaaaacatctttaaattaataccaaagtccaaggtagtttcttggaatgttatgatttctggatatgtggctgaagggaaactttttgaagcccttggcctctttagtgaaatgagaaaatcgtatgttgaacctgatgctattacttttaccagtgttttgacagcttgttctcaactagcagcactagaaaaaggtgaagagattcacaatctgattattgagaaaaaattggacaacaatgaagtggttatgggagctctacttgatatgtatgcaaagtgtggtgctgtagatgaagcattcagtgtttttaaatgtttgcccaaaagggatctggtgtcctggacttccatgattactgcttatgggtctcatggtcaggcctatgtagctttggagctttttgctgaaatgctgcagtccaacatgaaacctgatagggttacttttcttgctatattatctgcttgtggccatgctgggttggttgatgaagggtgctattacttcaatcaaatggtcaatgtttatggcattatacctagagttgaacattattcatgcttgattgatcttcttggacgtgctggaagattgcatgaagcatatgagattctgcaacaaaaccctgaaatcagggatgatgttgagttgttaagcacattattttctgcatgccgtctgcacagaaatattgatttgggagctgaaattgcaagaacgcttattgataaggatcctgatgattcatcaacctatattctcttgtcaaatatgtatgcttctgcacataagtgggatgaagtacgtgtggtgagatcaaagatgaaagagcttggattaaagaagaatccagggtgtagttggattgagattaaccagaagatccttcctttctttgtagaagacaattcacacttgcatctagagcttgtttttaaatgcctttcatatctctctgatcacatggaagatgagtctaaaccatttacatatcattttgatgttgaaacactgagattatattag

SEQ ID NO: 39626 - DNA, 237 bp, Glycine max
  Peptide Sequence Number=SeqID_156404
atgagaatcctgaaactggccaaatacaggctaaaggcccaagtggagaaggacgaaggcccaagaacttttggcattttgataaaatttggtgagagcttctctctgggttccttgttgaaccaatctcagacttatcaaggtaatccttgtggcgtctaccctgacttatcttccttcactggaagtggcgtcatccaaaatctccgtagcctatatcaagcgatccgctcctag

SEQ ID NO: 39627 - DNA, 264 bp, Glycine max
  Peptide Sequence Number=SeqID_156405
atgctgacatcttcggaaagggtgcagatgaccacattggcctctgcttgtcaatcgaatttggggtctccgaatgacgaggtgcagataaccataaggtgtctccgcatgctaccgaactcttgggtcatgatagcaaaaggtggggtggtcgacaaaagcggggcttttgctcctacgtatcctcaatttgtgatgaggaactcagacctacgtagttctttcaaaagtgagactaaaatagtctcggtgttctttaactaa

SEQ ID NO: 39628 - DNA, 510 bp, Glycine max
  Peptide Sequence Number=SeqID_156406
atgcgacaagatttgcgatctcatgcatttggcgaccagcattgcgagctatcgcacctcgacaaggtccggcggagggccgattcggtagtcgtagatttcgacaaagtcgttgatcttaatcaacggcaccgcctagtccaccacagatggaggactaaagttaacatcaatagagtttcttctaccgttgggtatgtattcggcgacgagcaatttattgttgtttgggtcagtgctgaagccaatgaggttgacgaggcagggactggggatttaggagaggatctcgatctcgttttcagcgggactggtgcagttgccgcaaccggtgcatttggtggcgtggtttttaaaggtgctagtggtgataagtttggttgttttgacaatgacgaggagcttgccagggtccaaggtgattctgtagactctgtcgtggttgcctcgaccaaggaaggtgtcggaggagaagctgttggcggtggcgacgatgtcgaaaataaatag

SEQ ID NO: 39629 - DNA, 354 bp, Glycine max
  Peptide Sequence Number=SeqID_156407
atggggcagaagaaagttttgacacttgtcatgtttgttatggcttatggtttggcagcaacaagattcagtgcctctcaaatccctccaacttgcaatggagatgaagcattactcacattttgtgggtcttatttggggaatatcctacccaacccaacttctgattgttgtaaatcagcaacttctgcgtttgacagagccatgtccgactccaccggtcaaggtataagagatctttgtgattgtctcatggttgctggaccagttttgaactttcaacaaaccaaacttgaaagccttcctgatgcttgcgggattaagctttccttttctatattcttatgtgtatga

SEQ ID NO: 39630 - DNA, 978 bp, Glycine max
  Peptide Sequence Number=SeqID_156408
atgcagccgaaatctcacacccctttttttgtccctccccaaaaagccatgaacaacaataaccctaacaacaacagtaacagaatctcatcaccaagaaatggcaacagcactacccaggcttgtgctgcatgcaagtaccaacgcagaaagtgtgcacccgattgcattcttgcaccttacttccctcacgaacgccaacgccagttcctcaacgcgcacaagttgtttggcgtgagcaacatcaccaagatcatcaagcttctcagccctcaggacaaggaccaagccatgcgtaccatcatttaccaatccgacatgcgcgctacagatccagttggtggttgctataggtacattctcgatctccaggcccagatcgagtactatagggcggaactcgaactcgtccttcaacaactcgccatttttagagctcaggctcaacaacaacaacaacaacaacaacaacaacatggtatctatgctccaaacaacgttaatatcgctgtcaatggcgatggcgaggttttgaatgctgatccaatgggattgtacgaccagcaacaacattatcagtgtcttcagccacaacaacaggagcagtatgctatgatgcatgaaaatggtcatggaagccaaaacagcgacggcactgctttccaggaacaaataaacacgtgggctgtgcagaacactgctgtgtctctttcttcgttgtcgttgcaagggcagggtagtaatgttagcgatgggtatgatcacaagccggtgctggggattgacatggattctgatgagagaagtgagttagggttcgagtctgaagaattagtccatcgcagtgatgaagcagttttatttaagatagacgatgcagaaattaaagcggaggctgatcactgcatgcaacaagctcaagaccatgacctgaaaggtgcagcaacatcgtttactctcacaaattgtacttgctga

SEQ ID NO: 39631 - DNA, 1770 bp, Glycine max
  Peptide Sequence Number=SeqID_156409
atgtatcgattagctcgtagagtagcttcttccattgcttctccctctgctaagaacctcgtatatggtggagtattgtcaagcagaaattttgtgagcaaagatatcaactttggggtcggggctcgtgccgcaatcctccagggggtaactgaggttgctgatgctgtcaaagttaccatgggacccaagggtcacaatgtgataattgagagaagtcgtgggaatcccaggatcacgaaggacggtgtgactgtggccagaagtatcaaatttaaagacaaatccaaaaatgttggggcggatcttgtcaagcaggtggccaaggctaccaacactgctgctggagacggtacaacttgtgcaactgttttgactcaggcaatactcacagaaggatgtaaatcgattgctgctggcataaatgttatggacttacgtaatggaataaataaggcagttgatgctgtaattactgagttgaagagcagaacattgatgataagtacaccagaagagataacccaggttggaactatatctgcgaatggggagcgtgatattggagaattgatggctagggcaatggagaaagttgggaaggaaggagtcattactgttgttgatgggaacactttggataatgaattggaagtggtagaaggaatgaagttaaccagaggatacatatctccttattttattactgatcagaagacccggaaatgtgaattggagaacccctttattctcatccatgacaagaaaatttctgacatgaattcattgctgaaaatactggagctggcagtaacgaaaaaaagatcactcttagttgttgctgaagatgttgagagtgatgcgttggctatgctcatactcaacaagcatcacgcggggcttaaggtttgtgctgtaaaagctcctggttttggggataatagaagagcaagtctagacgatcttgcaattcttactggaggagaggtcatcactgatgagcgtggtttgtctcttgataaagtccaaccagaaatgcttggcactgcaaaaaaggttactatcaccattgatgacactattattctacatggtggtggggataagaaggtcattgaagagagatgtgaacagctgaggacagctatggaagagagttctgccacatttgataaagaaaaagcacaggaacgcctatcaaaactatctggtggtgtagctgttttcaaagtttgtcactcatccttgagaatactaatgcaaccaaatattcaggttgggggggctagtgaggccgaagttggggaaaggaaagatagagtaacagatgctttaaatgccactagagctgctgtggaagagggaattgttccaggtggtggagttgctctcctatatgctaccaaagtcttggataaccttcaaactcaaaatgaagatgagaagagaggagtacaaattattcagaatgcactcaaggcacctacctctacaatagcttcaaatgctggttttgatggtgctttggtccacagcaaattgttggaacaagatgatcataatttaggttttgatgctgctaaaggtgtctatgttgatatggtaaaggctggaataatagatcctcttaaagttgttagaacagctttggtagatgctgccagtgtgtcattgctactgacaacaaccgaggcagctgtgttggataatccacatgacaaaaataaacctcctagtcgggtgccagatatggatgatttggatctctaa

SEQ ID NO: 39632 - DNA, 493 bp, Glycine max
  Peptide Sequence Number=SeqID_156410
atggttttaagttgtcattatctctactaccttgcattaagggctatttttgttggaggcatagcagcatttgctaaaatagcaggagcaatgaaagctgcaggtggtgcaaaaatgggtgcagctgctgctgctatgacggcagcagcaactgcagctgtggcgggtgtcattgatatagatgttgacaagtggtcattctttgaaacaattggaattctaaaagaagacttcggatatggtgatcaaccaataaggctatggtggaaaggtggtgatggtgactataaggaaaagaccatgggcagtcatgcattggagttgtctaattatgtgattgctaacagttgtgaggtgaagtcgtttgtggaatgcactggtggtaatgagggggttgtggataacaatttttctcaagacaatagttatgaatcagtgaagaatgtacagttagatgaatctgaggaggaaaagacaattggactcgataatg

SEQ ID NO: 39633 - DNA, 186 bp, Glycine max
  Peptide Sequence Number=SeqID_156411
atgtcaagaagcggcaataaaagatgtggagagagcatttgtgacgaagagattccgaacattggtgtatctcgtggtgctcattccgactttgatatatacctccaaacaagacgttatatgtatcaagaaggttcatcaacaacttcaaataaacttagtaaagcatatttgagaatgttttga

SEQ ID NO: 39634 - DNA, 309 bp, Glycine max
  Peptide Sequence Number=SeqID_156412
atgttagctggtctacgccatcttgacccagggatcacacctccaagacacccagtggacccagaaaagtccaacaaagcactgggatttccgcccttgatcacaggtctctgccaattctatggggtgtcggttacgcccacaaagcccatccggcctcccattaacaggtccttcattgaaaagtactgcatgccaaggcaggcacaacagccggggcaggaccagcagcagcagctagccgcagatgcaccactgccacctctacaacagccactatctctagagtccatctcttctcacatttag

SEQ ID NO: 39635 - DNA, 555 bp, Glycine max
  Peptide Sequence Number=SeqID_156413
atgaagaagaagatgatggcaagcacggccatctccctcgtcttcgccgcgctcttcctcttctcctccgtccactctttctacctccctggtgtcgctcctcgcgatttccaaattattgaagatattgagttattgtttcatgtgtggcaccagggtgaccccctctttgtcaaagtgaacaagttatcatctaccaagactcaacttccatatgactactacttcttgaagtattgcaaacccaaaacgatattgaacaatgcagaaaatttgggagaggttcttagaggtgatcgtattgagaattcagtatatacatttcatatgaggaaggaacagtcatgtactgttgtttgtcatgaaacattggatgctgaatctgcaaagagttttaaagaaaaaattgatgatgaatatcgagtgaacatgattttggataaccttccagttgctgttcgtagacaaaggagggatggaggtcaatcaacaacatatgaacatggttttcgtgttgggttcaaaggaaactatcaaggggtacaactcagctag

SEQ ID NO: 39636 - DNA, 708 bp, Glycine max
  Peptide Sequence Number=SeqID_156414
atgactagtgttttaaaacaagcaaaagagtctattcagttattggaagtctatacgtgggctagtttcatatatctatctcatagtttgcctgtcatcaattttcctgataatgaatccatgatagaggcctatttcttttccctatgtttttggatgtgtttcaatcagtttcacattgttgtcgataatttagatgtcaacagcaccaattctgttaactcgagagctgcagtgtcagctgctcttctcctgcttccatcagaattcacagaggtagatctatatgccaaagtatgtagtctttcatacacaggggtgcctgatttatccgagtatggggatgtgtacgagctaggatttggattgggacatgataagcctccaaccagtgctttggtgaagaaagaatttcaacgcaaaatcatctatcctttgagccctcatgaggatttttctgatggctcagctgaatacattgagttatatgcaacgctattagaatatttcaatgtgacttgctatggagcagttgctgatgggaggacagagtctagctctttagtactatatgcttatatggtaatggtaaaatttgaggcaaaattgccaacaagttacagtataatgttgctaggcattcttggcagcatgggaagatgcatgctctctgtcgcggtgattttcggatatcaagctattgattag

SEQ ID NO: 39637 - DNA, 264 bp, Glycine max
  Peptide Sequence Number=SeqID_156415
atgcaagacatgaatgcttgtggttggtggtgtttggtgtgggcttggccgatagtggtggttggtataggcttggccgatggtggtggttttgatgctttaggccgcgtgagtgagtgggttactgtgtttgctgtgttggtggtttgcggtggctgtgttggttgtattggtggttttcggtggctgtgttggctcggccgatggctgggctcggccgatggtggtggttcacggaggggaagggtgctgagtggtggctag

SEQ ID NO: 39638 - DNA, 381 bp, Glycine max
  Peptide Sequence Number=SeqID_156416
atgggctttagcattgaaagatgtattgtctccttagaacttgatagagcaggattaggttgccgtatgtctggacacggagtgcgtgtttgcatgcgtagatcttcagcaggtgaattggttccattggatttagaaattgaaacaaccttcagaagaaacaacacagagagaaaaataaatcttttgcacgacagaacagtagcatcaatccttgaagaggctcacttttctgagtcatcatcttctaattcacctacatccaaggaatctcaaacagcagaatttgaaaccgaagtcatggctgaagagcaacctctacgagtgaccttagaagattactcaagtatactcggtcggaggttcaagcacagaatataa

SEQ ID NO: 39639 - DNA, 252 bp, Glycine max
  Peptide Sequence Number=SeqID_156417
atgtcgcggaacttcatggattgcctaacgatgggtgttaagtaccttgaagcagtcaagcgaaggttgcatgccaccaaacaatggtccccggacgaaattagggcaatcaattcatgggacttcggactcaatgatggaggatgcacgaacaacgctaggcaatcaattcgtggggctccggactcaatgatggaggatgcacgaacagcgctaggcaatcaatttgtggggctctggactcgatggtga

SEQ ID NO: 39640 - DNA, 950 bp, Glycine max
  Peptide Sequence Number=SeqID_156418
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgccttttcggcgaatgcgcgggcataggcgttggcacgctcgatggcctggttttggttggttcccatggcgtagaccgcaatgacagtgccgcccccgccccaatacaccgaggtgcccgccttgaggtcgtctgcggttgttccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39641 - DNA, 699 bp, Glycine max
  Peptide Sequence Number=SeqID_156419
atggcagacgccgaacaatcctctgagtgcttcgaccgtctcgaagttgccattgctgacctcactgtcgctcaactccattccatcgtgactctcgattccatcgtctccaaacttgatgccattcttctgaaacggaatattccgatccccagccaccacgccgacgaggaagttcccagcgacgccgcggaggaccttgtccttctgggtatgccgaagttgttgtcactcacacatactccaataccgcctctgtcgttgccttcgccgctcaagccgactccatcacccacgctcaccgcagccatgtccatgccaactccgtcgccacgccccacattcatgccgcaacaccccgcacccttgccggccccgcttaccagcataagagacactacggggaagcttgtagcacgacttcaccctaccttacctctcgagagcggcaacaacatccaccttttgtccctcggctcctctcttgcttccctctcacgaccaccgtattcatcgtcgtcacctccaccaccgccaccagagccaccgcctccaccacgaccacggttggcgcgggtttatgcttcacggacagtgatgttcggtcatcaaggtcttggccatgcaaaccgctattcacaactctcactcccccttgttgcttcttcttttgaccatgcaacaacaatatctctttaa

SEQ ID NO: 39642 - DNA, 303 bp, Glycine max
  Peptide Sequence Number=SeqID_156420
atgcctcacctccacccaataccactactacatgcaaacaccaacaaccaacaccaccatcaacgaccatggtgtagggaagaagttgcgatggagttgggatggcaaaggagggtcatgttttccatctccttcctcatctcaactacatcacatcttcttccctgcaccatggtgtacccctcgaatctccccaacaattggtatcagagccaggttcaagttggtgaccggctcagacgagtatgcaagtaccgcaggtggccagaatggctagcgggcagggcaagaaccgctggatga

SEQ ID NO: 39643 - DNA, 642 bp, Glycine max
  Peptide Sequence Number=SeqID_156421
atgaacaacgagtacccaacaatcatcgcttccaccacccacggatcattagaggaacaagaagatgaacacatcactgaaatcagagaaatccacgagttaaccccgccgccgccacgtggaagagcctgggagacagtgcatcatacccacaggtcaagctctctgtccgtagcttcagaaggtggcgcctcttccagcgacaacttcagcatgagcagagagttcagcgctctggttctcgcagggtcctgcatcgaccacgacaacaacaacataagtcccatgaacgaaaacaaccacaacaacaacagcaatagtaacagcttgttggggaggatcagagaagaggacttgatggaagagacgaaccctttggcgatcgtgccggataaccaccctttgcaggacccggttccgtcgtcgacgtctcagggagtaaggggtggtggtggtggtgcacgtgaggagcacgtgtcggtgcagatggtgaagaaggaggaggtggatgctaagatatcggcgtggcagaacgcgaagattaacaacaggttcaagagagaagacgctgtcatcaatgggtgggagagcgagcaggttcaaaaagcttcctcttggatgaagaaagttgagatggattaa

SEQ ID NO: 39644 - DNA, 201 bp, Glycine max
  Peptide Sequence Number=SeqID_156422
atggcatctagcagccacccttgcagaggtggatcaagaggcaatccagataaccttggtggctatgttagtcgttgctttgctgctaatataggcaacaacttctccttggctgatgaactgatgagagccattctaggtattgaaatggccgctacaaaaaagtgcaagtatctttggttagagagtgtgactctttaa

SEQ ID NO: 39645 - DNA, 567 bp, Glycine max
  Peptide Sequence Number=SeqID_156423
atggaacacatgttaacctctaagaggttcatattggaagtgctgcacaaagcgggcatgatttgccttgatgaggacaagggagagtcttgtttgatacatccaggggcaccgcacgatgtggagacatgcccgacagcagaggagctgctacaggggatgatagacaaaggcctaattgaacctgtcccagttgagaagcctacccctttcccctacaagaatggcaaggtggtgccatggaggtacgccacacaagggcccaacagaaagaaggatgtgtccatcatccacgttaatggtgatttatcctccactaaggtcactaacatctctagcacgagcggcatgactcgtagcaagcgaatcttcgcagcacccaagccaccagtgcgatccaaggacccaaaggggaaggcaaaggcgagcgtggaagagagcgataaggcgggcccgattttggatgacgaggtcttgattggaaggttttccaaggaagtagatgacttcagcaaaaagggaatatccgctgaagaagcaaccgagttcctgcgaatcatccaatag

SEQ ID NO: 39646 - DNA, 197 bp, Glycine max
  Peptide Sequence Number=SeqID_156424
cattcttagcaagctcaaaatctaaagaaagtcttgctcagaatcttaaggaagttctccagctacttcaacaggaagaagaagaagaacccctcaagaaggaagccgaatcatccgagaataatgatgaccaagaagatgatccattctaccaaaatgaggatgactgttttggtatatcgttagacgatggttag

SEQ ID NO: 39647 - DNA, 304 bp, Glycine max
  Peptide Sequence Number=SeqID_156425
atggccttgatatattctgtccctgaatcggaccctcgtgtgaaatgttatgaccccttgaattctcgagagcttcctgatgaggacatgaccaagagcaagggcaaggatccacttgaaggacttggaggacctatgacaagggctatagcaaggaaagccaaggaagctcttcaacaagtgctgtccatactatttgaatacaagcccaagtttcaaggagaaaagtccaagggcccaattggcaacctaggcatcagccttttgggagaccaaatggtggctgacttgttggctgttgggg

SEQ ID NO: 39648 - DNA, 714 bp, Glycine max
  Peptide Sequence Number=SeqID_156426
atgaagcacttcactgacaccctcatcagtgccaacatagaaagagatcctattgatggcccaatgcctcatcttgaaactcgcttatgcatgctcttgtgtatcatacctcttgttgttggcgatcttattgaggaggaggaggaaaggacaccggttgatgaaaaagacaatggtcctacaggtttctggaaagagaaaaaggttgcaggaaaatgtcgtgatgatttagtctcaagtctccaggtattgggtgattatcaaagcttgctcactccacctcaacctgttcttgctgctgcaaatcaagctgctgcaaaagcaatgctatttgtttcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39649 - DNA, 243 bp, Glycine max
  Peptide Sequence Number=SeqID_156427
atgtgggtgcaagccattggtctgtttgctcaagcgacctgtgctcctgagtttggacttccaagaccgctcaataagagattactcgtcttgcacgttggtgggggtgccgtaaaacaacaaggacaacccttcccttgtgctcaagaatcccctacaacaagagacccacggtctcttaatcccttttcggaaataagaagaagagaagaagaaatctctcgtaaaagaggtagattgtaa

SEQ ID NO: 39650 - DNA, 393 bp, Glycine max
  Peptide Sequence Number=SeqID_156428
atgggttttcagaccttaccttacttcaacataccaaacatcactaatatatatgtttttgttctttttacaagtgttgaggaaaaaagcccagagtttcaagaacctcgggatttgagtggcgtctcctctcaactcttcttcttctccgttccgctgccattcatcttccaagaagcaaaggaatccattgatgaagaagatccaaggcaaacaagctccaatggagcttacatcatgagaccttactcccataggagagaaaaggaaagaaagcctcaagaggctaacattagcctcccatatgggaaggacaatgtagagctgctaaagatacaagactctaagaggattaggctagagctgctaaagaaggctatggggttctcatga

SEQ ID NO: 39651 - DNA, 432 bp, Glycine max
  Peptide Sequence Number=SeqID_156429
atgtaccctctcttgttcttagtcaacagcccaagtagatgtaccctctacttgtaccacaaaggatgtaccctccaatgtgttaagacaaaggaaagggaagaatcaaaagaattctcagactgtgtcgttttgaattctttgacaagggagaagggagacacaaaagaattcgggcggttagtccttcgttcttttggaaaagggagaagagagacacaaaaagaattcaggcggccacattctactggggtggtcccatcaaccctataccaaaaattaaagtttttggtaggaggccagctcatcatagtcttgggagaagaggatatattagttagttgcccatctactattccctatgttaaggcggcggaggaatctcttgaaacagctttccaagcattggagttcgtggacaatgtgatgtaa

SEQ ID NO: 39652 - DNA, 378 bp, Glycine max
  Peptide Sequence Number=SeqID_156430
gtgcaaattgcaaagaagaatgaaagttatactaagcaagccaacaagaaaaggaaggaagtggtacttgaaccaggtgatgatcctggacatttgagggcaaatgttttccaagaaggagggaatgatgagaatcttgaaattggccaaatacaggctaaaggcccaagtaatccttgtggcgtctaccctgacttatcttccttcaccggaagtggcgtctaccctgacttatcttccttcattgaaagtggcgtctaccctgacttatcttccctctttggaagtggcatcaccaaaacctccgtagcctgtatcaaacgatctgcttctcctcaggttcacatcacaaaagctctaagcaaattagaacgatga

SEQ ID NO: 39653 - DNA, 330 bp, Glycine max
  Peptide Sequence Number=SeqID_156431
atggccaagactttgaatgatgaatatgaaggatcaaatgagcaaaccactacttattattatcaagatgatgaatccacaagaacacacctaagtgttttacatgatgaggcgatacctttgtttgatggaaatgccacaatggaagaagtagataacaatgatatacatcatcgagtgaacaattttcctgatgagcacttcattaatgagattgatgatgatgtgattgaagatattaatgagttcatatatgatgaggaattatataatttagactcgagtggtaatcatcatgccaactactcgaggaaaggggcatcgagttga

SEQ ID NO: 39654 - DNA, 294 bp, Glycine max
  Peptide Sequence Number=SeqID_156432
atgattcatgagataagttatggtccaaccaaatttggaacttcttttaatggctcaatcgttaacaagtatagaattcacactaaggactatggacttaatagagccaccatgaatagtgggtttgacccaaacaattccattgttgatgagagatatgagttgtttgatatcaagcataaattagagcttcagtcagatgagccgtttgtattagctgaacaaacacaacaagttgtagatgcaattggctttgatgttttgatgatgatcatgatgatgtgttgcaattga

SEQ ID NO: 39655 - DNA, 255 bp, Glycine max
  Peptide Sequence Number=SeqID_156433
gaatcatatgaagtctcaatgacacacaaatatggagaagacacttcaacccatcttgtgattaactatgatctttggttgaaagctacaggagaaaataagaagaaaaaagtttgtggcctcgatcctagtttggatctttgcactgctagtatctctacacatgcttcttcaaaggctataccttcttccacaactcccgcacctttgacagaagaaagaacattgccacagatgatgcaacatgcactttag

SEQ ID NO: 39656 - DNA, 183 bp, Glycine max
  Peptide Sequence Number=SeqID_156434
atgaggaagaagagaatacgagtgataggaggttctctaggtcggagggctaggggagggttgcaccatcaaggaagtgaaggaggaggaagagtgcaacagaggagaggatgcagtagtagcagtaggtgggctggagatgcctgtgttttggaaaaaaaatacttaaaaatcacatgttaa

SEQ ID NO: 39657 - DNA, 246 bp, Glycine max
  Peptide Sequence Number=SeqID_156435
atgacaatcaattcatggggctccggacttgatggtggaggacgcacgaacagcactaggcaatcaattcgtggggctccggattcgatggcaatcaattcgtggggctccagactcgatggtggaggatgcatgaatgacaatcaattcatggggctccgaataagatttgatggtggaggatgcacgaacagcgctaggcaatcaattagtggggctccggactcgatggtggaggatgcatga

SEQ ID NO: 39658 - DNA, 225 bp, Glycine max
  Peptide Sequence Number=SeqID_156436
atggaaaatatccaaaatcaagacaaaagccaaaacaacaaagtcactgtttcactgcttgctggagaggcagccagagccggtagcatagccacttgtttgatgctcccaactcccaagttaaggtcttgcagcaggctcaaggggcacagtaatgttgttctaggcaggtctaatcctatagttttccatgttttgtctttgctaagtgattatcatacatga

SEQ ID NO: 39659 - DNA, 468 bp, Glycine max
  Peptide Sequence Number=SeqID_156437
atgaaggcccaagtggagaaagatgaatgcccagaggcagaggcactatcaagacaatttatgttgctgaaggcccaatctaatttgaaggcccaaacttatcaaggtaatccttgtggcgtctacccggacttatcttccttcaccgaaagtggcgtctaccctgacttatcttccttcattggaagtggcgtttaccctgacttatcttccttcaccggaagtggcgtcatacaaaacctccgtagcctgtatcaaacgatccgctcctactcaggttcacatcaccatacttatcaaggtaatccttgtggcgtctacccagacttatcttccttcaccggaagtggcgtctaccctgacttatcttccttcaccggaagtggcgtctaccctgacttatcttccttcatcggaagtggcgtcatccaaaccttcgtaacctgtatcaaacgttccacccgtaag

SEQ ID NO: 39660 - DNA, 273 bp, Glycine max
  Peptide Sequence Number=SeqID_156438
atgtctcagaagcattacgaaagtacctcggcttggatttttttcacagaaacaaatttcctcactaatttcgcgagaatcctcaaattccaaaaaggctcaacaatttactcttccttttttcccctaattataggagaaaagagggaggtgattgccgcccagctcgcccaggcgagctgcgttgcttccaccagaaggcatcgccttctgttggaaccccctggaaggcccaagtgggtctggttgctatttgcaccccctttttactaa

SEQ ID NO: 39661 - DNA, 174 bp, Glycine max
  Peptide Sequence Number=SeqID_156439
atgatatggcatctccagctagagaaaaatgttacaagcataagcgtagagcttcatccgcacaacaatcaacagagaaaaaatcgacgacaagatgactccaacaatgaaggaatcaacaacaaaacaacctctagcgaagtagcagatgcaagtggaaaagcatgcaactga

SEQ ID NO: 39662 - DNA, 777 bp, Glycine max
  Peptide Sequence Number=SeqID_156440
atggggaggaggatgatgcaatggaacaccatcaccaaagcttcaattctcatcaccatcaccctccacttgattctccccgtggccgttaacagcatgaggctcgaactggtgcacaggcaccacgagcgcttctccggcggcggcggtgacgtggatcaggtcgaagcggtgaagggtttcgtaaacagggacggcctgcggcggcagaggatgaatcagaggtggggtgttagtaattacgacagaagaagaaaaggcttggaaacaacgacgacgacggaggtggaaatgccgatgcgcgcggggcgcgacgatgccctcggcgagtacttcaccgaggtcaaggtcgggagccccgggcaacggttctggctcgccgcggacaccggcagcgagttcacgtggttcaactgcgtaatgcggaatgctacaacaacggcaacaaccaagaagaccaggaagaacaaaaccaaaaagaaacatcatcatcacagcaagaggaacaggacgaggacgacgaggagaacaaagaagaagaaggccaagagtaatccctgcaagggggtgttctgtccgcataggtctaagtcctttcaagctgtcacgtgtgcgtcgcagaagtgcaagattgatctcagtcagcttttctcgctcagtctttgtcccaagccttctgatccttgcttgtatgacatcagtgtttcagatcaagtgggaggtaccactttattcaaaatagaccaacatgatgaaaggaagattattagatgctaa

SEQ ID NO: 39663 - DNA, 463 bp, Glycine max
  Peptide Sequence Number=SeqID_156441
atgaattgcgttttcgttcatgtgtcctccacctttgagtttggagccatgcgtagtgattgcttagttcaattttccattctcaccatttttcggagccccatgaaatgcgttttcgttcatgtgttctccaccttcgagtttggagctatgcgtagtgattgcttagtgcaattctccattctcaccatttttcggagccccatgaattgcgttttcgttcaagtgtcctccaccttcgagtttggagttatgcgtagtgattgcttagtgcaattctccattctcaccctttttcggagccccatgaattgcgttttcgttcatgtgtcctccaccttcgagtttggagctatgcgtggtgattgcttagtgcaattctccattcccaccctttttcggagccccatgaattgcgttttcgttcacgtgtcctccaccttcgagtttgcagccatgcgta

SEQ ID NO: 39664 - DNA, 522 bp, Glycine max
  Peptide Sequence Number=SeqID_156442
gatcatggcttctccacctgcctcccctcctcctcctcctcctcctcctcctcctcctcttcctcctcctcctgctccttccaacgcatcggcttcgccgtctgccgtgaagcagacacgcaaagccttaggaaggaattaagaacatatttggggattgtggcgcctggtgctgagaaaccagtggtccatgttgatcctgctactggcaaggccgacggtccccacaggaagaaattaagaacatatttggggattgtggcgcgtgataaggtggacatcacctacgagaactggaaggaggcgaaatttgaaatcccagaggcttctgacagtaggacgaaaagaaagttacttcagaccgtgggcgagagacggaggcagtttaaatcagacctcacgaggaaatgggcccttacagccgatcaggacggtgtggaggacactgtctgtgagaaatacggcataagcaaggaaaaatgggcccagttttgccaaactcgcagagacccttcttgggag

SEQ ID NO: 39665 - DNA, 351 bp, Glycine max
  Peptide Sequence Number=SeqID_156443
atggtaggtaggggacgagaagcattgggaagtacaggcaatccccatgttgtgcagagcaagaactctttcccaacatatggcttgcctcccacctatacactacccgatgttgcacacactctcgatgagaatgtcaacaactctgcactgatgcccattaagagccaacaaccccaatctgatcatgcacatgtctctcaacccatgggggagacacatgaagcaccccgagaccacaatctagccagctttgaaccttacctcgggtatgccactaaggggcaagcagttggtgatatacccctgttggacactttggggggccctcagtatcgcccacaaccatga

SEQ ID NO: 39666 - DNA, 471 bp, Glycine max
  Peptide Sequence Number=SeqID_156444
atgatttgtgatcttggacaagaatcttttcagcaagcatatgcccttatgcatgggtggagtgacaaaagcttcacttcacttcttcaggtggtgcaagatatggttctagaggaaaacacattgccaaaaagttactatcaagagaagaaaatactttttctgatgggtatggagtaccagaagatttatgcatgccttaatgattgcatactatacagaaatgagtttgaagaaatgcccaactgccccgggtgtggagtgtcacgatacaaagtgaaggatgatgaccagcgtagcagtgatgaaagcaccaagaaaggcccccccagcaaaggtgttatgctatcttctgatcattccaaggttcaaaagaccttacatggcatgcaaatgggagaagttgcaatggaatgctccaccatccggttgattcctttcagtgaaagaagattaatagtctatatctga

SEQ ID NO: 39667 - DNA, 1551 bp, Glycine max
  Peptide Sequence Number=SeqID_156445
atgagtagtgctaatgaagcaatggaacaagaggatcaaatcaaacccctatggagatatgtcacgaagttaagaaagactcctggcgggggaaatgccatgatcaaatgcaatttgtgtgaaatctcattcattgggtcttacacccgagtaagggctcacctgctgaaaatcttgagagaagcagttcgaccttgttcaaaggtgactcctccaaaaattatcgaattaaaaaaactggacaatgaagcaactttgaagatacaaagttcaaagaaaaaatgtgtctctctacctggggaaggaaaacagaaacaagatggtgctcctccaaaagtcctaggtcctttagaaaaaggtttcaatttgcaaggcaaagatgatcttgatgccagaattgcaaggatgtttttctcttcagggctaccatttcatttagcaaggaatccttattatagggaggcattgtcttatgctgccaatactcctaatctcagtggatataagcctctaggttacaataagttgagaactacctttcttacaacaaagagaagacatgtggtgaaccttttgcaaccgataagaaattcatggaatcagaaaggtgtgaccactgttaatgatgggtggagtgatccccaaagaagccctcttatcaacttcatggctgtcactgagagtggaccaatgttcttaaaggcggtaaattgctttggtgatataaaggacaaggattttattgctcaacacatcaaagattcaattatggaggttgggtcatcaaatgtggtacaaattgtgactaataatgcagttgtatgtaaggcagcatgtatgatcatagagaatgagtttcctgtcatctattggactccttgcgatgctaatttgattaaattttttatcatgggacactctatgagattatcattgtacaacaacttcaactcattgaagttgctttctgttgctcctacaagatttgcttcaactgttgtgatgctcaagaggtttagaagtttgaaagaagaactccaaaagatggttgattacatactttctttcactgctcctatttatgttcttagaaagatagatattgatatggttgttctacacttggtatatgaaatgtgggattcaatgattgaaaagagtagcacacctcttcattgcctagcacattctttaaacccaagatattacagtcatgaatggttaagtgaagatccatcaagagttccctcacatcaaggtgtggaacttactgatgaaaggaagaaatgctttagaagatactttgatgatgtggatgctttcatgatgttgactcctttaagggacaaaggtgaattggatacaaaatcttggtggcttgttcatgcaatcttcgcctcacttcaagaaattcctcaaacaagaatgtgggatattgcaagagataggttttcacttgatgagaatggaatccttgaaatagcccatttatctcttgatgaaccggttttagaagctgtctttttcaatgaaggtgaccaagggctttga

SEQ ID NO: 39668 - DNA, 834 bp, Glycine max
  Peptide Sequence Number=SeqID_156446
atggaggtccagcaaggtctgagcgcagcgatggcgtgctctgcgtgcagcgacagaggtccggtgtggtctgagcgcggcggtctgcgtgtagcaatgacatgctatgcacgtggcgcagagggcccacctcttgctggaaagtatgatatgggagctttatgtatgcatgcacattctgaaatgcttgaagcccttataaatgatgctttagacaaaggagctgaaattattgcacgtggaagttttggacctataggtgaagatgcagttgatcaatattttccccctacagtgattgtgaatgtgaatcactcaatgagattgatgcaagaagaggcatttggaccaatcatgccaataatgaaatttagctctgatgaagaggttgtcaggcttgcaaatgactcaaaatatgggcttgggtgtaacgttttctcaggcagtcagagccgtgctagagagatagcttcccagatacattgtgggcttgctgcagttaatgattttgcatcaacatacatgtgtcagtcccttccatttgggggcgtgaaaaacagtggatttggacgattcggtggtgttgagggtttgcgagcctgctgccttgtaaaatctgttgttgaagatagatggtggccattcatcaaaaccgtgataccgaagcctattcagtatcctgtagctgaaaatggatttgagttccaggagtcgcttgttgaagcactatacgggctcagcgtgtgggaccgtttgcaagcattggttaacgtgctgaaaatgcttactgagcagaactctacaagtggcagcagaaaaaagaaaaatgactaa

SEQ ID NO: 39669 - DNA, 810 bp, Glycine max
  Peptide Sequence Number=SeqID_156447
atgaaaaaccaaatctctttcctcaccctgttttccataaacttgcttctttgctttgcactaggtccatgcacgcgtacatgcgcttttgccctagaggctgaggcagaacctccagtcgggttttcacgttcagaaactccaaacagtgaaagccccacatcacagcctccagtcgggttctcacgttcagagtttacgaactctgaaaacccgacatcatcattgtccgagaaagaagagtcagagtcttcttccttgggcgatcatccctacatgtcgttctcgagcgccttcgcggacatcctcaagggaaccctccgcggccacaccatcaccatgccggatcacgatccgaaggccagccaccaccgctctgtgaaagatatctgctcccacacggactacccggaggtgtgcgtgtccaccatcacgccgttcgtcggcaacgacttagacctcatgaacgtcctcgaggccgccatcaaggcctgctccttccaggccaacttcaccatctccgtcgtcgccaagcacatgaaggcctcgccggagatggccgccgcgctcgaggactgcaaggagcagtacaccagcgccctggagaacctccacagagccatggaggctattccgtcccgcgatctcggcaccgttacggttatgctcagcgctgttttggcggatgtttctgcgtgcgagagtgggtttgaggagcaaaagactgcattgtccatgcctcattcggaaggcatggttagcattactgccagtatttgtctttccattgcttcgttgattccctattag

SEQ ID NO: 39670 - DNA, 153 bp, Glycine max
  Peptide Sequence Number=SeqID_156448
atgcctttattccgcctacccttactaatgggcaatcgtaatttcttgctttccttccccaatggaactgaactagcactagaattccaagctacctatccagtttgcaacctcgtaaagagagatcgggatgatggagacttgaagaggtag

SEQ ID NO: 39671 - DNA, 1197 bp, Glycine max
  Peptide Sequence Number=SeqID_156449
atggttgaccgtacaaagagcaaggttcttatcagagaatataatgaagataaagatgctaaaatggtgagaaaactagagaggaactgtgagggtggaaccaaaaaggtggtctccatttttaccaacatgacgggtgaccctttatctaggattaggtttttcccccttcatgttatgctggtagctgagcttcttgacacaagggagcttgttggagtggttcggggaatcattaagaatatgggcactctttctgggtcattcttgaaaatgggttgtatcttaggcctcagagtctctcctacttacaggagaaaaggggttgcactaagacttgtgaccgcagctgaagaatggatggtgagaaatggagctgagtatgcattcttagcgactgaaaagaacaatggtgcatctaaaaacctattcaccatcaaatgcaactatgtgaatctcagctcacttgtcatatttgtccaaccaactagttcccttacaaagcaaatttccacggatataaaaatagagaaagtggacatagatctagcaatttcgttgtacagaagaaccatgaggaccaaagatttgtatccattggacatggatgttattctgaaggagaaactcagcttaggaacatgggtatgctactacaaagaagagggatggctcaacttgcggagcaaggtaaataatgaagatcttattaataacaatgaaacctcaagatcatgggtcatatttagcatatggaacacttgtgaagcttataagcttcaagttagaaagtctcaactactaaggtttcttcttacaaccttaaatcatgcaagagagaaagttttcccttgtctcaaaatgtgggttagtagtagtgactcactttgtagaccttttgggtttctcttcatctatggaatctatggagagggagtgaaccttggagagctcatggaatccatgtggagattcacatcaagagtaggagaagcaatgagggactgcagggttgttataactgagttagggttcggtgatccacttgctaaccatgttcctcaaacagattctatgtcatgtatcgatgatctatggtacacaaagagactttcaagccatggtgatgaaaatgttgatgaactaatgatgaacggacaagtgagaaatgtgtttgttgacccgagagatttttag

SEQ ID NO: 39672 - DNA, 495 bp, Glycine max
  Peptide Sequence Number=SeqID_156450
atgtctacactccttaggtttaaactcaacattgatggcagctccattggtaaccctggaaatgctgggtttgggggtattattcgtgactcctttggcgattggcatgctggtttctatggctcttgtggtacggctacgtcactgcaggctgaactactagctattcttcatggtttgaatttatcttgggataaaggctttaggaatattcaatgtgagtcagactccaaattggctttacaattgatttcagagggaaggaattcacttcatccttatgcttcaatcatacagaagattcaagactttaagctcctccattgggaccttcacttcaatcatacctttcgtgaaggaaacatgtgtgcggatgaacttgctaaaacaggttcctccttgcaatgtaatctccaagtgtttaatggctgtccccccttcataactcagctggttcttgctgacagaaaaggggcgcagtacattaggcattag

SEQ ID NO: 39673 - DNA, 529 bp, Glycine max
  Peptide Sequence Number=SeqID_156451
atgtcatgctctcgtgcgttgtcatcacgttggaccgacctcaatgaggaactggaacaacttcttgcgaatgtgcctcaattaaccattgaagagcacatagagtggaggaaaatgacaaacataatgcagaatgtcgcgactccaccaaaggctttttttcagactgttcacgctagggaccagggcctgatagagaatgggagtatggctctcagatatttctgcactacaaatatttcaacccaacatcatcatcatgcttctgttataactcttgtttcttcttctctttctctaacaagcacacgcatgcagaattccatacctgctgcgagaaacagcaagaacaagtttattactgctgagaacgtgaagagcctcgttagcacggtcgtgcttccttccatttcatccactccactcgagtctctccacagaggcaactgggtcaagctcatttgtggtgcaagctttgaggatgttgttgatatcagaaatctcagtctggtttacactcttgctggag

SEQ ID NO: 39674 - DNA, 3285 bp, Glycine max
  Peptide Sequence Number=SeqID_156452
atggaaggtttagacgatgacgatttcggcgaactctacactgtcgacattgaagttcccaatgccatccccgaagaagaagaagaagaagaagaagatgaaattgatgtaaacagtaacattgtgaatcttgataaggatatggacagcgagacagtgaatgatgactgtgctgctgagagtgacagcagcgacgacgacgacggtctgaaaatcgtgctgaatgacgaggatattcctgtcggagctgatgctcgcgacgaaggcaatggcgacaacggtgatgataacaatggttccagattttttcatcctaagactgggaggagtcgaggattggcgattttgaataatatgaaggccaatgcgtccatgggtatggcttcttacatttcatcgttgaacaaagggaggaggaatggcgatgcctgcatccagaaccttgctttgagctcctctcgagtgtgtcttgcagcaaatcctatggctgttcaatgtggatatggatcggctcttccttggtactggggtatatttgatgtaaacactgatacattaacggagaagctatggaaggttcctggagttgacataacggattactttaactttggttttaatgagagcacttggaagttatactgttcttcattggagcaactttggcgaacatccttgcaaactggtatttctgttgatgacgctgcaaactggaatcaggaagtcatgagagagcaaactgatcaagttgtgtcaggaaatgcattttttccttcatcagattgtggattgccaaaaggcagagcaattcaggttgaggacagcatggttgaacgacagccatccatagatgtaaggcgtccacgtaatagggattttaatgttatagagatcaagctgcttgactcctctgatgactgttctggttctggcaatagcactgtaatgaatgcatcattagaaggcgaatctatggcaggcaataagagaagtgttctcaattcttctggtgagctcaatgaaatgctgtctgaagatcagttggaagatgtgaaaaaagcagaggactcttctcttcatagaagaagcgggccgattcctggtgtagatggagatgagcatcgggatcaagcagaccaacattctgaagatactgcagaagtgccagagggagaaacaaaagcagaggaaggtggtggcatagacgcatgtagttcttatccatgttggattgaatcagaattgtctcttggagatcaagagcatagcctgacttcctatactgatagcgattctgaggcaatggataacagtgtacaagttgataatgataaaagtttcagccctttaaaaaggaaatcgttgaattgtgtcactgacatgaaggagtctttgccactttgttggaagaattcaaagaacaatagtatcaataaaaaagcagtaagtgcagcttataattcaagaactagaggtcaattcagaaaggaatggaggcaccgaagtggtggatatgaacctagtagttatgatataaataagcacactgaaaatgataatgatgtctccatcctcaagtccagtgcaaggaatctgtctctgttggctcgccgaccagttgattatggcagacataaagaccgactgcaagtttttggcagtcataaaataagagatctttcatgtaatagggaaacaaaacaatcctactattatggcgatgaaaaggttgttgatgagttggttgcatgccgctctaaatattatcatgaagatcaagaaagcttaagggagaatacaaaccgacatgaccgaaaaaatggggatgtggaggattatttttttgaaccaggccctcgatttgcagatagtgaggacagagagagagattggtatcatcttggttgtgagtactcttctgatgacctgagtccttgctcctacagggagtcaaggaagtttcctccaaaacattcatcttttcctgatgaagagaggtatactcaagggaaaagaatggatggaaaatcccattttatagacagaaattgcattgatgattttgatgaatgcgagtttaagtttctaaacaagagctatagaatgtctactattgctgagagagaactggaatttttagataattatcgtgaagagcagtttccacatattgatagagattggagaagatctgtctgtaggggaagacattatgatagcccccctttagttctgaataacttgtgttctgggataatggaagttgaagataattgtcagaaatatacacattgccagacttcaagttttaagtatcgtagacaatcttatacagattcagcgaaaaattatgcatatggggaaagagtaaatggaaactttgggggttcggggagagataagcatgctagggacaacagaggcagtaactggttgtgtggttatactgacactgctgaagatgaagatttcccaatttatcctgtaaaaaagtatcagttttacaggtccccatctaagttcctgaactggacagaggatgaaattatttatagacatcatgaaactcatgcaacatctctgtttgctaaggttcagagtgatgatttgccattgcagcggcatcagctaagcatgccaatacgagatagtgagaaatattttaaaggtagctctaagattatgtgcagaagtaagggtgggcaggcattgctgagatgcaggaaatcagttgacttgattcatggggaaggaaagtctcaagtgagaagttccagagtcttgtgcaatggcaggcttgaaaatgccaaccagaggattgctaagaagcggaggagagctgcagtgggttttgatgaatctaataaaaatgccagcaaatttgacaccccaaaacacaagagcaaccaggaaagtaagaaatgggtgcaggaccttcaagatcaagcgcagaaagaaagctcagaaatcgaggaaggtcagtttgtagcagaagaaccatacatggaggaggcttctgaaggtccagcagtgactgatggtgtgaacaagaagagaatgtcacaaaatgaaaatagttctgagcaatgtattggtggttacgacagtcaaaggattcttgattcattagccaagatggagaaacgtagggagcgctttaagcaacccatgacaatgaaaaaagaagcagaagagagtttgaagctcaacgatgattccattgtagataaaggtgaaatgaagcaacatagaccagctcgaaagaggcgttgggttggtaattag

SEQ ID NO: 39675 - DNA, 222 bp, Glycine max
  Peptide Sequence Number=SeqID_156453
atggattatcaagttgactgcattgactgtgctgctgatgcatcggttcttagtgctgtgaatgaaggaattgaagctgcaagagatattgtatgccttagaaggccctgggtgatgatcagtgtcaatgatgataaagatcttcattttcgtaaggctggacttgaatatgagtcaaataattcccaagttgaagaagtctacttgctgactatgtggtga

SEQ ID NO: 39676 - DNA, 570 bp, Glycine max
  Peptide Sequence Number=SeqID_156454
atggcaaccggacaactattctcgcgtactacacaggctttgttttacaactacaagcaacttcccatccagcggatgcttgattttgacttcctttgcggcagggaaacaccatcagttgctggaataattaaccctggttctgagggatttcaaaaacttttttttggtcaggaggaaattgccatcccagtgcatgctaccgttgaagcagcttgtgctgcacatcctactgccgatgtcttcatcaactttgcttcatttagaagtgctgcagcatcatccatggctgctttaaaacagccaacaattagagttgttgctattattgctgaaggagtacccgagtcagacactaagcaattgattgcatatgcccgatcaaacaataaggttgttattggcccagccacagttggaggcattcaagcaggtgcttttaaaattggtgacacagctggaacaattgacaatataattcagtgcaagctctacaggcctggatctgttggatttgtttctaaatctagaaagattccaccaacagaagctaattcaagttccaaatag

SEQ ID NO: 39677 - DNA, 2163 bp, Glycine max
  Peptide Sequence Number=SeqID_156455
atgggtagtagtactgaaatgggaatcccagaagaagaaaaagaagaagagcttctgaagaagatagaacggctagaagctggtcacgctcacctcaagcaagaaatgtccaacttcaagctcttccaaaacaacaagtctcgttccaggttcggtgctgccacgtgtaacaaaccctcttcttctctgcatcaaaatggaaacaagtatctcaatatcttgcagtcaatgggccacgctgttcatgtgttggatcttcaatgtcgtatcatgtactggaaccctagtgcggagagtatgtatggttatgccgctgaagaagttctagggcaggatgggattgagatgcttgtggatcccagtgattttggcttagccaatgatgtgttcaaccatgtcaaaaggggagagagttggagaggccagctccctgttaagaataagagaggggataggttctatgctgttacaaccaatacacctttctatgatgatgatgatggaagcttggttggggttatttgtgtctcctgtgattcaaggcccttccttgagaccagaattcccttgtcaggggtagagaatgccgaaccggattcaggtttgaatggtcgtaggaggagtagcatttcggataagcttggccttgactctaagcagccacttcaagctgctctggcgtcgaaaatttcaaatttggcctcgaaggtgagtaacaaagttaagtctagaatcaggactggagaaagtaacaccaatggtgaaggtgggagcggagagagtcatcattctgagcctagtctctcggactgtgttctagctgaccagagagaggatggtaattcaagtggagctagcacacccagaggagaggtgctaaaatctccttttggtgtattttctcatgttgaagagaaatccgaaggaaaatctgttagaggctcgggtgaacaaagtcaaggaaaacctattcacaagatcataacttctaaggctgaaacatggattcaaaagaaaacatcttcatggccatggagagcaaacgatcaggaaggatccgaggcaaggaatgttcgtgttgcctggccttggtcacagggcgatcaagaaaatgagtcagttaatcagaagaatatttcttctggattgaagccagaaagccaagcaggagaaagtaatcgatctggtattaacgaggcttcaggatcctggtcctcattttttaatgttaacagcacaggtagtaccagcagctgtgggagtgtcagcagtagtgcagccaatattaaaggggatgttgactctgattgcttggattatgaaattttgtgggaggacctgacaatgggagaaccaattgggcaaggttcttgtggaactgtatatcatgctcagtggtatggatcggatgttgctgtcaaggttttctcaaagcatgaatacacagatgatacaatactgtccttcaaacaagaggtgtctgtcatgaaaagacttcgtcatccaaacattattctctttatgggggctgtgacttcacctcaacatctatgcattgtaacagagtttctcccacgtggaagcttgtttcgtttgcttcagagaaacacatccaaaattgattggagacggcgagttcatatggccttagatgttgcacgaggtgtaaattatcttcatcattgcaacccacctatcatccatcgagatttgaagtcttcaaatattctagttgataagaattggactgtgaaggtcggtgattttggtctttcacgtcttaaacatgaaacatatctcactactaagacaggaaaggggacgcctcaatggatggcaccagaagttcttcgtaatgaactgtcagatgagaactttggggtgatattgtgggaacttacgaccgaaaagatcccgtgggatactctgaacccaatgcaggttgttggagctgtagggtttatgaaccatcggctagaaattccagaagatgttgatccacagtggacttctataattgagagctgctggcacagcgatccagcttgccgaccagcattccaggaactgttagaaaggctaaaagaactgcagagacggtacacaattgaattccaggcagctcgatctgctgttgaggaaggcactcaaaaggagttctag

SEQ ID NO: 39678 - DNA, 2070 bp, Glycine max
  Peptide Sequence Number=SeqID_156456
atgggtattggttttacaccaccttacttagcacccaccacagttggaccaggggttttggaaggtgtcaactatgcttctggtgcaagtggaatcctcaatctcactggaaaactctttggtgaccgaatcaacttcgatgcacaattagataattttgctaatacaaggcaagacatcatctccaacattggtgttcctgcggctctcaatctattcaaaaggtctttattttcagtagcaatgggttccaacgatttcattaataactatttagcaccagcagtcttaatttacgagaagaatttggcatctccagaactctttgtgaccaccttagtctcaaggttcagagaacagctcattaggctattcaatctaggtgccaggaaaattatcgtgacaaatgtggggcctattgggtgtataccaattcagagggatatgaatccagctgctggtgatggctgtgtcactttccccaatcagttagcacagtcatttaatatccagttgaagggcctcatcgcagagctcaattcaaatttgaagggtgcaatgtttgtttatgcagatgtctacaacattttagaagatatactcaacaattacgaagcatatggttttgagaacccatcttcctcgtgttgttccatggctgggcgttttggaggtttggttccctgtggtcctacttcgagcatttgctgggacagatccaagtatgtgttctgggacccttggcatcctactgatgctgcaaatgttatcatcgctaagcgcctcttagatgaagtctcagataatgaggttagaatcaagacatggcaaggtggatcagtatcaggagtggcattcagtaatattcacatggatagcatcagaaactgggccttggatcccactactactggatcagtggttctaaagggtgtcaattatgcctctggtgcaggtggaattcttaataactctagcgaaaattttggtggtcgaatcaacttcgatgcacagattgacacctatgcaaatactaggcaagaaatcatctcattaattggtgttcctgcggctcgcaatttgtttaagaaggccctctttacaatagcactaggctcaaattccagaaagggtgttggtatctccggaaacatttgtggggccagaaaaattgttgtggctaatgtagggcctattgggtgcataccatatgtgagggattttaacccattagctggagatgaatgtgtaactttcccaaatgagctagctcagttttttaacacccaattgaagaaccttgttgcagaactgaggacaaaattggagggattcggaaaaaaaaagctttccggtgctggggagcctagggttagggtttctgagagatgtgggatgttccatgcattgatgagccttatcgcgcgctgttggaagccgttcgggcacggtgacgacgccgctaatgccgccgccgccgccggaagagaatgcaaggacggcctcctctggttccgcgacatcggaaagttcgccgccggcgatttctccatggccgtcgtccaggccaaccaggtcctcgaggaccagagccagatcgagtccggcgccttcggctccttcgtcggcgtctacgacggccacggcggccccgattgctcccgctatgtctgcgacaacttgttccgcaatctccaagcgatattggctgagtcacagagtgttgtgacatctgaggccattcaacaggcgttccggcggactgaggaggggttcacggcgcttgtttcggagctgtggagctcccggccgcagattgcgactactgggacgtgttgtttggttggggttatttgccggcagacgctctttgtggcgagtcttggagattcccgtgctgtgttgggtaggagagtcggcaacaccggtgggatggccgcgattcagttgtctacggagcacaatgcgaattttgaggctatcaggcaggagcttaaggaattgcacccgaatgacccccagattgttgtcctcaaacatggagtgtggagagtaaagggaattattcag

SEQ ID NO: 39679 - DNA, 1041 bp, Glycine max
  Peptide Sequence Number=SeqID_156457
atggcttctcctcgttcttggttgtcttttcatgtctcatcattcatagtgacaattctcattttttgcttgtcacattgtgctctttgccttgatggacaaaccgttgtagactctcctttgttaacagaaaaattaggaatcaatcgcaccatcaaagtagatatcaatggcaatggagagttcaaatctatccaagctgccatagattccattcctgaaggaaattctaaatgggtcatcgtccatgttagaaaaggaatatacagagaaaaggtgcacgtaccacaaaataagccttatatattcatgagagggaatgggagaggaaaaactgccatagtttggtctcagagctctgaagataacatagattctgccaccttcaaagtcgaagcacacgacttcattgcctttggaattagcttcaagaatgaggcacctacggggattgcatatacctcgcaaaaccaatcagtggcagcatttgtggcagcagacaaagtggcattttatcattgcgcattttacagtactcataatactcttttcgattacaaaggtagacattactatgaaagttgctacattcaaggctcaattgatttcatatttggccgtggcagatcgatcttccataaagcggatatatttgtggtggatgacaaaagggtaacgattaaaggttcagtcacagctcaaaatagggaaagtgaaggtgagatgagcgggtttatcttcatcaaaggaaaggtttatggcattggaggggtgtacctaggaagagcaaagggtccttattctagggtgatttttgctgagacgtatctatctaagaccattgtcccagaagggtggaccaattggagctatgatggtagcacaaaagatctataccatgcggagtacgaatgccatggacctggagctttaacaacgggacgtgctccttggtctaggcagctaactaaggaagaagttgctcctttcatatcaatagattacatagatggcaagaattggttgccagcgtgggtataa

SEQ ID NO: 39680 - DNA, 345 bp, Glycine max
  Peptide Sequence Number=SeqID_156458
atggctgtagaaaacaaggactcaaatggaatggagagaaatagaaaagaaattgagaagaaaggaaatagagtgaaacaaagaagcagagaaagaaagaacaaaaaggttacaatacacaatccggtgggttgttcattggacatggtgtacatcgtcatttggtttataataaatgtagtagtcatggagtggagggagaaagaattagctgctgttaagataaatgcagcagatgttgatataattgcaaatgaactagagttggacataaaagttgctgaaagaactttgcgggagcataaaggtgatgcagttgctgccattcggcacttgcttcactag

SEQ ID NO: 39681 - DNA, 777 bp, Glycine max
  Peptide Sequence Number=SeqID_156459
atgggcaaattacgtaagagtatcggaatactttttgtgttcttattactagtgatagtaatagcagaatgccaaaaagtaaaaaaagatgaattactcgagggctttgaaggtggtggttttggcaacggagaaggtttcggtaaaggtggtggagatgcaggtggtgggtttggagatgaacatgggagtggtgtaggaggaggagctggcggaggtggtggaggctatagaggtgtaggaggtggtattggtggaggtttaggtggtggagtagttggaggaggtggtggaggtgaacatgatggtattggaggaggagttggtggtgttggaggaggtggaagtggtgctggtgggggtttaggaggaggagatggtggtggcattggaggaggagctggtgatggtagtggagttggaggaggtggtactggaggcagcataggaggtggacatggtggaggtggaggtggaggaggagttggtgttggtggaggttatggaggtggtagaggaggaagtgccagaggaggagctggtggaattggaggtggacatggtggtcgcaatggaggaggatttggagctggtgttgctagtggcactgtaggaggagttggtgggggatatggagatggaaaaggtggaggtgttggtggtggctttggagggggacatggtggtagtgcttgtgttggaggtggcaaaggtggcggcaatggaggagttgtaggtggtcatgcaagtgggagttcccgtggcagtggctattaa

SEQ ID NO: 39682 - DNA, 408 bp, Glycine max
  Peptide Sequence Number=SeqID_156460
atggcttttgagtctcgtgctctttcaaagtcccactttgtctcattcgcaccctctttgcgtcctctctcacttcgtctcattggcaccctaaaacgcgtcactgtcgaagctaattcaacctattctatgatcatcctcgaacttttggaggccgaggatgcagccgaagactccaaccatgtcaatgggaaccagaatttctcccgtacaacgataatcactaacggtggcggaaattcaggtggcgaccggaacaggtcaaacaccccaaaccgttatggcgtttgcaccataaataacacttgtactttcagtgccactagtggcaatatcaaccgaggctttataaggaggatgtatttgactaatactccatcaggaactactagtattatatactattag

SEQ ID NO: 39683 - DNA, 624 bp, Glycine max
  Peptide Sequence Number=SeqID_156461
atggcagattcaaggattttccgtctaagaagtcgaacaaggcacaattcattttttcgtgttcctttccttctctgtcgccagatcacaggtaataacttgaatgctgcatttgcatccgtttctgaagattccgtggatttatcaccgatctcagagatctcgtatgcaaatcacggcgaagatgtcacgtttcagaccttcttgttggaagaaccttcctcggtgactttggttccatctgatttaactcctaaagaaatcactgacgcgacgggaattattagctccactaattctatcagcaccgataaatttgatagttctaagtttaactctgtggaagcagagattactgtgaattttctcagaaatgtgaaaactgatgtcctcaacgctgctccccaatgtagaagagagcttatggatggaataattgagtatgttataagcgatctccaaacctataccctgccagaggagagagatcagtttgctcatttgctttcgatgaaaaatcgaatgttgtttctgtgtaccttcatttgggtaattggagtatcagttctgcttttcttcacttcgtatactcgtggcccttacagaggaccgacgccaacctga

SEQ ID NO: 39684 - DNA, 189 bp, Glycine max
  Peptide Sequence Number=SeqID_156462
atggggtctaggagggaagaggcaccactactattgatagcgatgaaactaaggcactcgtgtgctctctctgccaccgaaagttggaggaggacgttaatgttagtagaagaagaagagagagagggtgatgtaaaaatgtctgcagtgtcgtacgaggtgggggcgacaagccacatgggaccatag

SEQ ID NO: 39685 - DNA, 363 bp, Glycine max
  Peptide Sequence Number=SeqID_156463
atgcccgattctgtggaaatcaacctcgaacatgtagatgaggccaaagcagcagacaaagtgtccaactccaaccataataaggaagctagtaatggcaaaaaaaaaggcgaccagaaaatcaatgataccacaaaaggtcaaaatagtacttacactaacaatcaatgtaatcacagtgtcaacggctctatatacggtggcaccatcaacctcggtggaagtcaaggcaaccagaccaggtatgaaaatagtcgtgttataaataacaatggtactttcaatggtaatgccaacggatgctttaacgagggtggctttcagtctcacaccacacactactacgacggacgtagaggttaa

SEQ ID NO: 39686 - DNA, 493 bp, Glycine max
  Peptide Sequence Number=SeqID_156464
agcatcaaacaggcaagtctgtaaaggcttagagccattcaattacttaacaacaaggatggcagattcattcgcgcggttgatgctaatgcgcctcttggatgagaatcctgtggatcaaccaccatcatcgttgtcaccaccaccacaaccccgaccccgacgcaaccccagggatcgtgctcctcgccacaacaccccatcatctcaccactcacctccccaatctttcaacaacagtggcacactgaacatggagggtgccattaacaacgccggttgtgttcagggcaacggcaacgggggttactgtgcggatttcttggcgaagcttgacccaaattcaggtagctggttctctgagttggtgattcctcgtactgagttgcagcctgcggatgcgaggatgactttgaatcctctcttgctgacctttctagcaactgtcccgtttctctatctcaacatgaacattcctactttcaagagttag

SEQ ID NO: 39687 - DNA, 294 bp, Glycine max
  Peptide Sequence Number=SeqID_156465
atggaacttctagaggctcacgtggaaggagccaaagggtctaagtcaaactcaaataacagatatgatagtggaagccagaatggatcaaccatcaacagtggcaattatacaaacaacaataacagttatgatgactcataccactacgggggacgcgctattataacaccggcactttcaatggtaatgacaatgggggatatattgaggatggctctcacttcacaagaaggagctactatgggataccatgtgaactatcagctaatggacaaacaagaacttggctaa

SEQ ID NO: 39688 - DNA, 294 bp, Glycine max
  Peptide Sequence Number=SeqID_156466
atggcagacatgatgcaaagaaccctcgaacttgtgcaggctgatcaagcagctaaagggtccaattacggcacttcaaattcattcaaccaacatggcaacagaaaccagaatttctccggcgcaacaatcaacagtggcaatgatgcaggcaaccgaaacaggtatcacacctcaaaccactacaatgaacatgttcttaacaacactggtgctttcaatggtaatggcaacggaggacacatcgagggtggctttcactcctctaaaaggatctactaccgtaggcgttga

SEQ ID NO: 39689 - DNA, 312 bp, Glycine max
  Peptide Sequence Number=SeqID_156467
atggccgacttgatgaaaagaatcctcctaatggaggccgagcaagcaagcaaatggtccaaacatgttacttcaaccatcaacagtggcaatcatcacaacaacggtaacaggtatgaccactcataccactacgatgaacgccctatttataacagaggcactttcaatggtgatggcaatgggtcacatatccagggtgactttgactcctcagaacggaactactatggtcgtcgttatgaattaagtaagaaaggaggaaaaaaaagaagaaagagaggaaaaatagattttttaaaggtggtttga

SEQ ID NO: 39690 - DNA, 279 bp, Glycine max
  Peptide Sequence Number=SeqID_156468
atggaagaatccaagggttttgttggtggtgagtctcaaaaaccacatccagaaatgccctctatttcttttcaaattcctatgccagggaggaatcgatctggtggtctctacccttggggatggaggcaaagagcaataataccacagcacaccgtgcgaaactctaacggggcaagtgagaacacaaatttgaaggtttgttgcggttgttatgttgtcttcttcattatcgtatattatcgtgcatgggtgtacgtagctcagtacctgctttga

SEQ ID NO: 39691 - DNA, 440 bp, Glycine max
  Peptide Sequence Number=SeqID_156469
atggaagatttgtaccatgtcagtttcactacagatgacaattctagttcatccaacgacattttgtggtgtactgaggaactgaatgaattgagaaaggtccaattttcgggagcagaagatcatggagagtatgggggaattgacccactttactctaattttgggttcttcccagatgatccatcagaacaagaagggtaccttctatccactgatcaacaaaagtatcaccagcaagtgcaaccatcataccatgattatggacaattggatgataaccttcagtttgacatggtatctccaccactccaatttgatgcacaatatccaaccatggttccactatgtcacacaacaaaggacaagccaaactcaaactcaaatacccctttagcctcacttgacatcttgaacaactatggcaagggcttcaagag

SEQ ID NO: 39692 - DNA, 983 bp, Glycine max
  Peptide Sequence Number=SeqID_156470
aggcacttcgccagaggatagatagagcaacaggaagagtttcatacaaggatttgcaaaagggtccttcatttgatcctttagaggcaaccaaggtactaaaccccactgttgttgcattttatgaagagcttcccttttgtcaaatttctgtgttcacagaagttcaagttataatagaagatgttgctgaagcaaagaagattcatgttattgatcttgagatcagaaagggggtgcagtggactatcctaatgcaagcccttgagtcaagacatgaatgtccaattgagcttcttaagataaccgctgtagaaagtggaaccactagacacatagctgaggacactggtgagagactaaaggattatgctcaaggtttgaacatacccttctcttacaacattgttatggtatcggatatgttacatctaggagaagatgtttttgagattgatcctgaggaaacaattgttgtttattctcattttgcacttagaaccaagattcaagaatctggccagcttgaaatcatgatgagagtgattagaatcttgaatcctagtgtgatggtggtagctgaaattgaggcaaaccacaattctacatcttttgtaaaccgtttcattgaggctcttttcttctttagcacattctttgattgccttgagacttgtatgaaaggggatgaggggaatcgaatgattgtagaatccctatacttcagtcatggaataaggaatattgtggctgcagaaggagcagaaagagatagtaggagtgtgaagattgatgtgtggagggccttcttctcccgctttggaatggtggagaaagaattgagcaaattgtgtttatttcaagcggatttggtggctaaaagatttccttcttatagcacgtttgataagaatgggcattgccttcttattgggtggaaaggaacaccaatcaactctgtttctgtctggaaatttctttga

SEQ ID NO: 39693 - DNA, 351 bp, Glycine max
  Peptide Sequence Number=SeqID_156471
atgcgggggtccggggaatttgtccccttcttagatacgacgtctaggggtagcgaaatgccccaacgcacgtttttaagaaggcgacacggaccctccgttggtttgtttacagtagggatcgagacagaacccatatgcaatgcctatgcaaaagacacaatgcgggaatgtacacagtccccagcggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 39694 - DNA, 324 bp, Glycine max
  Peptide Sequence Number=SeqID_156472
atggaagaggaggaatccctacgaatgttttctccagaagtaatgattcaagatccaaacattggaaatgcgaattctcttttacctcctgtagttttttttcatggatctgggaattattccataccattagatgcctggtttgtgcccatttacaagggttttacattttttgctccattggagcttgtaggccttggatcttcttcatcaatggattcctttgcttcttggaagataaatggcagcggaatggagaaggaagagagagaggagacgccacttcaaggagaagatgagtctagaagaagctcaccaccatag

SEQ ID NO: 39695 - DNA, 276 bp, Glycine max
  Peptide Sequence Number=SeqID_156473
acttatcaaggtaatccttgtggcgtctaccctgacttatcttccttcactggaagtggcgtctacccagacttatcttccttcaccggaagtggcgtctaccctgacttatcttccttcaccggaagtggcgtcatccaaaacctccgtagcctgtatcaagcgattcgctcctactcaggttcacatcaggttgagctcgaacgaaaaaacctagctgacgtacattgtaaatttttaaggcaacaccgagcaaaaaagcatcctctaccgtaa

SEQ ID NO: 39696 - DNA, 207 bp, Glycine max
  Peptide Sequence Number=SeqID_156474
atgggggtgcaaatagcaaccaggcccacttgggccctccagaagattcctccaaaaggcggtggcttctggaggaagccaccttgctcgcctgggcgagctgggaaatccgagccgaggcacttccgtaacgtttccgtgggtgatttcatgaaggttttcgaccgttcttcgtcgttcttcggtcttcaaccgtcattttcttaa

SEQ ID NO: 39697 - DNA, 639 bp, Glycine max
  Peptide Sequence Number=SeqID_156475
atgcgggcttttttatggacagaattcactggaaccaccgatgatgaacatcaaaccacaaatgacattgctgaaggcgcaagccagctaccggggcgaccccaccaccattttccaccagctgtgcggcgcccgtccggccaccctgctgctggaatcggcggaaatcaacagcaaacagaatctgcagagcctgctggtgatcgacagcgcgctgcgcattaccgcactgggccacaccgtcagcgtgcaggcgctgagcgccaacggcgcggcgctgctgccgctgctggacgaagcgctgccgcccgaggtgcgcaatcaggcgcgccccaacggccgcgagctgagcttcccggcgatcgacgcggtgcaggacgaagacgcccgcctgcgttcactgtcggtgttcgacgcgctgcgcacgctgctgaccctggtggactccccggcggacgagcgcgaagccgtgatgctgggcggcctgttcgcctacgatttggtcgccggtttcgaagacctgccggcgctgcgccaggatcagcgctgcccggacttctgcttctatctggcggaaaccctgctggtgctggatcaccaacgaggctcggcccgtctgcaggccagcgtcttcagtga

SEQ ID NO: 39698 - DNA, 366 bp, Glycine max
  Peptide Sequence Number=SeqID_156476
atgatgtctagaagctcgtataataccacaaggaaagcaaacagtgcgtgtcaagtaggtgttcagaaacaagctggacgaggcaatgcattcctcaataggctaatacaagaggaagtctatgtagaaaaaccccctgggtttgagagtaacacttttccacaccatctaatgcaagctgaatttgaaatgagtgtgatgggagagctagagttcttcttaggactacagataaaacaaaccagatatgaaatctatatccatcaaaccaagtatgtcaaggaacttcttaagaagttcaagctaaaagatgcaaaagaaaatgaagactcttatgcatccaatgatgcgtcttggactggatga

SEQ ID NO: 39699 - DNA, 570 bp, Glycine max
  Peptide Sequence Number=SeqID_156477
atgcataccagggcaagatttcagccagcttctgcaaggagacgagtgtggatcatgcgcaccaacatatggatgatgttgctacctagcaaccttcttcagagtgaccacaactctgatctccccctaccgaagtggattgcgcctacaggacactcagtgggcccggagaagtccaacagggtcctggggttttcagctctgattacgagccttcatcagttctacggagtgcccgtcgcccctagcaggttcatcaggcccctattaatagggctttcatcgagaagtattgcgcccccaagcaggcatagggcaaggcatcacagtagagggcaacagacgcaccgccaccacctccagagttcacctcagctcacccacaaaaaggctggagcgttgcctacgacacatggtcaaccagtaggcacccaaccaccagaacagcgtttcgaggccatcaaaggatggtcattcctcagacaaagacaggggcagctaagggatgatgaatttccgcacttccttggaggaggcggagccatacaactgggatcaccaaacttgtga

SEQ ID NO: 39700 - DNA, 357 bp, Glycine max
  Peptide Sequence Number=SeqID_156478
atgccgatctccccctgcgaaagtatcggttggtctgtttcatcccgacatagggtagcgcccagaagacacctagtggacccggaggagcccaacagggccctggggtttcaagctctggttacgggcctctgtcagtcctacagggtgcccgtccccccagcaaggtcatgccatcgtgacataggaatcgcacccacaaagacactcagtgaacccagagaagtccaacagggccttggggtttccagctcgggttacgggcctctgtcggtcctacagggtgctcgtccccccagcaagggatcgcgcccgcaagacacccagtggacccgaagaagtccaacagggtcctag

SEQ ID NO: 39701 - DNA, 249 bp, Glycine max
  Peptide Sequence Number=SeqID_156479
atggtcatctacccaaaatcaaaacttgatgggtcatcaacccaactaacctctgtcaaacctgagtcatcaactcaggactccccaaaacctatcatctccaaacagaccatggcagattatgcctggtcaatccaaaccctccaagcccttgaagaaataggcctcaccaaggtccctatgttagccaaaaagacctgggcagaaatggcctcaaaatcagatgatgattctgagactgatctctaa

SEQ ID NO: 39702 - DNA, 282 bp, Glycine max
  Peptide Sequence Number=SeqID_156480
atgaatgcaggtgatccaccccagcagaagacaagtcaaggaaatgagaaaaagaaagaagatgagaatattactcaagtaattttgaaagaagtgaaaaataaaattaagggtttcccttctctcgatctcattacaggcgatccacctcaagaggagagaagtctaagaatcaagatagaggaagaactcaagaatattacagaaggtgatccacctaaacagaagagaagtcaaggaaatgagaaaaagacagaagacgacaatattactcaaggttag

SEQ ID NO: 39703 - DNA, 489 bp, Glycine max
  Peptide Sequence Number=SeqID_156481
atgttactggcagaggtgtgggtagaggagatcgtgatgattccgatgatgctccgcagcgtcgacggcctaccgcatccgcacggagacaatgtagaggctgacgtatttccggatgacccgatggcaccagctgatgtagaggacactggggcagacattcctacagacataggcgcgcaggctgctgaggataagcatgagggatttccaggtggtctgagcgacctatccgtgctgacccaatatgcagatcacgttgcttgcagcgtatggacgggagatgagcgtcttgagttgaagttatcctctcataggaggaaggtccatagtttaggcaggcctgtccctaccattgagggattagttgcttggacaggactaagtcctctgatcgcgcgttcggtagacactggcgatcagggacttttgtcctcgtttgtcgagcggtggcaccgggagacgtctagtttccatctccctgtgtga

SEQ ID NO: 39704 - DNA, 366 bp, Glycine max
  Peptide Sequence Number=SeqID_156482
atggatcttattgaaaatatggttgcaagtgacattgctattttcagagatagagcccacgtaccaacaaagaaaagtcttctggaacttacatcgcaggatgcgttgttggcacagaacaagttgttgtcaaagcaattagaagtatttaccgaaacactaaggtgtgccatctgtggtggagctcacaattctggctgttgtatccccaatgaagaaccaactcatgaagtcaattatacggggaaccaaccaaggaaaaatttcaatgcaagtggatattctgggtttcagcatggccagccatataattcacagcagggacagtggaggaatcaccctggaaaccagttcaacaaagactag

SEQ ID NO: 39705 - DNA, 2782 bp, Glycine max
  Peptide Sequence Number=SeqID_156483
aaccttggcaagactgttccctttgtcccttgcccgaaatcttgggaaacttaagacccttgaaatacagatctgtgacaagttggtagaaattgttggaaaggaagatgtgacggaacatggaacaactgaaatgtttgaattcccttgtttgtggaagttgattctttataagctgtcactgcttagttgcttttatcctggaaaacaccatctggaatgccccgtattaaaatgcttggatgtgtcctattgtcctaagttgaagctattcacatcagaatttggagatagtcccaaacaagcagttatagaggctccaattagccaactacaacaacaacctctgttctcgattgaaaagattgttcccaatctggaggaattgacactcaatgaggaagacattatgctgttgagcgatgcacatttgccacaagacttccttttcaaattaactgatcttgatctatcctttgagaatgatgacaataagaaagagactttgccttttgatttccttcagaaggtacccagcttagattatcttcgagtggaaaggtgctatggtctgaaggagatatttccctctcagaaattccaagttcatgaccgttcacttcccggattgaaacaattaagactgtatgatcttggagagctggagtcgatagggttagagcacccatgggttaagccatactctcaaaagcttcaattattaaagctttgggggtgccctcagttagaagaattagtgagctgtgcagtgtctttcatcaatctaaaagagttggaagtgacgaactgtaataggatggagtatttattgaaatgctcaactgccaaaagtttgttgcaacttgagagcctatctataagtgaatgtgaatcaatgaaggaaatagtaaaaaaagaagaagaagatgcttctgatgagatcacatttggaagcctcagaagaataatgttggattcattaccaaggctagtaaggttttattcagggaatgccactttgcatttcaagtgtttggaagaagccacgattgcagaatgccagaatatgaaaacattctcagaaggaataatagatgcgccattattagaggggattaaaacttcaacagaggatactgatcacttaacctcccaccatgatctcaacaccacaatcgagaccttgtttcaccaacaggttttcttcgaatactcaaagcatatgatccttgtcgattaccttgagacagcgggtgttacgcacggcaaacctgcttttctgaagaatttctttggcagtttaaagaaattagaatttgatggagccattaaaagagagattgtaattccatctgatgtacttccttacttgaataccttagaagaattgaatgtacatagctccgatgcagtgcagataatatttgacatggatgacactgatgccaacaccaagggaatagtccttccattgaaaaagcttactctagaggacttgtcaaatttgaaatgtttatggaacaaaaacccaccaggaactctcagctttcccaatctgcaacaagtgtccgtttttagttgtagaagcttggcaacactgttccctttgtcccttgcccgaaatcttgggaagcttcagacccttaaaatacagatctgtcacaagttggtagaaattgttggaaaggaagatgaaatggaacatggaacaactgaaatgtttgaattcccttatttgaggaatttgcttctttatgagctgtcactgcttagttgcttttatcctgggaaacaccatctggaatgccccttattagaaaggttggatgtgtcctattgtcctaagttgaagctattcacatcagaatttggagatagtcccaaacaagcagttatagaggctccaattagccaactacaacaacaacctctgttctcgattgaaaagattgttcccaatctgaagggattaacactcaatgaggaagacattatgctgttgagcgatgcacatttgccacaagacttccttttcaaattaactgatcttgatctatcctttgagaatgatgacaataagaaagagactttgccttttgatttccttcagaaggtacccagcttagattatcttcgagtggaaaggtgctatggtctgaaggagatatttccctctcagaaattccaagttcatgaccgttcacttcccggattgaaacaattaagactgtatgatcttggagagctggagtcgatagggttagagcacccatgggttaagccatactctcaaaagcttcaattattaaagctttgggggtgccctcagttagaagaattagtgagctgtgcagtgtctttcatcaatctaaaagagttggaagtgacgaactgtaataggatggagtatttattgaaatgctcaactgccaaaagtttgttgcaacttgagagcctatctataagtgaatgtgaatcaatgaaggaaatagtaaaaaaagaagaagaagatgcttctgatgagatcacatttggaagcctcagaagaataatgttggattcattaccaaggctagtaaggttttattcagggaatgccactttgcatttcaagtgtttggaagaagccacgattgctgaatgccagaatatgaaaacattctcagaaggaataatagatgcgccattattagaggggattaaaacttcaacagaggatactgatcacttaacctccaaccatgatctcaacaccacaatccagacgttgtttcaccaacag

SEQ ID NO: 39706 - DNA, 621 bp, Glycine max
  Peptide Sequence Number=SeqID_156484
atggcacctcacatctctagagcctctgttgttgttttggtagctttcctagtccttcccttacttttctcagacatggcaagagcaacaattccagaatcagatgttgatcttttagaatttcctttaaatttagaatacttggaggctgaattctttttgtttgggtctttgggtcatggattggatgtagttgctccaaatctgactgagggaggaccccctcctattggtggaaaattggccaaacttgacaactttgtcaaggatgtcatcttccagtttgctttacaggaagttggacacttaagggccataaagaggacagtgaaagggttccctaggccattgttagatctaagcgcgacatcttttgcacaaagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattag

SEQ ID NO: 39707 - DNA, 504 bp, Glycine max
  Peptide Sequence Number=SeqID_156485
atgtcgtacaggatgtcacgacatcacgcttcagaacatgcagattatatgtgtccgtatgaacagattaaacaagtaaataacacaagagaattgtttacccagttcggtgctacctcacctacatctgggggctccaagccagggaggaaatccactctcaatagtgttagttcaaggtctaacagcccctgtttacaaccttctcacctaaccactaccctcaaagacacaccagagatcaactctgaacaaaagagatcaactctacacactagagatcaactctacacactagagatcaactctacacacataggtccaacacttgatgttagggtaccatcaaggtggctcacaaaagactcaagtcccaaaaactcacaaactaactcttcaatcccggacttggtacagaactcgtgcagcctccatgattatatagccgtgtacgattctgggctgcaagttcttgatgctggaggagatctatcttcttcctga

SEQ ID NO: 39708 - DNA, 357 bp, Glycine max
  Peptide Sequence Number=SeqID_156486
atggttaaactcttgtccaagtttctattttcagtactacagattttgatttcacttaatgcagaaccatactcgttttggcctgatttatttaaggaagccaactatgagtggggactagtaatcaaggagtggatacatggggtgatggaatatttcccatttattggatctagctcctttaaattgagcaaatgcttcacttcttcaacgttcccacttgcactaatattattcaaagacccaagtagtagtagcatttgcatttccctcacgcacccaatgggtagagccatgaggtggttgaagggcccctacagcactgcctgtgttcgatggctggcagaattactctaa

SEQ ID NO: 39709 - DNA, 151 bp, Glycine max
  Peptide Sequence Number=SeqID_156487
atggcgtctttcctaaaaagaccaaatgtgaggatctatcatatgctgacaatagcggaggagacagcggatctcctcgggggcggagtaggtgtctgccatagctttggcctttgccagcattcagggaagctcttgactcccgttcaaa

SEQ ID NO: 39710 - DNA, 426 bp, Glycine max
  Peptide Sequence Number=SeqID_156488
atggcaagaatagcaaaagtggtcaagatctcggaacaagagctagaccgagtgaagcaaaataggaatggggtggtagggataccaaggaagcgcttggaggagaaggtggaagctctggccagcaaaggagagtgggcagcattcatcgacgtatttgctctgctagtgtttgggacagtactattctcgaatgtagatgggttggtggatctagtgacaatcgatgcctttcttgcttatcaccacagcaaggaaagctcggtcatccctgtttgggcagatccatatgatacattcaacttgagatgtgagaagagcagtgcaagaattgtctattgtacgcctgctctttatgtatggttggtcatcacatgtgctccaaaaagggtacaacaaattaggaagaactcttggcaggcatga

SEQ ID NO: 39711 - DNA, 201 bp, Glycine max
  Peptide Sequence Number=SeqID_156489
atgtctcctccacctttaaaaacctcacaatctctcaaaaactccttcaaagctcttcaagatgcctcctttggtctgctcagtcgcctttgggtccgcatgctccaaaactcccctctaattctgtgttttcagattttatatggaaatcctgtcggtggcctctcgctgagcgccaatcttgcgcttagcgcgcattag

SEQ ID NO: 39712 - DNA, 135 bp, Glycine max
  Peptide Sequence Number=SeqID_156490
atgcggaaattgattaaggaaatgatggaaaataaggtggctaatttcgtgggtcttaataaggttaagaagtggtggctggacagaaatatagaaatggcaataactgaagctacagggatccaaatgaggtga

SEQ ID NO: 39713 - DNA, 249 bp, Glycine max
  Peptide Sequence Number=SeqID_156491
atggacaaggctattaaagaggtttctggtgagaactatattgaacaggctgccatgagagatgttcagaaggcttatgtgtttggcaccacttattttctcagaataatgtttcaaggcatggatctttattttaagagacatgatggccaagctgtgacatatgaagatttttatgttgccatgcgagatgccaatgatgcagactttgcaaatttcttgctatggtttgtatttattgccttctaa

SEQ ID NO: 39714 - DNA, 303 bp, Glycine max
  Peptide Sequence Number=SeqID_156492
atggagagcccattagatcaagaagaaggtactcaacctaaaaaggaaaagaatgaaactccaaaggatagcagtgcggatcgcgagaaggaaaaaaagacctatctggtgcactacgtcaccttccacggtgaccttaccatggcctctgacaagatttccaccaccatcgttgtcttgccactgtcggccctgcagcagcctcgcaccactggactttgcaccagtggtgccatggacaatgcgccaccctccgtggtggctttcgtgttagccgtgccattttttgcacgaggcaattag

SEQ ID NO: 39715 - DNA, 864 bp, Glycine max
  Peptide Sequence Number=SeqID_156493
gttgatcccaaactgaaggaattgacactcaatgaagaaaacatcatcttgttgagggatgcacatttgccgcaagacttcctttgcaaattaaatattcttgatctgtcctttgatgattatgagaataagaaagatactttgccttttgatttccttcacaaggtacccagtgtagaatgtcttcgagtgcaaagatgctatggtctcaaggagatatttccctctcaaaagctccaagttcatcacggaatacttgcgcgattgaatcaattagagttaaacaaactaaaagagttggagtcgatagggttggagcacccatgggtaaagccatactctgcaaagcttgaaatattaaatattcgcaaatgctctcggttagaaaaagtagtgtcttgtgcagtatctttcattagtctcaaaaagttgtatttgagtgactgtgaaaggatggagtatttattcacatcttcaacggccaaaagtttggtgcaacttaagatcctatatatagaaaaatgtgaatcaataaaagaaatagtaagaaaagaagatgaaagcgatgcttcggaagagatcatatttggacggctcacaaaattaaggttggagtccttaggaaggctagtaaggttttattcaggggatggcaccttgcaattctcatgtttggaagaagccaccatagctgaatgccccaatatgaatactttctctgaaggattcgtaaatgcgccaatgtttgaggggattaaaacttcaacggaggattctgatttaacattccaccatgatctcaactccacaatcaagatgttgtttcaccaacatatgtgtatgcagttgcttccttatgcgtag

SEQ ID NO: 39716 - DNA, 1533 bp, Glycine max
  Peptide Sequence Number=SeqID_156494
atggcttccaaccaagaaataacagcccctttgagatattgggtggacaatgaacgaaagcgtgtagttatggcggaagcaagtggacactttgtagatgttctctttagtttcctaacccttccattgggaactatcatccggcttgggaacacatttgggcaaccaatagagattggttgcattaacaatctattcaagagtgtggaagctctgaacccagatgttttctggaacgacatctgcaagcgaatgttgctttctccgcgcaacccgttacaattctcttaccagagactaaaactgaaggtggatgatacgcagcccacaaagtatttcgtgtgtcacatctgttcaaagggcagtgatttctcgctgagtacttttgatgaggtaaagtgccactgtgggaacttgatgaaaagacaactagatatgctggtagagcctgctggtggcaatggtgtttttgttaaaggggacgccatgttcttgatcttcgatgacttgacagtgctccgtagctctcccagtgtctccttcaaaccaccactccaactcggacacaaagaattcagaaaggtggaagaaaaatctctagatgttgacacaaataaggtatttagcatactaaaccaagcattaacctccaaatctgctctaagtgtcacattggaaaacggaaaatctgagccatcgtcctctttcttaccagatattggcccaagtcgatggaaagattccataaaaatcaaggtaatagtgagcaaatcacagaacaagattctgtttgttgaagcagatggagactttgtcgattttctagtcagcttcctcacgatgccacttggatctattatgtaccttgtgaatggcaagttatcattgggaagcattgataagttgtacacaagtgtgaagaatctcgatccatcatggttcatagcgtcgtcaaccaaatccttacttaatccaaaggttgctcttcattttggttgtgggagcaatccaataaatgcttcagaagaagacactggcaagtattggtatggcactggaatagtgaaagataataggggacgtatcatctgtgaaaagaatatgatttcaaagaaaaaagatatgctaaaagatccaaaagatatcaaacttttggacccaagatcttcagatggagcaagaaaatccgatgtgggatttatgaagaggccatgtctatttgttgttagcgataatctggaagtgaaagcgatgacaacttcttcaagcattccatgtccatttatggagaatgaccggttgttggatgatttggaggaacatttggtggaaatcaggaagtcacaggcactaaacctattgatggcttctttgacatccaacgaagctgctttcacaaggagcctatcccacttattgtggaattggaaatgccaaagatgcattccattttggggtttactgggaaggaagaaaataaggcacagaaagaaaaaagaaaaggaagataaagaaagtgagaaagacatataa

SEQ ID NO: 39717 - DNA, 306 bp, Glycine max
  Peptide Sequence Number=SeqID_156495
atggtgatgaatagtctccatcaatggtgtcctgtcagttctgtagccaaaagcagtcagacaaaggctattagacgagaaggagctatcattcttcgtctaaagcttcaaaaggacactgatgcattcagactagagagagagaaggaagcgaccaaaaggctgtttgattttgctgacaagtatagggttcttactcggttcttgtccatatattctattgctactcaggttaccaggaatattctatggagggaagaaagatttaagagtgacattgaatcatttatgtgttcaatgatgtaa

SEQ ID NO: 39718 - DNA, 240 bp, Glycine max
  Peptide Sequence Number=SeqID_156496
atgggggtgtgggaagaggctggggggtgtgagaagaagagactgaggggtgtgacaaaaacagaccagggggcgcctggggttgcgcctgcagcaggggcgccaccagtcgcgcccagtggcagggcgctactagacgcgcccgcgtcaggggcgctaccctgctgctccctcgtgcgccgtgccggtgccacgtgtcgcgtaatccatggaagcgcctggctgggggacgctttgtaa

SEQ ID NO: 39719 - DNA, 342 bp, Glycine max
  Peptide Sequence Number=SeqID_156497
atggagaccttgaggagaccatttatatgcaacaacctaagggatgaagagaaaattgttcttatcttagcgggctatttgaagaaggtagtagaaaggtttaggatgcatcaatctaaatttgtaagcacacctttgagacatcacactaagctctcaattactcaagctcctaatattgaagaggaaaggaagaagatggatattgttccatatgctagtagagtaggaagcatcatgtatggtatggtttgtagtaggccaaacttggcccatgctattcacattgtaaaaaggtttagggccgattcaggtcaagctcattgggaggctttgaagtag

SEQ ID NO: 39720 - DNA, 4833 bp, Glycine max
  Peptide Sequence Number=SeqID_156498
atggacccaattacttctgccactgcccaaagtgcactgcaaattgcagaacatgtggtcaaacgacaagtgggttacatatttaattacaaagacaaatttaaagaggtggaacaatacattgagaggctggatgatactaggaagagggttcaaaatgaagttaatgatgcagagaagaacggagaagaaattaacgatgaagttcaacattggttaaaacaggtggatgagaagataaaaaaatatgagtgttttattgatgatgaacgccatgcacagacaaggtgttccattagattgatctttccaaataacttgtcattgaggtatcggttaggcagaaaagctacaaagatagtagaggaaatcaaagcagatggacattcaaataaaaagtttgataaagtttcatatcggttgggcccatcctctgatgctgctttgttaaacactggttatgtgagctttgggtcgagaaatgaaactatggagaagattatgaaagcactggaagactcgacagttaatattgttggagtctatggggctggtggtgtgggtaagactactttagtcaaagaagttgctaacaaagctcgagaaaagaagttgttcaatatggtggtcatggcaaatgtaacaagaattcctgacatagaaaaaattcaaggacaaattgctgagatgttgggaatgagattggaagaggaaagtgaaattgtaagagcagatcgcattcgaaagaggttaatgaatgaaaaggagaatacccttataatcctagatgatctctgggatggattgaacttgaatatattggggattccacgtagtgaggatgatgatggaagccaacaagatgtcaatgatttatctgattttggttaccataagatggaaaaagaagtgttttcggccgatttccatacaatgaaaaaagacaagttagctgtcgatttcaatacgatgaaaaaaggcaaattatctgttgattccaatatgataaaaaaagaaaagttatctggtgatcacaagggatgcaaaattcttctaacatccagaagtaaagaagtaatatgtaataaaatggatgtgcaggagagatcaactttctcggtaggagtccttgatgaaaacgaggcaaagagtttccttaagaaattggcgggaatacgtgcccaaagttttgaatttgatgagaaagtcattgaaattgccaaaatgtgcgatggattgcctatggcattagtttccataggaagggctctaaagaataaaagctcctttgtatggcaggatgtctgtcaacgaattaaacgacaaagttttacagaagggcacgaatctatcgagttctctgtaaatttgagctttgagcatctaaaaaatgagcagctgaaacatattttcttactgtgtgctagaatgggaaatgatgctttgattatggacttggtgaagttctgtatcgggttgggtttgcttcaaggggtccacacaattagagaagcgagaaacaaagtaaatatgctgatagaggagctaaaagaatcaactttgttggtggaaagtctctctcatgaccgcttcaacatgcatgacattgtgcgggatgttgctctttcaatatcatccaaagaaaaacatgttttttttatgaaaaatggcatagtagacgagtggcctcacaaagatgaacttgaaaggtacactgctatatgtttacacttttgtgatatcaatgatgggcttcccgagagtatacactgtcctagacttgaagtcttacatattgacagtaaagatgattttttgaaaataccagacgacttttttaaagatatgattgaactcagagtcttgatattgactggtgttaatctttcatgcttaccttcttctattaaatgcctaaaaaaactgagaatgcttagtttggagagatgcactctaggagagaacttatcaatcattggagagttaaagaaattacgaattcttactctttcaggatctaacattgaaagtttgcctctagaatttgggcaattggataagctgcaactttttgacataagcaattgctcaaaactaagagtaataccttccaataccatatcaaggatgaacagtttggaagagttttacatgagagacagcttgattctgtgggaggctgaggagaatatccaaagtcaaaaagctattctttctgagttgaggcacttgaatcagttgcaaaatctagacgtacacattcagagtgtttcccattttccgcagaacttgtttttggacatgttggatagttacaagattgtcattggtgaattcaacatgcttaaagagggagaattcaaaatccctgacatgtatgaccaagcgaaatttttggcattgaacctaaaagaaggtattgacattcattctgaaacatgggttaaaatgttgttcaagagtgttgaatatttgctgctgggagaactcaatgatgttcatgatgttttttatgaattaaatgttgaaggatttccatatttgaaacatttatccattgtgaacaattttggtattcaatatattattaactcagtggagcggtttcaccctttactggcttttcccaaattggagtccatgtgtctttacaaactggataatttggagaaaatatgtggcaataatcatcttgaagaggcttccttttgcagattaaaagtcatcaagattaaaacatgtgataaattggaaaacattttcccatttttcatggtcggacttctcaccatgcttgaaacaattgaagtgtgtgactgtgattctctgaaggagatagtttctattgaaagacaaacgcatactatcaatgatgacaagattgagttccctcaattacgacttttaacattgaaatctttaccagcatttgcttgtttatataccaacgacaagatgccttgtagtgcacaatcattggaagtccaagtgcaaaacagaaacaaagatatcatcactgaagttgagcaaggtgccactagttcttgtatatcactcttcaatgaaaaggtttcaattcccaaattagaatggttggagttatcctcaatcaacatccagaagatatggagtgaccaatctcagcattgttttcaaaatttgcttacattgaatgtgacagattgtggtgatttaaaatatttactgtcattctccatggctggaagtttgatgaatctacaaagcctttttgtaagtgcatgtgaaatgatggaggatatattttgtccagaacatgcagagaatattgatgtttttcctaagttgaagaaaatggagatcatcggcatggagaaacttaataccatttggcaaccccatattggtcttcattcgtttcacagtttggactctttgataataggagagtgccacaaacttgttacgatttttcctagttatatggggcaaagatttcagagccttcaaagcttgacaattacaaattgccagttagtggaaaacatatttgactttgaaattattccacaaactggtgttaggaatgaaacaaacttgcaaaatgtatttctaaaggccttgccaaatttggtgcacatatggaaggaggacagcagtgaaatacttaaatataataatctgaaaagcataagcattaatgagagtccaaatttaaaacatctctttccactctctgttgccactgacttagaaaaactggaaatccttgatgtatacaattgcagggcaatgaaggagattgttgcttggggcaatggttcaaatgaaaatgctatcacgtttaagtttcctcagctaaacactgtatcattacaaaattcatttgaacttatgagtttctacagaggaactcatgctttagagtggccatcgttgaagaaattgtccatactcaattgtttcaagctggaagggctcactaaagacatcacaaactcacaagggaagtcaattgtgtcggctacagaaaaggtgatatacaacttggaatctatggaaatcagcttgaaggaagcagagtggttgcagaaatacattgtcagtgttcacagaatgcacaaactacaaagacttgtcttgtatggattgaagaatactgaaattctcttttggtttcttcatagacttcccaatttgaaaagcttaacattggggagttgtcaattgaaaagcatttgggctcctgcaagcctcatttcacgtgataaaataggtgttgttatgcaacttaaggagttggaattaaagagtttgttgtctttagaagagataggatttgagcatcacccacttcttcagaggatagaacgcttagtcattagtcgatgtatgaaattgacaaatttagcatcatccatagtatcttacaattacataacacatttggaagtgagaaattgtagatcgctgaggaatttaatgacatcctcaactgctaaaagcttggttcaactcacaaccatgaaggtattcttatgtgaaatgattgtggaaatcgttgcagaaaatgaagaggaaaaagtacaagagattgagtttagacaattaaaatctttagaattggtgtctctaaaaaatctcacaagtttttgcagttccgagaagtgtgacttcaaattcccattactggaaagtttagtagtgagtgagtgccctcaaatgaaaaaattctctagagtccaaagtgctccaaaccttaaaaaagtacatgttgtagctggagaaaaagacaaatggtattgggaaggtgatttgaatggcactctacaaaaacatttcacagatcagtaa

SEQ ID NO: 39721 - DNA, 825 bp, Glycine max
  Peptide Sequence Number=SeqID_156499
atggacatttggccacaagacctccttttcaaattaagatttcttcatctatcctttgagaatgatgacaataagatagacacttggccttttgatttccttcagaaggtacccagcttagaacatcttctagtgcaaaggtgctatggtctgaaggagatatttccctctcagaaactccaagttcatgaccgttcacttcccgcattgaaacaattaatcctgtataatcttggagagctggagtcgatagggttagagcacccatgggttcagccatactctcaaaagcttcaattattacatcttatcaactgttctcagttagaaaaactagtgagctgtgcagtgtctttcatcaatctgaaagagttgcaagtgacgtgctgtaataggatggagtatttattgaaattctcaactgccaaaagtttgttgcaacttgagaccctatctatagagaaatgtgaatcaatgaaggaaatagtaaaaaaagaagaagaagatgcttctgatgagatcatatttggacgcctcagaagaataatgttggattcattaccaaggctagtaaggttttattcagggaatgccactttgcatttaaagtgtttggaagaagccacgattgctgaatgccagaatatgaaaacattctcagaaggaataatagatgcgccattattagaggggattaaaacttcaacagaggatactgacttaacctcccaccatgatctcaacaccacaatccagaccttgtttcaccaacaggtcaggaatcattatccaccaaattcaattgttatttgtttatatctctaa

SEQ ID NO: 39722 - DNA, 1122 bp, Glycine max
  Peptide Sequence Number=SeqID_156500
atgatccttgtcgattaccttgagacaacgggtgttaggcgcgccaaacctgcttttctgaagaatttctttggcagtttaaagaaattagaatttgatggagccattaaaagagagattgtaattccatctcatgtacttccttacttgaagaccttagaagaattcaatgtacatagctccgatgcagcgcaggtaatatttgacatagatgacactgatgccaacaccaagggaatgctccttccattgaaaaagcttactctagaaagcttgtcaaatttgaaatgtgtatggaacaaaacctcccgaggaattctcagctttcccgatttgcaatatgtggatgttcaagtttgtaaaaacttggtgacactgttccctttgtcccttgcccgaaatgttgggaagcttcagacccttgtaatacagaactgtgacaagttggtagaaattattggaaaggaagatgcgacggaacatgcaacaactgaaatgtttgaattcccatttttgttgaagttgcttctttttaagctgtcactgcttagttgcttttatcctgggaaacaccatctggaatgccccgtattagaaagcttgggtgtgtcctattgtcctaagttgaagctattcacatcagaatttcacaatgatcacaaagaagcagttacagaggctccaattagccggctacaacaacaacctctgttctcagttgataagattgttcccaatctgaagagcttgacactcaatgaggaaaacattatgttgttgagcgatgcacgtttgccacaagacctccttttcaaattaacttgtcttgatctatcctttgataatgatggcattaagaaagatactttgccttttgatttccttcagaaggtacccagcttagaacatcttcgagtggaaagatgctatggtctgaaggagatatttccctctcagaaactccaagttcatgaccgttcacttcccgcattgaaacaattaacactgttagatcttggagagctggagtcgatagggttagagcagcacccatgggttaagccatactctgaaaagcttcaaatattaactctttgggggtgccctcgattagaacaatta

SEQ ID NO: 39723 - DNA, 1635 bp, Glycine max
  Peptide Sequence Number=SeqID_156501
atggctttgaaggtattttttgaatattcaaagcatatgatccttgtcgattaccttgagacaacgggtgttaggcacggcaaacctgcttttctgaagaatttctttggcggtttaaagaaattagaatttgatggggagattaagagagagatcgtaattccatctcatgtacttccttacttgaagaccttagaagaattgaatgtacatagctccgatgctgtgcaggtaatatttgacatagatgacagtgatgccaacaccaagggaatggtccttccattgaaaaagcttactctaaaaggcttgtcaaatttgaaatgtgtatggaacaaaaccctccgaaggattctcagctttcccaatttgcaagtagtgtttgttacgaaatgtagaagcttggcaacattgttccctttgtcccttgccaaaaatcttgtaaatcttgagacacttacagtatggaggtgtgacaagttggtagaaattgttggaaaggaagatgcaatggaacttggaagaactgaaatatttgaattcccttgtttgtcgaagttgtatctttataagctgtcactgcttagttgcttttatcctggaaaacaccatctggaatgccccgtattagaatgcctggatgtgtcctattgtcctaagttgaagctattcacatcagaatttcataatagtcacagagaagcagttatagagcaacctcttttcatggttgaaaaggttgatcccaaactgaaggaattgacactcaatgaagaaaacattatcttgttgagggatgcacatttgccgcaagacttcctttgcaaattaaatattcttgatctgtcctttgatgattatgagaataagaaagatactttgccttttgatttccttcacaaggtaccccgtgtagaatgtcttcgagtgcaaagatgctatggtctcaaggagatatttccctctcaaaagctccaagttcatcacggaatacttgcacgattgaatgaattatacttatttaaactaaaagagttggagtcgatagggttggagcacccatgggtaaagccatactctgcaaagcttgaaacattagaaattcgcaaatgctctcggttagagaaagtagtgtcttgtgcagtatctttcagcagtctcaaagagttgcaagtgagtgagtgtgaaaggatggagtatttattcacatcttcaactgccaaaagtttggtgcaacttaagatgctatatatagaaaaatgtgaatcaataaaagaaatagtaagaaaagaagatgaaagcgatgcttctgaagagatgatatttggacggctcacaaaattaaggttggagtccttaggaaggctagtaaggttttattcaggggatggcaccttgcaattctcatgtttggaagaagccaccatagctgaatgccccaatatgaatactttctctgaaggattcgtaaatgcgccaatgtttgaggggattaaaacttcaagggaggattctgatttaacattccaccatgatctcaactccacaatcaagaagttgtttcaccaacatgtaaggaattcattatccaaattcaattgctatttacttattataagtaaattagtattctaa

SEQ ID NO: 39724 - DNA, 873 bp, Glycine max
  Peptide Sequence Number=SeqID_156502
atgggtgctcagaatgtggaaaagtctgcatgcgatatagagcatttgaaatttgatgatcaccatcacctagaagagatatggcttggtgcagttccaatcccaagtaaaaattgtttcaacagtttgaaatctttaactgtggtggaatttgaatctttacccaatgtgattcctttttatttacttcgatttctatgtaacttgaaagagatcgaggtaagcaactgtcactctgttaaggcaatatttgatatgaaaggtgcagaggcagatatgaagccagcatctcagatttctcttcctttgaagaaactgattctaaatcagttgccgaatctggagcatatctggaatcctaatcctgatgaaattctcagccttcaagaagtgtgcatttctaactgtcaaagcctcaaaagtttgtttccaacatcagtggccaatcatcttgctaagcttgatgtgagatcttgtgcaacattggaagaaatttttttagaaaatgaagcagccttgaagggagaaactaaaccgttcaatttccattgtctgacctcattaacattatgggaattaccagagctgaagtatttctacaatggaaaacactcgctagaatggccaatgctaacacaactagatgtatatcattgtgacaagttgaaattgtttacaactgagcatcatagtggtgaagttgcagatatagagtatccacttcgtgcttcaattgatcagcaagccgttttctcagttgaaaaggttttcccaaacttggtgcaactatcactcaaaaaggaagatgccataggaattttgcaaggacagtttcaggcaaggacaatttctcaaatactactgctttcataa

SEQ ID NO: 39725 - DNA, 234 bp, Glycine max
  Peptide Sequence Number=SeqID_156503
atggaagcaaatgatgctgacttagagatacacgtagaagataatatcaaccatgatttcaaccctacagagaccattacgtgtccacatcatgaaggaaagaatgacaaatatatggaggcctctcaaaggagttaccatttcagacattgccaatggaactttccttttccttttctagttctaccatcaagttgttcagagagttctaaaaggaggaccatggagctttga

SEQ ID NO: 39726 - DNA, 576 bp, Glycine max
  Peptide Sequence Number=SeqID_156504
atgactatcgagttagggcaacaaacggtggagctatccaccctcgttacacgtgccgctaacgataagtcctccgatttgttagcgtcgctaacatatcagtggacttatcgttggcagtgcatgttacaatctgtttctcctgaaagttgtactggtaaatcaggtggtacaactcaaatgagttttgagtgtattaaagggattaggttagctacttcaacaaccaacgatgctaacaacaattgtaaaattaagtcatctgatgcactcccaagaagtggactaagaactaaggtagctgacatgcagattagtgaagcaggctttgttaacactacacatgatatgttgaaatcaaggcgtgttgaagttccaaatgagaatggagttgtcaatggggacaaagctcaggatctggctttagattgcttggaaaatgcagaaactgaatgtactaacagcctgccaaactatgaagagggtgacattgatatggatcagcgactagacaaagcatgtaatttcatcataagggctggatgttcagattatgtaccaaatgccaacatgtaa

SEQ ID NO: 39727 - DNA, 213 bp, Glycine max
  Peptide Sequence Number=SeqID_156505
atggctttaaaacaccagattgtgatcgcgggccctctgtacttgacaacagcatatgatcatcaaattgcaaaatgggataataagaataattctttctgtgaggggaggtgtcacaactcttattttaaggtagttgatttagcaaacagaaatagtgcctgctttagctcttcggaacttagaattgccttctgctgcaattcctattaa

SEQ ID NO: 39728 - DNA, 120 bp, Glycine max
  Peptide Sequence Number=SeqID_156506
atggagacattgagaggaaaactcacttacagtgtgcagtggcaaatgatgttaggttgtgctctagataacaaatctgagcacaatgaaggtgttggagataggcaggatatcatataa

SEQ ID NO: 39729 - DNA, 150 bp, Glycine max
  Peptide Sequence Number=SeqID_156507
atgatggaatactgtaaagatgtcctcagctatcttgattctgatacatctattaagatactcatgtctctggatgatctggctgaccttgttcgggccacctgtgtctcgcgctcttggagagacattgccgatgcctcagtttcatga

SEQ ID NO: 39730 - DNA, 765 bp, Glycine max
  Peptide Sequence Number=SeqID_156508
agggctgcacgcccttgccttcagagggctgcatgccctcgccttcagagggctgcacaccttcgccttaagagggcagaacaccgcacgtcctctccttcagagggctacacatccttgcctttagatggctacacgctctcgtctttaaagggctgcacgccctcccctttagagggctacacgtcctctcctttagagggcttcacgtcctcgccttcagaggactgcaggtccttgccttcagaagactgcacgtcatcgcctttacaggactacacatcctcgcctttagagggcgacacgtcccgaccttcaacggttgcacgtcctcgcctccagaggctgcacgccctcgccttcagagggctgcatgccctcgcctttagagggcttcatgtcctcgccttcagagggcttcacgccctcgcttttagagggctacctgtcctcgcctttggagggctacatgtcctcaacattagaggactacacgtcctcaccttcagaggactacacatcctcgcctttagaggactacacctcctcgccatcagaggactacacgtcctccccttcagagggctacatgccctcgccttcagagggctacacgccctttccttcagaggactaatgtcctcgccttctaaggattacacgtccttagcttcagaggattacacatcctcgccttcagagggctgcacgtcctcgccttcagagggctgcacgtcctcgccttcagaggactacatgtcctag

SEQ ID NO: 39731 - DNA, 183 bp, Glycine max
  Peptide Sequence Number=SeqID_156509
atggagcaaagaagtatcagtataaactgccactacctagatgcagaagtgcagaggtggtggtcaattcatgtggcctgtggtcatgagaacggtgcatttgtacatgattttgaggtcagggattcattggttatcctatttgttgatgatagttatttacatctattgggtatgcagtag

SEQ ID NO: 39732 - DNA, 603 bp, Glycine max
  Peptide Sequence Number=SeqID_156510
atggcatgtttatatggaagaattttggccttctaccatgttctgccatctgccactgataacactgcttgcatattaattaattcatgcaatgaccatcactcttcactctttaattcgcagtttgtcaatgacctacatgctttgataagtccaacaccacagggcactcccctccccctaattctgttgggaaagtccaagaatgcactactctccactttcttgtttcttgatcaatttgtgtggcttggcagaacaggcatctaccagaataaagagcgcactgaactaattggccggatatctctttactgttggctgggttcctcagtgtgtaccaccttagttgagcttggggagcttggaaggctttcttcatcaatgaagaagttagagaaagatctcaagaacaagaataaatatgataatgagcaataccgtgccaaactaaacaagtcaaatgagagaactctatcacttatcaaagcaggaattgatacagtggtagcagttggactgcttcaattggcacccaagacagttactcctcgcgtgactggggcatttggatttgtttcgtctctaatatcttgttatcag

SEQ ID NO: 39733 - DNA, 333 bp, Glycine max
  Peptide Sequence Number=SeqID_156511
atggcgagtaacactatggttccattccaagtttcaaggctcaacaagagtaactatgacaattggagcatcaagatgaagagacatcttaggtcagttactttctacgcctcttcttcctctcaatttcgttttcccttctcatcctcctcaaaccttctcttttcccacataccaccaaacatgtctctgcaaaagggcgatcttggactcattcaccgttggatcatcgtgaaatttgaacaccagattcagaactcatttcctaacattctcaccgttgggaattatgaaaaagtgtcggagctaagaaaaataccctttgcatcttaa

SEQ ID NO: 39734 - DNA, 2183 bp, Glycine max
  Peptide Sequence Number=SeqID_156512
atggacccaattacctctgttgctgcccaaagtgccctagaaattgcaaaacaagtggtcaatcgacaagtgggttacatatttcattacaaagacaaattgaaagaggtggaacaatacattgagaggctgaatgatactaggaagagggttcaaaatgaagttaattctgcagagaagaacggagaagaaattgaagatgacgttcagcattggttaaaaaaggtggatgaaaagataaaaaaatatgagtgttttattaatgatgaacgccatgcacagacaaggtgttccattagattgatctttccaaataacttgtggttgaggtatcggttaggcagaaatgctacaaagatgatagaggaaatcaaagcagatggacattcaaataaaaggtttgataaagtttcatatcggttgggcccatccttcgatgctgctttgtcaaacaccggttatgtgagctttggttcgagaaatgaaattatgaagaagattatgaaagcactggaagactcgacagttaatattgttggagtttatggggctggtggtgtgggtaagactactttagtcaaagaagttgctaacaaagctcgagaaaagaagttgttcaatatggtggtcatggcaaatgtaacaagaattcctgacatacaaaaaattcaagaacaaattgctgagatgttgggaatgagattggaagaggaaagtgaaattgtaagagcagatcgcattcgaaagaggttaaagaaagaaaaggagaacacccttataatcctagatgatctctgggatggattgaacttgaatatattggggattccacgtagtgaggatgacaatgggagccaacaagatgccaatgatttatctgattttggttacaataatatggaaaaagaagtattttctgccgatttcaatatgatgaaaaaagacaagttatctgttgattccaatacgataaaaaaagaaaagttatcaggtgatcacaagggatgcaaaattcttctaacatctagaagtaaagaagtaatatgtaataaaatggatgtgcaggagagatcaactttctcggtaggagtccttgatgaaaacgaggcaaagactttgcttaagaaagaggctggaatacatgtccaaagttttgagtttgatgagaaagtcattgagattgccaaaatgtgtgatggattgcctatagcattagtttccataggaaggtcactaaagaataaaagctcctttgtatggcaggatgtctgtcaacaaattaaaagacaaagttttacagaagggcacgaatctatggacttctctgtaaagttgagttatgatcatctaaaaaatgagcagttgaaacatatttttttactgtgtgctagaatgggaaatgatgctttgattatgaacttggtgaagttctgtattgggttaggtttgcttcaaggggtccacacaattagagaagcgagaaacaaagtaaatatactgatagaggagctaaaagaatcaactttgttgggggaaagttactctcgtgaccgcttcaacatgcatgacattgtgcgggatgttgctctttcaatatcatccaaagaaaaacatgtattttttatgaataatggcatactagatgagtgtccacacaaagatgaacttgaaaggtacactgctatatgtttacacttttgtgatatcaatgatgggcttcccgagagtatacactgtcctagacttgaagtcttacatatagacaacatagatgattttttgaaaataccagacaacttttttaaggatatgattgaactcagagtcttgatattgactggtgttaatctttcatgcttaccttcttctattaaatgcctaaaaaaactgagaatgcttagtttggagagatgcactctaggagagaacttatcaatcattggagagttaaagaaattacgaattcttactctttcaggatctaacattgaaagtttgcctcttgaatttgggcaattggataagctgcaactttttgacataagcaattgctcaaaactaagagtaataccttccaatctcatatcaaggatgaacagtttggaagagttttacatgagagacagcttgattctgtgggaggctgaggagaatatccaaagtcaaaatgctagtctttctga

SEQ ID NO: 39735 - DNA, 809 bp, Glycine max
  Peptide Sequence Number=SeqID_156513
atgggctcaaaaatctaccctaaggttcatgagaaccctagggccttctttagtagctctagcccaagcctcttggagtcttctatccaatacccttgggggggagtgcaggttgatcaagaaaaggtgaaagccattcaaaagtggccaacccctaaaaatgtaactgagggacaagaacatgcatttgctccactcaaagaaaaattgactcgtgcacctattcttgcattgcctaattttgcaaaatcttttgaaatcgaatgtgatgcatctaatgtggggataaaggttgttttgattcaagatggacatcccattgcttattttagtgaaaaattaaatggggttgttcttagttattccacatatgataaggagttgtatgcattgcaatttccatatgtgatcaagtacaagaaaggtaagtcaaatgtggtagctgatgcaatctcaagaaggaaatccaagcttcaaccacgaggagatagtccttttcaagtattgtccaaaatcaatgataatgcttacaagatagatctacttggtgaacatggtgttagcaatacttttaatgtgtctgacttatgtccttttgatgtaggagatgaggatttcaattcgaggtcgaattcactcaaagaaggaggggatgatgagaatcaagcaaagaacaagggtattgaatcaatacaaagacttggtggaccaatgacaagggcgtgtgcaaagaaatcaaaggaagtcttgaaccaaatggtggcaactctcattgaagcatattcacatctagaaggattaaagcccaa

SEQ ID NO: 39736 - DNA, 282 bp, Glycine max
  Peptide Sequence Number=SeqID_156514
atgcgcctcttcttcgctcagcctggaggtgcaagcggtgcgcttagtcatcttcttccaggttcttctatgcgctcagccaatcatgctatgcccagtggatcatgcgctcagccagaggaggatggctcagcgaactgcaaaaatcaaacttcaccaaacttgcttattttacctgaaattgaaatggaaagaaaatcctatgatgatcatcttgtgcaattgaggtgtgttttttatggaagcttgcttgtggagcttctatggaggctggatctttga

SEQ ID NO: 39737 - DNA, 369 bp, Glycine max
  Peptide Sequence Number=SeqID_156515
ggtacatcctttgtggtacaagtagagggtacatctacttgggttgttgtaactgagaacaagagagggtacatctcttgtggatcagttcaagtgaagggtacatccacttggttgttcaaagagaacaagggacggtacatcccttgtggatctttgcttgtaaagggtgctgcaagagtgatggataaccaaggtattgttgcagaacacagtggatgcgagggatttgtgaacgagagtgagcgagaagatgagtcaagaataagttcaccaccacagaaagtcatggataagagcttgaaggtagcagaagatgaggggagggagaaggagagaaggagcatgaaattttatgcctcaaatgag

SEQ ID NO: 39738 - DNA, 315 bp, Glycine max
  Peptide Sequence Number=SeqID_156516
atggcatgcggtttgaagaaaatcttgccacagttcatatcagacaattctaagatgatccgaattcgaaaatggatatcagctaacataggatgtggaagcaatgacttccaagattattttgatgatgccaaagaatcaagagttaagcaagttccaaagaatcaggcttcaagaattaagtctcaaagaatcaagattcaagaacaattaagtttcaagattcaagattcaagaacaaacaagatcaagattcaagatttaagagaagttgatttcaagattcaagagaagaaatcgagaagcaacagttaa

SEQ ID NO: 39739 - DNA, 291 bp, Glycine max
  Peptide Sequence Number=SeqID_156517
atgccaggggcaggtttattgaagtttcaacaagcatttagtagcactaatggacgtataaaacttgttcattccatggaaggtattgtcaagggaagtcaacaggaaaaagcggttgattctcaaggttctgcaaaaaaactctctgatcatcccaatgcagtttcttaccttgttactcttataaagggtcctataagcgattcaactggggtatcaaaaaagattttgatggagctttctgagatagacaaggaaaatgttgcagttgttgcacagtttggctggtaa

SEQ ID NO: 39740 - DNA, 336 bp, Glycine max
  Peptide Sequence Number=SeqID_156518
atgcaaatgatagagtttggggcttcacaatctcagcttgttattattgacaagttgaaccatggaattagggagaaaaaactcgatcaggcttttgcaaatgacatgcttgaggaaatagcaagggcagttggggtaccgatcgagccttcagagataagcaaagcactagctagcattagacaggaaagggaagaagcagccactaggaaagaaagagccgaactttgcactagtactacatgtgagagatccaccattgaagcttggtttgatgatggaaacgagactgacccagaaacaaaaaaggttgttgaagatattgacttgagataa

SEQ ID NO: 39741 - DNA, 2187 bp, Glycine max
  Peptide Sequence Number=SeqID_156519
atgttggatagttacaagattttcattggtgaattcaacatgcttacagtgggagaattcaaaatccctgacatttatgaagaagcgaaatttttggcattgaacctaaaagaaggtattgacattcattctgaaacatgggttaaaatgttgttcaagagtgttgaatatttgctgctgggacaactcaatgatgttcatgatgttttttatgaattaaatgttgaaggatttccatatttgaaacatttatccattgtaaacaattttggtattcaatatattatcaactcagtggagcggtttcaccctttactggcttttcccaaattggagtccatgtgtctttacaaactggataatttggagaaattatgtgttaataatcagcttgaagaggcctctttttgcagattaaaaatcatcaagattaaaacatgtgatagattggaaaacattttcccatttttcatggtaagacttctcaccctgcttgaaacaattgaagtgtgtgactgtgattctctgaaggagatagtttctgttgaaagacaaacacatactatcaatgatgacaagattgagttcccgcaattacgacttttaacattgaaatctttaccagcatttgcttgtttatataccaatgacaagataccttgtagtgcacattcattggaagtccaagtgcaaaacagaaacaaagatattatcactgaagttgagcaaggtgccgccagttcttgcatatcactcttcaatgaaaaggtttcaattcccaaattagaatggttgaagttatcctcaatcaacatccagaagatatggagtgaccaatgtcagcattgttttcaaaatttgcttacattgaatgtgacagattgtggtgatttaaaatatttactgtcattctccatggctggaagtttgatgaatctacaaagcatttttgtaagtgcttgtgaaatgatggaggatatattttgtccagaacatgcagagaatattgatgtttttcctaagttgaagaaaatggagatcatctgcatggagaaacttaataccatttggcaaccccatattggttttcattcctttcacagtttggactctttgataataagagagtgccacaaacttgttacgatttttcctcgttatatggggcaaagatttcagagccttcaaagcttgataattacagattgcaagttagtggaaaacatatttgactttgaaaatattccacaaactggtgttaggaatgaaacaaacttgcaaaatgtatttctagaggcgttgccaaatttggtgcatatatggaagaatgacagcagtgaaatacttaaatataataatttgcaaagcataaggattaaagggtgtccgaatttaaagcatctctttccactttctgttgccactgacttagaaaaattggaaatccttgatgtgtacaactgcagggcaatgaaggagattgttgcttgggataacggttcaaatgaaaatcttatcacctttaagtttccgcggctaaacattgtatcattaaaattatcatttgagcttgtgagtttctatagaggaactcacactttagagtggccatcattgaataaattgtccatagtcgattgtttcaagctggaagggctcactaaagatatcacaaactcacaagggaagccaattgttttggctacagaaaaggtgatatacaacttggaatctatggaaatgagcttgaaggaagcagagtggttgcagaaatacattgttagtgttcacagaatgcacaaactacaaagacttgtcttgtatgaattgaagaatactgaaattctcttttggtttcttcatagacttcccaatttgaaaagcttaacattggggagttgtcacttgaaaagtatttgggctcctgcaagcctcatttcacgtgataaaataggtgttgttatgcaacttaaggagttggaattaaagagtttgttgtctttagaagagataggattcgagcatgacccacttcttcagaggatagagcgcttagtcatttatcgatgtataaaattgacaaatttagcatcatccatagtatcttacagttacataaaacatttggaagtgaggaattgtagatcgatgaggcatttaatggcatcttcaactgctaaaagcttg

SEQ ID NO: 39742 - DNA, 1431 bp, Glycine max
  Peptide Sequence Number=SeqID_156520
atggcttccaaccaagaagtaacagtgccttgcagatattgggtggacaatgaacgaaagcgtgtagttatggcggaagcaagtggacactttgtagatgttctctttagtttcctaacccttccattgggaactatcatccggcttgggaacacattggggcaaccaatagagattggttgcattaacaatctattcaagagtgtggaagctctgaacccagatgttttctggaacgacatctgcaagcgaatgctgctttctccgcgcaacccgttagaattctcttaccagagactaaaactgaaggtggatgatacgcagcccacaaagtatttcgtgtgtcacatctgttcaaagggcagtgatttctcgctgagtacttttgatgaggtaaagtgccactgtgggaacttgatgaaaagacaactagatatgctggtagagcctgctggtggcaatggtgtttttgttaaaggggatgccatgttcttgatctttgatgacttgacagtgctccgtagctctcccagtgtctcctttaaaccaccactccaacttggacacaaagaattcagaaaggtggaagaaaagtctctagatgttgacacaaataaggcatttagcatactaaagcaagcattaacctccaaatctgctctaagtgtcacattggaaaacggaaaatctgagccatcgtcctctttcttaccagatattggcccaagtcaacggaaagattacataaaaatcaaggtaatagtgagcaaatcacagaacaagattctgtttgtcgaagcagatggagattttgttgattttctagtcagtttccttacaatgccacttggatctattatgtaccttgtgaatggcaaattatcattgggaagcattgataagttgtacacaagtgtgaagaatcttgatccatcatggttcatagcgtcgtcaaacaaatccttactgaatccaaaggttgctcctcattttggttgtgggagcaatccactaaatgcttcagaagaagacactgccaagtattggtatggaactggcatagtgaaggataataggggacgtatcatctatgaaaagaatatgatttcaaagaacaaagatatgctaaaagatccaaaagatatcaaacttttggacccaagatcctctagagcaagaaaatctgatgtgggatttatgaagaggccatgtctttttgttgttagcgataatctggaagtgaaagcaatgacgacttcttcaagcattccatgtccatttatggagaatgaccggttgttggatgatttggaggaacatttggtgaaaatcaggaagtcacagactaaaatctatagcagtgacagggtgatgaagaagcttggtgtcgactatgaaggagtggatagggatgggttcggaattgggtaa

SEQ ID NO: 39743 - DNA, 4236 bp, Glycine max
  Peptide Sequence Number=SeqID_156521
gtttctttcgaatattcaaagcataagagacttgttgattatcctcagaccaagggttttcggcacggcaaacctgcttttccggagaacttctttggctgtttgaagaaattggaatttgatggagaaagtataagacagattgtaattccatctcatgtacttccttacttgaagaccttagaagaattgtatgtacataactccgatgcagcgcagataatatttgacaccgttgacactgaggcaaagaccaagggaatagtctttcgtttgaaaaagcttactctagaggacttgtcaagtttgaaatgtgtatggaacaaaaacccaccaggaactttaagctttcgcaatttgcaagaagtggtcgttctaaattgtagaagcttgtcaacactgttccctttctcccttgcccgaaatcttgggaaacttaagacccttgaaatacagaactgtgacaagttggtagaaattgttggaaaggaagatgtgacggaacatggaacaactgaaatgtttgaattcccttgtttgtggcagttgcttctttataagctgtcactgcttagttgcttttatcctggaaaacaccatctggaatgccccgtattaaaatgcttggatgtgtcctattgtcctaagttgaagctattcacatcagaatttggagatagtcccaaacaagcagttatagaggctccaattagccaactacaacaacaacctctgttctcgattgaaaagattgttcccaatctggagaatttgacactcaatgaggaagacattatgctgttgagcgatgcacatttgccacaagacttccttttcaaattaactgatcttgatctatcctttgagaatgatgacaataagaaagacactttgccttttgatttccttcagaaggtacccagcttagaacatcttcgagtggaaagttgctatggtctgaaggagatatttccctctcagaaactccaagttcatgaccgttcacttcccgcattgaaacaattaacactgtatgatcttggagagctggagtcgatagggttagagcacccatggggtaagccatactctcaaaaacttcaattattaatgctttggaggtgccctcagttagaaaaactagtgagctgtgcagtgtctttcatcaatctgaaagagttggaagtgacgaactgtgatatgatggaatatttattgaaatactcaactgccaaaagtttgttgcaacttgagaggctatctataagagaatgtgaatcaatgaaggaaatagtaaaaaaagaagaagaagatgcttctgatgagatcatatttggaagcctcagaagaataatgttggattcattaccaaggctagtaaggttttattcagggaatgccactttgcatttcacgtgtttgcaagtagcgacaattgctgaatgccacaatatgcaaacattctctgaaggaattattgatgcgccattatttgaggggattaaaacttcaacagatgatgctgatttaaccccccaccatgatctcaacacgacaatcgagaccttgtttcaccaacaggtattttttgaatattcaaagcatatgatccttctcgattaccttgagacaacgggtgttaggcacggcaaacctgcttttctgaagaatttcttgggcagtttaaagaaattagaatttgatggagcgattaaaagagagattgtaattccatctcatgtacttccttacttgaagaccttagaagaattgaatgtacatagctccgatgcagcgcaggtaatatttgacatagatgacactgatgccaacaccaagggaatggtccttccattgaaaaatcttactttaaaagacttgccaaatttgaaatgtgtatggaacaaaaacccccaaggtctcggctttcccaatttgcaacaagtgtttgttactaaatgtagaagcctggcaacattgttccctttgtcccttgccaaaaatcttgggaagcttcagacacttacagtactgaggtgtgacaagttggtagaaattgttggaaaggaagatgcaatggaacttggaagaacagaaatatttgaattcccttgtttgttggagttgtgtctttataagctgtcactgcttagttgcttttatcctggaaaacaccatctggaatgccccgtattaaaatgcttggatgtgtcctactgtcctatgttgaagctattcacatcagaatttcaaaatagtcacaaagaagcagttatagagcaacctcttttcatggttgaaaaggttgatcccaaactgaaggaattgacactcaatgaagaaaacattatcttgttgagggatgcacatttgccacaagacttcctttacaaattaaatattcttgatctgtcctttgatgattatgagaataagaaagatactttgccttttgatttccttcacaaggtacccagtgtagaatgtcttcgagtgcaaagatgctatggtctcaaggagatatttccctctcaaaagctccaagttcatcacggaatacttgcgcgattgaatcaattagagttaaacaaactaaaagagttggagtcgatagggttggagcacccatgggtaaagccatactctgcaaagcttgaaatattaaatattcgcaaatgctctcggttagaaaaagtagtgtcttgtgcagtatctttcattagtctcaaagagttgtatttgagtgactgtgaaaggatggagtatttattcacatcttcaacggccaaaagtttggtgcaacttaagatcctatatatagaaaaatgtgaatcaataaaagaaatagtaagaaaagaagatgaaagcgatgcttctgaagagatcatatttggacggctcacaaaattatggttggaatccttaggaaggctagtaaggttttattcaggggatgacaccttgcaattctcatgtttggaagaagccaccataactgaatgccccaatatgaatactttctctgaaggattcgtaaatgcgccaatgtttgaggggattaaaacttcaagggaggattctgatttaacattccaccatgatctcaactccacaatcaagaagttgtttcaccaacatatcgaggtaagcaactgccaatctgttaaggcaatatttgatatgaaaggtacaaaggcagatatgaagccaggttctcagttttctcttcctttgaagaaactgattctaaatcagttgccgaatctggagcatatctggaatccgaatcctgatgaaattctcagccttcaagaagtgtgcatttctaactgtcaaagcctcaaaagtttgtttccaacatcagtggccaatcatcttgctaagcttgatgtgagatcttgtgcaacattggaagaaatttttgtagaaaatgaagcagccttgaagggagaaactaaactgttcaatttccattgtctgacctcattaacattatgggaattaccagagctgaagtatttctacaatggaaaacactcactagaatggccaatgctaacacaactagatgtatatcattgtgacaagttgaaattgtttacaactgagcatcatagtggtgaagttgcagatatagagtacccacttcgtacttcaattgatcagcaagccgttttctcagttgaaaaggtcatgcctagcttggagcatcaagcaatcgcttgcaaagacaatatgattgggcaaggacaatttgttgcaaatgctgcacacctcctgcaaaatttaagagttctcaaattgatgtgttaccatgaggatgatgagtcaaatatattctccagtggattggaagagatatccagcattgaaaatcttgaagtgttctgtagttccttcaatgaaatattctcctctcagatacctagcaccaattgtaccaaagtcctttcaaagctgaaaaaattacatttgaagagtctccaacagctgaattccataggattagaacactcatgggtggaacccttacttaaaacactagaaacattggaagtgttttcttgccctagcatcaaaaacttggtgccgtcaaccgtgtcttttgcaaatcttacctctttgaatgttgaagaatgccatggattggtatatttgttcacatcctcaacagccaaaagtctaggtcaactgaagcatattccatacgggattgccaagcaatacaagaaatag

SEQ ID NO: 39744 - DNA, 189 bp, Glycine max
  Peptide Sequence Number=SeqID_156522
atgtggtatcatgtcagtgaaaaacctcgtcggtgcctaagagtacattacaagacaaaccacacactagtaagtcagatcactctcactaggcttaaaggaacactcaaactgggtgtatttacccttaaggcttacactctgaagggtttgtcaaggtctctccctcctgattcaggtccaacctag

SEQ ID NO: 39745 - DNA, 219 bp, Glycine max
  Peptide Sequence Number=SeqID_156523
atgaatgataaacactccctcacaacaatagtccctctcgaaagaaccgaaaatgtgaaacgggcaaagcaaaagaacaaacaggtcaaactacttctgatcaacaagggtttcagcgaaagtcatagattcagcgacaatcgtagcttcaggcgatgtggttgcagtgatgtagtttgcggcagtcggtgctcaggcggaagcagaaaggagaaatga

SEQ ID NO: 39746 - DNA, 728 bp, Glycine max
  Peptide Sequence Number=SeqID_156524
gcacttcacaccttccttgcttggccgacacatctggtcaagtctttatcacagcaggtagttgtgtctccgccaaaaccacctccgaagcccgatccggaggtcgatgatccgctttatctgatgacattgaccatcccagagcttttcttgaggccttatcaagttagatgggatgccaccgttttcggggtcgttaatccagatttccccctgtacataaagcacgaagacctctccaaaatcgcacacgggggtcaatgtctcaacatatcagtgttacagctgtggattctgcatctcactgaaacatgtatgcgagcggggaattctgatatctatggattcctcgagcctcagtccattcagaggtctgggcaattgcagtttgaatctgaaagttacataaagagttggatgcagagttcacaacgcgatgtgtatcttggagcctacctaaatgggccagacaactaccttaaggggattattaatagtgctatcaagggtcttgatgatgctccacagcctaaatcaaaggctcctgctaggtggattgtcgtcaagtgtaatagacaaaaaggaactactgagtgcggctactatgtgatgcactggatgtccaccatcattttaggaacttttagaaatagatggaaagcgtattttaacgatcctagaccattggagcctgagagattaaaagcattgcggatccagtgggcaca

SEQ ID NO: 39747 - DNA, 4833 bp, Glycine max
  Peptide Sequence Number=SeqID_156525
atggacccaattacttctgccactgcccaaagtgcactgcaaattgcagaacatgtggtcaaacgacaattgggttacatatttaattacaaagacaaatttaaagaggtggaacaatacattgagaggatggatgataataggaagagggttcaaaataaagttgatgatgcagagaagaacggagaagaaattgaagatgatgttcaacattggttaaaacaggttgatgagaagataaaaaaatatgagtgttttatcaatgatgaacgccatgcacagacaaggtgttccattagagtgatctttccaaataacttgtggttgaggtatcggttaggcagaaatgctacaaagatggtagaggaaatcaaagcggatggacattcaaataaagagtttgataaagtttcatatcggttgggcccatccttcgatgctgctttgttaaacactggttatgtgagctttgggtcgagaaatgaaactatggagaagattatgaaagcgctggaagactcgacagttaatattgttggagtttatggggctggtggtgtgggtaagactactttagtcaaagaagttgctgacaaagctcgagaaaagaagttgttcaatatggtggtcatggcaaatgtaacaagaattcctgacatagaacgaattcaaggacaaattgctgagatgttgggaatgagattggaagaggaaagtgaaattgtaagagcagatcgcattcgaaagaggttaatgaaagaaaaggagaacacccttataatcctagatgatctctgggatggattgaacttgaatatactggggattccacgtagtgaggatgacgatgggagccaacaagatgtcaatgatttatctgattttggttacaataagatggaaaaagaagtgttttctgccgatttcaatacaatgaaaaaagacaagttagctgtcgatttcagtatgacgaaaaaaggcaagttatctgttgattccaatatgataaaaaaagaaaagttatcaggtgatcacaagggatgcaaaattcttctaacatccagaagtaaagaagtaatatgtaataaaatggatgtgcaggagagatcaactttctcggtaggagtccttgatgaaaacgaggcaaagactttgcttaagaaattggcgggaatacgtgcccaaagttcagagtttgatgagaaagtcattgaaattgccaaaatgtgcgatggattgcctatggcattagtttccataggaagggcactaaagaataaaagctcctttgtatggcaggatgtctgtcaacaaattaaaagacaaagttttacagaagggcacgaatctatggagttcactgtaaagttgagctatgatcatctaaaaaatgagcagctgaaacatatttttttactgtgtgctagaatgggaaatgatgctttgattatgaacttagtgatgctctgtattgggttgggtttgcttcaaggggtccacacaattagagaagcgagaaacaaagtaaatatactgatagaggagttaaaagaatcaactttgttgggggaaagttactctcgtgaccgcttcaacatgcatgacattgtgcgggatgttgctctttcaatatcatccaaagaaaaacatgtattttttatgaaaaatggcatactagatgagtggcctcacaaagatgaacttgaaaggtacactgctatatgtttacacttttgtgatatcaatgatgggcttcccgagagtatacactgtcctagacttgaagtcttacatattgacagtaaagatgattttttgaaaataccagatgacttttttaaagatatgattgaactcagagtcttgatattgactggtgttaatctttcatgcttaccttcttctattaaatgcctaaaaaaactgagaatgcttagtttggagagatgcactctaggagagaacttatcaattgttggagagttaaagaaattacgaattcttactctttcaggatctaacattgaaagtttgcctcttgaatttgggcaattggataagctgcaactttttgacttaagcaattgctcaaaactaagagtaataccttccaatatcatatcaaagatgaacagtttggaagagttttacttgagagacagtttgattctgtgggaggctgaggagaatatccaaagtcaaaatgctagtctttctgagttgaggcacttgaatcagttgcaaaatctagacgtacacattcagagtgtttcccattttccgcagaacttgtttttggacatgctggatagttacaagattgtcattggtgaattcaacatgcttacagagggagaattcaaaatccctgacatgtatgacaaagcgaaattcttggcattgaacctaaaagaagatattgacattcattctgaaacatgggttaaaatgttgttcaagagtgttgaatatttgctgctaggagaactcaatgatgtttatgatgttttatatgaattaaatgttgaaggatttccatatttgaaacatttatccattgtgaacaacttttgtattcaatatattattaactcagtggagcggtttcaccctttactggcttttccgaaattggagtccatgtgtctttacaaactggataatttggagaaaatatgtggcaataatcatcttgaagaggcctccttttgcagattaaaagtcatcaagattaaaacatgtgataaattggaatacattttcccatttttcatggtcggacttctcaccatgcttgaaacgattgaagtgtgtgactgtgattctctgaaggagatagtttctattgaaagacaaacgcatactatcaatgatgacaagattgagttccctaaattacgagttttaacattgaaatctttaccagcatttgcttgtttatataccaacgacaagatgccttgtagtgcacaatcattggaagtccaagtgcaaaacagaaacaaagatattatcactgaagttgagcaaggtgccactagttcttgcatatcactcttcaatgaaaaggtttcaattcccaaattagaatggttggagttatcctcaatcaacatccagaagatatggagtgaccaatctcagcattgttttcaaaatttgcttacattgaatgtgacagattgtggtgatttaaaatatttactgtcattctccatggctggaagtttgatgaatctacaaagcctttttgtaagtgcatgtgaaatgatggaggatatattttgtccagaacatgcagagaatattgatgtttttcctaagttgaagaaaatggagatcatctgcatggagaaacttaataccatttggcaaccccatattggtcttcattcgtttcacagtttggactctttgataataggagagtgccacaaacttgttacgatttttcctagttatatggggcaaagatttcagagccttcaaagcttgacaattacaaattgccagttagtggaaaacatatttgactttgaaaatattccacaaactggtgttaggaatgaaacaaacttgcaaaatgtatttctgaaggccttgccaaatttggtgcacatatggaaggaggacagcagtgaaatacttaaatataataatctgaaaagcataagcattaatgagagtccaaatttaaaacatctctttccactttctgttgccactgacttagaaaaactagaaatccttgatgtatacaattgcagggcaatgaaggagattgttgcttggggcaatggttcaaatgaaaatgctatcacgtttaagtttcctcagctaaacactgtatcattacaaaattcagttgaacttgtgagtttctacagaggaactcacgctttagagtggccatcgttgaagaaattgtccatactcaattgtttcaagctggaagggctcactaaagacatcacaaactcacaagggaagccaattgtgtcggctacagaaaaggtgatatacaacttagaatctatggaaatcagcttgaaggaagcagagtggttgcagaaatacattgttagtgttcacagaatgcacaaactacaaagacttgtcttgaatggattggagaatactgaaattcccttttggtttcttcatagacttcccaatttgaaaagcttaacattggggagttgtcaattgaaaagtatttgggctcctgcaagcctcatttcacgtgataaaataggtgttgttatgcaacttaaggagttggaattaaagagtttgttgtctttagaagagataggattggagcatgacccacttcttcagaggatagagcgcttagtcattagtcgatgtatgaaattgacaaatttagcatcatccatagcatcttacaattacataacacatttggaagtgagaaattgtagatcgctgaggaatttaatgacatcctcaactgctaaaagcttggttcaactcacaaccatgaaggtattcttatgtgaaatgattgtggaaatcgttgcagaaaatggagaggaaaaagtacaagagattgagtttagacaattaaaatctttagaattggtgtctctaaaaaatctcacaagttttagcagttccgagaagtgtgacttcaaattcccattactggaaagtttagtagtgagtgaatgccctcaaatgaaaaaattctctaaagtccaaagtgctccaaaccttaaaaaagtacatgttgtagctggagaaaaagacaaatggtattgggaaggtgatttgaatgacactctacaaaagcatttcacacatcagtaa

SEQ ID NO: 39748 - DNA, 231 bp, Glycine max
  Peptide Sequence Number=SeqID_156526
atgacctctttgcacaagcttggaaagatcatgaagggaagagaagggcaactgcctccagaccccaagagccctatgacacgaccagattcattttcgagggcgcctgggagagatatgagtagaacgttcactcctggaacatccttatggagaggaacgctaatctttttgtcacaaagtacaagttccaccaagagctcaagaggcgaagataacataaagccttga

SEQ ID NO: 39749 - DNA, 573 bp, Glycine max
  Peptide Sequence Number=SeqID_156527
atgaccggtagattgttggccggatcattgacctttgataatcgcatcatgcactatattattgttagaattttgcttcctaggtcttcaaatttggctcaagcctctgaggaggacttgattttgatgtgggctttccttaccggtcgtcagatcgactgggctcacttggttcggtaccgaatgcataaggcattacgggccaatgcacctcttccatatcctcaattggtcaccctctttctccgtcattttcaaattcctcttgatgatgaaccttttgttcaagtcaagcgttcctttgctatatgtgttggtgctgtcacttcatttggttaccgtaaggatcgtaatagtcaatggctgaagaaagatgcacttcctccacaagatgagcgtactccttctcctcctcctcagcgagatgattcagcccttatgactgaagttctttcagagttacggggtcttcacacttatgttggaatggatatccgtctcacacagcttgaagaagatgtgggttatattcgtcagagcttcgatcttccaccaccaccaccatcttcttag

SEQ ID NO: 39750 - DNA, 387 bp, Glycine max
  Peptide Sequence Number=SeqID_156528
atgcataggaggatcaaaaggtcttttaaggttgtaatggggccaagaacaagacttgaacagaagtttctttctgatgatcatcagggtgctggtgcatttgaagttgctgctagacaatatctgatgaacgaagttaagcccaaatgtgcacaagttggtcttgaggcttttgctgatgcacttcttgtggtgcctaagacacttgttgaaaactctgggcttgacactcaagatgtgattattgcccttacgtataaacctgtaaatgccacaattgttgttgatcttgacagaactgatattttacatgagagaagttcaggcagtgggtatgcccaggctttgacaaaaaatgcagggcttggctggaaacaaagccagtga

SEQ ID NO: 39751 - DNA, 420 bp, Glycine max
  Peptide Sequence Number=SeqID_156529
atgggtaagaagaaacaaaatgactcacaacaatcctccaaaactgacaccgtttcaacctcttccaatattttcagcaagctcttcaacaaaagccaaaacagactaccgcaatggccgccacctctctattttctgatgacaaccccttttgaagaaaacctactccactttctgactcaacgaattgcacttagaaccctaatgatggaaaagaagcagaagaggaataaggacaaaaccccagccccaaccatcgataccgttgtttccataattgaagcttcagaggaacaaaagaagaagatgaaatgtgcagaagcgattgggaagaggaaaagaaaaagggacaaagttgagaaagattgggaacaagaatgttttccgaaattggaatctgttttggaagatgaaggttga

SEQ ID NO: 39752 - DNA, 183 bp, Glycine max
  Peptide Sequence Number=SeqID_156530
atgaaacattatgcaagtggatgttctactctctctctcgtcgaagacacttttcgtgaaggtatagtggataagtatgaccatgatgtcccacccatctcactagacattgccaacttcatatccattggcattgtcactctgagttggattgtcattgaagaacctcatcgactctggtga

SEQ ID NO: 39753 - DNA, 309 bp, Glycine max
  Peptide Sequence Number=SeqID_156531
atggaaggatatcaaaataacaactactttcactcaattgagatggagaaggaaaaaaaattgttgagaggtctcaatatagaaggaaggtgggaggagaatcctatggtggagattgggatttggagaaaaatgggtgaggtggatgaagtatgtttgaagtctagttctacctcgattttggtaaatggtagtccaacatcagagtttatagcatgtagagggttaagacaaggtgaccctcttgcaccatttttatttaatgttgtggttcaaggactatgtggaatgatgagacaagctatttaa

SEQ ID NO: 39754 - DNA, 633 bp, Glycine max
  Peptide Sequence Number=SeqID_156532
atgagaagatggagaggaaaaaatatgggagagggggaaaattatgggagtgcattacatggtaatgaagatgtagtagaaagcaacatgttacttttggagggcttctatgcatttgggatactcaaagcttctctttatcttcttcacttagtggagaaggattcattggcttcgaaggcacttggaaagaaaagggccagtagagtaagggggtgggaagcattagaaaataaaatagcttcaagtggtaccaatgtttgggccttgatgggagactttaattgtgttagaaggtcaagtgaaaaggaaggagtagaggggtatgaggttgtaaagggagagaaagatgagtttaatgcctttattaattgtatggagctagaagatatgcctcataatgggtggaagttcatatggtataggcctaacgacacaacaagaagtaggattgatagagttttggtgtctaaggagtggttggacttatggcaaggaagatctatatatgctcttgatagagatatatccgaccattgtcctcttttggttcaagatgtatccttgattggggacccaaatgatttagggtcattgattgttggaggaggaatggagggttatggagattga

SEQ ID NO: 39755 - DNA, 465 bp, Glycine max
  Peptide Sequence Number=SeqID_156533
atgtcttcacatcctggtatgcacatccacaaagtcttcaaagacacagaagcacctcctagccttctgctccccacgtttgtcagatacgagatcatcataggcatggaccacacatgtaacaacgcaaggaaaatgaatgaattagggttacctttggtaacacttgcaatgacctcaacctatttagggttacctctggcacatttctccacatcggaatgttcctcaaatgattctgagggtggaggtgccatccatcgtaactcaggggcaatgaaggtatcaatggctggttccaaaaagtatccagaaggtaaaaatgaaagagacataatggataaagttttttgctctgcatctcaaccaatgggtgatggagagaaaaggggcaccttggaagaagggtcagaaaagggaatccagtacaatgaaggtcaatatttttcaaaagcaaagggctag

SEQ ID NO: 39756 - DNA, 189 bp, Glycine max
  Peptide Sequence Number=SeqID_156534
atggtggtggtggaggaagaagagcttggtccaagagagttatcatttactactgctaatcggccttgttgtggaagttgtttgattatagcaactccaggaattaatgaagcattgagcttaatccggattttggttgtggacttaaagagggcaaataaagcaacgtttaccttagttaatttttag

SEQ ID NO: 39757 - DNA, 198 bp, Glycine max
  Peptide Sequence Number=SeqID_156535
atggattgcaaatccttaagcattaaggcggtgaggcatagttcaggacaacctctaagacataacaaaacacctaatggtgattccaacaacaattctgcacttgtaactgtgaggctattctctctgaagatacgtctcacatcagataaaagtcaaactttgtcagtggtgcagagttctagctttaaaacttga

SEQ ID NO: 39758 - DNA, 372 bp, Glycine max
  Peptide Sequence Number=SeqID_156536
atggcaatcttcagtggttgcgaggtaacgagggcagggaagacaacgtcacgagaagaaagagttttcaatgagcgcggggagaaaagcaaggtttgggttttgttgaaaaccgatgttaaccttgcgatgttaaatcaatatattttagtagtggagatcataattatcataatgtttacacataaagcaaagctcattcagaatggtttggaagcgtctaaacatggtttaggtatcttctccctcttccatactgaaggttcatacttacgtgttagaagactcaacttgttatgttttatctcagaggacccttcattggtaatggctaaggtgtccttcatttgtttaccgcttttgaagctatga

SEQ ID NO: 39759 - DNA, 357 bp, Glycine max
  Peptide Sequence Number=SeqID_156537
atgggtacgtatttcttaatcccggcggggatcgggggcggggtcaaggatcggttacaaagtcgagggtgggaaatgcaatacccgtccctgtttcaccccgttgtcatgcctaaaggtggtgggcaagataaagtgtcaagtgatgaattgaagttgaaggatccacgatgtcggatacaatgtcctgacatcctgctcgagaatactggaattgctgtacaatgcaagataaaaattttcaggaagaagatagatctcctccagcatcaagaacttgcagcccagaatcgtacacggctatataatcatggaggctgcacgagttctgtaccaagtccgggattgaagagttag

SEQ ID NO: 39760 - DNA, 393 bp, Glycine max
  Peptide Sequence Number=SeqID_156538
atgtccacaaaagagaagaaaagcttttgtcaatgtttgtggagtgtaaaagtcccacaaggatacacttcaaatatcaagagccttgtatctgtcaatgatctgaaattggttggcttgaagtctcatgattgtcatgtgttaatgcaacaactattgccaattgtgattcgtgatatcttgcctgacaaagctaccattgtcctttgtcaattggagatgtattttcctccatcattttttgacataatggttcatcatgtgagggaaattcggttgtgtggtcccattttttatggtgggatgtatccagttgagcggtatattgacacaattaaaactattcggggattcctgatactcgtttatgactggacaatgggggaagtaaag

SEQ ID NO: 39761 - DNA, 392 bp, Glycine max
  Peptide Sequence Number=SeqID_156539
atgaggactttcagcaaactcatttacaaaaagatattggtcgatttattgatgatagatctaggcagacacataccctgctgaagaacatagacttaggagttggtgttgggattcagctgcggggccaaagcgtaagggatgcctttattgttagagtttgtggtcttagttcctttgtcccacatcgcttggtctgtaaaacttgtgtggtcttagtcccacatcgcttgtttaaaggaattagtgggagtcttcttagtttagtggaggcagtgggagcaatggcattagaagaggggaaggtgaagatcgagaagttcgatggcagagatttcagcttttggaagatgcagatagaggattatctatatcagaagaagctgtattag

SEQ ID NO: 39762 - DNA, 662 bp, Glycine max
  Peptide Sequence Number=SeqID_156540
tccggccttatctgcggctccggattggccgaggcgaaaactatgggattgggagccatgccggccaccatctccggcgaaactatccccccgcgggaaaggccgatgagtacgtccgcccctcgcaaagcctccgccaggggttactcgtcctgccgggcaccaggatcccctcccggtcgcagaccagcaggtggcgcacccccagcctgtgcaacaaccaggtaaccgctattcccgccgcccccgcccctatcaccacgacttttatctcttctgggcgccgcccggtgagcttcagggcgtttaataaagcggcccccaccacgatggctgtgccgtgctggtcgtcgtggaagaccgggatgtcaagctcttccttcagcctctcttcgatgaagaagcagtccggggcggctatgtcctccaggttgataccgccaaaagcaggggctaagagctttaccgcctgcaccacctcggccgggtcactggtggccaggcagatgggaaaggcatcaacacccgccagggtcttgaaaaggaccgcctttccctccataaccggcagggcggcctctggtcctatattccccaaacctaaaacggccgtgccgttggtcaccaccgccaccagattccccttggcggtgtactcgtag

SEQ ID NO: 39763 - DNA, 198 bp, Glycine max
  Peptide Sequence Number=SeqID_156541
atggatatgaataatgaggcattgaatatgagtaaagatggtggattatcgaattctgctatcctcacatcaatgcagaacataaggtggcagataggggtgggtaaacgggcccaagtccatggactgccccgcttaacccgtggactatgcgggtttggcccgcggggtccacgggttgcccgcagcccgtattag

SEQ ID NO: 39764 - DNA, 516 bp, Glycine max
  Peptide Sequence Number=SeqID_156542
atggcccgcacgaagaagacaggggagatgacgactgaggccgcaaaggaaatcgctgagaagattgattcatttgaggagcaggccacacagggatcgttcgtcccccatggacgtcaggatgttctggccgctgctattggacgtccagagcaccatggacgtgtccgtgctgctggagccggtgtcaccatcaagcaatactttggatcggctccacggacgtcccgcaacgcttcctccctgcaacctgacgaattacagcagctgacccagcagatcaaggaccagctagaggagtccatcacagagaaagtgacgagggaggtcatggcatccttcaaccaccttcagtcgcagatgcaatctcagggagttgcagtgcctcctgagcctgtggttggtcctggtctctccggtcctcgagtgagcacaaaggggagttgtgttgatccctcaggaaacgatcctaagatcggtgactctgacagtaaaggtgagtgtggaggaggttag

SEQ ID NO: 39765 - DNA, 339 bp, Glycine max
  Peptide Sequence Number=SeqID_156543
atgcaaatagatattttctttgttgttgctcctaacctacaggtggttgtcatcatcaaaaagggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagccttgccttaaaacaaagtgctttcaagacatgcaaggctctggtaatcaattaccaggaagtgtaatcgattaccaaaagacagggttgagaaatagctattga

SEQ ID NO: 39766 - DNA, 317 bp, Glycine max
  Peptide Sequence Number=SeqID_156544
gaaacataaaggcagaggatgttgagtcctatgaaaacataaagacaaaggacgttgagtcctatggaaacataaagacagaggacgttgagtcctatgaaaaacataaagaaagaggatgcaaggactttgagtcctatggaaacataaaggcgaggacgttgagtcctatgaaagataaaggtgaggactttgagtcctatggaatcataaaggcaaggacgttgagtcctatgaaagataaaggcgaggactttgagtcctatggaaacataaaggcaaggactttgagtcctatgaaagatgtgggcctctag

SEQ ID NO: 39767 - DNA, 276 bp, Glycine max
  Peptide Sequence Number=SeqID_156545
atgtctgaaccctacactggggcaatgacaccaccttgcataagcttcaagcaaactagggggcaaataagaagttctcacccggaaccactgtcgaactggcagaaagagcaatgcaaacaacacatgcatgaggtttaccaagctataggttgggcaataatgatgttaagaaaaaaaaagcagaaagcaaatccaccaaaggcgagcaaagcaaaaagagacaaaagatctccaaattttacaaggaaggcacaaaagtgcaataaggattaa

SEQ ID NO: 39768 - DNA, 411 bp, Glycine max
  Peptide Sequence Number=SeqID_156546
atgaaagatgacaatattattttttctcgagcaactgaggaagcaatgaagatttccactatcctgaaatcctatgaagcttatggtcaaaagatcaaccagcagaagactgaactctcatgcagtcgaaatgtgcctaccaccaaaatcaatgcgcttgagatgcttcttggagtaaaggcagaaagggagacattgataaaatctgtggtacaagctattcccacatatgtgatgagttgttttgagcttcctatgggcttatgccaagatatcgagtgcatgattgcttgcttcttttgggtaggtggtttgaaatccaagaagatacattggatgagctggggcaaaatgataaggaaacgagtcttggctttagagttggacgactctttcacaggacaatgctag

SEQ ID NO: 39769 - DNA, 414 bp, Glycine max
  Peptide Sequence Number=SeqID_156547
atgactcccaaagaactagagcagttgactcaacaaatcagggaccaactggaggagtcaatcatagaaaaaggacttgcactacctctggagcctgaggttggtccctcagctgctcgtgtcaacacaaaggagagttgtgttgatccctcaaggaacgatccagacacgggtaactcaaacaaatgcgggttgtacatcgaagaaaatcctccctgcctggttgccctaggaagagtttatgagggatccaaaaccattcacgacatcccattgttgcatgatcaagtgaaagtcggtgttgaagaggttaaagatgcacatgctcccgttcttgtacccactgacgagctgtgggaccagcaaaacctgcagataggccagatcatgaggtcgatgatcccctatatctga

SEQ ID NO: 39770 - DNA, 228 bp, Glycine max
  Peptide Sequence Number=SeqID_156548
atgtatggtacaaggatctatagaaatgtagaagccacggacaatacctgtggacctggccatggtatcagatttttggaaggagttattagaatcaagacatggcagggaggttcaggaagtgctagcaacatccagtttcagaacattgaaatggacaatgtgaccaaccccatcataattaatcagaattactgtgaccacaaaaagaggccatgcaaaacacag

SEQ ID NO: 39771 - DNA, 219 bp, Glycine max
  Peptide Sequence Number=SeqID_156549
atgaggtacacgatgaattcggttataacagtgttgtatttcaatggaagggtatatgaagataatgatggtgtaatatttgaaggcagtaaaaaagcgattcagattaaacgtggaattagtttcaatgctttgaagaaaaaaattggagacaaggaaaatatattgccatgcaaatttgcgatgaagaagacgttgaaacgatgctggaaagtttaa

SEQ ID NO: 39772 - DNA, 165 bp, Glycine max
  Peptide Sequence Number=SeqID_156550
atgccgagtacattgaggcgtctgtgggctcagtgtagctcaccaagagagcggaccagatacaacgtgcatcgagtatacccaatggaggttacagaggatcgaggtaaccattcaaatatgtcatccgaggagatggaggagtaccgggaactattgaggtag

SEQ ID NO: 39773 - DNA, 238 bp, Glycine max
  Peptide Sequence Number=SeqID_156551
atggcagtcctagtcaccatcctaagtggtaggggtcaaaccgccattgccaatggcgagttcgctgtgcaacgcccatgtggcagtgaaaccgccattcgtgttggcgagttgatgcaggtggaactcgtcacctctgttggcgagtctggtcatggtttcgtaaaccgccagtttgactggcagttttgctttgcaggaggtgttgcaggagatgcaggcttcctttgcagtgcag

SEQ ID NO: 39774 - DNA, 291 bp, Glycine max
  Peptide Sequence Number=SeqID_156552
atggggagtgaaatgcaaccctttgtagagacaccaccaaaagtggtggaaccaaaccgttattcacataggtcaattgagacactggtggtggtcatagcagtgataacaatagctggtgtcattacaggaatgattgctagattgagtggtggaaggcactttgggggaaatggaagttgcattgatggagggctcccacctccacctccacctccacctcctccacctgaagaaccaaagccagcaccagcaccagaaggagatgcaagtcattcattgcttctttaa

SEQ ID NO: 39775 - DNA, 1207 bp, Glycine max
  Peptide Sequence Number=SeqID_156553
gtttgacaagcgtagttcgcttaaaaagcttagtgtcaatgattatggagctaaggggaatggtgatgctgatgacacagaggctttcaagaaggcttgggatgtagtatgttcttctggggaagcaattcttgtggtgcctcaggctaattatctgctcaaaccaatcagattctctggcccttgcgaacctaacgttgaagtccagatttctggaacccttgaagcatcagatgatccatcagattacgaggatgacagaagacactggcttgtatttgacaatgttaagaaactatttgtttatggtggtggaaccattgatggaaacggcaagatatggtggaaaaactcatgcaaaaggaacaaaaagcgcccttgcaaggatgccccaacggctctgactttctataattgcgaggacttgacagttgagaacttgagcatagaaaatgctcaacaaatccatgtttcattccaggactccgtgaatattaaggtttctggccttaccgtgaccgcaccagaggatagccccaacactgatgggattcatgtcaccaatacgcaaaacatccaaatctcaagctctgttataggaactggtgatgattgcatatctattgtacatggatccaaagatgtagaagccacagatattacctgtggaccaggtcatggtatcagtattggaagcttagggtccggaaaatccaaggaatttgtttcaggaatacgagtgaatagagccaagatttttggaactaaaaatggagttagaatcaagacatggcagggaggttcaggaagtgctagcgacatccagtttcagaacattggaatggacaatgtgaccaaccccataataattaatcagaattattgtgacaaaaaaaagaagccatgcaaaaaaatgctctcgaagaaatccgcgatccaaatcaagaacgtgttgtaccagaacataaggggcacaagtgcttctgatatagctgtgaagtttgattgcagcgataaatttccatgcgaggagatagtgttgcagaacatagacctcgaatgtgaagaaggagatgatgccgaggctatgtgtaacaatgttgaattgtcttacttaggaaacgttaggcctcgttgcaactcaaaaaagagaaaggcatttactactattacctccatatggaaatacttctcatggtatatatga

SEQ ID NO: 39776 - DNA, 297 bp, Glycine max
  Peptide Sequence Number=SeqID_156554
atgctccttcatcacttgttgatcacagcgataccaaatctgcaaccgctacgctgcgttaaaaccctcgtcactaacacgctcgttgaaagtctcaccaccgcggttgagcgagttgctggtgaaccaaatcttggctggcgaggttcgttctcagatcctgctctcgaaccactgccaaggggtgcttcttcgcttgcttcagagcgcccgcggctcctcagccaccactgtatgctgccttcttctcgttccggcaaacacaaaccaaataagcaaaggttgaacggtcattga

SEQ ID NO: 39777 - DNA, 171 bp, Glycine max
  Peptide Sequence Number=SeqID_156555
atgagtaaggtttctggtgttatttcccgccaagttttgcctgcttgtggctctctttgtttcttctgcccttccctcagggcaaggtcaagacaacctgtcaagaggtataagaagctcattgctgtcattttccctcgtaacaagcattattttattcacaatgtgtga

SEQ ID NO: 39778 - DNA, 879 bp, Glycine max
  Peptide Sequence Number=SeqID_156556
atggggactccggaattccctgatctcggcaagcattgctctgtttcttattgcaagcagcttgatttcttgcccttcacatgcgatcgctgtaatcagatatattgtttggagcaccgaggttatattaaacataaatgcacaaaggccaacaaacatgatgtcacagttgccatatgccctctttgtgccaaaggagttcgcctcattccagatcaagacccaaacataacatgggacaaccatgttaacgttgattgtgacccatcaaactacgagaaaatcacaaagaagagaaaatgccctgcccctggatgcaaagaggtcttagtattctccaacacaatcaagtgccgggactgcttgaaagaccattgcttgaagcaccggtttggccctgaccacaaatgttccggtcccaaaaagttggagacaagtttttcattcatgagtcttttgaataggagtagaaaagaggagccaaagcccaatttaacttcaacagcaccatctaagtggagttcaagctttctcaaagtggcttccaacattcgcgcctcagctcaagtgagcatgtcgaaattgggcgatgaaattaaccaagtttggcaggcagctactacaagagacggggtggggcaaagcagtggcagtggaaatagaaatgatcatcaagtggagcaatgccctcagtgtggatcaaagttttcctctgtgactgctttggtggatcatgtgcaaaaggttcatgaaagaaatggaaaccgattaggggttaagaagattgatgcatgtcctaagtgtagtaggggatttcttgatcctgtgtcccttgtggagcatgttgagagggatcatggaggtggttctagagcatag

SEQ ID NO: 39779 - DNA, 633 bp, Glycine max
  Peptide Sequence Number=SeqID_156557
atggaaacttgggaaacttctggataccaaattgagttcaattcccaggaaaatggaaaagtcaaatcaaataagaaacaaaaattgtgcaaacctcaaaaaaggaagatgaataagttagaggatgacaaggagaagcaacttctgctggaaaaagccattaagacattgaagtatgatgagactatgaaggaaaagcgtagaagggttgttcatctattaaaagaaggattggaggtttcatatgatgggaatggtaaaacaactcaagttcctcagtttctttatgaagttggttatggttcaagtaagggtattattggtgttactcaaccacgccgggtggtagttcttgccacagctaagcgtgtggcatatgagcttggtcttcatctagggaaggagcattattctgtcttaatacttgatgaggctcacgagaggaggttgaacacaaacattctgatcgggatgctttcacgtgtaattaaaactcgccaaatgtgccaccttgcaagtacaagacttgacttctggaaagttattccatactcctccacctgtgatagaagttcctacaaggcaatttccagtaacaacctgaaggcagcagagttttcacaagcactttga

SEQ ID NO: 39780 - DNA, 1467 bp, Glycine max
  Peptide Sequence Number=SeqID_156558
atgcctaaggttcggtttatgggtgaacaatctcacatatcagtcgaatttgataatattgtttctgctgtcttggaaaactatgaagttcctaagaaaaattcagcaaacctggatcatgaggaacaagatgtgatggccaatgagggtcaaatctctcctttgctggatgtcaaaaggagaaacccttcctggagaaaagttgttaacgataaaggcgaaataaatgtagcaatggaagatgacatgaatccctctttttggtctggagtttgcctacataatatggccaatttagccaaggaggggactaccatacgtcgtgtaatggaatctttattccggtactttgataatggaaacttatggtctataaaccatggccttgccttttctgttttaaaggatatgctatttttgatggatgactctgagaaaaacacacatgttttgctgtcgacgttaattaagcatctggatcataaaattgtccttaaagaacctcaaatgcagcttgacattgttgaggttgccacttcacttgccccatatgcaaaagtccaaccttctgtatcaatagttggtgcagtaagtgacatgatgagacatttgcggaagtgcatacactgttccctggatgactcaaatctggcccctgatgtaatcaattggaacaagaatttcaaaaaagttgtggataggtgccttgtacagttgtcaaataaggttggagaagcagatcccattcttgatgttatggccgtgatgctagagaacatctcaactatcacaacaatatctagaaccacagtctatgctgttcatcggaccgctcaaattgtagcctccttaccaaatgcattccctgagaccttgtttcatcaactactcctggctatggtccatccagatcacgaaacacgagtggtatctcaccacatcttttccagtattcttgtgccaacatctgttttccctcatccaagcttgtctgcttctgaccccaaggcatcaaatgttccacgaactctctctcgagctgtctctgttttctcttcttcagctgtcttatttgagaagctaagactggagaaacgttcttcaagtgaaaaattaattcaacacaacaaaggcaatatttctggagagattgaaccagttagtagcaatgttgggattgtaaacagattaaagtcaacctatggtcggttgcctagtgtgaataaccctcctctacaattggaactggatgaaattgctgcaaacaaagataatcggaactcgcttttcacttgtatacaggaggctgctgctctcaggctgactaagcttcagataaatcgattgctctcgtcaatttgggcacagtctttatctcctggaaatatgcctgcaaattatgaagcaattgcctattcatacactttggtgttgcttgtttctagagaaaaggtggaactttcttaa

SEQ ID NO: 39781 - DNA, 987 bp, Glycine max
  Peptide Sequence Number=SeqID_156559
atgaggccaggaaagaacaaacttactttgttgttggaatggccattgccaccatctcgtcggagatcactctttacgctggcaacgtcaatgattgtgttttcttcaaaagaatacaacattgaccatcttgtccagagtgccaaggcagtgcttacggagaaggttgatccctaccttcagttaattgaagatcacaagttgcaagctgtcagctttgctcctgataatctaagcatcaactatggatctaaagaagacgatgatagggccttagacatgctttcagatttattgacttatatacacaaaacacgggacctctttgcttctgaaatcattaagagcttggaaatgtttgcaaaagcggaattatcatcaataaaggaacaactgctagaagaattcgcaccagatgctatgtgtgaacttggatctcaattgaccatgaacatggctgcaaaggatgcttcaatagtttcaaatattgatgacgacttcatttttgaaccatttgaaagtcaaattaaacatagtcggagtttctccacagaggtccctggtcttctgactgctaatcaacttttagaattagctttggacacatctcatccagctgggaggatttctgtatcaaatgcatttaatatgccatacaaggatatggctgataagtgtgaggtacttctgctggaaaagcaaaagatgtccagattgatgagtacccaacagaagcaagaatgttcagtggactccctttcaccaaatcatggcaatgaattgaaaaatatggattcctcttcgcatgtggattttcaaaaggtggggaatcctcccttcgacgagaatgctgcttttgatttccacggaccaacttttagccctcttccaatggtgtctggaactgaatatcagaatcagcctcaccctttcaaacttccagcagcaagcccctatgataactttatgaaagctgctggttgttga

SEQ ID NO: 39782 - DNA, 216 bp, Glycine max
  Peptide Sequence Number=SeqID_156560
atggagtatgatcctgatcggaaccaggataatttatataggtggtgcatgcttttcgccattaccttcaatctttgtttgcttttacaattgctagacaaaacatacataaataatcaatggatcgcatggaatgctatccaaatttttggaaaaatcacaccagtcaaaattgttgatgctaatgtgctccatttaagtgcatctattacctaa

SEQ ID NO: 39783 - DNA, 411 bp, Glycine max
  Peptide Sequence Number=SeqID_156561
atggttcttcctcacttcaaacattctagattcaaagatgaccaacattgcagtcaccgtatagctgaagtgctagatccaaatggtaaaatttcaccagctcaaatttccaatatgttaaaaaggttaggactagcagttgcacctaggagaaagatgtgtgatgctgatgttgaaggacctttgtctactagccctaatcagttagatggtgacaaaataacaggagctaccaatcataaatccgtgaatttggagggaagcctgttggttcagcacctattcaaggaccacagaagatgtagttacatgatagccaatgcattggataaggatgcttggtttgtctcttcctctgaagagttctggaggaaaaatgcacccaaaggttttgcaaagccatgccattaa

SEQ ID NO: 39784 - DNA, 2667 bp, Glycine max
  Peptide Sequence Number=SeqID_156562
atggaatttctatgcttgttgttgtatatactggtagcttggtgtctttcaagttctgaacttgttggtgctgagcttcaggaccaagatatattacatgccatcaaccaagagctgagagtccctggatggggtgatggcaacaactcagattactgcaattggcaaggtgtcagctgtggtaacaactcaatggtggagggcttggatctgtctcaccggaatcttcgaggtaacgtaactctaatgtctgagctcaaagctttgaagcggctcgatctttcgaataataactttgatggatcgattcctactgcttttggaaatttatctgatcttgaagttctagatttgacttcaaataagttccaaggttcaattccacctcagttgggtggtctcacaaacctcaaatcattgaacctttccaataatgtgcttgtgggagagataccaatggaacttcagggcttagagaaactgcaggattttcaaatctctagtaatcatttgagtggtcttataccttcttgggtgggaaatttaaccaatttgaggcttttcactgcttatgagaaccgtttagatggcaggattccagatgatctaggcttgatttctgaccttcaaatacttaacctgcactctaaccagcttgaaggcccaataccagcaagcatttttgttccagggaagctagaagttctggttctcacccagaataattttagtggtgcacttcctaaagaaattgggaattgcaaagccctttccagcattcgaattggaaacaaccatctagtaggtaccattccaaagaccattggaaatcttagtagcctaacctactttgaagccgataataataatctttctggtgaggttgtgtctgaatttgctcagtgttctaatctgacactcctgaatttggcttcaaatgggtttactggaacaattccacaagactttggacaacttatgaaccttcaggaattaattctttctggaaatagcctattcggtgatattccaacatcgattctgagttgcaaaagtcttaacaagcttgatattagcaacaacagattcaatgggacaataccaaatgaaatctgcaatatctcccggttgcagtacatgctgttggatcagaatttcattactggagagatccctcatgaaattggaaattgtgcaaaacttcttgaattacaattgggcagtaatattttgactggaggtattcctcctgagattggtcgcattaggaacttgcagatagctttaaatttgagcttcaatcatctccatggaccactgccccctgaattaggaaaactggacaaacttgtttctctggatgtttcaaacaatcggctatcaggtaacatcccacctgagcttaaaggaatgttgagcttgatagaggtgaacttctcaaataatctgttcggaggtcctgtgccaacatttgtaccatttcagaagagtcccagttcaagttatttgggcaataaagggctttgtggagagcctttgaactcttcatgtggagacctttatgatgatcacaaggcttaccatcacagggtttcttacagaatcatactggctgtaattggttctggtttggctgtttttatgtcagtaactatagttgtcttgctgtttatgatcagagagaggcaggaaaaagtagccaaagatgctgggattgttgaagatggcaccaatgacaacccaactataattgcagggacgatttttgttgataatctaaaacaagcagtagatcttgatgtcgtcgttaaagcaactctgaaagacagcaacaagctcagcagtggaactttcagcactgtttacaaggcaatcatgccttccggggtggtcttatctgttaggagactgaagtctgtagacaagacaataatccaccaccagaacaagatgattagagaacttgaaagactaagcaaagtttgtcatgaaaatctagtgcgtcccattggctatgtcatttatgaagatgttgctcttctcttgcatcattattttccaaatggaacattggctcagcttcttcatgaatctaccaggaaacctgaataccagcctgactggccctctagattatccattgccattggtgtggccgaagggttggctttccttcatcatgtggcaatcatccatcttgatatctcttcaggcaatgttctcttggatgcaaattccaagccagtggttgcggagattgagatttcaaaacttctagatccaaccaaaggcactgcaagtattagtgcagttgctggttcttttggttacataccaccagaatatgcatatactatgcaagtcactgcaccaggaaatgtttatagctatggtgttgttctgttggaaatccttacaactagactaccagttgatgaggactttggtgaaggtgtagatttggtgaaatgggttcacagtgctccggtaagaggggaaactccagagcagatattggatgctaagcttagcacagtttcctttggttggaggaaagaaatgcttgccgctttgaaggtcgcgttgctgtgcactgacaacacaccagccaaacgaccaaaaatgaagaatgtcgtggaaatgcttcgagagataaaagaaaattga

SEQ ID NO: 39785 - DNA, 315 bp, Glycine max
  Peptide Sequence Number=SeqID_156563
atgacgaccaaacgaatcagtcttgagggagttgaggcgagaaatgacctcatcaagtttggagtggaggaagctctagttagcagtgagggcactctggttttgggtgagaagagtgatagcctcttcaaggcgagtgagagtttgggaacgagtgttatcagccatagaagagaggcaatgaaagcaccaaagatgatagctacagtacctaaagccttaaggtctcctggggatccttttgagcttttcatcatctgttgggcccttggtgctatcagaatcctcattgaaactacaaatatgcaactctaa

SEQ ID NO: 39786 - DNA, 282 bp, Glycine max
  Peptide Sequence Number=SeqID_156564
atgggccgtgctggcccacgggccggaacccattttgacggctctacactttacgtgcatgaagaatttgttgaagcagatatgtatcagcaaccgatggtggcagtggcacctaatgaagcagacattgatcaacatcatcttcggcatgcagtggatgactttgcagcaattactgataggttggacaggctactaaacctgaggatcttgaccgaagtaacagaagcctatactgttgttgaaaaatgtgtgggcatcgcaagacgctacattggctag

SEQ ID NO: 39787 - DNA, 348 bp, Glycine max
  Peptide Sequence Number=SeqID_156565
atgatagccatgccaaagcaactagacaaagataaaagcagtataaggataagacaaaaacatgggaacagaaagctaaaacagtctatcactaccaccaaaaaaaattatctcaataaggatctcaagaagagttttgatgaagacaattacttgcaagtacaggagatcaaacttcaagctcgtaaattaactgttcttattacctcactacggcgggagtgggcacgacggcgtgggcttagagaggaagagcgacaacaaaggcacagtggaggcacaaaggtgtgggctcacaagacggcacaatggatacaaggtcgaaaacgtgagtgtgaagagggctag

SEQ ID NO: 39788 - DNA, 117 bp, Glycine max
  Peptide Sequence Number=SeqID_156566
atggagagattgagaggtgtgatcatggaggaggaggcaaggttgggtaatcttgcacaccccgaccttccacatcttccctttcatgattatcgagcaataaattcactcatttaa

SEQ ID NO: 39789 - DNA, 978 bp, Glycine max
  Peptide Sequence Number=SeqID_156567
atggacaccaagcttctaacaatccgcaccctcgtctcatccctcagttcctcctccgaccaaacccgcctggccgccctccgccacctacgccgcacctccgccgaagaccccgccgctcgccccctcatttccgccgcaggcgccgtccctctcctcgcctccgccctctactccccctcccaccccatccaggaccacgccgccgccaccctcctcaacctctccatctccgaccgtcgccccctcgccgcctcccacgccctcccggacgccctcgcccacctcctctcccgccacgccacctcctccgctgcctccgccgtccagtccgccgccgccaccctccacagcctcctcgccgtcgtctccgagttccgccccataatcacctctaaacccgacatcatccgggccctcgtcggtataatcagtcactctgattccccgacgaggtccataaaggatgccctcaaggcatgctttggagtagccctccacccgccgagccggattgtactaatccggctcggcgcggttcctgcgctcttcgctctcgtagccaagggcaaggacggaaataggagggctggcataatcgaggacgccactgctgtgatcgcgcaggtggcggcctgtgaggagagcgaggaggcgtttcggaaggtgtcgggggtttcggtgttaacgatgatgttgagttcggagagtgggagctgcagtttgaggacgaaggagaatgctgttgcggcgttgttgaatttggtgaggtgtgggagtgagagggtttttcgggaggttagagacaaagttgggggcttggatgggatcgcgtacgtgcaggaacacggtagccccaaagggaagagcaaagccgtggcgttttttaagcttttgcttgatggtggaagcagtggtgaagttgttcaagatttgtatcccgttgatccagaatcgggttcaagctgtagtgggtaa

SEQ ID NO: 39790 - DNA, 150 bp, Glycine max
  Peptide Sequence Number=SeqID_156568
atgaggaaaggaggttcaacaggtggtgtgggttgtggtagtcgaagttggcactgcagctacagaatagagacaaaaggttctaacagaattctaacaagaatgacactaccagccttagtggaatcttcaataacagaaaaggaataa

SEQ ID NO: 39791 - DNA, 738 bp, Glycine max
  Peptide Sequence Number=SeqID_156569
atgtctaggacatttttgtacatgagtggagttgctttcgtgttgatgaagcccaaaccacatcctcctgctaacattagactcattgagaagtggactttcgcaaacaagaaaaactgcaaaaatcatggacagactacaagcagcaaggagatcgttgttgtaagggaaagagctttagcgtcaagggccaacatggtgcaacacaaaccaaaacaaaaccaaaagaggtacgatcaaatatgtcctaatcacaataacaactacctatgtgttgctaatctaaccttcaagaaaaaaagaaatgcttttacctcctacactcttgtgggggatagagaagaacacgtttaccttggtgattccagcactactccagttctgggaaaaaggaaagttcttcttaagctcacatctaggaagactttggctttgaccaatgtgctacatgtgccctctattagagttaatcttgtttatgtaccactattaggaaaggttggaattaaggtgtcattcgaatctgacaagattgtaatgacaaagaataaagtctttgtggctaaagtagaaaaccaactaaacaaaaaggtaaaaagggttaaatccgatgaggatggtaagtacactttgttcaatgaattttgtgagaatgaaggtatcatacatgaagtaaccccaccttattcacccaaatcatatggagtagctgaaaggaaaaataaaacccctaagtaa

SEQ ID NO: 39792 - DNA, 228 bp, Glycine max
  Peptide Sequence Number=SeqID_156570
atgcatatatatgaagcattgacacctctcttaatctctctgtttgtgcgtgaatgtcgtgctcctgtgtcctatattttagacattagccaagtcgaggtgtccggtgttcgtagcacatgctgttttatgcgagtgaaaaatacccagttgaagatagctactccaacatttcttgaaaatggaggaacgtctcctgaattgcttgaggagcctcagcatgattga

SEQ ID NO: 39793 - DNA, 315 bp, Glycine max
  Peptide Sequence Number=SeqID_156571
atggcagtggggaaggaagacgtggagatcgtgaaggcgcgcatcgacaagagggattacagaagagtcgtgctccgcaattcgctccaagtgctcctcattagcgatcccgataccgataagtgtgctgcttcaatggacgttggcgtcggttacttcagcgaccctgctggcctcgaaggcctcgcccatttcctcggtattttttcaccttttctgactttgactctgctctgtcgcgtatcggtttcgatttgtgtgggattctggtcgttgtgttatgagtctgaagaggattccttgtttgaagattga

SEQ ID NO: 39794 - DNA, 416 bp, Glycine max
  Peptide Sequence Number=SeqID_156572
atgaaaagctactcccaagggaccccaagatgaagaaaagacatgagcaatctattgcatctactcttatgcgtctagtagctggaacatcactcccacaaaggctaaaagacttgagtgagactgatgaagaggacgacagatttgtacaagttcatctccaaaagagaaaggttgcagctatggctacccctgccccaaaaagagtcaataaagtccaaaaagctccagaaccaagagaacatatcattccttctgcaatacccagaggcatcaagacaagggctactaaagccaatcctaagattggtgagaaagaggccaccgatgtcaagatagttgttgataggatgtgtccacaactacctgcttgggatgctaccaaaaagaaaggattcaagttgtactacaactag

SEQ ID NO: 39795 - DNA, 294 bp, Glycine max
  Peptide Sequence Number=SeqID_156573
atgcttttagtttcatgcattttctctggccttccactctgcaagcatggaggaagcaccaatgcttttacatcttctgaacacaccaactatttttttgatgttaacacagatggctttgaagaggctctggacagattcgctcagttcttcaataaaccattgatgtctgccgatgccactatgagggaaattaaagctgttgactctgaaaaccagaagaatttattatctgatgcatggagaatgaaccagcacacggtagtggtttggagtggccacaggctgctataa

SEQ ID NO: 39796 - DNA, 812 bp, Glycine max
  Peptide Sequence Number=SeqID_156574
tcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggttcctggatgcgaacaaccagacggtggttgccaccacggatcccgcagcctccggagcccgctttttctaccgcacggatggggtcgagggcatcacttccctgcagggcggcacgattgctcccaaggccgtcgccaatgtccgatggctgatcattcccgcagccggcacgggcggccgcgatccccagggtgcggtctactacataggcgccaaggtcacctacacgctggatggcaagaccgacaccgtggaggttgcaccagagtccatcgtcgtgcggccccagcctgaactggtgcttgactacttcctgccccgtgatgttccgggtgacgatgccttcacacccgaggtcgagccttccgaccccttcacgctgggcgtgcgcatcaagaacagtggtggcggcacctcgtacaagaccaagatcgataccgcccagccccgcattgtcgaaaaccggcaagatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 39797 - DNA, 666 bp, Glycine max
  Peptide Sequence Number=SeqID_156575
atggagtattttgctacaaacttctttgatggtacatggggactgccatggctatattttggatgtgcagacagcaggaactgggacactttggaagttagaccaaaagcaaaaggattagatacaaggagcgagcttctcaaattctatgaagaaaactattctgctaatctaatgcatctagttatatacacaaatgaaagccttgataaaattcaaaaccttgtagaagaaaagttccaggatattagaaacatcaacaaaagttgtttccgtgctcgtgttcagccgtgcaaatcagagcatttgcaaattcttgtcaggactgtcccaataaagcaaggtcataaattgagaattgtatggccagtaacccctgaaattcatcattacactgaagggccatgcaggtatcttggtcatctaattggtcatgaaggagaagggtctttatattacatcttgaaaaaattgggatgggctacggccttgtatgcgggcgaatcagattggggtttggacttttctttctttaaagttgtaattgatcttactgatgttggtcacgagcacatacaagatatcattgggttgttgttcaaatacattgagcttctacaacagtctggtgtttgcaaatggatttttgaagaggtatggatctag

SEQ ID NO: 39798 - DNA, 513 bp, Glycine max
  Peptide Sequence Number=SeqID_156576
atgcactttaacaaaaggatattatgtgtagtgaatcaatatatctcaaaggaagatcgcaaagaaagctctagtgatgaagatgcagagaatttgaatttaatggtcaagaagttaggcaaattgctcaaaaggtctaaagatagaaaattctttaaaccttcaaagaaggaggaaaacaacaacaacaccttcacatgcttcaaatgcgggaagcaaggccacattaagtcagattgttctgtctacctcaaaaaacaactttgtgaaaagaaagggaagaaggatggaaaaccgaaaaaggcctacgtagcttgggatgacaatgtatcaacatcctccgattctactagtgaagaagaaattacaaatgtgtgcttaatggctgattcaaaggatgactcctcaaccattgaagaaactgagataaattctaaatttgaggaagttttggaagcctttatgaaatgcatgaggaagcacaaaagcttgttgtttcgaacaataagctga

SEQ ID NO: 39799 - DNA, 357 bp, Glycine max
  Peptide Sequence Number=SeqID_156577
atgggagcttttgatgaagatgtcaaagctatctatctgagagtttttccattctccttggcaagtaaggcaaagacatggctcaaatcacatccaaacaaaagcctcaacacttgggaagaggtggaggaaaaattcattgcaagattctttacttcgtccaaattcatcagtgcaaaatcagccatcgttgttttttcccaagggtctgatgaacctctctgtgaaacatgggagagattcaagtctttgttgtggaagtgcccaaaccatagttttgattttgttgcacaattccatattttctacagtggtttgaaacctcagacaaagatgattcttgatgcctcaacttaa

SEQ ID NO: 39800 - DNA, 261 bp, Glycine max
  Peptide Sequence Number=SeqID_156578
atggaaacgtctttgacgccagcaatcatgggtcagcgcacactccagattgtggctgatgttttgcaggtcctacaaggaaggctagcaataacagattttgcaaaatatcctaacagaaagatatattcccgacaggatattctaagtgcccaatcctatggtgccagcttagcagccctgctcctagtctattatgaatgctcctcaggtgagtgcttgtctccccttggtttggctggtctcatagcagattcataa

SEQ ID NO: 39801 - DNA, 729 bp, Glycine max
  Peptide Sequence Number=SeqID_156579
gttgggcgagatgactttaagctgaatgttaaacttcagctttttgcccttgttgcaaagcaaccaacctttcatcagctacgatcagttgagcagctggggtacattactgtgctcatgcagaggaatgattgtggcatacgtggactacagtttattatccaatccacagtaaagtctcctggtaacattgagcaaagggtcgaggcatttctccaaatgtttgagaccaaactccacgagatgacaattgatgaattcaaggggatttgtgagcactgcatgtggccaatccatatgcaggacaatggtgtaaacccaaactggttaaagaatcattactgtataagaggaagtcatcaaagtaatgtaaatgctttgatagatgtgaagctagagaaacacaaaaatttgagggaagagtcatcatttttctggcgagagattaatgatggtactttgaggtttgataggacagactatgaggttgaagcattaaggcagctcactcttcaagaattgatagatttcttcaatgaatatgtcaaagttggtgcacctcgaaagaaaactttaagtgtacgagtacatgggaaccgtcattcatctgaatacaaaacggaagcctcagaaccacacttggctaaaatagacaatatctttacttttagaagatcacaggctctttatggttcatttaaaggactttctgggcagatgaaattatag

SEQ ID NO: 39802 - DNA, 345 bp, Glycine max
  Peptide Sequence Number=SeqID_156580
atgctgctaaaggactcgctcaacgagccaaatttgttaagtgaggcttatccgctttgcgaggaagtcagctcgctaagcgagtacaaaaccctaatgttgagtcagagaacaacacgcttagctcgtaaccagcccgtccaacgaggattttgtctcttctcatgtttagcgcgtccatgcctgcttagcacccagccactaactctcactcagcgagacatgctcactaagtgcgccttcgtaagctcagaagctcaaaagtctttaaaaactgagagaggaggggaaatgaagcgtcaagcagcgtggaaaggaaggaacagtgcatcgtaccaaggctga

SEQ ID NO: 39803 - DNA, 897 bp, Glycine max
  Peptide Sequence Number=SeqID_156581
atgactagaggtagagaagtaatgtcaaacaccacacatgttggcttgtgtgctgaagctcaacaacaagcaccatttgatttcttctctgcaagaaacacaaatataataagtaacgacataagtgggagaaggccatacatacctccaaagggaagcaagaagtactttattggaatccttaacagacggaacacggtttacaagttttattgtcaacaaaggacaaaacagagacagacagaggccatttatggaatagagaactattcctcaactggctccaatatagcatcctcaattgatggctatcataatttgactccagagctttcacatcagatgtcatttttcatgtttaatcagaagggccacaaatatttgtcaaagggagagtctaggattggtagaggaaaacaaaagcttgatggaaacaagaatgcatgcattgagacaatgtctaaaccaaaacatgtgtatggaatcaaagttaaacaagttcaatggcttctgaggtgttctttgtgcaatgaggagtgttacctcattgcttctaatgattttgctatatggggttgcatattgttggtcttcctcatgctttggccaacaacgcagaaagttgcacaggagattggccagaataatggccaacgagggattctgcttcttgaattccaacaagcaaagattgccatggaggaattgaaagtggagttggagagaatggtgggttatgatgcacaatatgagatccaagcaaaagttgacaacttgaaacattgctttggattgttgagatgtggggttgagactataacaagacaacttgatgatttctttgatgaaattgtggaaggaaggaagatgttgttgaatatgtgtagtcataagtag

SEQ ID NO: 39804 - DNA, 264 bp, Glycine max
  Peptide Sequence Number=SeqID_156582
atgttggttgtgagaatagcaactctcctcagaaacagtaccggtactgaagaagaagaaatccctgtgtctgtttcaattgcatcgctttcttcgattccagcactgagaaccataacttgttgtttcagaaacactaggaattctggtgagtacgctgttgaggttacgggtgtctcgccaaaagccacggacaaggatgttcctgacttctttgctttctccggtgtcattgagaatgttgaaattatcagatgtaaataa

SEQ ID NO: 39805 - DNA, 408 bp, Glycine max
  Peptide Sequence Number=SeqID_156583
atgatttacatctccccctttctcaagcaaattcttcttgatatcatcaaaatcttcatgatttacattttattctcgtcgttcggcgacattcaagcccgacgacgcacgagattcttctttgctgggaggggacgatcaagttcgatagtgtcgcaacctaccctttggcgggagggcgatgcgagggctcacgggtgcgtcttccatgggaggaagatgcgcggagtcgccaccaacgtttattcgaggaaaacgtcgaaaaaaccagaaagacgtggtctacgaactttaagtgtgaaaggttcagaagttgtatttacgcacggggaaggaaatcaaacctacgtagttctttcaaaaggggcgaatcaagcgattcttgttacttggaaggtggtcatttaa

SEQ ID NO: 39806 - DNA, 114 bp, Glycine max
  Peptide Sequence Number=SeqID_156584
aataagaatgaaaaaaatgtcattgttaaaggtggtgctcgtgatgccatttgtgcgatcaaggtggttgcggcaacagcaggagaagacaacattgataggatagagaaaaag

SEQ ID NO: 39807 - DNA, 504 bp, Glycine max
  Peptide Sequence Number=SeqID_156585
atgtggatccgaggattcagtttttggatcaaaggttgctttttgctggccttggtatctataatttccggtctggaacccgaactaggatttacccgcgtcgtctttcagacaaagtatggagatattgaatttggtttctatccaaccgtggcatccaaaactgttgaccacatttttaagcttgtgcgacttggaggctataacacgaaccatttctttcgggtggataagggattcgtggcccaagtagcagatgttgcaaatgaaagatcgactccagtgaacgaggaacaaagaagggaagctgtaaagactgttgttggtgaatttagtgaagtcaaacatgttcggggtattctttccatgggaagatatgatgatccggacagtgcttcatcttcattttcaatactacttggagatgcccctcatcttgatggcaagaagccatgggcaaagctagagagacccatgggagaagagaaaagggaaggtgggtgg

SEQ ID NO: 39808 - DNA, 128 bp, Glycine max
  Peptide Sequence Number=SeqID_156586
atggcggcgaaatacaatcctaccttgctagggcacggatggaagattctaagaagaggggcaaaagatgcaaatgaaggccccaaggttcttgtgagccttaggggtgatttcccgcacagaacgag

SEQ ID NO: 39809 - DNA, 963 bp, Glycine max
  Peptide Sequence Number=SeqID_156587
cagaagctcctggctgagaagatcaagaagaagctagacgaagctgcacaatcaggaagcgttgatggcatcatcgaccctccatccccggtcagaggccacatgaagtggaagatggcccgcacgaagaaaacaggggagatgacgattgaggccacaaaggaaaccgttgcgaagatcgattcttttgaggatcaggcgacacagggatccttcgtcccccatggacgtcaggatgttcctgttgctactattggacgtccagagcaccctggacgtgtccgtgctgctggagccgcagctgacccagcaaatcagggaccagctagaggagtccatcacagagagagtgatgcggcagctcatggcatccttcagctagagcagtcccggattcagtcgcagatgcaatctcaaggacttgcactgcctcccgagcctctggttagtccttccgatcctcaagtgagcacaaaggggagttgtgttaatccctcaagaaacgatcctgagacagatcctgcccgcctggttgccctagggagagtttatgagggatccactgttgttcataacactcctttgtttcctggccaagtaaaggtgggtgtggaggaggttacagatgcagatgctccagttcctgtacccactgatgaggtttccttagtggggcaggcacttcacaccttccttgcttggccgacacatctggtcaagtctttatcacagcaggtagctgtctctccggcaaaaccacctccaaagcccgatccggaggtcgatgatccgctttatctgatgacattaaccatcccagagcttttcttgaggccttatcaggttacatgggatggcaccgtgttcggggtctttaatccagatttcccgctctacataaagcacgaagacctctccgaaatcgcacacggtggtcaatgtctcagcatatcagtgttatag

SEQ ID NO: 39810 - DNA, 1167 bp, Glycine max
  Peptide Sequence Number=SeqID_156588
atgaaaaagttaattttaggattagcagtaactgcaagttcattagcattcgctcagacaacttctacttcatcttctaacccggttacatttggtgttaaaggtggtatgaacgtttcatctctttcaaaaggagctgaccttagtgattcaaaatctaaaatcggattcaatgcaggggtttttgcaaacatcccggtagcgagctcattcagcattcaaccggaggtattgtataatgacttgggttcaaaagtaaccagagaatatacagtattaggtaataactttaaggatgaatcttcaagaaatttaggatacatagctgtaccggtaatgttccagtataatgcaactcctgaattcttcttggaagcaggtcctgaattcggatttttagtaagtgctaaagataaattcaaaagttctacgaatgataatacaagcacaagaacgagaagtcttgacaaagatgctttcaacacattcaactttggaatcggtattggtgcaggatattatttcacaccaaacctaggaattacagctagatatactgccggattaacagatatctacaaaaacaacaatggtgatgcgatgagaaacaacgtattccaggtaggtttggcaatcgttgctggttcattaacgtttgctcaaacatttggagtaaaagcaggtcttaatatttctacaatttcaggtggtgattcaaaatcaaaagcgggattctatggtggggttttaatgaatgtccctgtagctcctagctttagtgtacaacccgaaatcttatacaatggattaggcgcaaaagctgatggaaataatgatgttaaagtaaatttagattatatctctgttcctgtgatgttccagtataatgcaactccgcagttttatcttgaagcaggacctcagtttagtttcctgatcaattcaaaatttaaatacaattcctattctagagatggaaaggattttgtgaaaggttttgattttggtgtaggtcttggtgcaggatatttctttacgaagaatatcggtgtgaatgcaagatatgttgcgggtgttatagatattgctaaagaagttaataacgtacaggcagatggaaaaaataacgtattccagatcggtcttacttataaatttaataagtaa

SEQ ID NO: 39811 - DNA, 156 bp, Glycine max
  Peptide Sequence Number=SeqID_156589
atgcaatcagcatgtacaaacaatcaaaaaacttctttaagctgggttcgaaggttgaaaattgttgttgatgcaccaaaaggtgagtctcgtcaacaggaatacggaataaggggaataagagtttcaccaacagaaatggcggaacacttttaa

SEQ ID NO: 39812 - DNA, 447 bp, Glycine max
  Peptide Sequence Number=SeqID_156590
atgttgttatttggaagtgagagaaagcaattaggaagagggcaaatttccccatctggggtagttttacaaactatttctccagatggggctcttttcaaacattttccagcatggggcagttttggacgtgttttgcatacatgcagcacccaaaccgccagaaccactggcgagtttggtgtcggtgaggaaatcgccattcacactggcgatacgtgcatgcatggtgaaggaaccgccaacactactggtgatatcagtatccatgggaaccgccaagtaagggaagttgcaactgccattggcgagttaagggcaagttgcaactccaactggcgagttagggcagaaggaatagtcattccagatggcgatttagggcctttatatacgcgaaaattgtttcagtattgctgtgtgttcacaactattcttcatacgtga

SEQ ID NO: 39813 - DNA, 1833 bp, Glycine max
  Peptide Sequence Number=SeqID_156591
atggccactttccacgttgttgagaaagatccaacctccagatacgcgcggtacgatgaattgttggggaaaggagccttcaagactgtatacaaagcgtttgacgaagtagacggaatcgaagttgcgtggaacaggataggcgttgaggacgttgtgcagacgccgcagcagctgggaaaattgtactcggaggttcacctgctcaagtccttgaaacacgacaatgtcatcaagttgtataattcttgggtcgatgataccgccggcaccatcaacatgatcacagaattgtaccggaaaaagcataagaatgtggatatgaaagccatcaagaactgggcacggcagattcttcgcggcttgtgctttttgcacagtcaaagtcctcctattgttcatagggacctgaaatgcgataatatttttgtcaatggaaatagtggactggttaagattggagatcttggattggcaattgtcatgcagcagcctactgctcggagtgtcatcggtacaccggagttcatggccccagagctttatgaggaggaatacaatgaacttgttgacatatattcctttggcatgtgcatcttagaaatggttacctgtgagtacccgtacagtgaatgtaaaaatcctgcacagatatataagaaagttacctctggtataaagcctgccgcccttgctaaagtaaatgatcctgaagtgaagcaattcatagagaagtgtctagttccagcatctatgagattgtctgcatctgaacttctgaaagatccattccttgcaactgaaaacacaaaggagatcaatcatgatacgctgcagctgcctaatcctcacatcaaattggtgaatctaccaaaatgcgagcctcatcccatggagatagattcatactccaggcgtacttcacctggctcctccatgggaagaattgaagaaacttctcaagtttcattttttgatcttgtgaggatgactgacaataacaaattgatgctaagaggggagaaaaatgctgaaagtacaatttcacttacgctgagaattccagatgcttgtggtggagcaaggaatatccatttcccattctatatggattctgatacagcaatttccattgctgaggagatggtggaacatctggaactcacaaatgaggatgtatctgtcattgcagagctaataaacgacatgattgctaagcttgtccccaactcgaaacccttatgtgagaaactctcatccgaaacaaatctattgtacaggccttcttcggaagttcagaatggtgaacaattcaattgccactggccattacaatcaagtgattatgatatgaaggcaatgtataaggatctagttcattcacggcctgtggatggggatgatcaggagaaacaagaatctgttatgtcagatatatcagcagcgtgtgggattacaattgcctcagattctaaagttgtagagcccgatatttttatttttgatgagttctgggaggggttcttcaattccacttcagatatcaggttttgtgggcaagaggatggacacaagaatcaatcagagaactccgtaggctctttaatcaattcatgttgctgcccattcaaaaactttgacatgtcaagtatatgttctcttactctagctgacaaagatccttcagaagggctgcggttggatattgaagcaatagatacatactttgaccgacgctttcttgagcttgagatgatgaggcaggaagccataaaaagtgcaaagaggaggagacattacgaggaagaacatacctgttatgtgatgcattag

SEQ ID NO: 39814 - DNA, 2085 bp, Glycine max
  Peptide Sequence Number=SeqID_156592
atgggtgaactatatcactcacacgctccattagacattaattctagtgggagtgaggaaaacttgatctctcattcaccagaagaaattaagcttgaacccattagttttgatgaaaatgatgcttgtcctgtgccacggcctggaatggtatttagttcagaggctgaggcgagattttactacaccaaatatgcccaccaaatgggcttcggcatcatgactagaacctcaaagaagggacatgatggcaaagttaaatatttaatacttgtatgctctgaaataacaagaagtgatgcattaaggaaacaatattgtgcagctaggatcaatttgactttacgtaaagatggaacctaccgaattaatgcagctactcttggtcatagtcatgaattgggttcacatcatctactctcaagtgatattgagatgaggggtaaaaggacattggatcaagaagttattgacatgggtgttaacaggatatcatacaaaaatgaatgcagaaaccaccttcagaaagaaagacatttgattggggagaatggagatggtgaagcccttcagaagtatttggtgaggatgcaagaacaggatgggaacttcttctatgcaattgacttggatgatttcttccgtgtgaggaatgttttttgggcagatggaaggagtagagctgcatatgaatcgtttggtgatgtggtgacagttgatactacatgtctttctaatcgctacaaagtgccacttgtaacttttgttggagttaaccatcatgggcaatctgtactgtttggttgtgggctgttatcatgtgaagactcagagtcatttacttggctgtttcaatcattgttgcattgcatgtctggtgtgcccccacaaggaatcataacagatcattgctgcaaggcaatgcagaaggcagttgaaactgtatacccctccactcgacatcggtggtgcttatcaaatataatggaaaaacttccccaactaatccatggacatgctaattataagtccttaagaaatcgtttgaagaatgttgtatatgatgcacccacaacaagtgaatttgaggggaaatggaagaagattgtggaggattttgacctcaaggacaataaatggttgaaggagttgttcctcgagcgacattgctgggctccttcctttgtaagaggtgagttttgggctggaatgtctattaatccacacagtgaaagcatgcatgcattttttgatggatatgtaagccggcaaacaactctgaagcaatttgttgatcagtacgatcatgctttgcaatataaggctgagaaggagtatatagctgacatacattcatctaataacagtcaggcttgtgttaccaaatctccaattgagaggcagtttcaatctgcatacactcatgccaagtttctggaggttcaacacgagtttgttggaaaggcagattgtaatgtttctgttgcctctgatgatggttctgtttgttgctataatgtcattgaggatgtgataatagaggataaacctaaggaatccgtggttgaagtaatatataacagggtagattgtgatgtaaaatgcagttgtcgcttgtttgagttcagaggtatactttgtaggcactcacttgctgtactgtcacaagagagagtgaaggaggtcccctgtaaatatattttggataggtggaggaaaaatattcggaggaagtatgcttataccaaaactagctatggtgttcagcattttgaacctcatggacagaggcttgaactgttatgcaatcaattcaacagtattgctgctgttgctgcagaatttgaggatacaagttcttttgtgaaggataacctatgtaacttaaaggagaaacttgaaacatggacaaccttattgaggaagtcatctcaggtggatgtagagaaaagtgtcattgttgctgcgatagttaacattgttgcagctatttggcactctagaaacaaagccgggttcgacaataaactggtacaacattcaagagccatcgacatggttattgctaatgtcaacttagcctga

SEQ ID NO: 39815 - DNA, 1626 bp, Glycine max
  Peptide Sequence Number=SeqID_156593
atggaagcacgtgtgaacgcgttggaaggtgagatctcggtggtgcgatcttccttggtgagtttccaggaagaagtaaaggagaatcacgcgaatctgatcgcgatgttggagaaacatttcggaaaatcgctggatgatgaagggactggaagtgcagtaagcaagaacaaagagacaccagaaaagaagacggaaactccaaaggggtcaccagctgataagatgaatgaatttcatcaatcggcgaagaaggtggagttaccttcgttcgaaggagaagaccccgccggctggatttcgcgagctgaagtttacttccgagttcagaacaccacgccagaagtgaaggtgagcttggcccaactttgtatggacggacccaccatacatttcttcaactccctcatcggagaagatgaagatctgacttgggaatcgttgaaaatagggttactcgagagatacggtggtcatggcgacggagacgtgtacgaacagctcacagagttgaaacaggagggatcggtagaggactatatcacagaatttgagtatttaatcgctcagattccgcgattaccagagaagcaattccagggttacttcctccatggtttgcaatcggagattaggggaagggtttgcactttggcaacaatgggagaaatgagtagaacgaagctgttacaagtgactcgggcagtagagaaagaggtcaagggtggaaatggatctggatttgggcgtgggcctaaaaatgggccttatcggtccaattctcatggtggaaacaaaggagtatcagattgggtgatggtgaaaaataaggaagggggtgtaagtagcagtatgagaagtgggctaagaggtgacaaacaggcccaaggagataatagacatactgggcctcgtgataggggattcacacatctctcttacaatgagctgatggagaggaagagaaaaggcttgtgtttcaaatgtaaaaagccttttaatccaggccaccaatgttccgaaaaacatcttagggtgttaatagtggatgatgaatgtgaagaggatggagaggctaaggtcttggctgttgaagtagaaggaggggaggaagatgagcaaggagagatgagtatgttggatttacatcacatagctcatgagaaccatcaaaccatgaagtttcaagggataattaagggtgtagaagttctcattttagtggacagtggggcttcccataatttcatttcacaaaagctagttcaccacatggattggccaattgaacagacccaacaaatgaaagtcaagttagggaatggggttcaaatagaagcacaggggaggtgtaaggagctagagatgtatattggcagtcacaaattaaggccaaatcttcaactgtttgaattaggaggaattgatgtggtgttaggcatggaatggttgaaaactttgggagataccattattaattggaaacaacatacactgagtttttgggaagaaggaagatgggttactcttggcaataaggaggggtgcaaaaatcccatgatagcattacaaagtattgtgggtaagcccaggcccaagaaagaaggggaggtgtggacgaattga

SEQ ID NO: 39816 - DNA, 669 bp, Glycine max
  Peptide Sequence Number=SeqID_156594
atggacagagatgaggctttgagacagttaaaaactcaattgctgaaggcacaagagagaatgaagagccaggcagacaagaagagagttgatagaagttttatgtgtggagaatgggtatttgttaagctaagagctcacaggcagcagtctgtagttaccagaatcaatgccaaactagctgccaagtactatgggccttatccaatagttgagagggttgggggagtagcctacaaactaaaattacctgaagggtccagagtgcaccctgtattccatgtctccctattgaagaaggctgtgggtaattatcaagaggataaggaacttcccgatttgttagaagacccagttgaagcatgtgaacctgaggctgcacttgctagcaggaaaattaagcagcagggtgaagaagtgagacaatttttgatccattggaagggtaaaactatggaagaagctacttgggaggaagaattaatgatgagaagtcaattcccaaattttgaccttgaggacaaggtcaattctgaagaaggaagtattgatagggtccaagggaatgaaggatatccacatcagcaattgattcactcaacacagaatggagtcagaccttttctggtttatactaggaggaagggtagaaaggtctttggtggctaa

SEQ ID NO: 39817 - DNA, 723 bp, Glycine max
  Peptide Sequence Number=SeqID_156595
atggaggtggaagcagcagaagcagacttcccttcaccggaggagcctcatcgtcagcgccgctccatctgctccaactgcgaccgtcccagtcgcgtctgtctctgccacgcgcttccacttcctccaatccaaaccaccacccaaatcctcatcatccaacacccccacgaggcccgccacaagctctccaccacccccatcctcaccaagtccctcctccgcgcctcctccctcaccgcccgccgcctccgccgcggcctctcccccctcctcgaccgctctccccccgccctctacctcttcccctcctccgcctccgccctccacatctcctccctccgcccctcctctggcctcgtcctcatcgccttcgacgccacgtggcagcacgcgagggaaatggtgagcgccagcgaggagttcctttctaaattcgcaactagggtttgtttgggcatcgatgagagctccagcggcgggagcatttacgattccgagttggttttaaggaaggagccttctgccgggtgcgtgagtaccatggaggctgtggctagggcactgcgcgtgctcgagcccaatggggtcgagattgaagcgaggttggttggggttttgagggagatggtcaggttacaggctgggtttttgaagcccgtgaagcccaggcctaagttgttgaagaagaaggaaaagaatgagggttctgatcaaggttag

SEQ ID NO: 39818 - DNA, 171 bp, Glycine max
  Peptide Sequence Number=SeqID_156596
atgcaatggtggttccaaagtcagaaaagatgcaaagacaagttgaaactaacaagaaacaagcatagaaccatggttacctcgaaggaaaatgaaagggtttcaacggagaacaacgacggtttgtggtggctaatggtggttgtgggtgatggagaaagtgcttgggac

SEQ ID NO: 39819 - DNA, 255 bp, Glycine max
  Peptide Sequence Number=SeqID_156597
atgtgtcacaaaatttccaaatcatctaatactttacaaagtaaccatcattgttatagtacccatgatttctttcaagctgctcaccataattattgttggtaccaagaaatggtttatccaagtggtactagacacgaatcccttaagcatgtagtaaagggtttgaatcctgacgaatgcatatatggagaaaatcttgttgagagggagatcccacttatgagtgccaacaggtcccttggaggatattaa

SEQ ID NO: 39820 - DNA, 177 bp, Glycine max
  Peptide Sequence Number=SeqID_156598
atgagcatctacaggactcgcctcctcttgaaaattgtgcctatccccaggccatgcgacagtagctctaaactactcgggagtagaccacggggaaaactgccagggaaccacattataaacgaaacctcaaagagagttggacttcttcctcagaaggaaacaacaccagaataa

SEQ ID NO: 39821 - DNA, 264 bp, Glycine max
  Peptide Sequence Number=SeqID_156599
atgatatgtccattgcaatgccatgaagagatgcatgatgtaatcaaggaatatgtcatagtaatacattatggccatagggactatcagcaacaatgcatcactaaaagaggaaaactctatatgaggcttcaatgtcatcaagcgagtcagagacacagcatgaccacagatcaacctccaatccttatggctcacatagactcgggtatagggcctaacatctcaatgtgtgtgcgatgtgtaggtgtcatgtgtgtgtag

SEQ ID NO: 39822 - DNA, 593 bp, Glycine max
  Peptide Sequence Number=SeqID_156600
ttctgagaacatggcacaacctccactccgtgagatggtccagccctcagcaacaacaacagcagcctgctccttccttccaaaatgctgctggcccaagaagaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagttgccttctcaagctgtccaaaatcccaaaaatgtcagtgccatttcattgaggtcgggaaagcagtgtcaaggacctcaacccgtagcaccttcctcgtctgcaaatgaacctgccaaacttcactctactccagcaaaaggtgatgacaaaaatttacctaacaatttctgtgcagaagcagcacattccccctcttccattccctccaagagcagtttccaacaaaaaaatggaagaggcagagaaagagatcttggacacgtttag

SEQ ID NO: 39823 - DNA, 189 bp, Glycine max
  Peptide Sequence Number=SeqID_156601
atgacgaacaaggccaaaggaaaaggcaaggaggtcgccggaaaaggttctgccggcaagcgcaagggcgccttcgacgacgacaagaccggtggcggccgaaagagaaacaagatggacatgccagataagggccagagtagcaggccacgtgtcgtccctaaagaggaaatgttagcccgaaactaa

SEQ ID NO: 39824 - DNA, 1095 bp, Glycine max
  Peptide Sequence Number=SeqID_156602
atgacataccagaaactttttcaaatgatgttggatgtgcaaagcatcaaagacactttgtcaattgtgaaaggtgtgctatttgatgctgaggagaagaaggaccacaagcatgggttgcgcgaatggcgaaagcaagtggtcaaaatgaaggtaggccacttcttttcttcgtccaattctcttgttttccgtcttaggatggctcgtcaaatcaaacatgttagacgtagattggataagatagcagatgatgggaacaagtttggtcttgagaggattgatgttaaccgcacacttgtgcaaagaagagatttgacttattcttattttgatgcttcatgggtgataggaagggataatgataatgataaaattatcaagcttttgatgcaaccacacgctcatggtgatgtgggtattggaggcttggggaagaccacacttgcaaagttggtgtacaatgatcagaggatagatgaacttttccaactgaagatgtgggtgtgtgtctctgatgactttgacataaggcagataaatattaagatcatcaactctgattctgctactgctttagctctaactagtgctccttctcaccaagaaaatgttagcagcttaggtattgagcagttacaaagtcgtcttagatacaacctttctggaaagaagtatttactagtgttggatgatatatggaatgatgatcgtagaaaatggatagagttgaaagatttaataaaagttggtgccatgggaagcaaaatcatagcgacaactcgaagaaaatcaattgcttcaatgatgagtacttttccctcaggagcttctagtagtaaactccctacttgcaatatacccgagcaagtaaggcatttatcagttgttggaaatgcttcactgagccgtgctttgttccccaagtccagaagtgtgagaactatattatttccgatcgatggagagggtgctgacaatgaagatcttttgattacatcggtaacaagattcaaatgcctacggattttagatttaagtgattcctgttttgagactctacctcattcaattgctaaattggagcatttgtga

SEQ ID NO: 39825 - DNA, 330 bp, Glycine max
  Peptide Sequence Number=SeqID_156603
atgaataccagtaatcaactacaccgcaccacacgtggagccctaatcaagccattgatctccaagcccaaccacagtactcctatccatgcatatcgccaacaccatgggcgaaacccatgtgggtgcatttcgccagtgcatcaggcaaaacccatggccacgcaagcagtgtgtttcgccagtggtgatggcgaaacacacttggcacacgtgattttttctgctggcatgaacagtggggttacgttgatggaaatgacgatatcacgtaatttttttacaaaacagaccccctcaggaatatgtttaaaaagagaccccttttga

SEQ ID NO: 39826 - DNA, 156 bp, Glycine max
  Peptide Sequence Number=SeqID_156604
atgtatgccataatagcgaaggatcaccaaggtaattgggtggttgggttggctaagaagattggtgctgccacaactttcaaagctgagttgttgggtgtttatgagggtcttaagtttgctggaagaaatagtattagatgcttagagctataa

SEQ ID NO: 39827 - DNA, 375 bp, Glycine max
  Peptide Sequence Number=SeqID_156605
atgcaatccgccattactactggcggcaagcttgtatcgctactggcagcagcgggacgcaggcggtatcgccattggcatcagcgatacacttgtatcgccatcggtagcagcggaacaaaagctgagtcacgaagcatgtgtcgctattcaaactggcgagacatgctgactaagcatgtcgccattaggactggcgggacatgccaacgtgggcagtcccaccattggtttgcattgtttcagtctgaaaagatgggtaggcttgcagtaggggttgcagtgtgcaggaatcactctgaaaaaagatgggtaggttgcagtgtgcagataggtaggctttgcagttctgaaaagcttgcatgtgaacgttaa

SEQ ID NO: 39828 - DNA, 262 bp, Glycine max
  Peptide Sequence Number=SeqID_156606
atgacgtgtttgaagctgcgtctgactcggccgagtagcatcgggaaacccgagagcgagttctccgggtcaagttcggtggcgtcaaaactcagcaccgatccgtttggagatgaagcgatttgggtcgaaggaggatttggggtgttggcgccagcgcgtggagttgaggaaggtgaagggaagaggaaaacgacgtcggatgaggaagtgagggaagaacggtggaggaagcggaggaagagtcggaagtcttcgagtg

SEQ ID NO: 39829 - DNA, 252 bp, Glycine max
  Peptide Sequence Number=SeqID_156607
atgcctctagctgctccatgttcgaatcttcagcacatggttgggcttggttcaaatttgggtcgttttggggctcacttgcattgggcccatgtcacgccggcgattcatgcggcggtgagagtggcatgcgatggccgtgaaaggcgatgtcgttgttgtgggcgcgacggaggggaagaattgcacggtggtgaagacggaataacggaaaggttgatggggttttgcaactttggtgtcacctggtga

SEQ ID NO: 39830 - DNA, 804 bp, Glycine max
  Peptide Sequence Number=SeqID_156608
atgccctcgcctttagaggactacacatcctcgccttcagagggctgcatgtccttgcctttagaggactacacatcctcgccttcagagggccgcaccccctcgccttcagaggactacacgtcctcaccgtcagaggactacatgtcctcaccttcagaggactgctcatcctccccttcagaggactgctcctcctccccttcagaggactactcgtcctcgccttcagagggctacacagggctacacgccctcgccttcagaggactacacgttctcaccttcagagggcaacacaccctcgccttcagaggactatgcgtccttgcctacagagggctacacgtcctcaccttcagaggactacatgtcctcgcctttagtggactacatgtcctcgccttcagagggctacatgcccttgccttcagaggactacaagtcctagcctttagagggctacacactctcgccttcagagggctacacgccctcacattcagaggactacacgtcctcaccttcagaggactacacgtcctcaccttcagagagctacacgctgtcaccttcagaggactacacgtcctcgcattcagagagttgcatgccctcaccttcacaggactccacgtcctcaccttcagagggctacacgtcctcgccatcagaggaatgcatgccatcgccttcagaggactacacgtcctcgccttcaaaggactacacatccttaccttcagagggttgcacgccctcgccttcaaaggaatacacatcctcgccttaagaggactacat

SEQ ID NO: 39831 - DNA, 297 bp, Glycine max
  Peptide Sequence Number=SeqID_156609
atgcaagaaaatttgaagaaactgaaagaggtgaataggaatcttcgtaaggagattaggcagagaatgggagattgtatgaatgatctaggcttagaagatctcaagctccttgaggaagaaatggacaaggctgccaaggttgttcgtgagtgtaagaggatatgttatagctctatttgcacatatatttatattgagaaaattgttgagaaaccagatactgagtatgattctccgcttgggaagcagagttttgctttaacagattttattcagacagtgaaaaatgtttga

SEQ ID NO: 39832 - DNA, 300 bp, Glycine max
  Peptide Sequence Number=SeqID_156610
atggtcttgccatggtccacatggccgatggtgccgatgctcacgtggggcttcttgcgctcgaatttgctgcggacggtgaaagtgcggcgtgggatggtggtggaagaaggggtgcggtggaggaaggaggaggagagaggggttagtttgtgggtgttggtggtggaggagaggaagggtgtggagttaagggaagaggatgatgacgaagaagaagatgatgcacaggggaataatatgagtttggaggaagctgttgccgaagaaattgccatggctggtggagaatttggatag

SEQ ID NO: 39833 - DNA, 201 bp, Glycine max
  Peptide Sequence Number=SeqID_156611
atggcggcaccctctttctcgccattgcagatggcggaacacccatctcgccattgcaaatggcgggatcctctaacaaaacaaacccccagcgttaaaagtttgcaaatagacccagattggataattatccccatagcctttcaagtgcatccgccactggctgcatcggttgatatatcatggcaaaaacatagctaa

SEQ ID NO: 39834 - DNA, 819 bp, Glycine max
  Peptide Sequence Number=SeqID_156612
atggacatcctggcacttttgatcttcagggtggtcctctttccaaatgtggatgggttggtggaccgagcagcgattgatgcttttctcaccttttacgaccgcaaggaaagcccggatgtcgctatcttagccgatctatatgacacattcgaccgaagatgtgagaagaacaatgcaaggatcgtttgttgtacgccgactctctacgtatggttggtttcgcacttctttcgccaagagatgagacacgtttgcccgctagaaggccaccgctcatgcatcgagaaaaaagaggcaaattgggaccgactcttagcaagcaaagaagaagcgtctgtcaattggttcccccgatggaaggaaggaagaaccgggattcttatttcgtgtgggaaatttccaaatgttcccttgatggggacgaggggttgcatcaattacaattgtgtccttgctataagacaacttggttaccctatgagaggggcaccatcagaggaaggcctcataccttttattatacgaggtttcaatagcaccaacgcgggggtgtttcagagggtccacaaggcatgggaaatgttgcaaagaaaggacaaggaacttaggggaagtagcaatgggcccatcggcggttactgtaggtggttgaaagcctacgaacaagatctggattggctcccgagtttgaggaccactaaggggatggagattgaaactccaaaagaagacgaagaggtacaggccctcaagacagaacttgagaaaacccaagcagtcaaagaaaagttcaagtcaacagctgttaggttctga

SEQ ID NO: 39835 - DNA, 321 bp, Glycine max
  Peptide Sequence Number=SeqID_156613
tgagaatgttgagcttcaggtcaagcttttccaactacatgaaagtgcccaaccaggggtgtgttcaagacatcatcggagcttagccagaagagttgaacgaagtgcactcgcggcatggaaaatggtacgaatgacgaaggagagcagcggggctgctagggcgcgggagcgtatgtttctgaaacgaggtgacgaaagtggaagggctacaacgacaggtttttcatcaaacgtcgtcagtgtctttatcttaattacgattatgccaccgcctaacttacaaagacggtcctttagcaccgatgtagaatcagcgat

SEQ ID NO: 39836 - DNA, 699 bp, Glycine max
  Peptide Sequence Number=SeqID_156614
atggccagcaccgcaaatcactgtctccaactcgccggcgccaccgagtcaactcgtcgctggagaatctccatttcgtgcaagaagaagtcggacaagttagcattcaaggaaacgaaggaaggcttcgtggactacgacagaggccagcacgaggtctccacgaaaatatccggcctccgcaaggacgacatcgccgcccgatatcgcctccgcgtcgccggaaaccgcttccagatggactggacggtgtcggaggtcgccgaacttgtcctctccctcaacctctccgacgacgacgacgtcgacggcctgctcaaccgctgggttggccgcttcgcgcgcaagaatttccccttccttatcaaggagttgacgcagcgagggtccattgaacactgtaaccgcgtgttccggtggttgaagaaccagaagaactaccgtgcgcgcaatgatatatacaatatgatgattaggttgcacgccaggcacaatcgaacggaccaggcgcgtggattgttttttgagatgcaggaatggaggtgtaaacctgatgtcgagacttacaatgctattattaatgcgcatggtcgggctggacagtggcgttgggctatgaatatcatggatgacatgctgcgtgcagctttaagcatgtctggtgaagggagagggagaaagagagagcatattgtatga

SEQ ID NO: 39837 - DNA, 531 bp, Glycine max
  Peptide Sequence Number=SeqID_156615
atggaagttgttgcatcaagagcaacaaggttgcctatatattctttatttgacaaagaaggaaatcacagtgacctatttgctaaaggagaggcattttcaactctctttaatgttattggaattggagttggtagtcaattagcatctaccatctgtgcatcaacacagggaaagaacccgagccctacacttttcctcgcgctttgttcttctcttctgcttcttcatcgcttcttctttgcgatcgtgagtacaggttcttcagcttgtttgtacggcttagccacgttacctagtcgtggtagcttgaaggagttggtttgtcgtcattaccgtgggctgtttggggtgctgactttgcattccgtttggggtgctcactcgtgctcgcatggtgtcattttcagtgaggaagacaactatgggtttgtagggcttgtttttggtgttgtggggtttgtgttagggtttatagggttcatgtatgggtttgtgggtgtggtttgtcctattgagccaggtgcttga

SEQ ID NO: 39838 - DNA, 210 bp, Glycine max
  Peptide Sequence Number=SeqID_156616
atggagtggtggtttgagcgtctctcccttgactcatcgtgctttcaaggcttcgttgattccgacagccgttacctctctgtctcctggggcaggatccagtgggagaagcaggtccgcacctccgcaagatccaccgtcaaggcggcatgtccgtcgtcgtcatcagcgcagttggcttcgtcggctcccacgtctccgtcgcgttaa

SEQ ID NO: 39839 - DNA, 156 bp, Glycine max
  Peptide Sequence Number=SeqID_156617
atggctctgagggtcacggcatttaaaggtaggcaagatcagtgctcgaacttgtccctgtctagtgaagtgcctgaaaacggtgggaactctgctatgtctgagttgttctacagtgctcctaaatctgctcctatatctttccttgtaacttag

SEQ ID NO: 39840 - DNA, 693 bp, Glycine max
  Peptide Sequence Number=SeqID_156618
aataccccaatgaaagagaggaagagaagaagcatccatgacataactttagaagacattcatatgactgatacttcccatattgataaacataactgggttccacttcctacaaattttgcggtgcagccacatactccccacattgatcaacctaattgggttccaccaactccaaattttatagtgcagccacatactcccagtattcatcaacataattgggttccaccaactccaaattttatagcgcagtcacatactccccgtattgatcaacatacttgggttcctcctgctcctccaaattttgcggggcaaccacgtagtgctcatattgatcaacttaactgggtttcaccacctccaaattttgcaccacatactcctcttgttgatcaagataactgggttccaactcctccagattttgcagtgcagtcacatactccccatattgatcaacataatttggttccacctcctccaaattttgcagtgcagccacaccaaatgcaacgagcacaacatatgcagcagttcaacttacatgattcatctcctcaaatggatgaatatagaaattttaatagtttccatccccagaatgagttggatcttattgcacaacagatccttgaatataagaagaacaagttcaaccacaaaaacaatgagggatcaagtaggtag

SEQ ID NO: 39841 - DNA, 1842 bp, Glycine max
  Peptide Sequence Number=SeqID_156619
atggcggttcgcatgcaatacagtgggaccactaccgtagcaaccggttggagtgaacgaaaagaaacaaaggcaatacaaaaagggcaaacacgaatacacggttttcattctttcaccactcttgtttccttttacgacgtcgttatggaactcaagtttatgcagttttcgcaacacgttcttcctcattccccttcttcatctcaaaccctcgcttctgcactctcttccccttcatcgtccaaaacgcgaaccctagtgtgtcgtttcgtgaatcgctcgagcctctttccgaccaccacccgccttcttcggagaaccaaatcgtttgagcaccacgcgcttttcacgcgcagggggagtttgagaagggcttgcagcgctagcttggagcctttctccgacgaagagttcgcgaagaagattgaagatctcgcactcaagtttcagctctctgatgaaaataccaacgcgaacgatttggattcggaggattttcaggagatttctctgtcgtcgttgaatttcgctgaggagttcgagccgccggaggagatttttccggcaaacatcgaacggaaagcgaacagcgttgagcttccgttttcgctgaggataatcaagaagaagctgcagtggaaggaagggttcagagaggcaggggaatccgcgtattgctctgtcaagaaagcgttctcttccatggtttttatcatcagggagcttcacagtttcactatgcagatgagggagtttttgttctacgaagatctgcaagggattctcgaaagggtgcagaacgaaatgcacgcgtccttcgtgtggctgttccagcaagttttctctcacactccgactctgatggtgtatgtgatgattctcctagcgaattttacggttcactcaatggggaacaacgccgccatcgccgccgtggctccgccgccggtaacatcagtcgtggaggctcacgaccaaaggggtcatattcagagtcataacattgattcctcttccatcaagacgttctctgtttcgaacggtaaaaacacagcctacgtcggtggaggaaatggcggcggcgggaaggtccgtccggcggggaatggaaccgatggggacggccggttcgacaggtcgcgacacggtacggtattctccgacggcggtgcttcgtcgcaggtatataaaacaggggataaaacagagtcagtgtcagggcaagaggaggaggaagagttgaatctgtggaacgcgatggtggaagaggcttcgagaatggagggtttggatcgcgatgttatgaaacggttcgtttcgccggtgatggcgagaattgaatccgatgactatgcagagtatctgagaacagagcttgtgtaccaaactgggttgtctcaagaccccagcaacactctcctccttgtcaactatgcccagttcctctacctcgttgttcacgattttgacagtttaactacaccactggttcatgagcaagatctatcgtctccagcacgtgatatccacgtgcatgacgaggatgatccaacacgtaacctagttgactttgacttttccgcatatacagcggaagagttgttcaagagagcgatagaggtggagccaccagacgcagaggcatataataaatacgccaagtttctatggaaagtgaagaacgatttgtgggctgcagaagaaacctatttggaggctatttcagctgatcctgataacgcattctatgctgctgactatgctcattttttatggaacactggtggtgaagacacatgcttccctttatcctccccagacaactccaaagaagtttaa

SEQ ID NO: 39842 - DNA, 307 bp, Glycine max
  Peptide Sequence Number=SeqID_156620
atgtctgattattactttgatgaggaggagatgcaagagttgctgaaggagaatgatgcgccagtctctgatgacttctttaacgattttgccgctcaagattcgtcccctccagcggatgagattcttcccgccgatgaggttcttgatcctcttcttgttcctacttctcatatggttcatacttcttctgccactgctccggatcctgctcctcacctgattccatctgaggagacattgccgagcagccacccgcaccacttgctgcggcagaatatggagtccaatcatgtcatgttgtccg

SEQ ID NO: 39843 - DNA, 871 bp, Glycine max
  Peptide Sequence Number=SeqID_156621
gtctttgccaatggatgctaagtcggctgtagaattaatggagtcttcctcagaggttcatttttctggatttcacatggatggttttgagcaaagaaaggctagcatagaacaaccaacaacctcagaaactgacatgtataaacaaccttttgtcataggtgttgctgggggtgcagcatctggcaagacaacagtttgtgatatgattattcagcagcttcatgatcaacgagttgtacttgttaatcaggattctttttacaataacttgacggaggaggaacttacaagagtacaagattacaactttgaccatcctgatgcttttgatactaagcaattactacatgttatggacaagttgaagcatggcgaagcagtagatattccaaagtatgattttaagagttacaagagtgatgatgttttaagaagggtgaacccttcagatgttataattttggaaggcatccttgttttccatgacccacgtgttcgggagttgatgaatatgaagatatttgttgacacagatgctgatgttcgtttggcaagaagaattaggcgtgacactactgagaagggtcgggatattggagcagttcttgatcagtattcaaaatttgtgaagccagcttttgatgactttattcttccaacaaagaagtatgctgatataattataccccgtggaggagataatcatgtggccattgatttgattgtacagcatatccgcacaaagcttggtcagcatgacctgtgtaaaatatatcctaatttgtatgtcattcagtcaacttttcagttaaaccatcttgatagttgctactatgcagatacggggtatgcataccctgatacgtga

SEQ ID NO: 39844 - DNA, 1156 bp, Glycine max
  Peptide Sequence Number=SeqID_156622
atgtctgattattactttgatgaggaggagatacaagagttgctgaaggagaatgatgcgccagtctctgatgacttctttaacgattttgccgctcaagattcgtcccctccagcggatgagattcttcccgccgatgaggttcttgatcctcctcctgttcctacttctcatatggttcattcttctgccactgctccggatcctgctcctcacctggttccatctgaggagacattgccgagcagccacccgcaccccttgctgccgcagaatatggagtccaatcatgtcatgttgtccggtgactcatcccatcacaagaaatacgaacattggacaatagaagaacataagtcattcctctttgggcttgagataatgaaagagaaaggatggaaacagatttcagagaaatatgttccatcaaaaactgcaagtcaagttgccagccatgctcaaaaatacatcaaacgcaagaataccccatccaaagagaggaagagaagaagcatccatgacacaactttagatgacatggatataatccgcattgatcaacataattgggttccatcaactccaaattttatggtgcagccacatactctcagcactcatcaacataattgggttcctcctcctcctccaaattttgcagtgcaaccacgtactcctcatgttgatcaagataattgggtttcacctccttcaaatcttgcagtgcagccacctactcctcatattgatcaacataactgggttccatcacctccaaattttgcagtgcagcctcctactcctcatattgatcaacataacttggttccatcacctccaaattttgcagtgcagccacctactcctcatattgatcaacataactgggttccatcacctccaaattttgcaccacatacttcccttattgatcaagataactgggttccaactcctccagattttgcagtgcagccacatgaaatgcaacgagcacaacatatgcagcagttcaacttacatagttcatctcctcaaatggatgaatatagaaattttaatagtggccatccccagaatgagttggatcttattgcacaacagatccttgaatataagaagaacaagttcaaccacaaaaacaatgagggaccaa

SEQ ID NO: 39845 - DNA, 483 bp, Glycine max
  Peptide Sequence Number=SeqID_156623
atgttatgtagtcttcatttgaaacctgagattaagactaaagatgataaaattcctgaagagattgaggaattgttactttcctataaggagatattcagggaacctacctcattaccccctgtaagggctcatgatcacaagattccttttaaggatagagtgtctacaatcaatgtgaggccctatagacactctacagtgcagaaagatgtgattgagcttatgactaaagagttattggatgtcgggttggtgcagcctagtaacaacccatattcatctccaattgtacttgtgaagaagaaagatggatcttggagaatgtgtataaattatagggagctaaacaaaagcactatcaaagacaaatatcctatacctattatagaagagctagttgatgaactacatggaagtggatggttttccaagattgatctccggtctggataccatcatattcaaatgtaccctacatga

SEQ ID NO: 39846 - DNA, 960 bp, Glycine max
  Peptide Sequence Number=SeqID_156624
atggaggcgttgcaggcggtgaaggacatgttcccgcggatgtcgaacagcgagttgatggctccggtggacaatgtaactgtttcgacggagaagctgagagttcggctcatggaagagggagtgagcgaggcggcgattcaggacagtgagcaaatcatgaggactgagtttgcggcgctgcaaagccagcttgtgctgcttaagcagaagcattcagccctcattgacaccttgcgtcaattagagacagaaaaggttgatctggaggatacagtagttgatgagagccaaagacagtggaatggtgaagaggcttcctcaagattagcacaagaaaaatttagtgaaggaactgcaagtgaatctgaagatgacaatgagagaaatgatgctgcagaggaagaaacagatgatgatgacaatgccttttttgatactcgtgatattctgtcatccagttcttttaaaagtaatgggtctgattaccgagtatcatccttctcttcagatgatgaaggattctatgcatttgaatcagaggatgacatagatccttcgattagatatgttggaaccaattaccctcatgttaagcggcgtaagaaattgccagaccctgtagaaaaagagaaaggtgtcagtctttggtcaatgattaaggataatatagggaaggatctaacaaaagtttgccttcctgtttattttaatgagcctctttcctccctgcaaaaatgttttgaagaaatggagtattcatatcttctggaccaagcatatgaatgggggaaaaggggtaatagcctcatgaggattctctacgttgcggcttttgctatatctggctatgcttcaactgaaggaagagtttgcaaaccatttaatccattacttggggaaacatatgaagctcactatcccgataaaggccttcgttttttctcagagaaggtataa

SEQ ID NO: 39847 - DNA, 303 bp, Glycine max
  Peptide Sequence Number=SeqID_156625
atgggaaagtgtggcaaaccatgttgccctggttgtcacctccacccagcttgcaagtccaaggacaaaaccaaaggcaccaaaaagcacaaactccacttgatcacacttgatgaccatttttctaatgattacacggaagatgaaggcaatgatcaaatgatcgtgatggggaaaattattctgaaatggggatttcatttcagatggatgaagttgaacaagaaaaagaaagatgaagattggcttttgccacttgaaaggatcaatgatgctatatttggatttgaagaaattgagtga

SEQ ID NO: 39848 - DNA, 354 bp, Glycine max
  Peptide Sequence Number=SeqID_156626
atggacttactggagttatgggcaattttcggccccggcgtcgccggcgctgtcttcggcgccggatggtggatctggcttgacgcggtcgtctgcagcttggtcaccgttcccttccttcactaccttcccggaattttcgcatcttttgcggctttgatgttcaattgcgttagaaaagaagacatcgattattctccatatgacgaaggcgagtggaggctgtgcaagcagataatgaacaacaacaacaacaataacaaaaccattttccactacaaagcagataagcaggcatgttataaaaaattatgtgcctcaggcatcactattgtatctgatagaggaatgtaa

SEQ ID NO: 39849 - DNA, 3177 bp, Glycine max
  Peptide Sequence Number=SeqID_156627
atgtcttctatgtggtattttcaggaagctgcagagcttctttccatcctttatgtgcaagggaagctagacataggatggaggtttgggcaaagtatggttgagttgcgggctttttgcttgaagcactcagatctaccagaaaatagaagcatcttgccattgaaaggctctatcgcaggtacgaatgatatttcagaagccaatggctttccagtggcattgccagtgagtggtgaacagagcttgaaagattgcaggaatggaggattagcctctgatagtagtcctgacaaactgaaccataatgatgaactgccagatggaggactatctgattgcaggttaagtgctcatgacgacatgttgggatgtggtgctgtgccccaacaagatgttggagtggtagggagagccaatgagaatgttgatgcatctgactctctcagttttgcacttgttttgaagaagttgattgatcgaggaaaagttgatgtaaaagacgtggcattggaaattggcatttcaccagatacattaactgcaaataccaatgaagcttatatggcccctgatgtccaacacaaaatagtcaattggctaaaagcccatgtatatactaatgcatttcagaagggtttaaaagttaaattcaaaccagccaatgcatccaaaaacgacagtgaagccatagatggttctgacactttaccaatatcagattcgggtttgttggatcctgttgctgttaagtcagttccgcccaggagaagaaccaccagtaacattaggattttgaaggataacaaagtgatatgttcatctgagggggttattggtgagaatgggatgccggtggacatgtgcagagtaggtcagtctgactgtgacaatccaaccaattataatgaagcatccattcccaatgcaactgaaatgaacttaaccaagtctgaggatatttttcatgaagttcaaggcaatgcttctggatgtgtttcagcaggcaactctactgcttgtttgctaaatgcttctgtgctttctgatcactgtcttgttcattctgcttcagaaccacttgattttggtttcataaagaaggatgcaatctctagttacattcatccatacatcaacaagaaattgctgcagattcgtgatggggtgcccttggaggacattatatgttcaagtgatgagggaaattcttctttggttgaatcctttcgggctagtgcctgctcaagtagccaaaatcagaatttaacttgcattgatatttcaaagcctgatgaagtaaatatggagcagttggttagggctagaaaaatgggacttttggaattttctccacaagatgaattggagggggaacttgtttattttcagcatagattattgcagaatgcagttgcaaaaaagaggcatattgataacttaatctacagtgttgccaagagtttgccacacgagattgataaggcacatcaacaaagatgggatgatgttattgttaatcaatatctgcgtgatcttagagaggcaaaaaagcaaggcagaaaagaaagaaagcacaaagaagcacaggcagtgttggctgctgcaactgctgctgcggcagcatctactagggctctccggaaagacaccttagatgaatcaatgcaacaagagaatatgacctttttccagaatttgttaaaattggatactctaaatggaagaaccggtgcttgttctcagccgatgtctcgagccaaagagacactttcaagagtagctgtgacaagaacttcgtcagagaaatattcggatttttgcatgccaacctccgatttgtctaaggagcattgtaaatcatgcgatatttgcagacgatcagagtttattttaaaccctatcctagtctgctctggttgcaaggtttcggtgcacttggattgctaccgtagtgtgaaagaaacgacaggtccatggtactgtgagttatgtgaagatttgtcatctagaagctccggggcatctgctatcaatttctgggagaagcctgttgcagaatgtgctctctgtggtggtactactggtgcttttaggaagtcttctaatggtcaatgggttcatgccttctgtgctgagtgggtttttgagtctacattcaaaagaggacaaataaatgctgttgaaggaatggaaactttgccaaaaggagttgacatttgttgcatctgccaccacaagcatggtgtatgcatgaagtgttgctatggccattgtcagaccacattccatccatcctgtgctagaagtgctggtttgtacatgaatgtgaggactactggtggcaaggctcaacacaaagcttactgtgaaaaacatagtttggagcagaaggcaaaggctgaaactcaaaaacatggaattgaagagttaaaaagtatcaggcaaattagggttgaactagagagattacgtctcctttgtgaaagaattgtgaaacgtgaaaaaataaagagggaattggtactatgttcacatgacatactggcctttaaaagagatcatgttgctaggtccgtgctggttcgaagccctttcatccttccggatggtagttcagaatcagctacaacgtcccttaaagggaacacagagggatacagatcatgcagtgaaccacttcaaagatcagatgatgttactgtggacagttcagtttctgctaagcgccgtgtcagagtcgccatatctatggacacagactcaaaattggacgatgactgctcaacctctcaaagtcgatacaaccacaggattccagatagattgcaattttctggcaagaaggttcctcatagaactgctgcatcacgtaatatttcagatgaaggtggatggatatccaaatctagaaatcattccgatagattcggaaaagagcttgttatgacgtcagatgaagcatctatgaagaattcaatgctacctaaaggatatgcatatgttcctgctgattgcttgtcaaatgagaagcactctgacgaggacgtatatgctagtgaaccagtggagcatgacagattttatgacagtcgtagtaattctgaaagggatcgtgctctcgacatcagatccaccgagcatataaattatatatatttaactcccacctcataa

SEQ ID NO: 39850 - DNA, 237 bp, Glycine max
  Peptide Sequence Number=SeqID_156628
atggattttgccggatttaaatacgcgagtacgattgggctcgaagacaatgtcggtaaaaagttcagcatggagacgtaccaatttacgcctttctgtcttcctattatgacgtattaccttactttggtttttattccaaaggataagatattattttcctttgaaggtgaacttgttcctcagatcaacatcaatattctaaacaagaattactatcacactactgtaaagtaa

SEQ ID NO: 39851 - DNA, 681 bp, Glycine max
  Peptide Sequence Number=SeqID_156629
atgagagggctgcacgtcctcgccatcagagggctgcacgtcctcgccatcagagggcaggatgtccttgccatcagagggctgcacgccctcaccatcagaggactacacgtcctctccatcagagggctacacgccctcaccttcaaaggactacacgtcctcgccatcagaggactacacgtcctcgccatcagaggactacacgtcctcgccatcagaggactacacatccttgccttcagaggactacacgtcctcgccttgagagggctacatgccctcgccttcagtggactacacatcctcgcctttagagggctacacgccctcgccttcagaagactacacgtccttgcctacagagggctgctcgctctcgccttcagaggactacacgtcctcaccttcagaggactacacgccctcgcctttagagggctacacgccctccccttcagaggactacacgccctcgcctttagagggctacacgccctccccttcagaggactacatgtcctcgccttcagagggctacacgtcctcgcctttagaggactactgcacatcctcgccttcagatggctacatgtcctcgccttccaaggactgcacgtccttgcctttagaggactgcacgtcctagccttcagagggctacatgtcctcgccttctga

SEQ ID NO: 39852 - DNA, 693 bp, Glycine max
  Peptide Sequence Number=SeqID_156630
atggcttctgcttccattcctccttcccctcctccaccaaggaacagtggcgctctgcttggttcttcagcggttgtcaccacaaaggaattttcacactccatttcgcagaagttgaacaattccaactacctcccgtggtgtcaacaagttgaactagtgctcaaaggccatcgcctctatcatcttctcactaaacctcaaattccaccacgatacctcaccattgccaattgtgatgctggtgtaacttctcctgagttcttactttgggagcaacaagatcaactcctcctatcgtggctacaatccaccatttccggcgagtgccagatctgtcataggtatggtcatgaagcatcttactgttatcaaaggcacaatgatgactatgttcctactcagcctatggagtatcccaaccagtatcctgatcagaatcagtctcagacctcagccaaccccaatcagtatcaaagtctgaatcagaactctaacacctatcagaatcagcagtctaatcagtactctgctcagcattctccacaggcttatctgactggtgttccttcggccccttctccaaaatggtatccagattcaggggcttaccaccatgtcacaaatgtctcccagaacattcatcagaccactccttttgaaggcaatttacggtctcaaacaagcccctag

SEQ ID NO: 39853 - DNA, 144 bp, Glycine max
  Peptide Sequence Number=SeqID_156631
atggccaaaatgagcagtggtggcattctattcaaagaaaaaagcaaccctttctgtggtgtaggtggtgagtgggcagcgctagaaggtggtgtgcggcttaccatgccagggagaggggtgttacaaaggaggtatttataa

SEQ ID NO: 39854 - DNA, 1371 bp, Glycine max
  Peptide Sequence Number=SeqID_156632
atggcttcgtcttcctccgatccgggaaagtccgcggagacgtcggaggccgcggcgttggcggtggcgaacgaccagctcttgctctacagaggattgaagaaggccaagaaggaaagaggttgcacggcgaaagagcgcatcagcaaaatgcctccgtgcgccgccggcaaacgcagctccatatatcgcggcgtcacgaggcataggtggactggtcgttatgaagcgcatctttgggataagagtacgtggaaccaaaatcagaataagaagggaaagcaagtttatccaaacagggttttattcttccctatcatcattatcgttgaacttgctggtgctgcatattttcttaagatgatgatgtttgttgttgatggattctggacaggggcgtatgatgacgaggaagcggcggccagagcatatgatcttgctgctctcaaatattggggtcctgggactctcattaactttcctgtgacggattatgcaagagatcttgaagaaatgcagaatgtgtcgagagaagagtaccttgcatctttacggcggaagagcagtggtttttcaagaggactagcaaaatatcgtggactctccagtcgatgggatcctacatatggccgtatgtctggatctgattacttcaatagcatgcattatggtgcaggggatgattctgcagcagaaagtgaatatgtaagtggcttctgcttagacagaaagattgatttaacaagtcacatcaaatggtggggatctaataagagtagacattctgatgctgggacaagattatcagaagaaaagaaacttggttctgctggagatgtttgcagcgaacttaagcaattggagcagaaagttcaacctatggaaccttaccagatgccacagttaggcaggctacacaatgagaagaagcatagaagttcttcactctctgccttaagtatcttgtcacaatctgctgcttacaagagcttgcaagagaaagcatcaaagagacaggaaaatagtactgataatgatgagaatgaaaacaaaaatacaatcaacaagttggatcatggcaaggcagttgagaaaccatcaaatcatgatgggggcaatgatcggctcaacattgcaatgggaatgagtggaacaatgtctcttcaaagaaatgcttacccattgactccattcttgtccgcaccacttttaacagcctacaatactgttgatccattggtagatcctgttctctggacatctcttgttcccatgcttcctgctggcctttctcgtacagctgaggttacaaagaccgagaccagtttggagaccagttcaacgtacactatgtttcagccagaggaatga

SEQ ID NO: 39855 - DNA, 789 bp, Glycine max
  Peptide Sequence Number=SeqID_156633
atgtgctcaaagtccatagcctttaacatcttctcaccgagcctcaaattccaccgcaatacaccaccattgcctatcacgatgccggtattacttcacccgagttcttactctaggagcaacaagatcagctcctcctctcgtggctacaatccaccatttctgcatcaactctgcaacgatcttcataccatctttctcaataatagctcaatttctgattatctgtttcgtaatcaaaccataattgactcgctctcatcaattggagaacatgtttctgaatctgaacttgttgatatagttcttgatgtcgcgactctacttcttgctcacgagactcatatttctcgcaagaaagctcttgcttcgttacttgcttcaattaatcttgccgaagctgctaaacctaattttagccctaattcttctatgcaagcgttttccagcgactctgcctctacaaatccacaagcttatgtttctcagggtcagtctagcttatcgtcaaactttggttcaagctacaacaattataatggtggaaataggtttttcaactccgttcatggtggtgaccagaacttctctcgtggtggtggctgcggcagaggttgctacttcaatgtgcagtatcatatttgtcacaaatatgacctggctactttctgccatcataggcatgatgacgattatgttctcactcaaccaatggattaccccaaccaatactccgatcagaatcaatctcagacttcagcccaatcagtatcacagtcagaatcctaa

SEQ ID NO: 39856 - DNA, 423 bp, Glycine max
  Peptide Sequence Number=SeqID_156634
atggagagcttagcttttgcattacatgaagtatctgcagaagctacagaaaccaaagaaaatatactacacatccaacctgaaagtgaaagctatgatgcccagattgaagacttaaagttagtcttaaaagctactaatgaaaaatacaactccatgcttgatgaggctgagtgggagcagagagaggttcaacttgtcagctgcataaagaaaaatgaagaagagaaggaatccttggaaaaagaaataaaaatattgctttatttgcttaaagaaactgaggaagaacaaaatgccaaaaaggaggaaaaagctcagttgaaggaaaaaatgaaggaagttgaggctaaggcaatccaactgcaggaagctcttaaggaaacaacaactgacaacatgaagttgattcagtgctcatag

SEQ ID NO: 39857 - DNA, 288 bp, Glycine max
  Peptide Sequence Number=SeqID_156635
atgccatcatttttgtcagtaggaaacaaagacggtcttgcggcacgtggttgttactttctcttactttggcgtgccctagcaattggaagctcgaaattagcacacaattactcacaacttcgtgccctaggtagctacagagagcatagtctccaacaaagaggtccgccgttgcttcttcttccgtttgcagtcgccgccgacaaaggtaaggctgttagttgtacgttgttggtggtctacattgtcgtgaagctgcgtcccataaaagtggggattatgtga

SEQ ID NO: 39858 - DNA, 780 bp, Glycine max
  Peptide Sequence Number=SeqID_156636
atgtcagacccatcagaacagcattgggcagcagtaaaaaggatcctcaggtatctggcaggcaccatcaattttggcttgaaatactccactggacctccatttgcattacatgcctactgcgatgctgactgggcatctgacccagatgacagaaggtcaacctctagtgcagccgtcttctttgggtccaatttagtttcttggtggtcaaagaaacagtctgttgttgccaagtccagtacagaagccgaatatcgcagtttagctttggccacagcagagcactgttgcccttgctcacaatccggttatgcactctcgtaccaagcatatggaactggatctttctttgtcagagaaaaggttatggataagcaacttcaagtcgtccatgttcctaccattgatcagaaagctgacattttgaccaaggctttaactcctcctaattttgctacttacagatccatgctcagagtggttgaaaactttacttcgaccctctcattaacttgcggggggaaagagaaggttgaaattgagaagaacagaaaaattgaggaaaggaaaaagggagatgacctcggcggcagtgacgaaggggtggcgaatcttgaggagccagttcttgcggagcatgaccttcaactgcctccacgcagctcccatggctgcggcgaaaccctagaagcagacgcgataggtgtagtactcttcacgttgaaatcgcaatttggctgtagtggcagagagaaaaagggtaaggcggtggggtag

SEQ ID NO: 39859 - DNA, 1023 bp, Glycine max
  Peptide Sequence Number=SeqID_156637
atgcagaacaactcaccgcgggcggttaaattactgtgccatccggctatccttgccgctatttacggcgtaacggcactcagcagtactgacagccttgccgctgaacaaaacagcaccctcaccgtgacggcgcagcagcaaaacagtgacgacggctatagcgccaccagcagttcggtcgccagtaaaacgccggtgtcgcgcctcaatgaagcccaatcggtgagcgtggtgacgcaacagcagctggaggattatcaggccgccagcctcgccgacgcgctgcgctttgtcagcggcgtaagcgaaggcaatacgctggcaggtaccgaagatggctttgtacgccgcggctttggcagcaactcggatggttccatctatcgtgatggcgtgcgcagcagccaggggttgaattttgatgccaccaccgaacgtgtcgaggtgctgaagggctcggcttcgctgctgtacggtatccagaatcccggtggcgtgatcaatattgtgagcaaaaagccgcaatacacctggcacaccaaagtcagcggtcgcgcagccagcgagggcggcggcgccggcacgctggacgtcaccggcccgctcggcaacggttttgctttccgcctgattgccgaaaagcagaatcaggattactggcgcaatttcggcagcgataaacacaccttaatcgccccctcgctacagtggtatggcgagcaggccagcttcctcatcagctacgaagattatcaatacgatattccctacgatcgcggcacggcgtttgttaacggtaagccggtagcgattggctataaagatcgcctggacgataaagctaaccatgcgtggggccacaataaaaccctgaacgcgcactacgactggcagttcaatgaggcgtggagcacgcgcctgacttttggctggaaccagcgtcagtacgacaacaacgaagtgcgggttacggcgatcaaccccaccaccggcgtggtgacgcgccgggggatcctctag

SEQ ID NO: 39860 - DNA, 843 bp, Glycine max
  Peptide Sequence Number=SeqID_156638
atgcgtttgaagctggccgggttaagccaggcgagaaggaagtgggcagcggtagcggcgcaaatttttactacaagccggcctgccgacgcggttcacaacaatgcgatattactaacaggcaacataatggcggcaaataacattaaaaatcgggtggatgtattcggtgaacgctaccgtgcgcgcgtcacgacattatcggccagcctgcaaacggtggcgcgatatatccacgaacatcgtgaggctatattagacgcgactgcattggatatcgcccaggccacccaaacctctgacgccaccgtggtgcgcaccgtgcaggcgctgggctttgccggtttgcgcgatctgaaaaccacgctggccgcgtggtttggtccggcgcaaaactcggaagagaagatgagcgcgaccatcagcgaactgtcgtgtgacatcaattccggcatcgattttgtgctgggcggccatcagcgcgcctgcgaagtgctggcagaaccggtcaaccgccaggcggtggcggctgcggtgacgctgctgctggaagcgcgtcaggtggcgctgtttggcatcaacgcttccggcattctggcggagtacagcgcgcgactgttccggcgcatcggcctgccggcggtgacgcttaaccgtgccgggatcgcgctggcggaacagctgataacgctacagcgcggcgatgtactgatcatgatggcgcagaaatcggcgcaccgtgagggcatgacgacgctgaaagaggcgcagcggctgggtatgccggtgattctgctgacccacgcgctggattcggcgtttgcgcagcagcggatgtggtga

SEQ ID NO: 39861 - DNA, 1113 bp, Glycine max
  Peptide Sequence Number=SeqID_156639
atgggtatacaaatgttgctattgtcaacttgtgctttttacagatacaatgcatatggtcactgcagtgaaggaacagacactcattttggaatgtccaatgaggaagctaatgctaagtttatgggagcaacgtacatgactaaatataggaaggcaaagaaaggaattcaattcctcatcaatggcagcaaaggtaccgaggatattgggatggaagcgatgcttaagaggctgaaaagagactttgacagtcagagaaagaagctgacgaaaacaaggagggagttgggggagatcaagagagagaatcaacagaagagtagagaatgccaagaagcttggaactccttgaaagagcttcaaaataagctaatgcacaagtccatgcatgggcaagtcaaggacaaaagtaagtggttttcatcattgagagacttcaagatgaaattgaagatatcaagtccaaagtcgcatgaagatctcaagtccaaatatattgaaggggctacggaacggaaacatctttacaataaggttttggagtttagaggaaacataagggtcttttgccgttgtaggcctctcaacaccgacgagatatatgcaggagcaacagtgaccttagattttgaatctgcgaaagatggtgatttaactgtaatgtcaaatggagctcctaagaggactttcaagtttgatgttgtctttggtccccaagatgagcaaggtattgatgctttcatgccatttgaatgtttaggacttggggaagaaatagctaaaaggggagtgaatgacacaaatggatactttctttactctttccctatggatggttgtcatcatcaaaaagggggagaatttaccatgcaagacaaaagatcattcgatgtttcggtaaagaatacggaaaatacccaaaaggggggcaaaagggtcattttaagccttttactgaaccctggctcgcccaagctagcctttagctcacatgggctcccaaatagcttaggggtgaagtatccagctcaccagggcgagctgagctcgcctaggcgagcaaggttacttcaggttaaagcaacaactcgcctgggcgagctgccatga

SEQ ID NO: 39862 - DNA, 219 bp, Glycine max
  Peptide Sequence Number=SeqID_156640
atggagatctcccagagccccatatcgtcacctgatgatactccatggggttatgtaaaacttttgaaagcttgtgactctagtgtgcaaaatgaaccagtaaatgttgtggtgctgcaacacttcaaagaaagcacaaatgaaaaaagcaaggatgtgacaacacttgactggaatgtaaatctttgtagcattattgtggttgcatacttaccatga

SEQ ID NO: 39863 - DNA, 813 bp, Glycine max
  Peptide Sequence Number=SeqID_156641
atggatatccacgcaccaaacccaaaagtgttggacgtgagggggtgtactgaaaaaaacccaagtctcacattggctagagatagtgtcaagatagaatatgttgttatggaaaagttgacagaatttgacttattgaagcatgctaataaaccatcattttcacttagtggagggaataaacgaaaactgtctgttgcaattgcaatgattggagatcctcctattgtcattcttgatgagccatccacaggtatggatcccattgccaaaaggttcatgtgggatgtaatatctaggatctcaacaaggcgaggaaagactgcagtaattcttactactcacagcatgaatgaagctcaagccttatgtaccagaatagggataatggttggtggacgattacgatgcattggaagtccacagcatctaaaaacaagatttgggaatcatctggaactagaggtcaaacctactgaagtgagttctgcagacttgcaaaacctctgccaagctattcaagaaagacttcttgatgtcccttctcatcctagaagcttacttaatgaccttgaaatttgcattgggggcactgactccgtcacatcaggaaatacatccattgcggagattagcttgacacgagaaatgataggcttaattgggcgctggcttgacaatgaagaaagagtaaaaacactaatctctggtacacctgtctgtgatggagcttctcaggaacagttatcagaacaactgtttcgagatggtacgtgtgaatcttccattgaaggctttgcttcttatcattaa

SEQ ID NO: 39864 - DNA, 290 bp, Glycine max
  Peptide Sequence Number=SeqID_156642
atccagctagacatctacctgtcatgcaagatgacacatatgttgaaccagatattcctcagtacccgatggcggcagcaactatggaggaagcacttgcacttgcagatgcttgccaagcaatagctgaaaggttagaacggttgttgaacctgaggatagcgacaaaaggtacagaagcatatagtgttatggaagactttctaaggatcgccagaggtgtcactgtggaatgcatatgtgaggtcgtgacgaaaatggcatatgggagacacatgaaggcattttga

SEQ ID NO: 39865 - DNA, 210 bp, Glycine max
  Peptide Sequence Number=SeqID_156643
atgacgattctgacaacagaggtggtggtggcggcaatggtgttacgccatggtggtgacaataacgataacgacaaaggtcataacaacaaagatggtgacaacaatggcgataaaggcggcgacgattatagtggtgactgcagtagtagtcatgatggtggtagcaaccatcatgatgattgtgatggattaaatgagatattttaa

SEQ ID NO: 39866 - DNA, 504 bp, Glycine max
  Peptide Sequence Number=SeqID_156644
atgccgcagcagctccatgcttcttcttccttcgctctgtgttttctgtcatgccaccgccatcctcagctttcattgccgccattgaggtcgtctccacggttgttgtgtcgtttctgccgtcagagtaagcgtttgatgattttaatggttgctagtttatacggattaaccaatctgtataactcatacggattacctaatccgcccacaacatttgcacgtaggcaacgagaagctgtccttgttgctgaggatgttcagcatgtggatcacgcagttgacgaggtctatgaacaacttgaagaagtagctgttgatgatgaagttgctgatgccgagggtttttcaggtgggctacatgacacatcagttctgactgcctatgttgatcatgttgtcgtcattgtttggaatggaaaagaacatctagaattgaagctatcctcccatggaaggaagtttagaaatttagcagacctactgcatagatggaaggcttag

SEQ ID NO: 39867 - DNA, 702 bp, Glycine max
  Peptide Sequence Number=SeqID_156645
atggcttattcccatgttgatgcttcaggattgataggaagggacaatgatagggaagaaattatcaagcttttgatgcaacctcactctcatggtgacagtgttggaaataaaagtatatgtgttattcccatagtgggcattggaggcttggggaagaccacactttcaaagttggtgttcaatgacaagaggatggatgaacttttccaattgaagatgtggataattattaaaattgtcaactatgcttcagttccaaccatttccctggctcaacatgaaatcattaacaatttagatattgaccagctacaaagtcattcagatataagctttctggcctttcaatggataattgtttatctctttttgtcaaatgggcatttaaggaaggcgaagaaaaatattcaaaagctagagaatattgcaagacaatatatagatgagttacattcaagatcatttcttgaagattttgaggacttaggccacctttattatttcaaagtacatgatttggttcacgaccttgcgttgtatgttgcgaaagaggagcttttagctgtgaactcctgtactcgcaacatacctgagcaaataaggcatttatcagttgttgaaaatcactcacttagccatgctttgttccataagtccagaagagtgaaaaatttttcccatccatggaatgggaattga

SEQ ID NO: 39868 - DNA, 684 bp, Glycine max
  Peptide Sequence Number=SeqID_156646
atgggaacaaaccaaaccggaaaaagattctatcaagtcaagattaagggcctagatgtcaccagccttaaggagttggggccgttgatgagacccctccagatgcaagccttccgcaaaatgtatggaaagattttagatttgaccatagcgaaggtattcacggaaaccgttgtatccctcacccaatactatgaccagccattgaggtgcttcacgtttggggacttccaaatagtaccgactgttgaagaatttgaggagattctaggatgtcctcttgggggaagaagaccgtatcttttctccgggtttcttccctccttgagcaagattgcagttgtggtcagggattcggtaagagagttggatcgtgtaaagcaaactcgaaatgacgtagtgggcttaccacggaagtacttggaaggcaaggcaagagatatggcgaatcaagaggagtgcgtcccatttgcggacgtattagctttgctaatctttggggttgtcctctttccaaacatggacggtttggtggatctagccgtgattgatgcgttccttgcatatcaccatagcaaagagagcccggtggtagctatcttggcggacttatttgatacatttgaccgaaagtgcgagaagagtagcgcacggatcatctgctgcttacccgctctgtgtatg

SEQ ID NO: 39869 - DNA, 132 bp, Glycine max
  Peptide Sequence Number=SeqID_156647
atggagggtgtgtggaacctgcgggtaatccgaggagagagaagacctcaacatcaccatttgaacaaggctgttagtggaccaagaagcccaggagttattggtgaacggggatcaagagaaagtgagtaa

SEQ ID NO: 39870 - DNA, 171 bp, Glycine max
  Peptide Sequence Number=SeqID_156648
atgttgattgtgctttttttggttttcaagcttgacgagagttacacgccgagcaaattttccattcgtgccggtgatggttttcacaacttgaaggagattaagaccgtggaactcgtgaaggcaactgggtgggtttatctatccttgtctggagctgatcctaggtaa

SEQ ID NO: 39871 - DNA, 513 bp, Glycine max
  Peptide Sequence Number=SeqID_156649
atgtgggtgtcgaccgagcggtttctggcagatttcagctgggaggagaaagagaatcgagagtgccgaagggttttcgagcgcgcgagttgtgcaatttcaacatgttcgataatagatgaacatgtagatatctatatagaagaggcctcgtcaaatgaatccacccaggcacaggcaaggagtcgtttgggattggatggaaatacttttgcctatgcggagggtgttcttaatgaggatagcctcaacatgtggagggataagatctggagtgccttttctctctatttaaacgagattgactcgacaaatttaaaatttagtgaaatccctaggtatgaatttgaagacgctgttcacctacatctaaaatacgaagtgacctggaaggaggcagaatccagtttcagccaaattagtgaaaggcccttgccctcttattcttatgcggttcagacattcatctatccccacctctataatcttatggaaaaggcccgccggccttaa

SEQ ID NO: 39872 - DNA, 405 bp, Glycine max
  Peptide Sequence Number=SeqID_156650
atgagaaataataccagcatccctatccaaaaaatattcaaggatgagacgtggaaaagggttattatggagatggacgagagtggtgtcgatggcgcctcacatattgggaaacgaaatgagttcctcgaaggcttgtgtggctttgaggaggtggcgactgccgatggggatcttgatgaattcagggtagagcttggtgttgaggaggcgcgtgaccatgttggtgatgttggagaggagataagggtcgagggagtagtgggaggtgagggttttggcggagaggggcttcgctggaacagatgtgttctactgagagggcgtggaaggcggagacagagtagtgagagtgagaatgagggtttggaggaagtgagggatggagagggagcaacaaaatga

SEQ ID NO: 39873 - DNA, 457 bp, Glycine max
  Peptide Sequence Number=SeqID_156651
atggttatgggagatttcatcagcagactctccttccccgaaaacaccgagactttttcaagtctcacaagttatccagaactacgtaggtctgagttcctcattggaggatacgtaggagcaagagcctcgcttttgtcgaccataccgccttttgttgccatgactcaagagctggtagcccgcggagataccttacggttattcgcaccccttttgtcatccagaggcggcgggcccgatgacaagcagagaccaagttttggtcatcctgcacccttgtatcatccagaggcggcgggcccgatgatacgcggagataccttacggttattcgcacccttttgtcatccagaggcggcgggcccgatgacaagcagagaccaagtttggtcattctgcacccttgtatcgtccagaggcggcgggcccgatgatacgcggaaatacccgagtg

SEQ ID NO: 39874 - DNA, 315 bp, Glycine max
  Peptide Sequence Number=SeqID_156652
atggaatcaggggtgctagtttcttcagagctaaaacaggacagagccttatccaacgaaggagctgagagatccgacatggtcctctggaatcttggcagcaggggaggcaacccagagcctctctccggcggcaaggattgctccggctctgatgctgatgccgaaggggacgaggaaagagtcgcgcttgttgacgaggtagttgatgttgaggggaatgggaatggtggagaagccttagtgagtgggatcctcttggtcccagaagagcttcttggtgcagggctcgccggaggaggaggaggaagatga

SEQ ID NO: 39875 - DNA, 333 bp, Glycine max
  Peptide Sequence Number=SeqID_156653
atggatttgctggctaatgttgcagtggagaataagaggagagtgtgtctggtttgggaagatttgacagtggtggcatcaagtgttaacaatagtccaaaaagggaattgttaaaagggttaagtggttatgcagaacctaaccggattatggcactcattggtccttcaggatccgggaaatctactgtacttgctgcactggctgggatacttcccaccaatgttagcatgacaggaaatgtactactcaacgggactaccagaagtaccggctgcagagatattacaaatgtgatcgatgtgatttcgattgtggtcccagacaattaa

SEQ ID NO: 39876 - DNA, 330 bp, Glycine max
  Peptide Sequence Number=SeqID_156654
atggtggcttcttgtctcgaccaagatccttccaagagacccaatgctgataagttgctcaaacacccctcctttaagaaccgtaagggaaccgattttctggtgaagaatgtgctgcaagggttgcccagtgtggagaaaaggtacaaggagagtaagggtaatttgcatgaagatgatgatgatccctccatgcaggagcttgaccctgtgtttccaaacgatgataaagaggttcggtttggaggggaaacggttatccaacaagctgcaggaatggaaaaggtgaacaacaacgtagcagtagggaagggatgttggcgactctga

SEQ ID NO: 39877 - DNA, 339 bp, Glycine max
  Peptide Sequence Number=SeqID_156655
atgaacggcatcaccacccagaggatgttggggtgggagaggtcgaggtcgatggatttgattgcgacggcggcggagttcatggggatgcagagggccggctttgtagacaagggcgctcatgccttggccaatctggttcaggagctcgtaggaggaagagtccagtgggtattggacccttttgcctcctgctgcttcttctgctccgttggttgcggccatgctattctacatagaaaacctaagtccgttatatctaagcctcatgagactaatctcatagtaatttctagcaataacgatatcttgcttctaggaaaagaactacacaactaa

SEQ ID NO: 39878 - DNA, 445 bp, Glycine max
  Peptide Sequence Number=SeqID_156656
atggaatcatattttgtatggagtttatcaagagatgcagaaaatccaggaaacaatttgtatgtgacaggattgtctcctaggatcaccaagagagaactggagaaacatttttctgctgagggaaaagtgatagatgtccatctggtagttgatccttggacaagggaatcccgtgggtttggctttgtgacaatggagactcttgaggaggcagatcgatgtgtaaagtatctgaatcgctcagtacttgaagggcgtgtcatcacggtggagaagctcaacggcgttctccaagtgactctcctcgtcgctcccctagctattctccttatagaagaagctatagccggtctccctattcttcagaccgaagtaggagtcgttcttactctcctgactataggaggaggaagtcaaactatccatatcactctaggcgaag

SEQ ID NO: 39879 - DNA, 435 bp, Glycine max
  Peptide Sequence Number=SeqID_156657
atgatcgacacaggtcatattctcgctcttgctctccttatagcaggtcacctgtcagcatccgcgacagatcatactctccttatgactcacgatatgactcaccggatgatcactcctacagaaggcaccattacagatctgtttcacgaggtgcctcgcctgatgatcgctattatagaaggcaccattacaggtctgtttctcgaagtgcctcacccaggccaaggagaaggtcaaggaggagctactctcggagtgccactcctgtttcaaagaggagcaactcgcgaagtgtgtcccccaggtcaaggaagagtcattcaagaagctccaagaggagtggcaaatatgagaaacactactcaagaagcccgagtttctagattgagttttggtttggatccgttcaaggcttgtctaaaaaccacctga

SEQ ID NO: 39880 - DNA, 162 bp, Glycine max
  Peptide Sequence Number=SeqID_156658
atgggtctcggtttctctaagcatgagaaacttgcatgccttgaatgcactttcttgggcaagtcacaatgtaatgcatgccagacagtggtagcaggaagcactcaaggccaggctgctaatgatcgatgtttcccaaaccgtattaagtgggtcatataa

SEQ ID NO: 39881 - DNA, 723 bp, Glycine max
  Peptide Sequence Number=SeqID_156659
atgaaaggaattgacttgttctgttcttcctctgcttccacagcagtaaattctagcatgcaccatcgttctatggtacatcgaagcaccaaaagcttcgaccatgatcgaaggaaaagccaacttcatgttccttgttcatcccaattgcccatcaatcctaagccttataattactttgagaagcacagaaagagttcagcttcagctgataaacaaaactgtgacgtgcgtagaaaaagttctgctgatgttaacgacctttatactcatgctggtgctgatggttcatctagaagatatctccttggtgatgcgccattcattgaatgggtatctgagtctaataaaatctcagcaatggttccttctcaacatgatgtcaaagacaagcttgtggttatgaaaagaaacgatcctcccactcttcggtcctcttcttcagctcgatccaaggacaaggttgtggttttgagggtgtcattgcactgcaaggcctgcgaaggaaaagttagaaagcatatttcaaaaatggaaggagtgacatcattcagcatagacatggaatcaaagaaagtgatcatcattggagacgtgacaccattaggggtactggcgagtgtatccaaggtgaagagtgcacagctatggccatcttctacatcgtcatcctcattattactttcatcatcttctaggccaacatctccatggtcgacataa

SEQ ID NO: 39882 - DNA, 928 bp, Glycine max
  Peptide Sequence Number=SeqID_156660
atgccccaagcactcctacttcgtcaccacactgaaagagacacttacaaggcaaccggttggaaccggtcacaaggcggaacccgaagagtcacccccagcgtagaagaagatagcagcctggagaggcggttgccgaacggtgacgtgtacatgggaagcttctcggggaacgcgcccagcggatcggggaagtacctgtggagagacgggtgtgtgtacgaaggtgagtggaagaaaggcaaggcgtgcgggaaaggaaaattctcgtggccttctggagccacctacgagggcgaattcaaatcgggtcgaatggacggcttcggaaccttcaccggatccgacggcgacacctaccgcgggtcctggagctccgacaagaagcacgggtacggtcagaagcgttacgcgaacggggacttgtacgaggggtcgtggaagcggaacgtgcaggagggggaggggcgctacgtctggaagaacgggaacgagtactacggggagtggaagagcggcgtcatttgcggccgtgggacgctcatttgggctaacgggaaccgttacgagggccaatgggagaacggtgttcccagggggcaaggggttttcacctggtccgatgggagctgctatgttgggtgctggaacaaggaccttaagctgcaccagctcaacggaactttttaccccgggagcggcgataatctcaccgtctcaatgaggaagcgttcttccgttgacagtgctagagggagtggtgttaagagttttcccaggatttgtatctgggaatccgagggtgaagccggggatataacctgtgatataatcgataatgtttcgttgttgtatcgggattcgagtggaaccgggtcagatcgaggagatgttaacccgtttcgccggaacccttgttgcttttccg

SEQ ID NO: 39883 - DNA, 303 bp, Glycine max
  Peptide Sequence Number=SeqID_156661
atggaagaaagttccttcgctgatgtaatttacaactacgaaagaaccttcttccatgatttcctgtggaagaagttccgtgagatgacacgaaagaagttcacgaaagaaggttcttccatagttgtaagaggaagaaggttcttccgcaaaaacattaaaaaatattttgggaatcataaaaaattgctgggtgcccctagcaatttccaaaaggcaaagattcctccaaggctccaaatgagttggacttacccacaaacagtggtggtaggttgctcttccggtagttccaaggaatag

SEQ ID NO: 39884 - DNA, 1146 bp, Glycine max
  Peptide Sequence Number=SeqID_156662
atgccagtcatcgccgctaagcgcacattgagatcccacccctcatcgccccctcgcaaatcgccccgccgatgcaccgccgcaacccccaattccactccaacgatgaacagattcggcgccgacgaaaaccgagctgacccggaagctgtgaaacccaagtggaatcccaaagacggtgagcaattgaagagggtgaagctggcattgcacttgtccactgcgccgtcttcggtcgtgtgccgcgaggaggagcagaatgtggttttggagttctgcaaggggtgcgttgagcaccagaaggccgggagtctctacatatgcggctgtcccggaactgggaaatcgttatctatggagaaagtgaaagacaaattactcaattgggccaaggaggcaggtcttccacagccagatgttttgtctgtaaattgtacaacctttaccaacacatcagatattttcactaagatacttgggttaaaccaaacacagggtaaaaaggtttcggctacgcccttacagcaacttcagaacatgtattctcagaaatcgtctaacaagaacatgacattgatagtagctgatgagttagattatttgataaccaaagacagaggcgtgctccatgatcttttcatgctcaccacctttcctttttctagatgtatattaataggtgtagcgaatgcaattgacctagctgatcgatttcttccaaggcttacatcattaaattgcaaacctattgttgtaaattttcgggcttactctaaagatcagatcctcaagattcttgaagaaaggttaaatgaacttccttacactgtcttccaacagcaagccatggaattatgtgctaggaaagttgctgcagcttctggtgacatgcggaatgctctttgtatatgcgggagggcaatagagatgcttgaagcagaaattagagagtctgcctgcaatttgaatacttcattggaagagatatcatcctccagacaaaatcttgctacagctcctgattttatgaaaaaacgagaatttgagactgtaaggactgatcatatggcacgtgccttgtccaagacatatagatcaccagtggtggatacaatacaatctctgccacatcatcagcagagttag

SEQ ID NO: 39885 - DNA, 1142 bp, Glycine max
  Peptide Sequence Number=SeqID_156663
actcagttgggaaggaagcttccatttcgcgagagcttaaaccgagtgattttgatccgaaggagaagttctggacaaggtttccggctgaaggatctaagattacgccgccgcatcaatcagtggagttccgctggaaggactactgccctatggtttttagacaattgaggaagctatttcaggtggatcctgcggattacatgttagctatatgtgggaatgatgccctcagggagctttcctctccagggaaaagtggaagcttcttctacttgacccaggacgacagatttatgatcaagacggtgaagaaatccgaagttaaggtgcttcttcggatgcttcgaagctactaccaacatgtttcgaaatatgagaattctcttgtgacaaaattttatggagtacactgtgtcaaaccaattggaggccaaaagacgcgctttattgtgatgggcaatcttttctgctcagaatatcaaatccatagacgatttgacttgaagggatcttcacatggccggacaacagataagaccaaggagattgatgaaactaccaccctcaaggacctggatctcaactttgtgtttcgtctacaaaataattggttccaggatttcatcaaacaaattgagcgggattgtgagttcttggaggctgagggaattatggattacagtcttttagttggccttcatttccgtgatgataatacatatgaaaaaatgggattgtcaccatttcttttgcgcacaggaaagtgggattcttatcagagtgaaaagttcatgcgtggttatcgctttcttgaagcagagctgcaggatagggatcgagttaaatctggccggaaatcattgattaggttaggagccaatatgcctgcgagagctgagcgcatggctcggaggagtgattttgatcaatacaccccttgttgcagtggggaaacctacgatgttgttttatattgtgggattattgacattttgcaagattacgatatcagcaagaaactggagcatgcttacaagtctttacaggttgacccttcatcaatctcagctgttgatcccaagctttactcaaaaaggttccgggattttgtgggcagaatattcattgaagactggtaa

SEQ ID NO: 39886 - DNA, 195 bp, Glycine max
  Peptide Sequence Number=SeqID_156664
atgaattttgataaacttcgggttgtaactaaacttgctaatattggtcgtaaacaagaggttgtgctgacaactgttatggcagaggagcttggaagtttcaaacaattttacggattggtggggcagatgaacgtcacaaaattcaaatatagatgtaactcgaatgagaaggcagttgtcctttacaagtga

SEQ ID NO: 39887 - DNA, 279 bp, Glycine max
  Peptide Sequence Number=SeqID_156665
atggtggttcaaaagatgaaaacagagacagggttgctagacgaacaacctccatctaacactcaactagaggacattggcaggccttatggtgaattgagtaggttttttgttgtaagatgtaaggatcaactagagcatacttggcatctgctagacggtaatggcaacatgcactctgttatgtataaccaagatctggtgaacccaactatactgtctagaagacaaaactcagatatttctatgggctcacagaaaattatcaagagaccatga

SEQ ID NO: 39888 - DNA, 1451 bp, Glycine max
  Peptide Sequence Number=SeqID_156666
atgccgagaaaaggaatgagaagcattttcttcacatcaacgcccacggcatcactaccacctccttcccgtcaacgcactttctcagactcgttaatggacgaaaacatagaaaccgcagagaagctcataacgaaatgggacgattccaaagtcacaacaacaacgcaacttttcagcggcacgcgccaggaagccaaacagtacctaaacgccgtgaagggactacaatccgctatgcagtacctcgtcgcacaggattccacctccagcaccctcgtgcgcgcgcagttcctcatgcaactcgccatgaagacgctccagaaagagttctaccagattctatcctccaacagagaacacctggatcccgaaactgtctccacgcgctcctccgttgaccaccgcagcagcgtctccgattacgacgacgaaatctcaatcaccgaggacgagttccgcgtttccgagaccgagcgcgtttccatgctcgccatggaggatttgaaagccatagctgagtgcatgatttcctccggctacggcaaggagtgcgtcaaggtttacatcgtcatgagaaaatcgatcgtcgacgaagcgctgtatcatctcggagttgaaaaattgaacctctctcaggtccagaagctggattgggaggttctcgagttgaagatcaagagctggttaaaagccgttaaagtcgccgtcggaacactgttcaacggcgagaggatcctctgcgaccacgttttcgctgcggattcggggaaaagaatcgcggaatcatgtttcgcggaaatcaccaaagacggcgccgtatctcttttgggatttccggaaatggtggcgaagtgcaagaaatcgccggaaaaaatgttcaggattctggatttgtacgaagcgatctccgactactggcctcagatcgaattcatattctccttcgagtcaacggttaacattcgcacacagaccgttacgtcgatggtgaaactcggcgacgctgttagaacgatgctaacggactttgaaactgcgattcagaaagagtcatcgaagaaaccggtccctggcggtggtgttcaccctctcacgcgctacgtgatgaactacctcacgttcctcgccgattacagcggcgtgttggtcgatataattgccgatttgccgcaatctccgttgccggagtcttactaccgcagcccgatgcgcgaggaaaacccgccggcttcggagctatcggagcgaatcgcgtggatcatactcgtcgtgctctgcaagctcgacggcaaagcggaactctacaaagacgtggcgcactcgtacctgtttctcgcgaataacatgcaatacgtcgtcgtaaaggtgcgcaaatcgaacctagggtttcttctcggcgaagagtggttggcgaagcatgaattgaaagttagagagtacacgtctaa

SEQ ID NO: 39889 - DNA, 207 bp, Glycine max
  Peptide Sequence Number=SeqID_156667
atggaattggaatcaaaggaaaggacagaggggaagaaacagaatgagagtgatgtggatagaaactccaattcaaatggggtggtgatcacagtttacacggaatcagtgagaactagctccagaaagaaaacaaagcaaggttccaatatgctcgcgctgctcctcaaccccaaaacctccaagcccaggtacctgcggaaatga

SEQ ID NO: 39890 - DNA, 1359 bp, Glycine max
  Peptide Sequence Number=SeqID_156668
atggctaactcctctaaggccaaagaggatgctatcctcaggctcacaaatcatcagcttttgcttggggagtctatgcaatcgttgatccttaaatttgaggagttgcttcaaagcataccactcgttccctctgcctcaccttcattaccaacccctgcacctgctctacctccgacacctgcattcaatcacataatgaaattagatgtcccaagattcgatggcactaatcctcttggttggatctttaagatcaaccaatttttcgagtatcatggtacttcagagcatgatcgtctcacgattgtttcgttttatatggaatgcagtgtccttgcctggtttgagtggatggccaacaatggatttgacaaatcggattataaggcttcttcctctgttcctcctgagttgcttcatttatgggctcaccccagaaattcggcaagaggtccaggcactgcagcctctgactctggtgcaggcgaccggccttgcacgccttcaagaagaaaagcacctggatgcgcaattgattccttgagggcgccttccacacaccactctggtccttccctcacattcagttccatcgcttgccacgcttctacctccgccaccacgaccaccaaccccagctctcaagcgacgacaaataccatagaggccattgttgtgcctctaaggcttcctctccggccaccaggtcgtgatcctcatggatggcgacagcactcacaatttcatccaagaggagttagtgaccaagctcgggttctcttcgcgagagacaatcccattgcgggttatggctatgactacggttatggctatggtggaaaatttgcagagatcaaagaacagaagatggcacaaacgctggcaatgcccgtggcaccttcgctcgctatcatctccaattctcgcctctccaagacactctccgttcccgttctcaacaacccaaagtttcaagggttaagcatcaagtgcgttcgtgttggaggtgtggagattccgaacaacaagcgaatcgagtactcgctgcagtacattcatggagttggcaggaccagagcaaaacagattctgtgtgatatccaaatggataacaaaatcacgaaggaactcactgaggaggagctcatcactctcagggacgaagtctccaaatatatgattgaaggcgacctgagacggttcaatgcggttaatataaagagactgaaggacattcagtgctacagaggaataaggcacattcaggggcttccttgcagaggccagcgaaccaagaacaattgcaggaccttgaagggtaagaaggttgccattgccggcaaaaagaaaaagtaa

SEQ ID NO: 39891 - DNA, 1104 bp, Glycine max
  Peptide Sequence Number=SeqID_156669
atggctaaagttggtaagttgcggagcaaggctcaaggtcagagggcaaccccgcatcttttatcgtgtgcaagaaaaaatctgaaagatgttaatgtaaggaacaactcttctaaagcatcggagaagaaagattgggaagatgcaacctgctcagtctgtatggaggtcccccacaatgctatccttctcctttgttcatcttattacaagggttgtcgcccatacatgtgtgctactagtcatcgctattcaaactgttttgaacaatacaaaaaggcatatactaaagcaacatctgttcaaagtttgcagccagaagcaaacaattccaatattgatttaagcacaggtgaatctaaagacaatactgaaattcctgagcttctttgccccctttgtcgccggcaggtgaaaggttggacagtggttgaagcagcacggaagtctctgaatgccaagaaaagaagttgcatgcaagatgattgctcttttgtggggaattacaaggagcttaggaaacatgttaggtctaagcatccatttgcacgaccgcgagaagtggacccaataaaagaagaaaaatggaagagatttgagtgtgaaagagaacgaagtgatgtgattagcacaattttatcttcaacaccaggggctatggtacttggggattatgtgctggagccaaatgaccatgctttttatagtgatgagtatgattctgattcggaatatctagaggatgatttcttctcggtgaggtccattggtttggggagaactggccactttttgccaaacattaggtataatcaggaccgtgctgctgataattttgatgttgatcattttggtttgcagagtgttgcatctacaggttctgctgctgtctctggacgaggactccacaggatattgttaggaaggtctagaagacgacggaggcataggatagcaaatgcaagaagtgttaggaatacggaatgtcctgtattctgcatgcccttggatccactattgttatttgactttccagcaggaccccgagcgccttggctgcatgcttgcggcaccgtatatgacgcagcttgtcaaacgctctga

SEQ ID NO: 39892 - DNA, 297 bp, Glycine max
  Peptide Sequence Number=SeqID_156670
atggatcacgtaatttgtatcccaaaatacttattcggaaatataaaaatcatactttggaatagatattctagaagtggatacctcagcaccccaaaaggcatttccctttttgtcttcccaaaacctcacgctaacactcactccttcactcacctaaaaatggagaagaagcaaaggctcttttttgggttgaaagacaaggtggttcacggtctattatcgcaggaagcaccatgcgagattgggaagcctcaagcccgcaagggcactcccgtcgctcgaggaaggatttga

SEQ ID NO: 39893 - DNA, 444 bp, Glycine max
  Peptide Sequence Number=SeqID_156671
atgcaggttgtaaaaggaaagaacaagggttatggccttccagctgatatttggagtctgggatgcactgtactggagatgttaacaggccaacttccgtactgtgatttggaatctatgcaggcattatatagaattggaaaaggtgagcgacctcgtattcctgattctctttcgagagatgcacaagattttatcctgcagtgccttcaagttagtccaaatgatcgtgccactgctgctcaacttttaaaccattcatttgtccaaaggccactttctcagtcctctggttcttcatttcctcatattcacggccggaaggcaaaggtgaagtatcaacgtccagctgaaaaagttaaccctgccttcttcccctcaaatcaggtgaccggcgaaaaacccatagggtttaactctgggagcaatagtagcaagaattag

SEQ ID NO: 39894 - DNA, 2247 bp, Glycine max
  Peptide Sequence Number=SeqID_156672
atgatgtttgcatatttgttgtttggatttcttcatggtaatctacggttcgtaatgggttgttgggtgcagttaatgaagagagaagatgtgaaggagcttagtctatggcggtggaaaaaggaatatgtggtggcaattgggattatcagtggcaatggcggtgttaaggaagatgatggagatggaggcgtagataaggttttcccacgcggcattgtcttgtgtttcaagtcacgtggttctcgtgacgttcagttgatcattgttggagaagttgccggttggagttattctctttctcgcgtagaaaaagggccgaaaagattgagggctgttgcttctgtggagataacctgctattacttagcttctggaagaaaacctgctgcagtgcaaccctattgttttaggggaagggctggtgaagaagaatggttgagaagtgctggaagtgttgctgggggtggcagttcggcccaccattttgcagctcaatctaatcacaccgattcttctaatgttgcccatcacacaaggaatagatcatctaagtccactaatgattttgatagccctcgttctgtgtttctggaacgaacattttcttcaaattctcggaggagtatcaatggttctgctaagcatgcctatagtagtttcaacagaagtcatcgtgataaggaccgtgatagagagaaagatagatcaaattttgtagacaactgggatcgtgactgttctgaaccattttctgacatctttcctggaaggatagagagagacactttacggtgttctcattcaatggtttccaggaaacagaatgagattttgacccacagagttgcagtagataccaaatctggtggcaatagctaccagaaaagcggtaatgacttactttctggcagtagtattggtagtagtgttcagaaagctgtttttaataaggattttccttcacttggagttgaagagaggcagggaataactgaaatagggagagtttcatctcctggtttgggtgctgctgctagtcaaacactacctgttggcagttcagctttgattggtggggagggatggacatctgctctagctgaggtaccaactataattggaagcagtagtactggatctctaacgttgcaacaaactgtttctccaacttctgggtctgtacttacaagtacatcatctggtcttaacatggctgaagctttggcacagactccatctcgagctcgttctgctccccaggtgtctgtcaaaacccaaaggcttgaggaactggctattaagcagtcaaggcagttgattccagtaacaccatcaatgcctaaggctttggttaacaattctgagaaatcaaaacccaagacagcagtcagaaatgctgagatgaatatgtctgtcaagagcatgccgcaacaaccctctgctctgcacatcgttaatcattctgttcgcagtggaaatgccaaagttgatgctccgaaaacatctgggaaatttactgatctcaaatcagtggtgtgggaaaatggtgtttcccctactacacctaaggatccttcaagccaaacaaatcactctaacattagaactggaaataatcttgctgttgcttcagcagctgcttctacacctttgaagaagaccaacaacatcaaatctcccacagagcggaagccaatttctttggatcagaaactagggtccactatggataagaaaaattctatttctcaagtgcagagccggaatgatttcttcaatctcattaagaagaaaactctgatgaactcctcagttcttccagattctagcccagtggtttcatctcccccaatggacaaatctggtgaagtgaatactgaagctgttggctctcctgcaaggcctcaagatcttcgaaatggtgctgaagtgactagcaatggtaatgcccatgtagagcttaacaaacctgattatgatcagaaagatacaattctagatgaggaagaggctgctttccttcgttcacttggctgggtggaggattctggtgaggatgaggaaggccttacagaagaggagatcaatgccttttatcaggagtgcatgaagttgggcaccactacattaaagctatgccagggcatgcagccaaagttgtccaagttttttgaaccttatgctacgactaacttgcatggagcttctgctgaattgagttctgactccagatctgaagcttga

SEQ ID NO: 39895 - DNA, 1023 bp, Glycine max
  Peptide Sequence Number=SeqID_156673
atggactccaatgtcggtttagcgctgttcgttatgacaacgattctactaattcaacagtttccccttacaagtgctcaatcaatcggtgtgaatcttggcttaactggagacaaccttccttccccaaaagaaattgtggaactctacgagaaatatcatatcaaattcatcagaatctttgagccaaggcatgacattcttgaagcccttcgaggtaaacctttggtgcttgtcattggcacaaaagatgaagacgtacaaaccatagcacaggaccaaaacgcagccaacacatgggtccaaaccaatgtcattccatacataaaggacgttaattttcggtacataatcataggtaacgaggtgacaccagggcctatagcagcctacgttgcaaagggtattcaaaatatgatcaatgcactcaccaatgctggcatacacaaagacattaaggtatctgcagttcttaaaggtactgtcttagcatcttcttatccaccttcagctggaacattcaccaatgaaacaaccaacattatcaaacagattgcaacaattttgttgcaacatggttcacccatgatgatcaactcgtacccttaccttgcatattcctctgacccacaacatgtttctcttgactatgcactctttaagtcaacaagccctgtggtcactgatgggagttacaagtactacaatctgtttgatgccatgcttgatgcttatcatgctgcttttgagaagattggtgtgtcgaacctaacacttgttgtgtctgaaactggttggcctagtgcgggttatgagccttacacaagcaaattgaattctcaagcttacaacaaaaacttggtgcagcatgtgagaggaggaaaagggacaccaaggaggccagaccagagtttgaatgtgttcatttttgaaatgttcaatgaagatcttaagcaagctggaattgagcacaactttggagtcttctatcccaataagaaaccagtgtatccgttgttttaa

SEQ ID NO: 39896 - DNA, 1856 bp, Glycine max
  Peptide Sequence Number=SeqID_156674
atgaggttgaggtctttgccacatttacagtgtctcatgctgctacgactatggtgccttgcgttgttaccgtgtggccaaggtggtcatggcaacaatgagagaaagtgtgggccatgcgccgccgctgctgaagctggaggattttttgggcaactcctccatcgtgatgtgttactccaatcaccatcaccacttagcaatcccatgcttctgccgttggattctggttctcggagtagcttgaatgaagttgcttcaaatggccctaatcaagaaggagaagaagaaggggctgcgccctctgcgtctttttcgagtgctgaaaacgttaagctcgaacattccggtgtctcggtcggaggagacgcgtgggaggaatatgtaatgttctgtcttggtgattctttgctgtttatggccagaattttaaacggcgctttctttgacaacctccagtcttctgttcatgatgtttctagagctgtttctatctcagacatgcagaaagattggtgtgatctgttcgcgcaaggcctcgcggctcccaacaaccttgccgttgtcgcttccgtttcagtcataaacgctccaaacgcgcctgccaccactccaatcccagaaccgcttgcgtttaacaacctcgtcgacgccgcttctgctcccgccgccatcaaacctcacccaccctttcgctgcaaagtctatggcgctcgcggagcagctcaagaagaagagcgagtgacgagttgcagatctgatcttcgcggccttcccctttggtgcggaaagttgaagagaagagcggcggcgccgattggaggagaggcgagcgctgaagcaggaaccgcaacaacgggacgtgggtgtcaagttccagtggtggaggcgagtttagtggcggtgtttttggtgtgtgcagcggaggagaggaggaaacaaacctacaccatggatcgcaagaacccgaggcgaaagcccaagctcgagcgccgcaacgctcttaagtactcctcctccgaatacgacgccggatcgtccccctccgacgacacgctctacacgcgctccatggagttctacgaccgcacgagtttccgaatcgagggcgtcgaaggcgagttcgatcgaatttgccgcagtttgggcctctccggcccagaggacttcgctattcccgctgcggcgtgggaggccataaagtttcgctactcttcggatattctcccgagactgaagctcgataacctcgatattcccgaggaggaggaaggtgaagaagaattgaaggtaaacgaggatataatagttaattcagtagaggaaggtaaattgagtgaaaaacacggagatagtagtagtgttagggttagggttagggttagggttagggagatagatgaatcgagcactggtattaaggggactcggccaccgatgctgaagccgccgccgggggcgagggttcaggtggtggatgatagcacgtgttccacgtgggaccttttgagggacttggctcctcaaggggaagaagggttaccgttgaaccgttccgagaatgagagtgaagtagcgagagaagtagagagaggagcggtggagaaggaagaaggggaagttggtactagagagagtccgaagagggaagaggaagagaatgtggctgggctttcggagtcgtgttcgttttctacttccaacgaagatgattcttcgagtagtactacggaccctacgtctaataatatttctccgcaagggagaatcaaacggattattaccgccgaaagctggcagaagggtgagtttctcgggggtggctcgtttggctctgtttatgaagggatttccga

SEQ ID NO: 39897 - DNA, 348 bp, Glycine max
  Peptide Sequence Number=SeqID_156675
atggcggcgggagcagaagcggcgtcgacgaggttgttaaacgcaagcggttctgggattggagtggtggcaggcgcgtttggagcgtttatgactgaaacggaagcgacaacggcaaggttgttgggagccgcgaggccttgcgcgaacagatctgaaacagatcaagttaaattttctttggttaatcttggatctggaaaagaacaatattcaactatgttagtggaaaattatttgacgaaagaagtgacaagttggattgtatttttcttcatcccaaattcaaatgaaggttcagaaagtttgatgtttccatttctaacactctacacatttgacgtataa

SEQ ID NO: 39898 - DNA, 216 bp, Glycine max
  Peptide Sequence Number=SeqID_156676
atggtggtgcaacaggtgaggacaactgagcaaaattctaccactgaaggatgtagactcgaaaaggaaagtgttagccatgcaaaccctaaggctaatttggtggctaacggaaacgtgagtcataatagaatgaatttgaatttgctgggggattctgaacctccagatcctatggttgaggtggaggtggaaacatctaatacaccattttaa

SEQ ID NO: 39899 - DNA, 378 bp, Glycine max
  Peptide Sequence Number=SeqID_156677
atgggatggatcttcaagatatctcaattatttgattatcaccatacgacagatgaagaacacatcaatgttgcctcgttctatatggacgggccaacattaagttggtatcaatggatgttccgcaacagcttcatcacattgtggacatcactcctgcaagccttggagacatgcttcacgccaatgttttatgattatcccaaaggtgctttgttcaagctcacccaaacaggctctgtcaatgagtacttgcatgagtttgagcgcctgttgcttcatctccggcctggtgccgaaattgcaccatgtggttcaggcattacaacccatttcactgcctcaggctatctccctcgccaagttgcagaaggataa

SEQ ID NO: 39900 - DNA, 369 bp, Glycine max
  Peptide Sequence Number=SeqID_156678
atgaagccaaagaggcaaagtgcatcggggtggaagtgcctaagaagtgcattaaagctaatctgggctagggtggggtcaggtggggttggttgggaaataatgggggtgggtggcggtgaggtggtgtcggggtcgggatcatcctcgtcgacaatgagtaaaaagaagcgtgctttgcatttgtggcacaggccatgctcatgctcacgggccatctcttctggtgtgaggcggcgaatctgggagcagttggtagtgggtggcttgggtaaaggtgagggtaagggtgatggtgaaggtgaaggtgagggggagggtagcagaggtgggggtggtgtgggaacggcgggagagggtgggttctga

SEQ ID NO: 39901 - DNA, 687 bp, Glycine max
  Peptide Sequence Number=SeqID_156679
atgaggcttccttctaaaatgaccaaagaagagatagacaaagtggtggaagaaaccatagtggaaatgggtctggaagattgtgcagatactaggattggaaattggcattgtaggggtattagtaatggtgaaaagaaaagacttagcattggccttgagattctgacacaaccatatgtcttacttcttgatgaacctactactggacttgatagtgcctcagctttctatgtgattcaatctctgtgccacaatgctcacaatggaaagatagttatctgttccattcaccagccaagtagtgaaacttttaatatatttgatgatttgcttttgctttcaagtggggaaactgtttattttggagaagccaatatggctctaaagctatcttcatctaattcagcactgggagcgaaaaaagccgagattagagagacactcattcgaagttatgaaggttcaaggctaatgatcaatgcgagaagaagaattcaacaactgaaagctaatgaagagcaagaaattaaggccaagataggtagcagtgccacgtggtggaagcagatgtgcacattgaccaagcgatctttcctaaacatgactagggacattggttactactggctgaggatagtattctacatactggtggaggattaccatttttcattgaagaattga

SEQ ID NO: 39902 - DNA, 300 bp, Glycine max
  Peptide Sequence Number=SeqID_156680
atgacccacacgccacacggagctcagaggggctgcgatagtgaagttgtagaggtgaaggtgctgtgggacctaccgtgggaattttcaaagcttctcagaatctcactcacgaggaatttgtctgtacattttctcttaattacacaaatacctatgcctacaatacgaaaacggtgcttccagaaaaacatcgttgaaaatgtaacatatttacaaaattgtcactgcccccctactacaacggtcatattgtcaccgacctcgaaggtgcatcgtagaatcgcgtttttgcagtag

SEQ ID NO: 39903 - DNA, 219 bp, Glycine max
  Peptide Sequence Number=SeqID_156681
atggttaccaccatgtttttcgaaaccattgtggcaacgttggatggatcggcgccattggattctttgattcctccagcgtgtggcatgccacatgctcctgtggtgatggagcttccgtggggaatggcttgccaggcttggtgcatggtggagagagaagtgtgggaggagggtagaggtggaaatataaataagggtggtggggactattcttaa

SEQ ID NO: 39904 - DNA, 1920 bp, Glycine max
  Peptide Sequence Number=SeqID_156682
atggactacagagccctcaattcgatcaccatcaaggatcgcttcccgattccgacaatcgacgaactgctcgatgaacatggcggtgcacgttggttctcgaaactggatttactgaaaggctatcaccaaatcctcatggcttcggcagatgtgagcaaaactgcattgaggactcatcatggtcactatgagttcctggttatgccctttggcctttgtaacacaccttcttcattccaggccacaatgaacacgacctttgttccttatttgcgtggaagttgtccttcaatggccgataccacagtcagtcagagccttacatgggtttttaggcctttcgtgcttttaccgccgcttcatccaaggctatgccaccctggcctgtgtaaggctctggttttgagactatcgaacttctccttgccctttgtggtagggactgacgcctctggaatcggtatgggagcgattttatcccaacaacatcaccctatagcctatttcagcaagcctttttgtccaaagctactccacgcatccacctatgttcgagaactagcgacgatcatggcggcaatcaaaaagtggcgtcagtacctactgggccaccaattcacaatcctcacagaccacaaaagtcttaaggaactcatggcacaagcaatccaaactccggagcaacagacatacctcgcgcgcttaatgggttatgattatacgattcaatattgcgccagcaagacaaatttggtagcggatgccttctcccgacgaccggagatcacttccgggagttttttgatactaacaatcccaaattgcatgtttttgcaaaacttgaaggcagagctatcaaccaatctagtgtttcggaggtaccaccagaagatctttgacgaaccctacaatcactccaactgtcttttctggcaagatttaattttgcagaaggggcacatctggctactacagggagctccgtccatctcgactatccttgtcgaatttcactcaacacccaccgcaggacacatgggggtcatgaagacattaacacgggttcgcgagaactttacctgggcaaatatgaaaaacggcgttcgccaatatgttgccaactgcatttcatgtcaacaatcaaagtatgatcaccgacactctccaggattattatgtcctttgcctattccgacgcggccgtgggaagacctttccctagactttattgtgggactaccaaactttcagggtcattcgaccattctggtcgttgtagaccacttctcgaaaggagttcatttgggcatgttaccgacacagtactcagcttccggcgtggcaaggatgttcatggacatcgtcggcaaaatccacagcatgcctcgaagtttggttttagatagggatccccctctttgtgagtcatttttggtacaagctaagcggcacgaagctccgcatgggctcagcataccaccctcagaccgacggacagacagaggtcatgaaccgtgtcatcgagcagtacctcagagcctttgtccattagagaccatccacatgggagcgattcttgatatgggcggagtggataatcaacccctcacaatcctcgacacaaaatgggaacagacagcttcgggaagacaattacttgtcctagttcaatggacaggattacttccagaagacacttcatgggagaagtgggagaaccttaaaaaggattacaaccttgaggacaaggttgttttggaagctcggagggatgttatgaatgaagacacagagcaagatgcaacaacagagcatgaggcagaagcaagagaagaaggtcaaaaagggaaattagtaagccccagtaccttaaggattatgcaacaaaatgaggctaagctggcaatgatcttctag

SEQ ID NO: 39905 - DNA, 1518 bp, Glycine max
  Peptide Sequence Number=SeqID_156683
atgaccaaagaagagataaacaaagtggtggaaaataccataatggaaatgggtctggaagattgtgcagatactaggattggaaattggcattgtaggggtattagtaatggtgaaaagaagagacttagcattggacttgaaattctgacacaaccatatgtcttacttcttgatgaacctactactggacttgatagtgcctcagctttctatgtggttcaatctctatgccacattgctcacagtggaaagatagttatctgttctattcaccagcccagtagtgagatttttagtctgtttgatgatttgcttttgctctctagtggggaaactgtttattttggagaagcaaagatggctctaaagataccaacaaattcaacaattggaatgagaacatcagagatcagaaggatacttattcagagttacaaaagttcaaagctaatgatcgatgcaagaaaaagaattgaacaactgaaacccaatgaagagcaagaaattaagccctacataggtagcagtaccacatggaggaagcaattatatacattgactgagagatctttcctaaacatgactagggacattggttactactggctgaggattgtattctacatactggtaggaattactattggcaccctcttttttcatattggcacaggaaacaactcaatcttggctagaggaaagtgtgtatcattcatctatgggttcatgatttgtttgtcatgtggaggattaccatttttcattgaagaattgaaggttttctatggtgaaaggtccaaaggacattatggagaggctgcatttgtagtgtcaaacatcatatcttcattccctttccttgttctaacatcactctcctccggaataatcatttacttcatggtgcaatttcatccgggtttatctaattgtgcatttttctgtatcaacttgttctgctgcctatctgttgttgagtgctgcatcatgattgttgcctcagtggtccccaatgtgctgatgggcataggaacaggaactggtgtaattgtcttcatgatgatgccctctcaaatattcagatcattacctgacattccaaagttcttctggcgctatcccatgtcctacctcagttttgctgcttgggcagttcagggacaatacaagaatgacatgctgggggttgaatttgatcctttgctgccaggagatgttaaagttagtggagaacaagtgctatcattggtatttggtgttccattggatcataacaaatggtgggacttaacagcattggctaccttattattagttcacagattggttctttacttggtgcttcggtttgtcaaaagagctcaatcacctaaactgtggttctatgccaagaaaagtttacactttgcaggaagatgtttcttcagtaagaagccatctatctcttccaggaaacaagctcagcatccattatcatctcaagagggtctaatgtccccaaaccttgcaatataa

SEQ ID NO: 39906 - DNA, 175 bp, Glycine max
  Peptide Sequence Number=SeqID_156684
atggtgatgatatgggaagatgtaacagttgagaggcctgaaagttttggagaacacaataacaataagaagttaatgctgaatggaatcactggttttgctgaacctgctaggattatggctgttatgggtccttctggctgcggcaaaactacctttcttgactctttcactg

SEQ ID NO: 39907 - DNA, 894 bp, Glycine max
  Peptide Sequence Number=SeqID_156685
atggcagcagctgcaccaccacccaagccggaagagcttcagccacaccctgtgaaagatcaacttccaaatgtttcatactgcatcactagtcctcctccatggccggaggcgatactacttggtttccaacattacttggtgatgcttggcacaactgttctaataccaaccactcttgttactcagatgggaggaggaaatgaagagaaagcaaaaatggtccagactctgctgtttgttgctggcataaacacatttttccaaacactatttgggactcgtctacctgcagttattggaggatcctgcacctttgtgccaactaccatttctatcatttttgctggtcgctacagtgacattgtgaatcctcaggagaggtttgagaggataatgcgtggaacacagggtgcgcttattgttgcttcgaccttgcaaattgttgttggcttcagtggcctttggcgcaatgtagtgaggttcttaagccctctctctgctgttcccttggttgctctgtcaggctttggactttatgagttgggctttcctgtggtattgatatctgcaacaagaactagtccttatttctttcctacatcttgcaaaatgtgtggagattgggctgccggaaatcgtattcttactagtattttcacagttatattctcagtgacaattgtgtggatttatgctcatcttctcactgtgggtggagcatataaaaatgtaccacagacaactcaagagacttgcagaactgatcgtgctggaattataagtggtgcaccttggattagaatcccatatcctttccagtggggagctcctacatttgatgctggagaagcttttgcaacgatggctgcttcatttgttgcactagtagag

SEQ ID NO: 39908 - DNA, 132 bp, Glycine max
  Peptide Sequence Number=SeqID_156686
aagattaaggttttgaagtttttaggatttatgtggaatcctctttcatgggtcatggaagctgcaacaatcatggccattgctttggccaatggaggaagtatcatctcgggcagctcaaggcaaaactag

SEQ ID NO: 39909 - DNA, 303 bp, Glycine max
  Peptide Sequence Number=SeqID_156687
atgggtggcggcgccgccgcgtcggaaaaagaaactcctcctttttttaaaaaactacatgttttaggccgcgtgagtgagtgggttactgtgtttgctgtgtcggtggttcacggaggaggagggtggcggttctttgtaggcttggccgatggtggtggttctcggaggaggaaaggggctgagtggtggctagtggtggctcttggctgttccggcgctttgactgtctgtattcccctttttctctctctctctctgacatgcacagtaattaatgcagcatttaaaggacctaattag

SEQ ID NO: 39910 - DNA, 667 bp, Glycine max
  Peptide Sequence Number=SeqID_156688
gtatgcaagtgcaactccaatgccaccttcagttcttagccgtggtatcggttggcagggggtaggaattttgttatcagggatctttgggacagggaatggatcatcagtttctgtagagaatgctggactcttagctttaacgcaagttggtagccgcagggttgttcaaatatcagcaggattcatgatctttttctccatacttggaaaattcggagctgtgtttgcttcaatcccagcaccaatagttgcagctttatattgccttttctttgcctatgtgggttctgcaggcctcggtttccttcagttttgcaatttaaacagctttagaactaaactcatcttggggttctctattttcatgggcttctctataccacaatacttcaatgagtacactgcatttaagaactatggtcctgtgcacactcacgctagatggttcaatgacatgatcaatgtcccattctcatcaaaagcatttgttgctggctccttggcactgttcttggataccacattgcacaacaaagacagtcaaacacgtaaggacagaggcatgcactggtgggacagattcagttcattcaagacagatacaaggagtgaggagttttactctctacctttcaatctaaacaagttctttccctctgtatga

SEQ ID NO: 39911 - DNA, 810 bp, Glycine max
  Peptide Sequence Number=SeqID_156689
atgtcagggctgaaggaattgctgaagaaagggttaggtttaggcgacatggcgttcaacgccggcggcggagccataacctggttccccggccacatggccgccgctacacgtgccatccgccaccgcctcaaactcgctgacctcgtcatcgaagttcgcgacgctcgcattcccctctcctccgccaacgccgacctccagccacacctctccgctaaacgacgcgtcgtcgcactcaataaaaaagacctcgccaaccctaacatcatgcataaatggacgcattattttgagacgtgtaatcagaattgcgttgcgatcaacgcgcacagcaagagttccgtgaagaagcttctggaggtggtggagttcaagttgaaggaagtgatttgcaaggagccgacgctgcttgtgatggtggttggtgttcccaacgttggcaagtctgcgctgattaactctattcatcaaattgccaagtctcgctttcctgtgcaggagaagatgaagcgcgctgctgtgggtccgctacctggtgttactcaagacattgctggattcaaggatcttgtaatgcaagttcagcgtgcactctattcaagtctatcagaattcaatgggaacgtagaagatgagagtgacctggagagccttattgacctgcaatttagtgcactacagaaggcattgaagatacctcacaaggcttcagaagcgcggttaatggtatccaagaagttccttactctattcaggaccggtaagcttggacctttcattctagatgatgtcccggatgtcaagcct

SEQ ID NO: 39912 - DNA, 1053 bp, Glycine max
  Peptide Sequence Number=SeqID_156690
atggaggatggttcaagaaataggactcatttcaacatggcttcaagaaaagctgaagaatctgcttggagacgctatgaggctactcagtggctagaaagccaagtgggtcctcttggtataccaaaccagcctacagagacagaactcatttcttgcttgagaaatggtttgattctttgcaatgccattaacaagattcatccaggagcagtgcctaaggttgtcgttgtggataatcaagtgccttcacaatcacttgcctgggattctcagcctttgcctgcctatcagtattttgaaaatgtacgcaattttctgtttgtgatggaagaattaaagcttccggcttttgaagtttctgatcttgaaagggataatctagagatgggatcggcagcaaaactcgttgattgcattttggcacttaaatcatttcaagagttgaagcagatgaacaaacagaatggatacaacaaacacataaaatctcctttgcctatgagaatgcattcaagagcagctgcattctcctttgatgcttctaggcacttggatttgtctgccacattgactttgataaactgtccttgtattctcatgtgcacttgtataattgcatttttcttgctactacctttgctggatccagcagagattgtggaattacttgccaagcaactggttgaccttatgtttgatgccaaagaaaatatcgatggaaacatcattgcttctctccataaagaacacctggtagcggatccaataaaggtatttaatcagataatggcatgttgtaatggggaacagccacctacaaatttcaacgagttgccattgcttctaaaggattctgtaaaagaaaagggtaacttaccacctcattccatttcaacacctacgcaatcagatgctttatctgctcctgacagttctaagcatggcgaagcttgcctcagaaagtgcaagtgcaatcaggtgcatcttttagacatgcaggaaaaagaacttctggtaggcattttttcatcttgtttacacttaatttaa

SEQ ID NO: 39913 - DNA, 1407 bp, Glycine max
  Peptide Sequence Number=SeqID_156691
atgaccctcatcaaacttggtgaggttaatcgtgccgtcagttcgactgcaatgaacaataggagtagtcgttcccacagtgtgcttactgtgcatgttaatggcaaagatacatctgggagctccattcgcagctgcttgcacttagtagaccttgctggaagtgaacgggtagacaagtccgaggttacaggggaaagactaaaggaagcacagtttattaacaagtctctttcctgtttgggagatgtgatcacagccctggctcaaaagaattctcacatcccttataggaacagcaaactcacacttcttttgcaggactccttaggtgggcatgctaaaacattgatgtttgctcatgtgagtccggaatcagattcatttggtgaaacaatgagtactctaaagtttgctcagcgggtttccactgtggaactgggggcagcccgtatgaacaaagaaagcagcgaggttatgcatcttaaagaacaggttgagaaccttaagattgcattggcagccaaggaagctcagagggtaacgttccaaagaattaaagaaccacacactccatcagagaagtcaacactggtgtctgagaaaactccattgcgcccacgaagacttagcattgagaactgcagcgctgtaaagactgacaaacccgtgaatcgtgaggatagaggtggagtcaaatcaccacttttgttacctcgcttgagaagattaagtttggaaggttcaaaaactatcaagagagatagtctactaccaaaagtatcagataatgctgtaagcaaagctttacagtacgagcgagtgtctcagcagaaatatcacccaatgcaagatccagaatcagtgtcaaaactaaatggccatttcagcagtggcaattccaggtcagagttgcatgccagaacccctcaaagtccaacaagcatttcctatcaaacgagattgataaaagtaaatggtgggatgcaagttcatcctcttaaactgcccaaaacacctgaaccaccagtggtggatggaggcgatgcacatggtactaaggtgatgggtagcacaaatggaaaaggatcgcagataagaagatccttgagaacaattgggaaactgataaatggccctgataagaggagccaacaaaatatggttgaagtcaagtcacccgtcaagggcactggctatacaaatcatcttgtaaaatcaccaatttcagctgttgagaagactaaaaggaggcaatctctaacggggattcaaccaccactgccaaacaactcccgtagaacttcacttggagggaagccagtagtagcatatgacaaggacagaaatgctagaactcctcctccttcccaatcagacagcaagactgcgaaacggtggctgtag

SEQ ID NO: 39914 - DNA, 267 bp, Glycine max
  Peptide Sequence Number=SeqID_156692
atgaaaacaaaaacagaacctgtatcaagagctgaagctctgataccagatgatgtgatcctgactaggagcggatctcttaatacaggctacggagatttggatgactccacttctagtgaaggaagacaagtcagggtagacgccccaaggattaccttgataagtctgagattggttcaacaaggaacccagagagaagctctcaccaaattttatgaaaatgcaaaaagttcctttattggaaacaaaaaccaatacttatag

SEQ ID NO: 39915 - DNA, 184 bp, Glycine max
  Peptide Sequence Number=SeqID_156693
tcctttcgctaagcgcgagcctcgcgctaagcgcatatttggtcatgcactaagccgcgagtctcaagcgcttagcgctcaaccattgcttctgaggctaatttgctctgctaagctagccaaggatgagctaagccaacttcaattcaatctgaattcggctaagcttcagcttgatcgctaa

SEQ ID NO: 39916 - DNA, 228 bp, Glycine max
  Peptide Sequence Number=SeqID_156694
atgggattggtgcaactaaatgtgtcttatgatcaagaagcattctattatagagaagcatttcgaggctctatttctaaaggcggagagacgagtaacgttttggttaaactcatctccatgaagtacaagggcaaagaaaacatcaaggagtacattatggaaatgtctaatcttgcatcgaaacttaagtcacttaagttagagcttggtgaagacatgctctag

SEQ ID NO: 39917 - DNA, 294 bp, Glycine max
  Peptide Sequence Number=SeqID_156695
atggtatggtccctcaataagcttatatctcactatgttcaagaggaagagagactacaaagagataggactaagagtgcttacttgactctaacctatcaaaataagaaaaggaagaagattaaggatgttgtggaagggtcttctcagcaaaggaaacaaaagagggttggggaatttacctgctacttttgcaagaagtcgaagcacatgaagaaagggtgtccagatatttggtggatggattctggtgctactactcacataagtatgtctttacagggttgcctataa

SEQ ID NO: 39918 - DNA, 117 bp, Glycine max
  Peptide Sequence Number=SeqID_156696
atgtttgctagtgcccctggactgtggaacaaaggagtatcccgaacctacaccgaggtattgacggcgattctcaaatatcgcagaacagaacagaatgggattacgatgagatag

SEQ ID NO: 39919 - DNA, 159 bp, Glycine max
  Peptide Sequence Number=SeqID_156697
atggggaccaccaaggttgaagaccgaagaatgacgaagaacgaacgaaagatggcggaaaatcttcacggaatcacccacggaaatgtttcggacgcgttacggaagtgcctcgccttggattttcttcacggaaacgattttttcactaatttctag

SEQ ID NO: 39920 - DNA, 384 bp, Glycine max
  Peptide Sequence Number=SeqID_156698
atgtcgttaagaacttacaacatcggttttaaaataaccgatgttaaaattcgcactaaatttagttttaacatcggttatttgaaaactgatgttaaacccagtgcaccaacaagtgccccgtttgctcatggggtattctccaaaaagctagagcgcacatcaaaagtagcatcggtctgcaagtgcttggtgttgaggacattgatgacaaagtcaaggtctgtgatgaaggttgggaacaaggttgtcttcaaccttttgttagctacagtttttttacctgcaaggctccatgactccacacaaggaggtttgagtatgggtccaactataaggggaggcgaatgtaataagtgcgaaacacggggaagacgagtgtaa

SEQ ID NO: 39921 - DNA, 963 bp, Glycine max
  Peptide Sequence Number=SeqID_156699
atgacatctgcacattccaacacgtctgcttacgatcacctgcgcgccctgttcagccggctgtcgcgtttcggccacctgtccgccatcgccggttgggacatgcaaaccatgatgccgccgggcggcagcaaggcgcgctccgaagcgctggccgagctgagcgtgctgcagcaccagattttaacggcacaaagcaccagcgcgctgttggatcgcgcgcagcaagagacgctggacgaaatcgaccgcgccaacctgcgcgaaatgcgccgccaatatgaagacgccgtgctgctgccggccgcgctggtcgaagccaaatcgctggccggcgcgcgctgcgaacacgcctggcgtgcccagcgcccggccaacgactgggacggcttcgccgacaacctgcgcgaagtggtcaagctcagccgggaagaagcgcagatccgcgcgcaggcggccggcaccagccgttacgacgccctgctaaacctgtatgaaccgggcatgcgcagcagcgatctcgaccgcatcttcggcgatttgaaaacctggctaccggatctgctgcagcgcgtggtggccaaacaggctaacgagccctgccaggcgccgcagggtccgttcaatgtggacacccagcgccagcttagcctcagcgtgatgaagctgctcggtttcaacttcgacaacggccgcgtcgacgccagcgcccacccgttctgcggcggcgtgccggaagatgtgcgcatcaccacgcgttacaacgagaaagagtttttgaccgcgctgctcggcatcgtgcacgaaaccggccacgcccgctacgagcagaacctgccgcgcgatctgctcggccagccggtcgccctggctcgctccaccgctatccacgaatcgcaaagcctgctgttcgaaatgcagctggcgcgcggcaatgaattcctgaagatcttgcgtccgttg

SEQ ID NO: 39922 - DNA, 435 bp, Glycine max
  Peptide Sequence Number=SeqID_156700
atggctccgagaaagtttcctacaaagagatccaggaaggacaaagcggctgaagggaccactgccgctactgagtacgacagccatcacttccggagtgctgagcaccagcagcgttttgaggccatcaaaggatgccagttcctgggatactctttagtgctggaggagtgcatggagtgcgagtatggccagaggaggaaccgggccgatgggtttgatgaggaggccatcgcccagttgctgtgcataccgggacaggattttgctcggaccgctgccgggagacgggtgcgaatcatgcgcaccaacatgactaccctgactcagacatggatgacgttgctgcttagcaacatcctgcccagcgatcataattccgacctccctctgccgaagtgtcagctggtatgccacctaccaggcaccctctag

SEQ ID NO: 39923 - DNA, 444 bp, Glycine max
  Peptide Sequence Number=SeqID_156701
atggctatagtcttcctattgatatatggagtttgggatgcacaattcttgaaatggcaacatcaaagcctccttggaatcagtatgaagggcagagatatgcctgaaattccggatcacctcttaagtgaggcaaagaatttcattcagctatgcttacaaagagatccatcagcccgcccaacagcccagaagttaatagagcatccctttattcgagatcagtcagcaagaaaagctacaaatgtcagaataaccagggatgctttcccctacatgtttgatggaagtcggacgcctccgagggttccaaatgattttgccaatgcaggaaagtctggaatctggatggattggataaggaggcttaaagtagcattaggtgcagccaggggcctggcctattttcatgaacttgctgacccacctatcataacttattaa

SEQ ID NO: 39924 - DNA, 426 bp, Glycine max
  Peptide Sequence Number=SeqID_156702
atgagtgtagagcagttcattgagaaagtggcctggcctggagcccgaccttcttttgtgggggatactgaaagttttacaaccaaggcacctcaacaaagattagagacgagatataatgaggctgctcatcctagaccagtgccagcatcagctgatgcaccatttccaggagtggatccatcttcacctcagtacgcagcagactcttccactcctgtcttagagatacatgagggccagaccatactagtcctgcctttagacacttttcctccagctactccaagagaaagtgatgaaaagcgcaaaatcgacctcatcattgttggggacaactttgtggaggatgaaggtgatggtagtgccaccgataaaggaaaagagattccaatagaggtgagaaggtactcaggaaggagatag

SEQ ID NO: 39925 - DNA, 441 bp, Glycine max
  Peptide Sequence Number=SeqID_156703
atgaatggcggaaatggaaccactccaacaatggtgtcaccaccttcaccacatagctcatgtcggtccactgagcccaaccaagaggacaacaataacaacaacaatgacgatgacaataacaacaacaacaacggcgacaatgacaacaaccataacaacaatgacgacgacaacaacaacatcatcatcctcaacaacaacaacaaccacaacaacaacaacaacaacaacaataacaacaatggcgacaacaacaacaacaccaacaacaacaacaacaacaacaacaatggcgacaacaacaacaaccaccaccaccctgaagctccttccttggtgctagtagggtgccctcaatgtcttatgtatctaatgatctctgaggataacctcaagtgcccaaaatgcaaaagcattaatttgattcattttacctaa

SEQ ID NO: 39926 - DNA, 444 bp, Glycine max
  Peptide Sequence Number=SeqID_156704
atggatccctcgacatacatttttccttcttctaccaaagaaccaaagaaaaaggacaagaacaaacacaacgatcataagcttaaggatttcgaaccctccggtcatgcgagtttgaagaagatgaagcaacaaatgctgtatttttcgactgcttatcgtttggccaatatcttagccatgactaatggtggttcctttactaatgagtttgtgttgagtcatttgattgatttgaagctaatctcagatcatggtcgttgtgtgctgaataagagtgacgacaatgctaattgggtaactttttgggcctttcaagctcaagcgccgactatcgcacaacatctcaaaggctcttcaatggtcaacaagttaaaggttgatttgaatgatgatgaggatgacgaggtgcatggagctgatagatgtgatgaagaccattag

SEQ ID NO: 39927 - DNA, 525 bp, Glycine max
  Peptide Sequence Number=SeqID_156705
atgtctcggaacttcgcgtattgtgcaacaaagggtgccaagtacctcgaagcggtcaaacaaagaggcttgaaaagtgcaagaaaacgggctgtgttttctgcgttttcaagaaaacgcgatgaactcactaagcgagcatgctgcgctaagcaagttcatcaatactcattttatatggcctctaagaaacataagagtagtgattctagaccacaggatcagaatgataataggagatttcaatcagaggaagcctggaaccgatatatcgataatattttagaccgaaggatcctttcgaaaatgaataattggaggcgaaaccttcataaacgtctcaccaagcttcatgaaggaagcatagatgtggcagtggttaaggaattctatgccaatttctatagtccagcagatcaagctcctaaatgtgcaagaataagaggtcatttaatcaagatagatgcagacagcttaaatgagttcctccagacttcagtgttattagaggagggggaatcttaa

SEQ ID NO: 39928 - DNA, 489 bp, Glycine max
  Peptide Sequence Number=SeqID_156706
atgggttcatcagaaggttgctcgagggagtccgaggagtcaggtttcagtgtcagggatcctacaaaagaggtatttgaggtgtcctcagattctgattcattagggtcatattcaactaatttttctacttttttggatagcttgtcggagcaagtggtagataacattactcacatagtggatagcgtttttggcaacactactactatcgttgatgttgcattcggatcttcaagaaatatgaagagaatacctcaagaaaagaggcgagtagaaaccgatcagagagcatttgcggagaaggagtatccgcctattactcttcccagattcgcatgggtagacggggaagtaggcaccttcttctctcggtacaatgataattcggccattgagaatcttctcagttggcttaccattttctcaataaagaaggagctttgccttatcactttgaggacacgttggattgatgtggacgcttag

SEQ ID NO: 39929 - DNA, 474 bp, Glycine max
  Peptide Sequence Number=SeqID_156707
atgaaacgaggaatcgaccttgagatggatttcgccgacgggcttgcggcgatggttgacgtgagtggaattgcggttgcgagaaatcatgcgcgcggattcgtcgccgatcactttcgatcccttctcggtttcggagttgacgacgatcttgtcgggaccgtgaatcttgtagtaggagagaacgccgtcctggagcacgaaccagcgcggcctccatcccttcccgtagttcacccacttgtgcagaatccccgagattccgttcccgacgaggtcgttgattctgacatccaccgccggcgccggagcgaggctcgtgcggccgctctcgccgccgttggagaggcagaggtggagttgggagggacggggggcggagtcagatctcgcggcggcggcggcggggagagggggcatggcgggggaggaattgtcggagacggcggagacgcagcagaagggatgcattaa

SEQ ID NO: 39930 - DNA, 495 bp, Glycine max
  Peptide Sequence Number=SeqID_156708
atggttctacttggttcgagcaggattgcttcttgtctaggatatgtttcgactattcgagagagcagatcagatgacaagaggttttccattttcactgggactaagagactccacttgagggccgacactcgggaggatcgagtggcatggatggaggccctgcaggctgtgaaagatatgtttcctcgcatttccaacagcgagctgatggcaccggtggacaatgtggccatttcgactgaaaaactgaggcatcggcttgtggaggaaggtgtaagtgaggcagctattcaggacagtgagcaaattatgagaaatgagtatgctgcgctgcaaaaccagcttctgctgcttaagcagaagcaggtgacactgattgacactctgcggcaattagaggtacatttaatgaaaagtagaaaacttcatgccaatcaaactggctattcttggtggatttctactattgcacagaaagctggtaattcttag

SEQ ID NO: 39931 - DNA, 1572 bp, Glycine max
  Peptide Sequence Number=SeqID_156709
atgtatcggttgaaaggagacactagtgagattatatttctgggttgcatttatttatctgtgttgctgcaaaagttttcaaccagtttaaaggccaagcgtgcaaagacagaaaaggttgatctggagaacactgttgttgacgagagccaaagacagttgaatgatcaagaggcatcctctagattaaggcaggaaaaatctagcgaagcaagtgcaagtgagtctgaggatgataatgagagaaatgatgcagttgaggaagaaacagatgaagatgacactgccttttttgacactcgtgattttctatcatcatccaattcttttaaaagtaatggatctgatattagggtctcttctttctcttcagatgatgatggactctatacagttgaatcagaggaggatgtagatccttcaattagatctgttgtaaccaactatccttatgttaaacggcgtaggaaattgcccaaccctgttgaaaaggagaaaggtgtcagcctttggtcaatgattaaggataatatcgggaaggatctaactaaagtttgccttcctgtttattttaatgagcctctctcgtctctgcaaaaatgttgtgaagaaatggagtattcatatcttctagaccgagcatatgaatggggaagaaggggtaatagcctcatgagaattctcaatgttgctgcgtttgctatatctgcctatgcttcaactgaagggagaatttgcaaaccatttaacccgttgctaggggaaacatatgaggctgactttccagataaaggctttcgatttttatcagagaaggtcagtcatcatccaatgatagttgcatgtcactgtgagggtacaggttggaaattttggggagatagcaacttaaagagtaaattttggggtcggtcaattcagcttgatcctgttggcattttgactttggaatttgatgatggtgaagtatgccagtggagtaagggaaatcaagactactcatgtaaactgaaattcaaggaacaatctataattgaccgaaatcctcaccaggttcatggtattgttcaggatagaaatgggaaaatattgtctacattactcggaaaatgggatgacagcatgtattatattaatggagactatagtgggaaagggaagggttatgaatcgatgtcagatgcccatctactatggaagcggagtaagcctcccaagtttcccactagatataacttcactcggtttgccatcacattaaatgaacttacccctggattaaaggaaaagctgccacctaccgattccaggttaagaccagatcaaaggcatttggaaaatggggagtatgacatggcaaattcagaaaagttgcggctagaacagcggcaacgccaggctcggaaaatgcaagagagcgggtgggaaccacggtggtttggtagggataaaagcggcacctaccgttacttaggagggtattgggaggcccgaaaacaaggaaattggaactcttgtcctgacatttttggccatattcattctgatcatatttcagacgaaggtcaataa

SEQ ID NO: 39932 - DNA, 225 bp, Glycine max
  Peptide Sequence Number=SeqID_156710
atgtctatcttgatagagagaagtggtgcttcatcaaatatacctagttctggacttcaaagatttggtgtattgtgtcactgcaacttggatgctccattgatgactttgtggattgaggataatccttcaagaaggtttttcgattgtgggctatacaaggtttcaaggagaaaaagatgtgattttttcaatggttcgatcctccgattaatgatcatgtaa

SEQ ID NO: 39933 - DNA, 450 bp, Glycine max
  Peptide Sequence Number=SeqID_156711
atgggggctaaagcaagggatcctttgaccccttttctttttatcattgtcactaaggctttaaaaggtttgataaacaaagttgtggagctagggaggttcaaggcaagagcctcagcctttctaaattgttttgttgcatctctaccttttaaattcttgggaattctagttggaaggagtccaacaagggtttacaagtttggtgtatataaagaggtatggaatagacataacactttattttggagcgacaggtggttaggtggtggtcgtttgatggaggagtttcctcagtcatatcaaattttgatgtggaatagagtgtttggctggttgggtgtttccatcgtgcagcacaacgaagtgcaaagtcattatatgcaacatgatttgatttttaaaggggcaccttgtcaagatgtttatcttatgcaaactagtgcataa

SEQ ID NO: 39934 - DNA, 244 bp, Glycine max
  Peptide Sequence Number=SeqID_156712
atggctgggggcgtgttctctcacaaacgtaaatctcgcgcagcgaacattggaaggaaaatggatgagccgttttattgtttgagacctagtggaacatctgttgcatcagcaccgtttaccccaattgctgagtcaagtgttaatgttccaactccaactgttgagtcacgtgcacgaattcaatctagaacaacaagatcaagtgctcatgtaggaacaacatcatcaactactcattcaa

SEQ ID NO: 39935 - DNA, 186 bp, Glycine max
  Peptide Sequence Number=SeqID_156713
atgaaagtatttacatcaacgccagccacactcgctcaacctgaaggtgaagacggtgcgcttagcgagttggctttcgctcaacgcctctatacagctcatccttcttccagaattgtccatgcgcttagccatcagatggggcgcttagcagatgatgcatttagccagatgatgagtggctga

SEQ ID NO: 39936 - DNA, 306 bp, Glycine max
  Peptide Sequence Number=SeqID_156714
atgaacctgacggcgagttgggcacgaagaactagtgacaacaagctagtgatggagaaagcctgcgacaacgagttgatgacggggcctccacgatgtcgtgggtgctcaaagctttctacgctgccagttaacaagttgattgtgctttacgtggttttcaagcttgacgagagttacacgtcgagcaaagtttccatccgtgccggtgatggttttcacaacttgaaggagattaagaccgtggaactcgtgaagccaactaggtgggtttatctatccttgtctggagttgatcctaggtaa

SEQ ID NO: 39937 - DNA, 474 bp, Glycine max
  Peptide Sequence Number=SeqID_156715
atgcagagcccctgcattggtgatctccaccttcaaggctcttcccccatcatctcacctactccttacgccccataccttcttctcacctattccctagctatatctagaattgtggctccaccctccccccatcataatcacataaccatcatcaccacctaccacttccatactgcactaccaccctatcccatctcctccatgtcgtgcatcaccgccaatccctgtagaagcaagcttcatgatgaatcaagattgattcaaagaagttttgatgataacaaaggtgatgacaaaaagctcaaagaatcaaagaataagttcaagatgctcaagattgaatcaagaacacttcaaggttcaagaggaaatttgatttcaagaatcaagaatcaagattcaaggttcaagcttccaagaatcaagatcaagattcaagactcaagattcaagcatcaagagaagaattaa

SEQ ID NO: 39938 - DNA, 453 bp, Glycine max
  Peptide Sequence Number=SeqID_156716
atggatcaagaggctgagattccaattaaggcattggtaggactcaaggaatttgatggacatgaagagcttcattcagaatttagtggtgatgatgtatgtttggatattcctctcacagcttatggaaactttgttttggatttgcagcagaatattcatgaggatgaccctcttgagtttaggcctgaaaggtttcttagcaatgatcatgagagtggaaaaatgggtcaagttggggtcaggggacaacattatcaactttttccttttgggagtggaataagagggtgtcctggagcttcactagcactaaaggttgctcacaccacccttgctactatgattcaatgctttgaattgaaggctgaagaaaaaggagggtattatggtcatttcttaattaagttaggagagttagaaaaaagtgttttgattattatgaggagataa

SEQ ID NO: 39939 - DNA, 237 bp, Glycine max
  Peptide Sequence Number=SeqID_156717
atggtcgtgatcgaaagtgatgctgaagttctaggccattatggattcactatggccttattggttgaccatgaccctcatgaattaaccacgatcatgcaagatgaggtgtgtctggggaagcttgcttgctttctgcaaaatgcaatcgatgttttcgtcatggtggtgtcccacttcgatgagggtcccaacgacactgtcatcgacgacggtgttgtcgttaaacctttctaa

SEQ ID NO: 39940 - DNA, 498 bp, Glycine max
  Peptide Sequence Number=SeqID_156718
atgactagaaccaagagagttcaagaggactttgagaagaaagaagactcttctccaagagctatagatggcgtccttaatgaaaaagatcaagcactgaagaaggttaagggatgcctgaccctcttgagagttctcactaataaggaccttgacttggaattggacccagaagtaaaggagatactatcttttctccactttcatcataatcctaaatcatccaattttgagagcttggaatggggcaatggccttaagccaaagtcttttgttgagaaacctcttgaattggagttgaagcccctcctttccaacctcaaatatgtttttcttaacccaccatcttttcttccaattatgattactacatgtttacatgaaacaaaggaggagaaattgtcgggttctaagggacaacaaggaagcctttgggtggagcgttcatggcataaagagtttggaccctactatttgcacccacaaaatcaacactga

SEQ ID NO: 39941 - DNA, 672 bp, Glycine max
  Peptide Sequence Number=SeqID_156719
atgggagatacaacatctagagatcaaggatttcaaagcatcttgcattcccatgacaatggcattccagaaattagcattcaagatagcagggtatctgaggcacttcttgactacgaaaggcatacaacaaaaggtggtgagctgaatgtgcctattactcctcttgcagagccaataaatattgaaaatcaggcactaaaatttcctcctttagttgcatatgcattaggctttgcaagtggaactgtgatagctatacttatttgtgtcttacaatccctcttgcctgttcagtctgtccagggttcagcatcatcaggtagggcacggagagatgctgcagcaagggctatgcagggttggcactcacaacgtctccttagcaatggtgaatttagtgatcctattattaagtgtttactttggccttttggttcgtttgctgacttacctgtctctgttggtatgtctggttgggctagatcggacacatctgtggttgacattggacctcctgctgattggaaagattgttttgaggtctatgctttagttcctggccttctgcgcgaagaggtgcgtgttcaatcagacccagctggacgcttggtcataagtggtgagcccgagcattctgacaatccatggggggtgacacctttcaagaag

SEQ ID NO: 39942 - DNA, 435 bp, Glycine max
  Peptide Sequence Number=SeqID_156720
atggaggaacaggcctcacaggattcctttgtcgcccatggacaacaccctggtcgtgtgcgtgctgctggagccaatgtcacgatcaaacaatactttggaccgactccaaggacctcccacacatcttcgtccatggctccgaaagacatggagcagttgacgcaaaaaatcagggaccagctggaggagtcgatcacagaaaaagtgactcgacaagtactcgcactacctcctgagcctgtggatggtcgttcagctactcatgtcagcacaaaggaaaatgttgtcatctggttttgttcgttgcataataggctagacttcctgaaaggaattattatcagaaaaaaaggaagtactgcatgcgagtattacatcatgcaccggatgtcaactataatcttaggaagtttcaagaataattggaaaatg

SEQ ID NO: 39943 - DNA, 2630 bp, Glycine max
  Peptide Sequence Number=SeqID_156721
atggcccacactgcatcagtctctaacggtgctctatcctttaacaccatgattcatatgttgaatatttgcctcaccccatcaaactttatgttgtggcgtcgccaactgcttctcctccttcaaggacaagccttatatggtcatattgatggctccactcctgcccttccttccatgttaacctctgtcgatggttcttcgtcctctaccgtcaatcccgcatttacctttgggaaacaacaagaccaacgacttgtcagtctcctcctagcttccctcacggaagaaaccttggctgaagtcctccattgtgagacttctcaacagatttggactgcccttgaatctctctttggcggtgattttaaacatcgggatatcgcgattcgcgaccaacttctgcatctcaaaaaggattcatcctccgtgcgagacttctccaaatcctttcgtgccctctatgatcaactcagactcatgggtagacctatagatgatcttgataaattgcactggttcttgcgaggattgggtccaacttttaccaacttcggcgcatctcaactagccatgtgcccactccccactttcagagatttagtatttgttgcagaaagctttgaattttacataaatgcgatggaagttgttccttctgaagctgctttctactccaccactcatcatccatcacacttttctcacccacactcctcgtctggagatcgttcctcatctggtgagggtcactatgctaccttctgtccccaacggtataatggtgctcccccatcttctgctaatattgctgaatcctttgttgcgtcttgcaatatttcttttcctaacaactcggattggtacttggataccgatgcttctgctcacatgacgccaagttcttcaacgttggatgccatggaaccatattctggtaatcacaaagttcttgttagaaatggaaatattctgcctatctctcatattggttctcgtcgcttgaattctaccctgcaacttctagatattttggttgttcctggtttgcagaagaacctcatttctattagtaaactcactcatgactttacagttgatgctattttcactaacaactcctttctacttcagaaaaaggacacaaaggaaatcttggcccaagggaggcgtgaacacaacctgtacgttctggagcatggtcaagttgcttttcttgttgttgtctctctgtctgctccttctaaaccatcttcgcaattgtctatgccactattgtctcgcccttatggctcatgtccttcagaagacacttcccctgttgttcttgcgcctccatatgagcctcaatctgatgtggttcatactgttccagcaggtcactctatggtgactcgtgctaaaactggtatctacaaacctcgtcactttgtagatataactacttatcggccatcttctcttttacatgcattactcaccacttatgaacctaaaggttttaaatctgctgccaagcatcctggctggcttgctgccatgaatgacgaactcatggccttacactccaacaagacttgggaacttgttcctcaaccacctaacactaacattggatttactcagactcccgatcttgattatgatcatacattcaatcctatggtgaaggcatcaactgttcgtgctattcttactctagcagtcatgcaacattggccccttcatgaactggatgttaacaatgccttcttgaacgaactcttgtcaaatccagtctacatggagcaacctcctggattcattgatcctcgcttccctcaccatgtttgtcgtcttcgaaaagctctttatggcttgaaacaagcccctctagcatggtttcagaggttcaactccttcttacttcatcttggttttattgacaaaaaggcagatccatctctcttcatctatcatcataacaccgcaactctctaccttcgtgtctacgtcgatgacattattttgaccggcagtaatcattttgccatccaaactatcctagctaaaattcaagccgagtttgccatcatggatctaggccgtctaagttattttcttggtcttgaggtagattatggtgctaacggtatttttctaagccaagcaaaatacgcccatgacattttggacagggcaaaattgttggatgcccagcccattgccacaccttttgcttctggtattcaattgacaaacactggagacccatttcatgatccaaccctttatcgctctcttgctcccaccactgatcatttccaagctatcaagagaatattgtgctatgtcaagggcaccttgtccttcggcctattcttcactcggggatcctttcttcttgttcttggttactctaatgccaattgggcttgttgtgttgagactcgtcactctacctatggctactcgatattcttgggagcagcagagctaatgtggctcactcatttgctgcgtgatctgaatgtttactctgctccccctactcttctttgtgataacaaaagtgctatatttctttcccagaatccggttgctcataagtgtgccaagcatattgatattaactaccactttgtttgcga

SEQ ID NO: 39944 - DNA, 412 bp, Glycine max
  Peptide Sequence Number=SeqID_156722
atggataatatatcaccaatattgtgcaataatgttttaatgtatttagcagggcgtaagagggatgttagtttcctcaccaatcttccaggtgcatccaaaaagctaaaagttttcaatgttgatctcagcaaccctgagagtttccgtgaagcaatcgaaggatgcattgggagtaaagaagaggaagtgatagatgagatttattggagtgatgaaaatcttcttagagatttgaagccatttgcttggtcatattcaatttctaagacattggcagagaaggcaattcttgaatttggagaacatcatgggttggatgttgtgactctaatacctacttttgttcttggacccttcatttgtcctaagcttcctggctcagtttatacttcactggctttcttatttg

SEQ ID NO: 39945 - DNA, 186 bp, Glycine max
  Peptide Sequence Number=SeqID_156723
atggatcacccaggaagaacccaagcgaacttagaagacaacaccgaaagcatagttcgtcttgtaatccttaacacctctaatttggtcagcattgagacctcaggaattgcttctcttgaggaactgcataagagtttggtctcaagtgggaggcaggtaagggctcacactaattgggtgtaa

SEQ ID NO: 39946 - DNA, 144 bp, Glycine max
  Peptide Sequence Number=SeqID_156724
atgatggatacctcagagccctacactgagccttacactgggacaatgaggggcaccgtgcatgagcctcaagcgaacctaggggcagatcaaaacttctcacccgtcgatgtttttaaacagaaaaaaggggacaaaccctag

SEQ ID NO: 39947 - DNA, 255 bp, Glycine max
  Peptide Sequence Number=SeqID_156725
atgtcgtacaggatgtcacgacatcacgcttcagaacatgcagattatatgtgtccgtatgaacagattaaacaagtaaataacacaagagaattgtttacccagttcggtgctacctcacctacatctgggggctccaagccagggaggaaatccactctcaatagtgttagttcaagccttcgtgtttatatagccatctgcgtttctgggctgcaacggcttgatgctggaggagatctatcttcttcctga

SEQ ID NO: 39948 - DNA, 348 bp, Glycine max
  Peptide Sequence Number=SeqID_156726
atgactttggtagttggagcaaatcttcttaatggtttaaagaagtcaggaataagcattttcttgattatagggattatggtagtgcggttcataatttcacctatcttgggtattttgattgttaaagcagcatattattggggattcattggatcgtattcgttatatcaatttgttcttatgcttcaatatgcgcttccacctgcaacaattgtaggtactgttgcccagatgctcgggaatggtgagagtgaatgttctcttatcatgatatggacatatttcattgcaacatttagtctcactctttggtgcaccttcttcatgtggatgttggaggtatag

SEQ ID NO: 39949 - DNA, 177 bp, Glycine max
  Peptide Sequence Number=SeqID_156727
atggcgtcagatgtatccaaagtgcgcacagaaatgcccctcttcctccaccgtgtagccgtgacggtggctactgatccacatgagcatcctccatggatactccatgacctccccctaaaattggtggttgcgaggttgggagtgattgctacatacagatacatcgtacactaa

SEQ ID NO: 39950 - DNA, 1872 bp, Glycine max
  Peptide Sequence Number=SeqID_156728
atgatgcggttctacacaacctctgcaaaaccttttcattctgaccactatagtagacttgtctctttgattgactcatgcaaatcaatgcaacaaattaagcaaacccatgcgcaattaataaccacagctctaatctcacaccctgtttcagccaacaagctcctcaagcttgctgcttgtgcttctctttcttatgcccacaaactgtttgatcaaattcctcaaccggacttgttcatttataacaccatgataaaagcacattctttgtcaccccattcctgccacaattccctcatagtgttccgctcgctaactcaggatttgggccttttcccaaatcgatatagctttgtatttgctttcagtgcttgtggcaatgggttgggcgtgcaggagggagagcaggttcgcattcatgctgtgaaagttggtttggagaacaatgtgtttgttgtgaatgccttgattggtatgtatgggaagtggggacttgttggggagagccagaaggtatttcaatgggctgtggatagagacctgtattcttggaacaccttgattgctgcctatgttggatccggtaacatgagtctagctaaggaattatttgatggaatgcgagaaagagatgttgtgtcatggagtactataatagctggttatgttcaggttggttgtttcatggaggctttggatttcttccacaagatgttgcaaataggtcccaagccaaatgaatatacccttgtaagtgctcttgcagcctgttcaaatctagtagcattggatcaaggaaagtggatccatgcttacattgggaagggtgagattaagatgaatgagaggcttcttgctagcatcattgacatgtatgcaaagtgcggagagatagaatcagcatcaagagttttctttgaacacaaggtaaagcaaaaagtttggctctggaatgccatgattggtgggtttgcgatgcatggaatgcccaacgaggccataaatgtgtttgaacaaatgaaggttgaaaaaatatctcctaataaagtcacattcattgccttattgaatgcttgtagtcatggctatatggttgaggaggggaaattatatttcagattgatggttagtgattatgcaattaccccagaaatagagcattatggatgcatggtagatctacttagtcgttctggtctcttgaaagaggctgaagacatgatttcaagtatgcctatggctccagatgttgcaatctggggagcactgttgaatgcgtgtagaatctataaagatatggagcggggatatagaataggcaggatcattaaaggcatggatcctaaccatataggctgtcatgttctattgagtaatatatattctacatctgggagatggaatgaagcaagaattctgagagagaagaatgaaatcagtagggatagaaaaaagattcctggttgcagctcaattgaattgaagggaacgttccatcaattccttgttggagatcaatcccatcctcaaagtagggagatttattcatttttggatgagatgacaactaagttgaagagtgctgggtatgttcctgagttaggggaacttttgcatgatattgatgatgaggaagataaagagactgctctgtctgtacacagtgagaaattggctattgcttttggattgatgaacacagcaaatggaactccaattcgcattgtgaagaatttaagagtatgcggggattgtcatcaggcaacaaaattcatctccaaggtttacaacagagtaattatagttagagacagaacaaggtatcaccacttcgaagatggaatctgctcttgcaaagactattggtag

SEQ ID NO: 39951 - DNA, 249 bp, Glycine max
  Peptide Sequence Number=SeqID_156729
atggtgagtgttaagatgttctacttagcacctttccaaaccatccaccatcagggttattttgggaagttgtggggtggtcttaccactgtacacatggttgatggtgtcgatgttgacattgagcttatgcttaaacttgttgcgagcgacatgactgatgaaggagcgacaacatgtttagaaatgaaactagatagaaaaggctctatctattgttgtagtggcgacgagcaaaattattgctaa

SEQ ID NO: 39952 - DNA, 222 bp, Glycine max
  Peptide Sequence Number=SeqID_156730
atggagagtggatatccatgccaaggggtgtcatggtcaaaggagagtgaggcttggaaaaaagttgaaacaaggagtgtagcctcaaagaaaaggaaaagggtgaggcctgtcggtatgagaaggtacatgatatggttgagagggttattgaaatatgcagcctcaatgtttcatgggattattggaaccatgaacaggttaaaagggttctggtggtga

SEQ ID NO: 39953 - DNA, 2133 bp, Glycine max
  Peptide Sequence Number=SeqID_156731
atgaagggcaaaggagcctggtactgggcccacctggagcccattctggttccccaccccgacaccggcctccccaaatccgtgaaactcaaatgctccctctgcgactccctcttctcctcctccaacccctcacgaaccgcttccgaacactttaaacgtggtacatgctccaacttcacctcctctctcagacccccttctccactccctatttcctccatcacccccgctccccgcaagcgtccctcccccgccacctcacctccttcctatcaaaatcactccttgcccattctccactcttcccacttccaaatctctcacgccaatactgcacactcgcataatcaccaccaccaccaccagcatttaatgttgtctggtgggaaagatgacttgtgtgctcttgcaatgtttgaggacagtgtgaagaagctaaaaagtcccaagacttctcctggtcctgctttgagcaaggaccaggtgaattctgctttggacttgctcttcgactggttctatgaaaactccgtgtctttgtccatgatcgagcaccgaaagtttcaggcctttttgagccaggttggcttgcccaacaagttggggagggagatttctggggagaggcttgatgctaggttcgtggaggccaaggctgagtccgaggctaggataagggatgccatgttttttcagttggccagcgacgggtggaagtgtggggattggtttaacttggacttttgttgcggtggtgattgtggtggtgtaggcggcggggagagtttggttaagtttgtggtgaatctccccaatgggagtagtgtgtttcagaaggccgtgtttaatgggggagtggagaattccaagtacgctgaggaggttatgggagatggttacggaggttaccgggagtgtggtccagaggcgaaggcgttgaggaacttggaggtgcagcaccattggatggtcaacacagcttgccagcttcaggggttgactagcttgatcaaggattttaactgtgagctgccgcttttcagggttgtgattgagaattgtttgaaggttgctaattttatagacaatgagttgcatgtgaggagtgttttcctcaagtacaggatgcaggagatggactgtggtgggttgattcgcgtgccttcgccgaaatgtgatccgttgaagaactttggagtggcgtttcctacgttggaggatacgttgagctgtgctagagtgatacagagggtggtgatggaggatgggtttaaggtgatgtgtatggaggatccactggcgagggaggtcgcggggatggtgcaaaatgaggggttttggaatgagttggaggctgtttattcgcttgtgaggctcgttaaagggatggtgcaggatgttgagacagagaggcccttaattggtaggtgtttgtctctttgggaggagctgaggagcaaggtgaaagagtggtgtgggaagtacaacattgtggaaggacatgcggagaagatagttgaaaagcggtttaggaagaattatcaccctgcttgggcagcagcgtttatacttgatccactttacttggttaaggatgctagtgggaagtatcttcctccgtataagtgtttgacgcgcgaacaggagaaggatgtagataagttactgacgaggctggcttcccgggaagaggctcatgttgtgttgatggagctaatgaagtggaggtcagaggggcttgatccgctctatgcacaggctgttcagatgaagcaaaaggatccagtaaccggaaagatgaaagttgctaatccgttaagtagtagacttgtctgggaaacatgtttgagtgaatttaaatccctgggaaagattgctgttaggctcatttttctgcatgcaacttcaagtgggtttaagagtaactcgtctttcactaggaaagtttcagctaataaacactcaagagttaccttggagagggctcagaaaataatatatattgcagctcatgccaaacttgaaaggagagacttttctaacggagaagagaaggacgcagagctgtttgtcatgtccaatagtgaggatgacatgcttgaggtttatgctgatgctcccttagtgtaa

SEQ ID NO: 39954 - DNA, 381 bp, Glycine max
  Peptide Sequence Number=SeqID_156732
atggctctcctatggactattaatctactaagaggctactacacattttttggagataatttgatctcttggaaaagtaagaaggagagagtggtggcaagatttagtgcaaaggcagaatacaagactatggcttatacaaattggaatttggggaatatgcttcttatcattgtcccagcagtttgtgaacaaagcagtagtatatttggagattcatccacatgctcaacttatggacaagcttatgcggcattttctacaggacttttaattaagcacaaagctaacatgcttgttgaaggtgttttcacaatataccaaatgacatgctatgcctttatcacccgtctttttcaatatgttcgtgagtttgaataa

SEQ ID NO: 39955 - DNA, 618 bp, Glycine max
  Peptide Sequence Number=SeqID_156733
atggctaattggcatatgctttttatttttaggttatcatttactactgctaattggccttgttgtggaagctgtttgattatagaaactccagcctcagctgctcgtgtcaacacaaaggaaagttctgttaatcccttagggaacgatccagacacgggtgactcagacaaatacgggttgtacatcgaagaaaatcctccctgcatggttgccttaggaagagtttatgagggatccacaaccactgacaacatccatttgttgcatgatcaagtgaaagtcggtgctgaggaggttaaagatacagatgctcccgttcctgtacccactgacaaggttaacttagtgggacatgcacttaacacctttcttgcttggtcgacacatctcgtgaagcgtttatcagaacagatgataacaaaagatgatgacaaaggtgatgacaaaaagctcaaaggtcaatcaaagaatgagttcaagatgttcaagatagaatcaagaacacttcaagattcaagaggaaagttgaattcaagaatgaagaaaggctattcaagaatcaagaaaaagcctaatcaagataagtatgaaaaggttttttcaaaaactgagtag

SEQ ID NO: 39956 - DNA, 285 bp, Glycine max
  Peptide Sequence Number=SeqID_156734
atgacggtttacaagtgcaattgcggccatatccacatttgtgacaacaatcttgtgttttacatcttcactccggcgctccttgttgctgatttggccgagacaatcacgttcaatcgattggttgaaatgtggtttttgttggtgaatatatttttaacgttagtggttggctccattctcggttggatgcttaataaaatcgccaaaacccccaaacacctccggggtcttgtcaatggttgctgcactgctggttggtacctttcaaatttgactaaatag

SEQ ID NO: 39957 - DNA, 318 bp, Glycine max
  Peptide Sequence Number=SeqID_156735
atgggaactgaatttggtggcaacaagcatcgacctttttgtttggtgactccatcaccaacattgttgtctattgatctacacgatggtagtgatagagacctcattggaactcaatgctctctcatgtgcccttcatttgcgcgccaaacaacatttgggcacccaactgttctggcgcatccagccatatttcatgcctttctttctagtgacaggaaagtggtgggatctaagatgtcagaaaggtttgatgaagatggcaatgagatgatgaggggtggggtcgcgattgaagaggtgtcagtggacgactga

SEQ ID NO: 39958 - DNA, 470 bp, Glycine max
  Peptide Sequence Number=SeqID_156736
gggctctgtggggcagtagcaacgagcttaagctccgaagagaggaaatggaccaatcgcgagtagacggtttgatcttgaaggatgaattgagggtttacctaaggtccaagaggagcttgtctcagtggttaagcgagaccgaaacccacatgttagccatcatcagcaagtaccaagaagaattaaatctagccacagcccacgagcacaaagtagcagacgaatatgcccgagtgtacgcaaaaaaggaggctagaggaagggtgattgactcgttgcatcaagaagcatcaatgtggatggaccggtttgctcttactttgaacgggagtcaagagtttccccgattgctagcaaaggccaaagctatggcagacacctgctctgcccccgaggagatccacgggctcctccgctattgtcagcacatgatagacttgatggcccatataattaggagtcgttag

SEQ ID NO: 39959 - DNA, 198 bp, Glycine max
  Peptide Sequence Number=SeqID_156737
atgaccaagccgatgttggatcaatttcatccacgaattcataattccattgaaaacattgttgatgtcaaagtttatggtaattatggatatcatgcaattgttgccttattaggtatggatggagattcatggtctttggttcgtaaccatttgcttaaagagcttgaaaaatggttaccatggataagtggatga

SEQ ID NO: 39960 - DNA, 1086 bp, Glycine max
  Peptide Sequence Number=SeqID_156738
atgtctaatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttagctgctattcatggacttatagtgcatcaaatggatgtaaagacagctttacttaatggtgacttgagagaggaaatttatgtggaacaacctgagggctatgtgattcaaggtcaagagaacaaagtgttggaaaagaccaaattattcttatcttctcattttgatatgaaagatctaggagaagctgatgtgattcttggagttaaaatgagaaaaagtgataatggtttttccttgtgtcagtcacattatattgaaaagatacttaaaaaatttaactgttatgatgaattacctgtgagaactccttatgatcctagcatacatcttaagaaaaacaatggttctagtgtttcacaaactgaatatgctaaaatcatagggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatttattgctcttgatttagcaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttgtacttgaatcgtcgagggggatggggcttaagcctttgtgttga

SEQ ID NO: 39961 - DNA, 147 bp, Glycine max
  Peptide Sequence Number=SeqID_156739
atggcttcagagttatcgactgacacaaccaagacaagtaccagttctaattcatcatcagcaacaagcaagatgttggaaaaaactagaagtcagaagtacaaaacagaaaaatataacacagattggaggtttgttgtgccgtga

SEQ ID NO: 39962 - DNA, 471 bp, Glycine max
  Peptide Sequence Number=SeqID_156740
atgttgcaaaataatccttcttccctttcattcactcaaccaccactgtgcttcttcttcatcatccttcatcttcttcttccctctccctctctcccctgcccaatatcatttcttcaccttcttctcggcaccaccactgcccccaactctgcattcgtcctccgcccccattctcccgtcttcccctccaaaaccctaacccccaaaaaacccaaaccccctctgccctcctccagtggaatcgcaatcttgagctctccagcttcaccccccgctgctctctacaaggtttttgctcatgtgccaaaggacgaagttgagaataggatagaacagataaacaaggtgacaagccagaaattagaaaaacttgaagaggagaaagaatctattcttgctcagatggctgaactcaagaaaattttgtatgcgaagttcaatgactcgatcaatcttgaggaggattag

SEQ ID NO: 39963 - DNA, 618 bp, Glycine max
  Peptide Sequence Number=SeqID_156741
atgacccgcaccaagaaaactggtcaaatgacgcctgaggtagcaaaggaaattgctgacaagattgcctcacagggaagctttgttgcctatggacatcatgatgtactgactgttgccattgggcaaccagaacaccttggtcgtgcccgtgctgctggagctggtgtcacaatcaaacaatactttggaccggctccaaggacctcccccatttctacgttcatggctctcgaagacctggagcagggactcacactgcctcctaagcctgaggttgctccttctgttgctcatgtcagcacaaaggagagttgtgttgatccctcagggaatgacccagacacggaagaaaattctccccgcctggtcgcccttggaagactttatgaagggtcaaccaccgttcacaacatccctttgggcaattatcaagtgaaggttatgtgggatgctatcgtgattggggtgtataatgataacttccccttgtacataaagcaagaagatttgtctgaaatagcacacagtggtcaatatctcagcatctctattatacaattgtggattatgcatatgactgagacaagtatgcgagcggggaatgccgatgtgtaa

SEQ ID NO: 39964 - DNA, 1680 bp, Glycine max
  Peptide Sequence Number=SeqID_156742
atggctggaagtctatcaaaaatcattccggatatgtcgaaaatagaacctctagacggctcaaattataggagatggtctcaaaaacagttgattttgtttgaagccttagaggttgattatgtgctatttgaagatcctcccgctgatgtcaacgcttctgaatcatctactcctgaaactcctgccacccctgtcgtcacaccgcttcctgcagaaaccaagaaagctgacgaagaagcaaagaagaaatatgaaaaggacaacaaaactgctagaggtcatctgctaactcacatggcagataatctgtttgatcttttcattaatcaaaagtctgcgaaaacaatatgggacactctgctgaaatgttacggcgatgacgatgctggaagaaagaaatatgtggtaggaaattggttgcgtttccaaatgatggatgacaaaccaatcatggagcagattcatgagtatgagaatctagttggtgatatactaaatgaaggaatgaagatgtgtgagatattgcaggctaatgtgcttctagaaaaatttccaccttcgtggagtgactaccgcaaccaactgaaacacaagaagagggacttgtcacttcaagaattaataaatcatatgaagacagaggaggccaatcgacttaaagataagcatgttttacattctgtaaattcagttaatgctaatgttgttgagtttgctgatcaacacaggtcaaaaggaaaagaaaaacgatttcagaaaaaaggacaaaagaaaacacacacaaatatcaacaaaggtcataaagcttatgagtgcaaactgaggaagggacaacaatctaacaactcgaaacctgctgcaccacatgctcctcaagcacatctagcagaaaatgaagaagtgatagttgctgtggtagtggaggcaaacatggtcgacaacaaggtggactggattctagataccggtgtttctaaacacttatgcgccaacaaagagctttttcaccagattgaggatgctgatgacggagaatgtgttttcatgggaaattcagctacagctggagtgcttggtaaaggaaagattctccttaaacttacttctggaaaaacattatctttgagtgatgttttgtatgttccctctctgcgtaggaacctaatttctggtagttgtctaaatagagctggattaaaaatggtttttgaagctgacaaagtagtaataactaaaaatgggaactttgtggggaagggatatttagctgatggtttatttgtattgaacaccattcctaacacatctaatgttatatcatctgttggttctgtttacattgttgagtatgttaatttgtggcatggtagactaggacatgtgaatgtgaattctatcaagaagcttagaaatatgaatctaattaatgtgctagatataaataacttttctaagtgtcctatatgtgtggaagctaagtatgcaaagaagccttttaaacctgtcaaaaatagaactacggaactgcttgaattaattcacacggatttggctgacttcaaaaacacagtaagtagaggaggtaaaacatattttattactttcatagatgatttttctagatatgccaaagtttatcttctaaggacaaaagatgaggctgaggaatgtttttaa

SEQ ID NO: 39965 - DNA, 411 bp, Glycine max
  Peptide Sequence Number=SeqID_156743
atgggggcggaggacgaatgcagagttgggggcagtggtggtgccgagaagaagtggattgacaacaatatcggtgtgcggactgatgatttaggatttatgttggtaggtcttaagaaactcgcttaccagaatgaccctttcatcatgacagaacaagctaaacaggtattttatgttcaagatccttgtgatcaaaagtggtcagtggttctacatgggaaaacaattgatgttaatgttgaagatgatgattcactcattgatacttatgtcagtcctttgtccatacaaatcttgcctaacatcgtcggagaagaagaaattgacgacaaaatggctacaccacccaactcccctcttccttatcctactgattcagcaacacatttcccttctaccttgaagtag

SEQ ID NO: 39966 - DNA, 207 bp, Glycine max
  Peptide Sequence Number=SeqID_156744
atgaagtcctcatccccgtcttggtcagccataccaaataggtcaacgatgtcccctaaccgtacccatcccgtccatgttcccgcgcagtaccggaaacaaggaaagacacctagcaggcgtcccctaattcaagaagtcaatgctagtattgttttttgtactacaagtataactaaaggctctgggagagctaatgtattgtaa

SEQ ID NO: 39967 - DNA, 225 bp, Glycine max
  Peptide Sequence Number=SeqID_156745
atgtccttcatgattgtaatcatgttttggaactcgacgccacacattcgaagacccttttgtgcaaagtgttttagaagtgcttcgatcgatgggaacgctgaaaacgtaaatgggtacttggaaagatgcaaaaagtttggagcttttgtcaaaaacggggtgtttggatctttcagattgggtttcaagtgggttcaaagggaaggctctaaagctgactga

SEQ ID NO: 39968 - DNA, 252 bp, Glycine max
  Peptide Sequence Number=SeqID_156746
atggccctccaaaggcatcatctctcgttactttttatcatgttttcttttgttgcttgtcacagcaccgtgctacttgatggtggtggtacattcaaggactttatcaaacaaaaaagtacagatgttatgagcataaggaaatttggcaaattgggtgacatttcttcttcgcttaaaacggttaacgtcaatgattatggagctcgcggagatggcaaaactgatgacactcaggttaaattagaatag

SEQ ID NO: 39969 - DNA, 150 bp, Glycine max
  Peptide Sequence Number=SeqID_156747
atggcattgaggttcaggagcgagcatagaggaaggaggttgcagagtggaggtggagaagagacgaagacaaaaagcatagccacaacatgcggtgatgatgaggttgaggacacaaataagaacacaaaggatagaaagaggtattga

SEQ ID NO: 39970 - DNA, 922 bp, Glycine max
  Peptide Sequence Number=SeqID_156748
atggtgatgctaaaaaacggtctgccgaaagacggcccgcagatgacgggctggcagcagctgcgcgtgtttatttcggcgtgtttgagctgctggtgtggatgaagaagtttaaggcgcagtgccgcccggcgttaccgctccggtgcaaacccttcgaatcgcgaccctttgtagctcagcgttcctttctctcccaccgtcagttggtggtactgctgcgcctccaggcggaaggtcatctcgaggccgcccgtttccggcttaaagctcgcttcatagcgcattgttgtgcccgcaggcgtcacctgctgctggcgcgagcggcggtcattgagcggtttttcgcgtttgttcgtcaccactacgcgcttttgcatcagcggtgcggcatcgttatccgccttctcgcggcgctgctgcacgaagcggaacgaggcggcaatgacgataatcgccaccacgataatgaaaaacagcggcatcttgctcattctacaatcccatcagattatgcggaattcaggatacctcgcctgccccggcattgccaaacgcccgcccgcctacctggttctcgccgggctgtgcgcgtccctgattggcgatgccttaactctgctcccgcgtcagcgtctgctgtatgccgttggggcgtttttcctgtcgcatctgctgtataccatctacttcgccagccagatgacgctctccttcttctggccgctgccgctggtgctgctggtgattggcgcactgctgatagcggtgatctggtcgcgtctggaagagatgcgtttgccggtctgtacatttatcgccatgacgctggtgatggtgtggctcgctggcgagctctggttcttccgcccgacgtctcaggcgatgtctgcgttcttcggcgcagcactgctcttactcg

SEQ ID NO: 39971 - DNA, 159 bp, Glycine max
  Peptide Sequence Number=SeqID_156749
atgtcacgaaactttacggattacgcaaccatcccctcttcggcttctggaattgtagtaaacactgtggtgtatcaagaagaactagcagaatatgaacgaaaggaagggaacatggggaattatcattatgttctactggggagagacacagaatga

SEQ ID NO: 39972 - DNA, 236 bp, Glycine max
  Peptide Sequence Number=SeqID_156750
gaaagatgataacaccggagagatcatcggcgacattcttatccgtggtgggctacagtgacacacgagttgacttagacaaaagcattaaggagaaggatactaaatacaaagggttcctctcaatgatggcttcaaaattagcgtatgagaatgaagaattcgttagtaacgcagtgcgaaatcattgggatatggatttcttggggtcacacagcttctggaacggtacgtaa

SEQ ID NO: 39973 - DNA, 366 bp, Glycine max
  Peptide Sequence Number=SeqID_156751
atggagcctcatggaagctattacggaaggatctcactatactcgcccagacgtggaatggcaaggctgatatatggcttagtgatgaagatggacatgggcctgggcaactttatttcaggtcaaatcacgcagatcgcccaatccaacacctctcgattggggttcccgatgttgatcttagtgttgtgtgacgctcaaggggtcgtttctgacaccctgacctttgagtcactaagccttgtgattaacttagcctacataaagaaaaactgctggaaccccactgactcatccatcaccttccaagggcctcattgtgcccaagctagagccgcaacacctgacgccccacctctagcatag

SEQ ID NO: 39974 - DNA, 387 bp, Glycine max
  Peptide Sequence Number=SeqID_156752
atggggaccactaagggagaggagcttgccacccagctcgcccaagcgagccaggttgcttcctctagaagcaactaccttctggaggaacatccttgtaggcccaagtgggcctgcatgtcacagaacttcacgtattgtgcaacaaagggtgccaagtacctcaaagcggttaaacaaaggttgcatgccctcaaacaatggttttgtagaagcaagcttcatgatgatgaatcaagattgattcaagattcaagaatcaagtttcaagaatcaagaatcaagaataatcaagatcaagattcaagactcaagattcaagaatctagaaaagactcaatcaagataagtactaaaaagtttttcaaaacattgagtagcacatga

SEQ ID NO: 39975 - DNA, 303 bp, Glycine max
  Peptide Sequence Number=SeqID_156753
atgttggtggcaactccgcgcgtattcctttcttggaacacgcacccgcgagtcatgcgtcgccctcccaccgaaggattaaagcaagaactaggcaatatgcagatacatcaagcatggccaaaatcaaacattaagcatggccaaaaattatatcttccaatgaaacataccccccacacttattcccaaaacaattccaaagctccaaaattccttaagggtaaggaaggcatcaacaagaatcaagccaaggctattgtgcaagcaatcaatggggcaaaacaaaccaaaagattatga

SEQ ID NO: 39976 - DNA, 375 bp, Glycine max
  Peptide Sequence Number=SeqID_156754
atgagacctgatgaggttgttcttcttgagccaattgtgccagttatacatgaggttgttgaagcaggtgagtcacagttgagacaggaggctgctactcctgagaggacaccacagaccccagaagattcactctcaccagggatggacttatcttttgctcagcaggtagaagatcctcctacactagtacatgagagacaaccaaatcctcctacacccatcatagagatgctagaagactctaccacgccaatcctaagactgtcatccactcctccagctaccccagttttacatctgacagatgaggaggatatgcaggaccaggacacacagggcacacaggaccaaacaagtcaagtgaaaggataa

SEQ ID NO: 39977 - DNA, 887 bp, Glycine max
  Peptide Sequence Number=SeqID_156755
ctcttttgcttgcatgctcttcggctattcatgcctttgacatcacacaactgctaggccaatatccagagttttccacattcaacaaatacctaacggaaaccaagctcgcagacgaaatcaacagccgcaacaccatcactgtcctcgccgttgaagactcagccatgaattccattgctgccaagtccccagaagccattaaggccatcattagcacccatgtcatccttgacttctttgatgagaagaagctcatggaagctcaagctaatagccaacagttgacaaccctattccaggcctcaggcattgcagtgaaccaacaaggcttcctcaaggttgcactcgtcggcgaaggcgagatcgccttcggctcggccgtgagtggcgccccagtcgacgccaccgagctcatgaggaccgtcaccagcgagccctacaacatctccattctccaagtcaccaaacccatcctagtcccaggtgttgattcacaaaccccagcctcatcatctggtgcacaatcctcacaaggagccaatgctcccgttgctgcacagggtgccaaagctcctatgtcatcattacaaggtgccaaggcacccattccgacaccggttgcaaagtcacctgtgccagcacagagtgccaaggcaccagttccttcgaagactgcggccgcatctccacctactggtgaaagcgttgccgagtctccggaggttgctgctgaagccccagcaacgagcccaactggagctgaggctccaggtcccatggctgatgatgttactcctgctgatgttcctagcagtgcttcaaccacaaagatgggtttggttggcgcagtgatggcctttgcttccctcttcattgttctataa

SEQ ID NO: 39978 - DNA, 696 bp, Glycine max
  Peptide Sequence Number=SeqID_156756
atggcttccttccctcctctaggttcactcactctctgcgaagtcaatcgtgacctaatcactgtcgacgccctctctgacgatcgagccaaccaaacctacggaaaaatcctcggtttggtgttcagtcccgtcccgtttcacaatctggagaacgacgcttccgatcaggatggtgcaacgacgacggcgacaaccgccggagaaagcgttcggaggaaaagcccggtggcactcttgcaagggtttatgaacagctatctcggacgcctcttttaccctgatgatgtgcatttgttgccggaggttgatctccaaggagtaagctggcaccctaataagcatataattgcttttatctctgccccaacacaagtcttagttcgtgattaccaagagtctgaggggaaggatccgagtattttgacaaatgagtcgcagagagatgctagagtgctggagtggaggcccaatggtgggaaaatgcttgctgtgggttgcaagggtggaatttgcatgtgggctgcttcttatcctggaaatgctgcatctgttagatctggagctgcttcctttttaggaggtttgtccagaagctcagggaatcggtatatcctggtcgattttcttcgtagtccatatgatgagcatgttagtgctctcacttggagtccagatggaagatatccttattaa

SEQ ID NO: 39979 - DNA, 1008 bp, Glycine max
  Peptide Sequence Number=SeqID_156757
atgaccctctcgtgcatcctcagacacaaaatcttccctccaccccgctcccccttcaacctcttcatccaacggcgatggaagaaacccaccgtctccgcccaaacccgcttagtagacagagtccgagaaccccacttcgacaaactcgcttcccacctcaaaagactcgaccttgtcctcaaaacccacccacaatctcatgcccgcgcgcaagcgcggtcctttcatctctctcaccctcctctcccgctggcgaaacatcctcggactcaccgtccccgtgggcccattcctccacaaatacccccacgtcttccacgtaatggaacagaagctgtgaagagggtgaagaagctgctgatgatgtccgtgaatggcacgcttcgtttgcacgccttaaggttgattaaaagagaattgggtctccctgaggatttcagagactccattattggaaggtatgatcgagatttcagattggttgatttggaggttgtggcattggttgattgggacgccgaatttgcggtggctcgggttgaggaatggagggtgagggagtacactgaaaagtggttgagtgagttcgagaccaagttcgcattccccgttagcttcccaaccgggtttatgtttgagagagggtttaaggagaggctgaggaattggcagaggcttccttacaccatgccttacaagaggaacgaggttgttcgggtgaggacgtgtggagggatcgagtggtatgagaagagggctgtggctgttcttcatgagctgctgagcttgactgtggagaagatggttgaggttgatcggctggctcattttggagggactttggtatcgaagttaatgaaaaccagacaattgttggcttgtgatgatgagtctaataaggaagagagtaatgctgtagtatgtgaagtgaatgaggaaggtgaaaggcaaggagattgggtgattcctttcttggagaattgtgaagagaatagatccccttga

SEQ ID NO: 39980 - DNA, 792 bp, Glycine max
  Peptide Sequence Number=SeqID_156758
atggctgagaatttggacgatgacgagttttggctgtcgccgcaattcctcgccgacgatgatgttgtcgtatttccgataccctttgaagcaaagttttcacctttgtctaacaatgccgttttgttcccgtacagttctcccgttgattccaccgttggtggctccagcgagaccgagagcaacgaggaagagcaacttgttgccgagttaactcgccacttgactcgctcctctcttcaacctgacaccgaggctgtgggtcagtttgtgtctggttctcctcaatccacactttgcgcgtttggaagtgagtgtagttatggcaaagggtcgagccacggtagcccagatggtgtttgcaagttgtcctctgtgaagaccacttgggatttgctgcatgcggctacaggggaagttgagaggatgaggttgaagcaagaaggtgtttcgccattggcattggcgaaaccctctccacgtcactgccatgtcgctgctggtatcgccagactacttgtctcctccatcgcctccgccgccggaattcggaccgtcagagcctccgccaccgccaccgccaccgccgccacgtgggccgcttccgccgaagccgtcgttggggagggcggagaggagggggagggtgggtttgaagggcgtggcggagttgttgaagttgaaaggaagggactgagagtggagcggagtgagagtttgaaattgttgaaggcgagtggtgttttgacggcaatggttgaaggcaatgggcaagagaaggaatttgtgcgc

SEQ ID NO: 39981 - DNA, 462 bp, Glycine max
  Peptide Sequence Number=SeqID_156759
atgtcacaaattgagcttactgtccaaaagtacttggctcttcttggaaaacaccctgttgccgtgaaagctctaacatctgcaattttgaatctaattggagatttgttatgcgagcttgtgatagacaaagtgccatcactggatttcaagaggacatttgtctttacttttcttggttttgctttagtgggtccaacattgcatttctggaggtatttgtatatgagtaaattggttacacttcctggagcatcaggtgcccttttgcggcttgtacttgatcagttcttattttcacccatattcagcggagttttcttatctacattggtgacactggagggaagcccatcacaagttgtacccaagcttaaacaggtccttgctgctaatgttattgctttgatgtggaatattattctctcatttatggcacataaagaggttcttacaaaatag

SEQ ID NO: 39982 - DNA, 438 bp, Glycine max
  Peptide Sequence Number=SeqID_156760
atggctctggataccgtgttgaataaactgagagagagagaaggaagagaaaacttgttgaacacttattcccactcacctgatagcttggatgatttgtcttatgctataatgtatgagacaaccaagttggcttatcgcgtttcagaagatgatgttacacgtgctcgtaatcagttgaaatcttcactgctactacacatagatggaacaagcccggtggctgaagatattggccgtcagttactcacatatggtcgaagaatcccgtttgctgaattgtttgctagaattgatgctgttgatgccagtacgattaaacgtgttgccaatcgatttatctatgacaaggatgttgttattgctgccatgggtcctattcagcgtttgcctgattacaactggttcagacgtagaacctactggaaccgttactag

SEQ ID NO: 39983 - DNA, 426 bp, Glycine max
  Peptide Sequence Number=SeqID_156761
atgactccgcctactcggcgagcgactcaccgagtctcgtcgccagcgactactctgcctgccggagccacgagttcatcgacgtggtccaatccagctccgccacttcgagatcgcgcgctttacgcggcggttcgcggaggcgctggcctccgttcgcggcttgttcgtcaggggcgcggaggagctgaaacgcaccgtttcgatggcgtgcgacgcggcgaggaggtgcttcaggagcaggggattctagttccgccggtgaggaagaaccagttcatgcagaccaagtggttcggaccgtgtcgccgaaccgcgaacgatgttttgatggaaatgaacggcgtcagctgcagagtggtggggttcgatgacgtcgttttggaagcggggcgtagcggtggcgttgttgttcgtacgagatga

SEQ ID NO: 39984 - DNA, 1112 bp, Glycine max
  Peptide Sequence Number=SeqID_156762
gttgcacttcgattggaggtatcatgtgacagcgaaggtgacaacatctgcccagctgatggtgttggtgttcataatcctggttactggggcatgaatattgagcaagggaagaaatacaaagtggtcttctatgttcgttcaactgaatcacttaatctaacagtttcattaactggatcgaatggtgtaggaaacctggcttcatctgtgatcacaggttctgcacttgatttttcaaactggacaaaggtggagaagatactggttgccaaggcaacagatcataactcaagacttcaattaacaaccaccaccaaaggtgtgatatggttggaccaagtgtctgctatgccactggacacatataagggacatggtttccgaactgaccttgttgaaatgctgacagctttgaaaccaagatttatcagatttccgggagaatggttaagaaatgcatttcgatggaaagcatctgttggaccatgggaggagagacctgggcactttggtgatgtttggatgtactggactgatgatggacttggctattatgagtttctccaacagcttgcggaggacttgggtactgcaccaatatgggtatttaataatggtgtcagtcataatgatcaagttgatacatctgcggtcttacctcttgtgcaagaagcccttgatggacttgagttcgcgagaggtgatcgcacttcaaaatggggctcccttagagctgctatgggacaccctgcgccatttgacctaagatatgttgctgttgggaatgaagattgcggaaaaaagaactatcgaggaaactacctgaaattctacagtgcaataaaaagtgcttatccagatatccaaattatttcaaattgtgatggttcttctcgacctttagatcatccagctgatatgtatgattatcatgtttatacaaatgcgaatgacatgttttctagagctaatgcatttgatcatacatctcgaaatggtccaaaggcttttgtaagtgagtatgctgtgactggaaaagatgctgggacaggaagcctcttggcagccctagctgaagctgggttccttattggactggaaaagaacag

SEQ ID NO: 39985 - DNA, 306 bp, Glycine max
  Peptide Sequence Number=SeqID_156763
atgctttggatggtcctgatagcatgggattcggttctcttattcccacagagaatgagaggtccctcatggaacgtgtatgacatgaagagagcccaagaggggtcttgtattgtggctacgaagactgagtcaaataaagttgcagggaatgccattttatatgaatgtgttcaaacaataatgagcattgaagataatggtggcttacgtgtacttgccattaatatcctgggaggattcttgccaaaccgtgacaacaatatcagggaatgtttccgtaacccgtggcacccaggtagctag

SEQ ID NO: 39986 - DNA, 237 bp, Glycine max
  Peptide Sequence Number=SeqID_156764
atgtcagcagataagggtaacacatacacattgctaatgttcaacactgcagttagcctgttttccatagtcttgctttgcataacagcagctcaagggaggaaaacacttcaccttaacaatgaatggctaacatcctttccagatattaatgatattgatggtatctgcaaaacactggtagagacacaaggttactcatgtgaagaacatcaggaattgaacacaatatcatag

SEQ ID NO: 39987 - DNA, 165 bp, Glycine max
  Peptide Sequence Number=SeqID_156765
atggttgagagtgtggacaatcagaaggtagcaaatcatcttgaccatatggtatcaacccttggaagaaatcctctgaaggttttggtgcaagtaaatacgagtggagaagaatgtttcctcactccctttgggtgtgaggcaaattcttgcttgaggcattag

SEQ ID NO: 39988 - DNA, 894 bp, Glycine max
  Peptide Sequence Number=SeqID_156766
atggaaggcagggcgctcgcgtggtttcagtggatgactggtaacggccagttcacatcgtggccgattttccttcaagccttgcaaacaagattcgcaccatcacagtacgaagatcctacaagagctctattcaagcttacccaacaaggcgcaccaaccgttgatgttggtacaagccgccggcctggcacgcctctaggaggagaagctcctggacgtccatcacccaccgtggacgctcgttcgaccccgccgcctttgaagcgcctctccccggacgaaatcgcatccagttgggagtgtggcctctacttcaattgcgacaagaaattccataaatgccaccgttttgcctctagggtttttcttctaatcgtggaagaggacgagagccatgcacctcatatagtgatgaatgacccgcctcccgatccgccagaccatgtggaccctattgaccctagcacccataatttcattcaacaagagctggtaactcaattgaatcttccatgtcgtgacacatcatttcccttacgggtcatggtgggaaacgaccaacatctgcaatgtacaagcgtgtgtgaggaaatccttattgacattcaattcgcacagttcaccgtcgatctccatgtgctgcccatctccagcaccaacgtggtgttaggtgtacaatggcttaaatccttgggactggtcctcacggactataacactatatgcatgcagttcttccatgattgccgtgtcgtggaactcaaagtgttgttggtgaagaaacatgacgggtcatggcggttttgtgtggattaccacgccttgaatgccattaccattcgcgatcattttcccattcctacaattgatgagctaggcggtgctagatga

SEQ ID NO: 39989 - DNA, 624 bp, Glycine max
  Peptide Sequence Number=SeqID_156767
atgccagctgggcggtccggtgagaaagctgacaagccgcccgtgctattacaacatggtatctttagtgatgcttcaacatggctggtaaattctccagatgaatcattgggatttatcttagcagacaacgagtatgatgtgtggcttgccaatgttcgtgggacaaaatacagcagcgggcacacatcgcttattcctaatgacacggcttattgggattggtcatgggatgagttggctagtaatgatcttcctgcttttgtccaatatgtgtacaactatactggtcagagaatacaccatgcaagtcattccttgggaactttaatggctttagctgctttctctcaagggcaagtgctgagcatgttgagatcagcttcattactttgcccaattgcttatatgaatcagattccatcaataccaacaaaacttgctgcagacacatttatagctaatgacttgtactggttaggaatccgtgaattcaatccaaacgggggtggtgctgcatcaaaatttgtggaatacatctgcaataaactaaaattgaactgctcaaacctagtgtcacttgtcacaggtgctataaatgctactggcatgaccaggaattaa

SEQ ID NO: 39990 - DNA, 420 bp, Glycine max
  Peptide Sequence Number=SeqID_156768
atgattttctcaaagtcttgtagttttcttgggctctacctcgttatagtggcttgtcttgttttacagtgctgtgcctatgcaaaccagacttcaacaactctggttgtagatgcttctaaatctggaaggcaaattcctgacacacttttcggaatattctttgaggagatcaaccatgccggtgctggtggattgtgggcagagcttgttaacaacagaggttttgaagctgggggcacacaagttccatcaaatattgcaccttggactatagtaggacaagaatcagctattttactacaaactgagcttagttcttgcttcgaacgcaacaaggtagcattaagaatggatgtgctgtgtgacaattgcccttctgatggtgttggtgtctctaacccgggtttttggggcatg

SEQ ID NO: 39991 - DNA, 405 bp, Glycine max
  Peptide Sequence Number=SeqID_156769
atgctacaagcatctgacaacaaggcaagattaaggaaaggagggcacttatccatcaaagaaaaacatcttttatcaagaacattcacacaaatgttacccactctcacaataatatatcagactcttggtcttcaacctgcttgttttaaacccttgactcactcactcactcatgtctatcacttccctcaccatggccgagtcctgcctcctctcttctccctcctcacattccatgacaactccctcgtctaccagtccaatgctgaccctgacctcctcgccgcctttgagaccggcgacgccgagctactctacgagatccgcctccttagcgcctcgcagcgcgttgccgctgcacgcttcctcgtcgagaatcggtgcgacgggaaggtcgcgtag

SEQ ID NO: 39992 - DNA, 162 bp, Glycine max
  Peptide Sequence Number=SeqID_156770
atgtttaataacgctcatgtgtttgataagacaccacgaaacggtccaaaggcttttgtgagtgaatatgctctaattggagacatacaagctaagcatggaacccttttgggagctgtgtccgaagctggattccttattggattagaaagaaacagatga

SEQ ID NO: 39993 - DNA, 687 bp, Glycine max
  Peptide Sequence Number=SeqID_156771
atgacggtatcattcagaaaaactgaaggtggagggatattggcttcaagcaatatcgatgcttctgaatcagaagtttcaaaatggaaaaggatagagactacattggtagctgatacatcaagttccaattcatctttgtatttaacaacaaccaaaaaaggggtgatattgctggaccaagtgtctgctatgcctttggacacatataagggacatggttttcgaggtgacttagttaacatgttattagagttgaaaccaacctttttcagatttccaggacaaacattaagaaatgcatttcggtggaaagatagtgttggaccctgggaagagagacctggtcactttggtgatgtttggagttattggacagatgaaggatttggttattttgagggtcttcaactagcagaggacattggtgcaaggccattgtgggtatttaacaacggcatcagccatactgatcaagtagatacaagcgtcatcacaccttttgtgaaagaagcccttgatggtattgagtttgccagaggtgaggctacttcaaaatggggttcccttagagcatctatggggcacccaaagccttttgacctaaaatatgttgctattggaaatgaagattgtgggaagacaaactaccaaggcatgctctcctttttctttttccttttttaa

SEQ ID NO: 39994 - DNA, 228 bp, Glycine max
  Peptide Sequence Number=SeqID_156772
gttgcaaacgtggggagcaaccaaataaatttcaagatttctctaaacggatttgagagctcaaatgcaactaaggcaacaaagacagtgctcacatctaagaatgcattagatgagaatagcctcgcaaacccaacaaatatagtaccaaagcgaagtccacttcagagtgctaacaacgagataaatgacatacttcctccagtttcattgacgatcacagtctga

SEQ ID NO: 39995 - DNA, 411 bp, Glycine max
  Peptide Sequence Number=SeqID_156773
atgcctaacaatgataatgcccagcacatgtatcagaggatggaaatgattgtaccaggggcagggggcaggcaattgaggttaacagtggtctttctagcctttgacgtattttttattatcttttgcattgggatggcatgtatagttttctttgccctcttctgcatcatcccaataatagcactagcttatgctatgagaatcagagaaggtgcatcagaagaagatatcttgtcacttcctatgtataggtttagtcagtcaaattcattggtgatggttgatgacaacaagaagcaacttattaaaggaagagtagattcatgcaatggaagccatatgagtgcgctttctctccatccagatgattctgtgagtgctgactgtgttctcatatctcccatgtag

SEQ ID NO: 39996 - DNA, 378 bp, Glycine max
  Peptide Sequence Number=SeqID_156774
atgttctggctctccaaggtcaagtttgttttgagcgataatgcacctcaccgttgttcaatctttatctcagaaagttcaaaccaatgtatcacctctaaggatattaaatttgcagagcgggcaagttgcttttgtctgaagccaacggccgatgcattcgcaatgaaaatggtgcgtacagggaaggcgatacagttctgctccttcaacatacggacaaaggcagatacagcattcctacaacataatccgaagcagttcagttatctttcagcagttgcacgatgcatttcaactgtatgcaaagcaacaaagaatcagggcaagttgcaaccaagttcactttcgaaagaatccattaccaagaatccttga

SEQ ID NO: 39997 - DNA, 426 bp, Glycine max
  Peptide Sequence Number=SeqID_156775
atggttattgataaaaggaatacgaggagcaatgacgtgcagaatatcctgccaagaaaagtaaggcaaaagtgtgtaataggacaggtgggaaaaatccccagacacatggcaaggaggttcgaacgttacccgaggcaaataaaagaatggttccttatgagacaaaaaggcaaggggaaatatgaagtgggccaatcatctaaagcagaagatcatgtggaagataaaaaatgtaatattgagctagttctaaaaggtctcaagaaaatggaatggacctcgactaaagatgatccaataggggtggccagtggttttgcatcaatagtagtggtgctagatgaagagaaagcctttacagaggccatgagactccatctgaacctaaggggagaatttgtgaaggacaacatgaatgcttaa

SEQ ID NO: 39998 - DNA, 763 bp, Glycine max
  Peptide Sequence Number=SeqID_156776
agggttgtggtacctcctccatctcccggagaatgacttcgcgctcgcggctgatgcggttttcctcgaatcgggagttctggaggatgtcggcgaggatgtcaagggcctgggggacatccttgtcggtgaccttggcataataggtggtctgctccctggaggtgtaggcgttgaggtgtcctcccatgttctcgatctcttcctcgagctcacgcgcgttgcgcctctcggtgcccttgaagatcatgtgctcgaggaagtgcgcggtgccgttagtctcctcggtctcgaaccgagacccggcgtcgatccagacgccgacggtggcggtgcgggcgctgagggtggactcggtggcgatgcggaggccgttggggagcgtggtcacgcgcgtctcgggggcggagaggatgcgcgtgtggtccgagagggtcggccggggggacccgtgcttgaggaagcgggggtcggggttctcgagcagccggagcttggacttcacggcctcggcagcgcggtcatagatcatggcggtggggggaggaggggcgggaggggaggaggcggcgggggccacggcggtggaggcggagagggatcggagggaggagagggcggaggcccgccggtcggagcggcgggccgcggaaaggaggcggttgagggacatggcttggctccgcgctcgcagtcgggtctagggtttcacggtggaagagaaatcgcgaatatatatgaagtggagaggagagagagataa

SEQ ID NO: 39999 - DNA, 264 bp, Glycine max
  Peptide Sequence Number=SeqID_156777
atggccaccaacaacattcagtttcaacaaaatgtgagtgccaccatccaagacttgcacactcagattggacagttagctacaactgtcaaccgattactaatgagaagggtgttcaaggagatacggcttagaacgttcatatggcttggatttgtccattgcggtgcagttcatatggcttggatttgtccattgcggtgcagttctcaagggagggatgcaatcgaaatcgtggttgctattccctatgcaataaggtag

SEQ ID NO: 40000 - DNA, 414 bp, Glycine max
  Peptide Sequence Number=SeqID_156778
atggttccatcaaggagggcctccaggataccatcaagggggaaatttctctcaacatcaagtccaaggttggagatcccatcttggaataacttcaacaaagataaaggcggtccatctattcgacctcccaatcaagggcttaatctatatgagaggaccactaagctggaggatagtttaactcagtttatgcagaatctatatgtacaagtgggccaattagctaagcaattggctaaaacgtccacgagaagtttggtggccaacacagagaagaattctaaggaggagtgcaaggtaattttcactaggagtcaaatgagggagaatacagagagagaaaaaagagacgagggagtattggaggatgtgagtaatgaggaaggagagaaaatgagagcaaggagagag

SEQ ID NO: 40001 - DNA, 288 bp, Glycine max
  Peptide Sequence Number=SeqID_156779
atggatagagctaggctgatctttggcctagtctctcgcttggatatgaacataggagcactgatctctggccagatgacctctatagcccagtctacacctctagacttagtgttgagcccgatcattaacctggcctacatcaggaagaactgttggaaccccgaggatctaacagtctctatccaagggactaggagggcaagggcaaggctagctgagcttccttatacttctgcagctcctactccagcatccacttcagtagccccttctgtcccaacttag

SEQ ID NO: 40002 - DNA, 552 bp, Glycine max
  Peptide Sequence Number=SeqID_156780
atggcaacaattccccctagccgatcatcatcacacgcgtttgttgccatggcaaccttcacgactctgttgttgtgcacggcggcggcgaaggagagcgtgtacgagatactccccaagtacgggctcccgagtggtctgttaccggataccgtcaccgactacaaactcgacgaggatggccaattcgtcgtcgttttgccgaagccctgctacatacagttcgattacttggtttactacgagagcaagatctccggcaagctcagctatggctccatcaccaatctcaagggcattcaggtccagcgcctcttcatctggttcaacgtcgacgagatcagggtcgatttgccaccctccgacagcatctacttccaggtcggcatcatcaacaagaaactcgacgttgaccagttcaaaaccgttcgttcctgccgcaaatccctctcgtgcccccctttccttccacgtccaattcagtttcatgagaggagtctagctcggtcgattaaccagtatgaggattattgtaaattcactaatacttga

SEQ ID NO: 40003 - DNA, 878 bp, Glycine max
  Peptide Sequence Number=SeqID_156781
acatcaaccaagacaaagcagaatgtaccgacaaacttcttggtctagctggttgtcttccctatgttggtggtgaagccaaagtccccgccatggattgttgctctggtatcagagaggttattgacaagagcaagaggtgcctctgcatcctcatcaaggatcgtgatgaccctaatcttggcctcaagatcaacgtcacccttgctctaagtttaccagatgcttgtcaaacacccaccaatataactcagtgtgttgatcttttgcatttggcacctaactccacggaagctaaggtgtttgaggggtttaaaaatgccttgaccaacaaaactagtccctcctcagtccctggtgctaataacgcgactgctaatggaacaagcacgagcgcgaacaacaacagcagtagtgggtggggaaagagtagtagaaaagtgacaaatgcaagtgttccatggacttcactcccgtcatctattgcaaagcttgggaggggatttgcggcaggaacgaacggttttgaactggtcaacgtcgagtttcttgttgatgatgccgacctggaagtagatgctgtcggagggtggcaaatcgaccctgatctcgtcgacgttgaaccagatgaagaggcgctggacctgaatgcccttgagattggtgatggagccatagctgagcttgccggagatcttgctctctcggtgacggtatccggtaacagaccactcgggagcccgtacttggggagtatctcgtacacgctctccttcgccgccgccgtgcacaacaacagagtcgtgaaggttgccatggcaacaaacgcgtgtgatgatgatcggctagggggaattgttgccatggctgagagggtg

SEQ ID NO: 40004 - DNA, 1671 bp, Glycine max
  Peptide Sequence Number=SeqID_156782
atgtttgggacactgttgttgcctctccctttcttcgccaactcattcccattccttccttctcccaacaaaaacgagtttgttagattcatcactacaccttcacattgcaacctaaaaatctctcagttcaacggtttccgcttttgctacgtgtttcttttctgcgcgttccacctctctcagctagtgtccattgtagccacaacacaagctcttacagcggttttaagaaatatcaggtgtacaatgtactacctacttggaaaggttgttgaatatggcactgttcttactagatttgacttttgtgaacatcaattttatgtgatattggatgtgatgaagcttaaaacatggcttgcgagtgttttgttgctcactattgctgtgcttaccaatacattaggtgcatttgtgggggtaaacattggcactgatgtttctgatctgccatctgcttcaaatatagttggcattctacaagctaatcaaattactcatgcgcgtctatatgatgctaacgcgcacttactacaagccctttcaaacactagtattgaagtaattgttggtgtcaccaatgaggaggtactgaggattggagaatctccatcagcagctgcagcctggattaataaaaatgttgttgcttatgtcccatccaccaatatcacaggaatagcagttggcagtgaggttctttccactatcccaaatgttgcccctgttctggttcctgccatgaattctcttcacaaagccctggttgctgctaaccttaacttccgggtcaaagtttcaactccccagtctatggacattatccctaagccttttcctccttccactgccacctttaactcttcatggaactctactatctatcaactccttcagtttctgaagaacacaaattcctcctacatgttaaatgcctacccttattatggatacactaaaggagatggtattttccctattgaatatgctcttttccgacctcttccttccgtgaagcaaattgttgacccaaacactctatttcattataacagtatgtttgatgctatggtggatgctacctactactctatagaagccttaaatttcaataatatacccattgttgtcacagagactggctggccgtcatttggtggagctaatgaaccagatgctactgaagaaaatgccgagctctacattaataatatgattcagcgggtcatgaatgattcaggtcctcctagtcagccaaacatagccattaatacatacatatacgaattgtttaatgaagacaagaggaatgggcctgtatcagaaaaaagttggggcatcttttataccaatggaagtactgtttatccgttgaattttggtgcttccgacctgattactggaaattcttcaggagttttttgtgtggctaaagatggagcagacactgataagctgcaatctggactgagctgggcatgtggacaaggaggagcaaattgtgctgcaattcaaccggggcaaccatgttatgttcccaataatgtgaaaagtcatgcctcttatgcttataatgattattatcagagaaagcatagcagtggtggaacttgtgactttgatggtaccgccacaattactaccaaggatcctagtaagtcgatatga

SEQ ID NO: 40005 - DNA, 228 bp, Glycine max
  Peptide Sequence Number=SeqID_156783
atggagggaggcaacagaaaagggtacgcgtggccagtatctgctggattcaacgccgctcgtgcagccatttccgttaagctccctcttcaccaggttagccttaaagctctctcctctcttcaggcaactgtcaccaatttcgctaccaatttcatctcttccggtttagccggtttcgtcttctttcacgaatcgctctctttccagaggagatccaatccgtga

SEQ ID NO: 40006 - DNA, 483 bp, Glycine max
  Peptide Sequence Number=SeqID_156784
atgtgcttcagattttatgacagaatatctcttagaaaggaacataaactaaaggatattggtccaaacaattggcacaaagcctgttttgtgccaacaaagtcagacgcccttgttattggttatagaacgtggctaaggaagtatgcaggtggtcaggttgattggagaggaaaatatagtggagctcttcctccaacacctccgagagaacagcttttggacaggtactggtcccatgtggtgaattgcaagagttgcaattctgcttataagagcctcaatgcggttgaagtaatgctgcagatcatatctgttgcttcaattgggattgttgccgtcatgaagcatggtacaatgtcagtggcaaaaagaaattcaatggttgccttagcagtgctatcatttgcactgtcacggtggttagctcacttcatatacaaaaacttccgttatcatgactatgagcatgccttccgctga

SEQ ID NO: 40007 - DNA, 129 bp, Glycine max
  Peptide Sequence Number=SeqID_156785
atgatgaaatttgtgaaggctggtgtctcgctaagcaaggcccgtgcgcttagcgagagtttatgggctaagcaaggcaaatcggatagaacagggctagatgactgcattgctagacatagagtgtag

SEQ ID NO: 40008 - DNA, 1218 bp, Glycine max
  Peptide Sequence Number=SeqID_156786
atgcctaaagttagaagattgaagtccccgtctactgattgtaatagaccatatccttacccatccaactccaaaaacattgagctgcataaacctatgaatttgttgggatcagctgatgaaatgaaagaatgggagcaggctagatgtcctatttgcatggaaacccctcataatggtgttcttttgaaatgttcttcctatgagaagggttgtcttccttacatgtgcaataccagttaccgccactctaactgccttgaccagttttgtaagtcctttgcttctcatctctcatcagaagtactgcaagaaattcctgtcacaggcagagtctctcatagtagagaaattcagtcagagtctcggcaccccactcaatgtgggagccagttacaaccaaagctcatttgccctctttgccgtggagaaatatatggatatatggttttggagcctgctcgaaggtatatgaattctaaattaaggagttgttcttccgaaacatgtgaattccaggggacatatccagaactcaggaagcatgctaggtctgaacatccttctgttcgaccatcagaggtggatccctcgcgacagtgtgattggataaggatggaacaagaaaggggcttggaagatctttttagctcaatccatgcaagttctgatgcagattacagtagagataccattttgactgggggtcttgctgacttgatgtcctcgttcttgtatgaaatatttatctctattgaagatgttaaccgtatggctagtttgttgactaattcaagacacagagtgccattatatgacagaaggtctggaacaacacacagggtatcaaatgatacacagacaaatcaatcagctcgatggagatccaatttaccttcaatgcatcaactggagagaattgctaggagtagagagagaaccaattttccatatttatcatcccgtgatcttgagttagaggcaaatcgtacggctagatggagaacaaatatgtcgtcttttagaatgcctcgcaatgagcatcagttttatagagacctcagtgcagaggtcacatcttcaacaaggatgcctcgggcctcacaaggtgctcaaactaatccccagagcaacatttcttcatctggaagtggaaggtttcctggtcgtcaattacgctggcgtgatcaaagatggtcgactaacaaccaccaatga

SEQ ID NO: 40009 - DNA, 1101 bp, Glycine max
  Peptide Sequence Number=SeqID_156787
atggaagctgtgtgtgctttttctgttggcacacttcacatcccaacagcacatgaaacatcaaactcctttaggaaatccatattcttgagcaaccaagtggcttcaccagtttcattggtttttctcaggggcagttcaaaatccaagcttttaactgccttgtcaccccctccattgacagaatccagtaaccaacctgaggctgagccagaatttgaaagtcatgcagagaaatttgactggtactctcagtggtaccctttgatgccaatttgtgaccttgacaagaggaagccacatgggaagagggtgttgggaattgatgtggttgtgtggtgggataggaatgagggtgcttggcaggttcatgatgatgcttgtcctcatagattagcacccttgtctgatggaaggattgatcaatggggcaggttgcagtgtgtgtaccatggttggtgtttcaatggcaaaggagaatgccagctcattcctcaggcactccctgatggccctccggtgagatcatattatgttgatgcgtggaacataagtagtggcttgttttgtgacccttatgaaactcaggaggtacatacgtccaaaaaagcatgtgtagctgcttacccaagtactgtgcagaatgatatcttgtggttctggccaaatactgatcctcaatacaaagatattattacaagaaaaagacccccattcataccagaaatagatgatccatcgtatactaaatcaatgggaaacagagacattccttatgggtatgaagtactgatagaaaatcttatggatcctgcacatgttccatatgcacactatggactaatgcgtactccgcaaccaaaaggtaggcatataagcttaataacagtgaaagctgatagagaagggggcaggccacttgacatgtctattgaaaagttagatatcaatggcttttcagcaaatcaggcttggggcaaaagcaaatttatgccaccatgcattttttatgcatatactccagatcaacctgcctcatctggtgaaactaagaaatcatcagctaagaagaaaatgtgtttaatctttgtttgcgttccg

SEQ ID NO: 40010 - DNA, 297 bp, Glycine max
  Peptide Sequence Number=SeqID_156788
atgtgtaggggaaaggacaatgccaagtgtagcgaaggagtacccaaaattggtaaacatcaatactcaaggcagtatgcatttgactttgtactttgtcaaaacaagtcacgaaggaaacgctgttggaggcatcccacatttagttcttccaaaataattattcccacatggcagcattggattacttcggagttagacagagatatttttcttctcacatacgatggaaaaatggccaaagtggttgagggccaccgcaggtatggttctgcacgtaattacattaatttgtaa

SEQ ID NO: 40011 - DNA, 1497 bp, Glycine max
  Peptide Sequence Number=SeqID_156789
atggagggtgatcttcaaaggtctctatctttgcgcctaaatcgtagaggagatcgaagtaatcaaaatcctgctaaagattttgaggtgggtttcttttcttcggggagggtacctcaagattaccccatgaagatcgtttggaagaaagggtttgttcggttggttcttgtagcagggatcttgtggatgttattaattcttcttgcattgttgttccatatatggtcttgtcaaacttccgtctcctttttatcagctatgtgtaacaaagatagcaaggtttacaacatgttaggcaatatgggactggtatcaaaacctcacagatgtccaattcctctttccaatgaccctgataaaatagttatcccaactagaagaactcccaacgaaattctaaaaaatctgtcgtatgttatggaagatgaggttccacatagtgaagctcagtcatctcctctatttggaggccatccaagttggaaacaaagggaggaaagtttcaaactaaaatcaaatatgaaggtgcattgtggattcattcaaggtggtggtgctgaaatgaatcgtgtagacatcaaatatgtcaagaaatgcaaatttgttgttgcatctggcatttttgatggctatgatttacctcatcaaccatcaaatataagccttcgctcaaaggagcttttttgctttcttatggtggtggatgaggtatctctgaaattcatgagggaaaatggtactgtcaaagaagacggagctggtggaaaatgggtgggaatatggcgacttgttcttcttaagcatcctccttatgatgaaccaagaaggaatgggaaagttcccaaaattttaacccacaggttgttccctcaagcacagtatagtatttggattgatggtaaaatggagctgatagtagatccattgctaatccttgagagatatctgtggcgaggcaggcatacgtttgccattgctcaacacaagcatcaccgtagtatatatgaggaggctgattcaaacaagaggcgaaagcgatatgctcgaccccttattgatctccacattaaaatctattattacgagggaatgaagccatggagttcaaataaaaagaccaatagtgatgtaccagagggagccatcatcattcgggaacatactgccataaataacttatttagctgcttgtggttcaatgaggttcacctcttcactcccagagatcaactgagttttggctatgttgcatacagattgggggacgcgtttaaattctttatgtttcccaactgtgaatacaattcactgtttgtgttgcaccctcacacaagagagcactcttctcccatagaatgggttaaacagttggatgaacttaagaaaggcaatttaagagaaagtaggggaggactaggcttgtttacgccttatcctggggatcttgattctgttgttctgccaaatgtaacaagaacatcaaaagcaggctga

SEQ ID NO: 40012 - DNA, 2001 bp, Glycine max
  Peptide Sequence Number=SeqID_156790
atggggatttccttctcatgtccatttgccaagtacaatgatgtagaagatggcttagactccgttgttgtaaaatccatcaactttggcaatgacgaaatcaaaactccaatgcgatcggtcagtttcaagaacgaagatttagaacccaccatccttaaatctctaggttctggaaagatgacaatagaggcatctgtgagcttcaaaagaaaggacattgataacatcatctcaaccaacactttgtcatttgacaaagaggaaaacatgcctatctcaaggactagcaaaaagagcaaagaaatggatgatcttccttttaagtcagagtgtcaactggaaaccatccaatcagcacttctaaatccaaacagccccaaacacattgcagcacttaaattgcagaaagtatacaagagttttcgcacgagaagaaagctagcagattgtgcaattcttgttgaacaaagctggtggaagctcttggattttgctgaactcaagcgcagctccatatctttctttgagattgagaaacatgaaactgcagtttcgcgttggtctagagccagaactagagctgctaaggttggaaaaggtttatcaaaagatgataaagctcaaaaacttgctttacagcactggcttgaagcgattgaccctcgccatcgctatggacataatctacacttctattacgataggtggcttcagtctcagagcagagaacccttcttctactggttagatataggagaaggaaaagaagtaaatcttgagaagtgccctcgttccaaacttcaacagcagtgcattaaatatcttggtccgatggaaaggctggcttatgaagttgttgtggaggatggaaagttcttctacaagcagacaggagagctccttaacactggagaagatgcacatgccaagtggatttttgtccttagcacatctaagacattgtatgttggcaagaagacaaaaggttcatttcagcactctagcttcttggctggaggagccacatcttctgctgggagactagtgattgaaaatggtgtcttgaagaaaattgagtttgttgtttcttttcaacaggctgtttggcctcacagtggtcattatcgtccgacagaagaaaattttaaggaatttatttcattccttcaggagaacaatgtgagcctttctgatgtcaagatggatccagttgatgaggctgatgacttgctttctctgagaagtagtggtcatcttagaagccactcatctgaagaggacttcactgagaacatgaatggcctggagattgtagagaccattattgaaggctcagttgcagcagagaaggccaatttgatcgaaaccgagaggtcttctgtattgatggcaccttgcacaaggcgatttcaaattcttggaagagaactgagcaatctagaaataccaaaaaggggtcatgtgtttgaaggactagaaaatgagatagaaggtagtgaacaaagctgtgtgagtatccaaatggaatctcaagaaacaacacaagcatttgtaccagagctagaccatacaaattcagatgaaaacttatctgatgacaatgatgtagaaaccattccacaagagtccatactcaaaagaatcaactcacataaagaaatgaaatcatatcaactggggaagcagttgtcttgcaaatggacaaccggagcggggccgcgcattggctgtgtgagagactacccttgtgagcttcagttccgagctttggagcaagttaatctgtctccaagaagtggatcccgctctaaatcatcctttgctcctagaagcaccactttgttgagctctagtctttcaaatgtagcaagtctatgtgggaacttaacaattgaaccacttcacatgcctcaaagaggtgagtccaatagttcaggatcaaaatgctcccctttgatcagaggatcatcagtgataccagttattcacagttcatga

SEQ ID NO: 40013 - DNA, 162 bp, Glycine max
  Peptide Sequence Number=SeqID_156791
atgtcatcgaaaagatcaaggaagaaattgagaggctgttggagactaaatttatccacactactaggtgaattcttggatttctttatcaatcataagggagctgaaattgatcaaaataagacaaaagtcatattggagacttcccctccacaagagtaa

SEQ ID NO: 40014 - DNA, 282 bp, Glycine max
  Peptide Sequence Number=SeqID_156792
atgattgatgcatttgctgagtcacaggggattcctatggacactgtccattccaaagccatttctggaaaaggttttgttggtgaagttcctgtttttcttgcaaagcctcaaacttacatgaatctcagtggtgaatcaacaggaccactggctgcttattataagctacctcttaatcaggtgcttgtgttccatgatgacatgaacttgccttgtggggtgcttcgtcttcatgacaaagggggtcatggaagccacaaagggtacaacactaaatga

SEQ ID NO: 40015 - DNA, 189 bp, Glycine max
  Peptide Sequence Number=SeqID_156793
atggaccctggtcaccctgccacgagtagcaccataaatattcatgtttattggtatcgaaagcttccactacccaaagtggaaaaccttctagaaaacgctgaagccaccactgatgtcccttacaacgtcattcagtatctcaaaaaagcctacgatgatttggaagaaccctttgttaaaaaataa

SEQ ID NO: 40016 - DNA, 230 bp, Glycine max
  Peptide Sequence Number=SeqID_156794
atgccgaaaatcaaaaagaagcaggcttacgcgatccgtgaaaattccgtgatgggggtacaaatagcaatcaggcccgcttgggccttccagattcttcctccagaaggttgttgcttctggaggaagcaaccttgctcgcctggggagaagggattcagccttcttggcacttcttattctctcgaaattgctgaggaaaaccatctccgtgaagaaatccaagccga

SEQ ID NO: 40017 - DNA, 717 bp, Glycine max
  Peptide Sequence Number=SeqID_156795
atgcctgggacagatatgcagacaatattcttggccggaaaatccttccggaaaggaatggaagttgagaggaggaactggcataaggagctcaccaacttctcagagggaagcattgatgttgctattgttaaagaattttatgctaacctctatgaccctgaagacaaatcgcttaagcaggtaagggtgcgagggaacctaattaaatttgatgttgacgccctcaacaccatcttgaagacaccagtggtcatagaggaaggggagagcttgcccgcctactccaggtttgctaatcagaggcctgttcctgaagagcttgcagcccatctatgtctccctgggagaggatttgagttgaatgcagacggcctacctctgaagatcttgaggaagaatctgactactctggcccagacctggagtgttctatccttttcaaacttagccacaacatcccacacttctgacattactctagatatggctaagttgatatgcgggctcgtcatgaagatggatattaaattggggtccctcatctcagagctcagagctttccttgtctatgctgcaaagcctgcatcagggccaactcctaatcatgcagagtttgcaagatgtggtctagcggcggcaagttatgagtgtcgaggagtttcttcaggaggtggcctggccaagagtccagccttctcctttgggagggggtga

SEQ ID NO: 40018 - DNA, 792 bp, Glycine max
  Peptide Sequence Number=SeqID_156796
atgttggccaaaacatcactgaccgatgtcaaccaaaacagtctgggcaacaacgacaaaaaaatatccctggtcaatgttgacaaaaattcccatgacccacgccagtcaaaaaatagtcctgccaatattgctgaaactgcaaaacgggttggaacaattgtgattgctgatgaagtttatggccatcttgcatttgcgggcaagccttttgtgccaatgggagtttttggctctattgttcctgttctgactcttggctcattttctaagagatggatagttcctggatggaggcttggttggtttgtgacaaatgatccatctggcacttttagaaatccaaaggtagatgagcgctttaaaaagtactttgatcttttgggaggtccagccaccttcatccaggcagctgtacctcagataattgagcatactgaaaaggttttcttcaagaaaaccattgataatttgaggcatgttgcagatatatgttgtaaagagttgaaggatattccatacattatttgcccttataaaccagaagggtccatggctatgatggtgaaactaaacctttcacttctggaggatattagcgatgatattgatttctgtttcaagcttgctaaggaggaatctgttatcattcttccaggaactgcggtagggctgaataattggcttcgtattattttcgctacagatccagttgctcttgtagagggtttgaagagggtaaaatctttttgtgaaagacatgcaagaaagtggtcaatgactacagaataa

SEQ ID NO: 40019 - DNA, 1080 bp, Glycine max
  Peptide Sequence Number=SeqID_156797
atgcaaaaaattggtgtgccttcctgtgaaggtgactgcatatgttcatttactttggcacagccttttatgatgtcaccttatataatttctctaggaggccctagtaaggagatcctgatctctgggatgcttttggatgaaagccaggtcagatccatcgtggatgagataaaacaggtgatcacagctagttcaagtagaaaacgagagagagcagagaggacccgagctgaagattttgatgctgaagagggggaactgattaaagaggaaaatgaacaagaggaggaagtttttgatcaagtgggtgagatattgggaactttgatcaaaaccttcaaagccaacttcttgcctttctttgatgaactatcatcatatctgacacctatgtggggaagggacaagactccagaagagagaagaattgcaatttgtatttttgatgatgttgcagagcagtgtcgtgaagctgctgttaagtattatgatacctatctcccattcctgttggaggcttgtaatgatgagactcctgatgtcagacaggcagccgtgtatggtctcggtgtttgtgcagagtttggtggatctgtgttcaaacctctggttggagaggctctttcgaggttaaatgctgtgatccagcatcctaatgctcttcattcagataatgtaatggcatatgacaatgctgtttccgctttgggaaaaatttgccaatttcatcgtgacagtattgattctgcccaggtagttcctgcatggctaaactgtttgccaataaaaggtgatttgattgaggccaaagttgtgcatgatcaactttgttcaatggctgagaggtctgacagtgagctgttgggcccaaacaatcagtaccttccaaaaatagtttcagtgtttgctgaggttttatgtgctggtaaagaccttgctacagaacaaacagctggtcgtatggttaatttactcagacagctccagcaaactttaccaccctctacactcgcttctacttggtcatctttgcagccgcagcaacaacttgcattgcaatctatcctttctacatag

SEQ ID NO: 40020 - DNA, 342 bp, Glycine max
  Peptide Sequence Number=SeqID_156798
atgtttggattatggtattttaattattttgagctctgtcagcaagctttaactttagtttttgtggagacaaagaagggagctgattcgctggaacactggttgtgtcttaatggttttcctgcaactactattcatggtgacaggtcacagcagtgccgcgtcccgcgtcggaggtgcaccagacacgcaaacgggtacgactccggtgcgacgcggtgtccattgcctccgccatcaccggacatggttggacgcaggaagcgcgcgattggacgcggcccaccaagaggacacgcgcgattggacgcggcccaacaagatatttcattatttatttaa

SEQ ID NO: 40021 - DNA, 1905 bp, Glycine max
  Peptide Sequence Number=SeqID_156799
atggcatttgttcaacattttcatcaagaagttgactctgtttcttgctactgtaaagtagattcaggtctgaaaacagttgttggggcaaggaaatttgttccaggatcgaagttatgtatccaacctgacataaaccctaatgcacataggagcaaaaactcacgtagagagaggaccagagttcagcctcctctcctgcctggtcttccggatgatcttgctattgcatgtttgattcgtgtacccagggttgagcacagtaaactgcgtttggtttgcaagagatggtatcgccttctgtctggaaatttcttctattcactcaggagaagtcttggaatggcagaagaatgggtttatgtcatcaaaagagatcgtgatggaagaatttcattgcatgcttttgatcccatctaccaactgtggcaatcccttccacctgttcctggggaatattctgaagcattgggatttggctgtgcagttctcagtggttgccacctgtacttatttggtggaagagatccactgaagggatctatgagacgtgttattttctacaatgcccgtactaataagtggcatagagcaccagacatgctgcggaaacgtcatctgtttggttcttgtgtaataaataattgtctctatgttgctggtggggagtgtgaaggaattcaaagaactcttcgatctgctgaagtttatgaccccaaccggaacaggtggagctttatctcagagatgaccacagcaatggttccctttattggtgttgttcataatggaacatggtttttgaaaggacttggatctaatcgcaatgtcatatgcgaatcctattcccaggaaactgatacctggaccccagtgagtaatggaatggtcaatggttggcgtaatcctagtatctcgctgaacgggcaactctatgcacttgattgccaggatgggtgcaagctcaaagtatatgacagagcaacagattcatggaagaagttcattgatagcaagctccatttaggtagttcccatgctcttgacgctgctgctcttgttccccttaatggaaagctttgcattatacgcaacaatatgagcatcagtctagttgatgttttgagttcaaacagacgtgtggaaagcaatcctcaactttgggaaaatattgctgggaaaggtcatgtcaggttcttcaagcctgagatccaaactcctctgatgataatcttggctatacagttagggaaattgttggtattttgggaaaatcaaattgaaacaggtttatccactttcctgtgcgggaaagagattgtgcttcattgtaaagatgagttgtttgcggcagttgttgatgaatgcatcagccattttgttgatgtcatctttctcattctcataaactatttgtctgctcatcaatggcttcttcctatcgttactttcattgctgctcctcttgttggtgccgctgccactgccactgaaaaacctcagattcagattcacttccctgaacttggtttggttgctgaacagtgcattgaaatgagttggatcgattcagtgttgttttgggacaactatccggtggggacttcggttgatgttttgcttcaaaggcataatacacaggagaaatacttgaagaagaaatcagattatgtccagcaaccaatttccaaaactggccttgaaggtatatggaacaagatgatggagctagaaaaacctgttcttgcattgaatccctatggtgggaaaatgggtgagatttctgaggtggaaacaccgtttccacctagagctggtgtcaatggacctggaaatgctaatcatgcagaggctagagtttggggaaagaagtatttcaaaagaaactttgatagattggtagag

SEQ ID NO: 40022 - DNA, 183 bp, Glycine max
  Peptide Sequence Number=SeqID_156800
atgaacaaaaattataacaatccaattcaagagaaaaagaatcaaactttgagaggaacaaggttggaaaagggtgtcaaagactatgggcaggaagaagaacttttcaattctagaggcaacagagaagaagaagaagatgatgataagaaggaatatgcaaagagattggatagattttga

SEQ ID NO: 40023 - DNA, 615 bp, Glycine max
  Peptide Sequence Number=SeqID_156801
atggcatatgaagcttcttggaatgatgttgtcatgtattatatcctagaagtgtataaggaagttgggattaaggttgagaagcaactttttggtgttacaatcgtcatcggaatatccaagacttgctttattttgatatcaaccttgttcttggaccaagatgggaggaggcccatgttgttgttaggctcatgtagcatggcaatctcattgtttgtgctgggcttgggttgtaccttgcttaagttatgtggtgataacaaggatcaatgggtcattgctttgtgggtggttgctgtctatgttgcagtatcatgcttttgtattgggcgtgggctgacaacttgggtctactcttctaagattttccctctaaggctaatggcccaaggttccaacttggccatttttgtgaaccgtttgataagtgggattgtgtccatgacattccttagtgttttagaggcaataacatttggaggcatgttgtttgtgcttggtggggtgatgacaccaaaggcaaaaggtaagaggagattgaagcgttgtttgaagataaagtgcattgaatctgagagtaaggtttacattaaagctttcatctttctttga

SEQ ID NO: 40024 - DNA, 173 bp, Glycine max
  Peptide Sequence Number=SeqID_156802
cactccctgcgtctgcttttcttttcataacgttttcatcggtaaagaacatcacatcacaagtcacagcctcacatgatagtacggagattctctggcatattcttgggccattgcccactcttccccctcactttctgactttggagtttgggcgggagagaaaatattga

SEQ ID NO: 40025 - DNA, 306 bp, Glycine max
  Peptide Sequence Number=SeqID_156803
atggttttgagaatgaatggcacttgttctttggatgtgatcatgcaatttctatttggcaattatctggattttggcataaaagtcagcagaagatttatcaaggcaagagcgcaatggagcattggagaaccaagtccaacagaagtagaagcatgggcattgttacaaggtcttacatgggttcagcagctccgataccaaaacattatcattgagcttgattgcaaagctgttgtcgatgatctaatgtactgcaatggcaacaaaacatatgagatcatttttataaggaagctaagataa

SEQ ID NO: 40026 - DNA, 1200 bp, Glycine max
  Peptide Sequence Number=SeqID_156804
atgtccaaaaagatgggcttggtgagaataggttctaaaaagagacaaggtgacatcaaaagatcaaaacccagatgtagaaatagcaaggaaatggctactttagttgaaccccccaacagaattaagcctaaggggaagcattattatacaatatggcaaacattgtttgagattgatacgaagtacgttccaatcaagcctataggccgaggagcatatggcgtggtgtgctcttccatcaacagggagaccaatgagaaagttgcaattaagaagattggtaatatatttgagaattctattgatgcattgagaactttaagggagctgaagctgcttagacatattcggcacgagaatgtcattgctttgaaagatgttatgatgccaatccacagaacaagttttaaagatgtctacttggtctacgagctcatggatacagatcttcatcaaattattaagtcctctcaaccactttccaatgatcattgcaaatatttcttgtttcagctccttcgaggtctaaaatatcttcattcagcaaacattcttcaccgggacttgaagcctgggaatctgctcgtcaatgccaattgcgatttgaagatatgtgactttgggcttgcacgaactaatggagttgatggccagtttatgacagagtatgttgtcactcgctggtatcgtgcaccggagctcttgttatgctgtgacaattatggaacctctattgatgtctggtcagtagggtgcatttttgctgagattcttggtagaaagccaatcttccctggaactgaatgtctcaaccagctgaaactaattataagcgttcttggaagccagcatgaatctcatcttgagtttattgacaatgcaaaagccaggagatttatcaaatcactgccctgtactagaggcagacacttctctcagctatacccacaagcagatccattagccatagatttgttgcaaaaaatgcttttgtttgatccaaccaagagaattactgtcttggaagctctccaacacccgtatatggctggcctatatgatccaaggtgcaaccctcctgctcaggttcccatcagtcttgacatagatgaacattggggagaaccgatgattagggaaatgatgtggaatgagatgctacattatcatcctgaagctgcttctaccaatgcatag

SEQ ID NO: 40027 - DNA, 1792 bp, Glycine max
  misc_feature (33)..(33): n is a, c, g, or t
  Peptide Sequence Number=SeqID_156805
gcatggttgtgcgaagggttttggagtgggaantggtgagaatcctggagagatgcagcagcctgaatcaggcgaaagaagtccacgcccaaatctacataaagaacctccagcaatcttcctacgtactcaccaagctcctccgcctcgtcaccgccctcccccacgtccccctccactcctaccctcgccttctcttctcacagctccacaccccaaaccccttcgcctggaccgctctcattcgcgcctacgctctccgaggacccctctcccaagccctgagcttctactcctccatgcggaaacgacgcgtcagtcccatctccttcacgctcagacactcttgcttggtggcttctcctctgatttgtacgtcaacaatgccgttatcgacatgtacgtcaaatgcgggtctttgcgttgtgcgcgcatggtgttcgatgaaatgcctgaacgggatgtcatttcttggaccgggctgattgttgcttacacgaggatcggtgatatgagggccgcacgggacttatttgacgggttgccggttaaggatatggtgacttggactgccatggttaccggttatgcgcagaacgccatgccgatggatgcattggaggttttccggcggttgcgagatgagggtgtggagattgatgaggttaccttggttggtgtcatatctgcttgtgctcaattgggtgcgtctaagtatgctaactggataagggacattgctgagagttctggatttggggtaggagataatgtccttgtggggtcggctttgatagacatgtactcaaaatgtggtaatgtggaggaggcatatgatgtctttaaaggaatgagggaaagaaatgtgttttcttacagttccatgattgtggggtttgctatacatggccgagctcgtgcggctattaagttgttttatgacatgttggagaccggggtaaaaccaaaccatgttacttttgtaggggtgcttacggcatgtagtcatgcaggcttggtagaccaagggcagcagctctttgcctccatggaaaagtgttatggtgttgctccaactgcagagctttatgcttgcatgacggatcttcttagccgcgctggatacttggaaaaggcacttcagcttgttgagacaatgcctatggagtccgatggagctgtgtggggagcacttcttggagcatcacacgtccatgggaaccctgacgttgctgaaattgcttctaagcgtttatttgagcttgaacctgataacatagggaattatttgttgctttctaacacttatgcatcagctggaagatgggatgatgtgtctaaggtcaggaaattgctgagagagaaaaatttgaaaaaaaatccagggtggagctgggttgaagcaaaaaatggtatgattcacaagttcgttgctggtgatgtgagtcatccaaaaattaatgagataaagaaggagttaaatgatcttttagaacggctgaaaggtattggataccagccaaacctaagttcgctgccatacggtattaatgatagagagaagaggcttttactaatggctcatagtgaaaaactagctttggcatttggattgctgagtactgatgttggttccactataaagattatgaagaaccttaggatatgtgaggattgtcatattgtaatgtgtggagcgtcaaaagttacaggaagaaaaattgttgtgagggataacacgagattccaccactttcttaatggtgcttgttcttgcagtaatttttggtga

SEQ ID NO: 40028 - DNA, 597 bp, Glycine max
  Peptide Sequence Number=SeqID_156806
atggagtatcaaaaccaaagggccaaggagggtagattctgtgagaaactcaagatcaagaataggccaaagtttgtaggagtgagacaaagggcttcagggaaatgggcagcagagatcaaagacacatcaaagaagattaggctttggcttggaacttatcaaactgctgaggaagctgctcgagcttatgatgaagctgcatgcctccttcgaggttcaaacactcgcaccaatttttctactcaagggtgtggcgttgctacaaattctcctatatctctcaaactcagaaacctccttgatcgtaaagccatgtcaaatcaaagtcaaagtcaaattcaaaggcaatcctctatgataagttccactttccaaggtgctgatacttcagctagtccaaatgttagtgccatcaataagatcatggttatggaaaactactctgcttgtagtagtgaaggaatcagtaacaagattttcggtacaatggtactttgcccagagtgtaacaattcttttcaactcctcaaagttaacccattggatattttgcaagctcgtgatcacttacagtcacaccccatctcagtataa

SEQ ID NO: 40029 - DNA, 960 bp, Glycine max
  Peptide Sequence Number=SeqID_156807
atgacgaacatggatctcattgggtttcgtaaattacaggaatgccaagccaaggtctcgcccaatacctactctccgctcccaagagcacgcaccaccactattgcacttcttcctcgttctccctctttttcttcttcttcgctaaacccttttttctatctcactaacacaacaatgggagacgagaagaagggcaagcctgctgcttccggcgtgtggtccaccatcaagcctttcgtcaatggtggagcctccggcatgctcgccacctgcgtcattcaacccatcgatatgatcaaggtgaggattcaacttgggcaaggatcagctgcgcaggtcacttccaccatgcttaagaatgagggttttgctgccttctataagggtctatctgctggattactcaggcaggctacatacaccactgcccgtcttgggtcatttaaaatcttgacggccaaagctattgaggctaatgatgggaagcccctgccactgtatcagaaagctctatgtgggctgactgctggtgctatcggagcaactgttggtagtccagcagatttggcactcattcggatgcaggctgatgcaacattacctgctgctcagcgccgaaattacactaatgccttccatgcactctatcgaattactgctgatgaaggggttttggcgctttggaaaggtgctgggcctactgttgttagagccatggcattgaacatgggcatgcttgcatcttatgatcaaagtgttgagttcttcagggattctgttggtcttggtgaagctgctactgttctagtagtctatgctcccattgacccacttgtagacttaacaacactgaaacaaaatgatttagtcaaaccttacaatagttgggttgtcttccacatccactgccattattttatttgccaaaagctcaatagttgccaacagatacaatag

SEQ ID NO: 40030 - DNA, 1377 bp, Glycine max
  Peptide Sequence Number=SeqID_156808
atggaaacaaaattaatttactgtggagcgagatgcaccaaagatttatggctgttctttaagcacatagaccatgtttctccttgcagtcgagtcattgaggcggctacatgtaaagttattgtgctccctgtgatgggtgaagatgtaggagtacaattacgagaacaagacttatcatggaaaggttttctctcttctgccaatcagactcagaatcccaggtctgatcattactctccaagctatcaatcagttgattctgtcactaatatactattctcttctggaaccacaggggatccaaaagctattccttggactcaacttgcaccaatacgaagtgctgctgatggatgggctgccattgatattaaacctggagatgtgtattgctggcctacaaatttaggatgggtgattggaccaacagtattgtatcattgctttctaactggtgcaactctggctttgtaccatgggtctcctcaaggtcgtgattttggaaaatttgttcaggatgcaggtgtcaccattttgggaacagttccaagcttagtaaaagcttggaagagtacacaatgcatggagggcttggattggacaaagataaaaacattttgttcctctggagaaacatcaaatgttgatgatgatctatggctttcttcaaaagcttattacagtccaattgttgaattgtgtggaggcactgagcttgcatctagctacattgcaggaagtcccttgcagcctcaagcttttggagcatttagcacagcatcaatgacaactggttttgtcattttagacgaaaatggagttccttatccagatgatgttgcttgtgttggggaagtgggcttatttcctctctctctgggagcatctgacagattgcttaatgctgatcatgagaaggtttactttaagggaatgcccatttataaggagaagattcttaggaggcacggagatataataaaaagaacagttgatggatatattgttgtgcaagggagggctgatgacaccatgaatcttggtggaataaagacaagttcagtagaaattgagcgtgtctgtgatggagcggatgaatgcattctggagacagctgcagttggtgttgcaattgcaaatagaggcccagaacaactggttatatttgtagttttaaaggaaggatacaattcaagtgcagaaactctaaagatgaaattcactaaagctattcaaagcaaccttaaccctttgtttaaggtaagccttgttaaaattgtgccagactttcctcgaacatcttccaacaaaatactgaggagagtaatgagggatcaaatgaagctccagctatcagttcagagcagactttag

SEQ ID NO: 40031 - DNA, 936 bp, Glycine max
  Peptide Sequence Number=SeqID_156809
atgggaaagagcgtgggggagttgggagtggaggagttggtgaatgcaggaggcctaagagtggaagaaggcaatgaattgtaccatgctttgagggatatcctttctgagtttcagtctccttcacacatatggcgccaaattgtgactcggagactgctcaaaccatcctatccacactccttgcatcagcttctctactactctgtttatcactctcaacattcttccctcccactctattgcttcccttctctagatcaatccaaacgctccaacctaggccgtctcatggaaaaacatggacctgagcttttaggaccttcctacaaagaccctattactagttatcctctatttcacaagttttctgttcaacaccctcagctttactggtcccttgttctcaaggaactttcagtttcctttgttgaacctcccaagtgcattttagatacttctgacccttctaaacatggagggacttggctccccggttctgtcctcaacattgctgattgctgtttgcaacccagttcacacccccacaaaacagatgacactttagccatcgtttggagagatgaaggtttcgatgattccgaggttaatcatatcacgctcaaacaactccgccaccaagtgatgttggtagccaaagcaatagatgccacattctcaaggggagatgcaattgcaattgacatgcaaatgacagccaatgccgtaataatctatttagccattgtcctagcaggatgtgctgtggtctcaatagcggatagctttgcaccaaaagaaattgcaactcgcctccgtgtttccaaagcaaagggtattttcacacaggatttcatagcaagaggtggcaggaaattccctttgtacagtattccatctaaccccttcctatcacatctcccaaatcctgcttga

SEQ ID NO: 40032 - DNA, 177 bp, Glycine max
  Peptide Sequence Number=SeqID_156810
atggcaccaaatgaaatggaaagcttggaagcaggccaaagatctttgaatgctaaaaaagagaaacctttccatgtttcagggcaccaatcacattatgccaaaattgttgaaatcattgccctaggaatcccatacttgaattgcatggtgaatagccaggagagggacacgtga

SEQ ID NO: 40033 - DNA, 3084 bp, Glycine max
  Peptide Sequence Number=SeqID_156811
tccgcaatagggctcaaactgatgatattgatagtgaacctgataattatgtggatgctctcaacaccattgaatcagaatctgaaaatgatattgattatataacaaaacgagaggtgcagcagttatcttcacgtgtcacttgtggaatgattgaaaatggagttagtgaagctcctcctaatttaatggacaataatttatctgatgtcgttttccagactgattatactgttctcttaaatgaagaacaagggcatttagctgactcactgcaagaaaatcatgttcttgatcttttatcaaagccaaatgcatctaatttgggatatgtaagtccatctgatgatcttgatagagaaaatatgaccagagacactgcttccttaaacaaagaaccattcagggatttgcctgactctctgcaagatattcctcctctcacatcagagccacatgtatctaatttgggacctgtaagtccatcagatgttctttatagtgaagaaatgaccagagacaccatttgcttcaataaagaaatgttcgggaatttgcctgactcattgcaagaaatttctcctctcacatcagagccacatgcatctaatttgggacttgggaatccatcagatgttccttatggtgaagaaatgaccagagacactgttttcttcaacaaagaaacatttgggaatttgcccaacttgcaagaaattcctcctcccacagtagagccacatacatcaaatttgggacctgtgaacccatcaaattctcctcacagtgaagaaatgaccacagataccgtttccttaaacaaagaaatgcttgcgaatttgcctaactcattgcaagaaactcctgctctaacattagagccgcttgcatctaatttggcatttgtgagtccatcagatatttctgttagcaaagaaatagccaagaatatagctgattctcatccctccaagactcctgcctgtgagcaggttcctcgcccaagtgaaaattctgttttggataactcagtatgcactgactcctacattggttcttctactgttaatgatacagtgtcagcaccaattgagactgatatatcattttctggttccaaaaactctaatttaccagatgaggaagcaggtaagatcaacaacaatatctgcaaatctgaagagactcatagagagtctttggctgatcattcagttaggttctggactaatggtggattattaggactcgagccatcaaaacctcctgactttaacaagtcaacttctctaggtcaagggtctttgagcactaaaagtgaaacagatggtggttcacatcataattcaatgcaaaagagcaatggttataaagaggaatgggaatcatcagaagaggttgctgagcagattctaaaggaaccaaattctagattcttaacgtcaggccataatgatgaccaagcttgtgtctctgaaaaggccactggcaattctcagcagagtaatggatttggtcagactgagagggacaatttaggggaaatcagggtaattgcacctggaagtattctcccatcgacccctgacacaaaggacagtactgaacccaaccagggaaatggtgaaaactcatcgcgtgtgtttggacttagtcgtagattactaataaatagctttcagcggaaagtttcttttgatgaaaaatctgaacattataattctctgaaatctgttatattggaccagagtggacaaaatggcattgtaggaccatcacttcctgagacaacatcctccaaagagaaagttggttctggatatcctataaagtcacttcctccttcacctccacttgaacatatgaaaatatccttccatcctgtcagtggactagagacctccaaattaaaactgagatttccggatggcagtaatcatcatgaaagcgtaaatgatatgtttccttctttccagttggttcctgaagcttctcttcctctggatggttcagtttctcactctgatgatgatgacactttctgtagatcatctccatacatatcagatgatggtcaaagccctcgctctgactataattctgatcagtgggaatctgatgagactccggaaagcagtgaccaaggggtgcatgattctccttgcagaaggtcatcaactgaatctgtgtccaatgatgataccaatgcaaaaagtggacatggtacatgtactatgaatggtgtggaacattctctgtccaggcctttacttgattttccaagttacgataatgttaatcctgcacttgagaaagaaagtaaaaaacattccaaatgcaataatgctgttatgtcacatagtcatgcagagcctgcacaaccaccacctcctcctcctcttcctccaacgcaatggcgagtctcaaaaccacagttggatatgacaagtgggacacagtattgtatgtctgaagatgctgaacatattggtgatcacagtcttccagattctactatcctccagcagcctagggtcacccaggttgagcaaatacaaattaatcacgatgatcatgaatcttatgacaacattatatataaattgaaggacaagctggatcagcagaagttgaagggtcagaaggaagcaaaccagttgagaatgggaaaggagatagatgaaagagaagatttcctatatcaaatcagaacaaaagcattcaacctaaggcccacagtatcaggaaagtcaaatgataccactggttccacagcaaacgtcaaagttacagcaattttggagaaggcaaatgcaatccgtcaggttgttgcgagtgatgatggtgaagatgatgataactggagttaccccacaaattgctgtcctcctaaagccagtgccattggtaaatcaaatcttaattctgagataagggttgagtttgctgcacaagctgaatttcagaagtatatttatgtgaaggttgaagatcctcaacttgcaccaaagaatcaggttgttcaccatgtttcatcgcgtcgatttgtggcttctgcagcagcaccattgtgtccaaggggaa

SEQ ID NO: 40034 - DNA, 240 bp, Glycine max
  Peptide Sequence Number=SeqID_156812
atgtctagcgttagggtccctttcatgtcgaaggttcggagccatagaaagaaagccactgtttggtcacacctcacagacccaaaccagtcattttatcacacaacactttccggacacacaatgatttccgttcaagaatggcttgcaaagttggcaatgtccctcttctcccttacctcaccgatccgtacacttaacctgctttctcactcttcgtcgcttctctttggcagttaa

SEQ ID NO: 40035 - DNA, 594 bp, Glycine max
  Peptide Sequence Number=SeqID_156813
atgacaacagcttccaggagtcatagattgatggttcaggttcaaaacattgaagcttcactacctgccttggagaaggctgtattggcacaaacaagtcacatacatttagcttacacagctggttgtgaatggcatccacgcatgaaagctgctcgaaatcatttcatttacaatgacttgcctcactttattatggattcatatgaagaatgccgtgatcctccacgggtacacttgcttgataaatttgatactggtggcccaggatcttgtttcaggagatattcagatccgaccttctttaaaagagtatctgcagattcagatgaatcttactctgggaaaactgaaaaagcaaggaaatctcataaaagcaagaagaaaagatcacgaaggaatggagacattttaaggagtgaacagaggcacagcactagtggaaggtattacatctatatatgtctatttaatcttggcatacttgttcattcaaaatcaacacttacatattatattgactacccagaatgcaatctatttcttctgctatcagtgggcaaacctcttcctcacaaacagcctccaccatag

SEQ ID NO: 40036 - DNA, 204 bp, Glycine max
  Peptide Sequence Number=SeqID_156814
atggccgtgatcaagagtctgaaaactggcgccagggtggaggatctggtcttagatcgagaggtcacattcaaactttttgagaaagcaatttgtccctgcaaagtagctcaagtggtagttatcaggacaagggttggaatcttccctaaaacacaaatcattgtgtttgatcttccatcaggaaaatgttttgctccttaa

SEQ ID NO: 40037 - DNA, 569 bp, Glycine max
  Peptide Sequence Number=SeqID_156815
cttcaccgtctgtcgtgaagcggacacgcaaagccttacatctacaatccttgtctaccagaccacctggtgctgacagaccagtggtccatgttgatcctactaccggcaaggctgacgatccccacaggaaaaaattaagaacatatttggggattgtggcacgtgataaggtggacgtcacgtacgagaactggaaggaggtccttactgctcagaaggacttgatttggaaggatattcatgtggaatttgaaatcccagaggcttctgacagtaggacgaaaaagaagttgcttcagactgtcggtgagagatggagacagtttaaatcagacctcacgaggaaatgggcccttgcagccgatcaggacggtgtggacgacaccgatgtgcgcaaaaaggcacaggctatccagaaacagaacactgccccccacgtatcaagcaatactttggattggctccatggacgtcccgtagctcttcctccctgcctcctgaagaattacaatagccgacccagcaaatcagggaccagctacaggagtccatcacagaaaacgtga

SEQ ID NO: 40038 - DNA, 295 bp, Glycine max
  Peptide Sequence Number=SeqID_156816
atgtcgcgggggtcaggagaccttggggacgtcaggtggggtgctattgcccaaaaccaagcttggctaatcccgacccaacccgggcatagtcagtcagtgagaacctgtgacgtacctaagcaggcgagctcctggcagtcaaccaataaaagaacaaagtccacgaagcaaggaggcttgtgtggcgactggccggctatgtatcttgggtggtatctgagaattagcctctgggcactggtaatcgattaccagatgggtgtaatcgattacacagtgttacctgctactg

SEQ ID NO: 40039 - DNA, 735 bp, Glycine max
  Peptide Sequence Number=SeqID_156817
atgtggggtctctcgtcgaaacccgacggatgtgattcgtcgcgtgatcgacctcaatctcacggccgccgttctcgtcgcacgccgttcgctccaggcactgccggccggtggggtgttggtcaacgtgtcctccggcgcggcgacgacaggcgcgccgggagagtacgtgcactacgcggcggccaaggcaggagtcgatgcgctcaccaaggggctcgccatcgaagccgcggcgcagcaggtcagggtcgtcggagtcgcccctggcacgaccgacacggaggaagtcgccgaggtcatcagcttcgcgctttccgccgccgccagctacgtgtccgggaccacgatccgcgtggccggcggggtgtagcagccggggccaggcccggggagtccgcacgaccccttgagccaacggcgagcgtgttcagtcgagcagcttccgcagccgtgccttcttcaggttctcgcggacgatccacgtcacatcggcgtcttcgccactgtccagcgcttggaaacgcgcgagtccgggttgcggtgacgcggccacggcgacgctccagcagtatccgagcgccctgcggagaacgcgcttgtcctcgtcgcgtcggcgttccggcgggagtgcgcggatcagctcggtcgcggcctcgcacgcgtccagggccgctcgagccgtgtccgcgtcgaccaggagccggggttcgcagatgccggcgacggcagcgc

SEQ ID NO: 40040 - DNA, 369 bp, Glycine max
  Peptide Sequence Number=SeqID_156818
atgattaatgcaaactatccgcaagaatcattgcatccaatctcaaacgggaatctaaggatagacttccataaaagattttgtaaatataatttcgaggagcgaacctgcagatctgacggcacggagtggaggtccttaaagtggctggagctgcagcaagagcgatcggagcaaaaatcgccggaaacaaccgtgccggtagaactgacggaagcttccggcgagacggtagtgtcgggaaactgcgtatcggaagagcgtaactggaaggaagcggtggtttttcttttcttggatatggaatgttggcttgaagaaggttgttctatggcggcaattgtgagagagcagcgaatacacacctga

SEQ ID NO: 40041 - DNA, 417 bp, Glycine max
  Peptide Sequence Number=SeqID_156819
atggcgctgctggtggtgccggagcatgcgccgctgcgcaacccgaaaaccggcgggatcatcccttcgccgtttattcagggcatcgtgccgatcatcatcctgttcttctttgtggtggcgattgcctatggcgcggtgacgcagcagattcgccgcgctgacgacatcccccgactgctggtggatccgatgaagagcatggccggttttatcgtcatggtgtttccgctgtcgcagttcgtggcgttcttcaactggagcaacatgggcaagtttatggccatcggcctgaccgatatgctggagagcgccggcatcagcggtgcgccggcctttctcggcctgatgttcctctcggcatttctgtgcatgtttatcgccagcggctcggcgatctggtcgatcctcgcgccg

SEQ ID NO: 40042 - DNA, 540 bp, Glycine max
  Peptide Sequence Number=SeqID_156820
atggccgctgttccagacgggcaggcgcggttcgacaaatttatcggtcagcagcgcgccggccacggtcagtacgatgaccgagctggccatgaagaaccagttatcgatcacgctgacatggaccgtgtcgctgaccgctttggcggcctctgtactgatgccggagagcagtacgtcggtggtgacgatcagcagattcgcggtaaaacccgatgcgacgccggcaatcgccgccagcaggcccgcgaccggatgacgcccgacggcaaggaagatcagcgcgccgagcggcggcatcaccaccagtgcggcatcggaagagatatggctgaagaacgcgataaacagcaccatatagctggcgtagcgacggctgacgcgcgacgccattttcaccatcagcgactgcagcagcccgactttttccgccagcccggccccgatcaccagcgccagaatggagcccagtggggtgaagccgctgaagtttttgatgatgttgggcaggatccactgaatgcccgccacgctgagcag

SEQ ID NO: 40043 - DNA, 390 bp, Glycine max
  Peptide Sequence Number=SeqID_156821
atgaagaaaagatatagaggccatcaaagtgtgtcattggagaataagacaggagattcaagtgtggtcaagatgagtgagaaaaataataatgttgatgccggcgactgcatgattcttgatgagcatgaaggagaagagcattgttgtggcaaaggaacaaatgcgaggagtgtttcttttttgccaagaagccaagagaagataggagatttggctaaagttgtgataaaacaagacatgaagggaggagagcataaatatgggtttaacaacaataaacgtgagaagccagagaaggtaagggtggtggatgatgaaactggcgacaaacatgagctgtatgaagtcctaaggatgccatctagatgtgtatttttcaagatatag

SEQ ID NO: 40044 - DNA, 286 bp, Glycine max
  Peptide Sequence Number=SeqID_156822
cagaaaagacggatctcagaacatagccatagttacggtttcagggcttagagagactggactggacgcgtaccgaacgaagatcgtgtctatttacgctcaaacaatccatataggtggaaagctggaagcttcaatagttccccgcgggaccttagagtgctatgatggggtatttcaagcactttacgtccccccgctcgccttcagctcacctggtcctttacttgaccaagggaaaatcccgaagaaatgtgccgagcagaatagcagcatcatgctttaa

SEQ ID NO: 40045 - DNA, 372 bp, Glycine max
  Peptide Sequence Number=SeqID_156823
atgtcacgttacagaggacctcgtttcaaaaaaatacgtcgtctggggtctttaccaggactaactagtaaaaggccaacagtcaaaagcgaacttagaaatcaatcgcgctccaaacgacaattgcttaaatacgttcgtatcgccggaaaagctaaaggatcaactggtcaggttttattacaactacttgaaatgcgcttggataacatactttttcggttgggtatggctgcgactattcctcaagcacgccaattaattaaccatagacatgttttagttaatggtcatatagtggatataccaagttatcgttgcaaacctcaagatattattacagcgaaggatgaacaaaaatcgaaactctga

SEQ ID NO: 40046 - DNA, 477 bp, Glycine max
  Peptide Sequence Number=SeqID_156824
atgatggtgtcctcaccaccgacgttgacatactaccaaacaacgtcggtgccactgacgttgtattcttgcattacaaagacgggtcctaggatgaccgatgttgttgttgtcgacatacaacgacatctggaacaaagacggtgtggggcccgtcgtagataccggttttcaaccgataacaaggcctttgaggtagtcctcctcgctgtgccagagaacgacgagaagtggggggagaaaatcgtggctcgagtttctagcaagtcgttggcggagatcacagaacactaccagaaacttgtcaacaacgtggtgcttattgagtcgagtgagggaagtgaaaagactactcaagaaaaacatcatgggaatttggtcactcgtgagcataatgcaacacaaaagtcacaagaaatggcgcaagaaataatgctgaagctgatgatgcagaactcggtagtcgctaataaataa

SEQ ID NO: 40047 - DNA, 332 bp, Glycine max
  Peptide Sequence Number=SeqID_156825
atgactgcggatacaaccacagaaagttactggttgaattggagggttttggtttgtgccattttggttctgttttcagctatcatttcttcactgattgtattgaagtatgaagtttcacggaagaaagcaagaaatggtgacaaggaaggcctgaatttgaaagaaacatcgtcaactttgtacgaggatgaaatttggaggccttgtttgaaaggaatccaccctgtctggttgctcgggtttagagtttttgcctttgttgtgcttttggtgcttctcatactcactgctaccgaggatggaggaagcattttctacttttacactca

SEQ ID NO: 40048 - DNA, 315 bp, Glycine max
  Peptide Sequence Number=SeqID_156826
atgcttcctccatcctcggtagcagtgagtatgagaagcaccaaaagcacaacaaaggcaaaaactctaaacccgagcaaccagacagggtggattcctttcaaacaaggcctccaaatttcatcctctcataatgggttgccacgtgcctttgggagagccagtcacaaacctcatttcgttttacttcagattctctcagtgagaaagacagagaaaagggaccagggacagggtacatttgtatttggattttgtattggaatgcttagggctaagatgcttcatgtattccaagaatggttttttgcctag

SEQ ID NO: 40049 - DNA, 3950 bp, Glycine max
  Peptide Sequence Number=SeqID_156827
atggatgccattaagcttataactgcgcgggatatcgataaaatgaacaatatctctgtaacgcctaaaggcggaacgattgctactgaagtgagcggtaatcaggttaatttgactgctcccagtgtggttaagctcaaccttaatcaggctgatattaagtctttcacacgcaatggtagtgatttagtggtcaccactaaatccggtgaagtcgttgttattcataaattctacgatgctaacggcgacagcgatctggtgctgcaggacgacaaaggcgcgctgtggtgggtggaagatcccggcacagaaggcttccagtttgtctctatcgacagcacggaagggctgttagcggaaaacgtcacgggtgacggaacactaaccgcctttggtatcgccggcgccgcgctggccggtatcggtgcgctgatcgccggtaacaacggcggtggcggcggcggcggtggggataacggcggcggcgacaatggcggcggcggtgataccacggcaccagcggcggtcagcgatctgctgatcacggataacgcgggcagcgtgcagggcgctatcacgggcggcaccagcaccgatgacaacacgcctacgctgagcggcacggccgaagcggggaccattgtcagtatttacgacggcaccacgctgctgggaacggtcaccgtcggtgccgatggccgctggagcttcacgacacccgccctgggtgaagggaagcacagcctgacggttaccgtcaccgatgctgccggcaacaccagtccggccaccagcccggttgatttcactgtcgatacgcagccaccggcagtggccacggacgtgtccctgaccaacaacagcggcggcagcaccacgccggtaccaaacggatcgagcagcgatgacaacacgccgaccctgagcggccgcggtgaagcgggcgctgtggtcagcgtttacgatggtcagacgctgctcggcacggcgctggtgggcgcgaacggcaactggagttttaccacgccagcgctgagcaatggcagccacagcctgaccgtgacgctgacggacgctgccggcaatgtcagcgctgcgtcctcgccgtttgtggtgacgattcaggcgggcctgccgtcaaccagcagttcgctgcaaattaccgacgatagcgatgccacgctgcgcacgctgagcgatggcgccagtaccaaagacagcacgccggtgctgagcggcctggcgagcgctaacgccgtcatcacgctgtacaacggcaccacgctgctgggcagtactattgccgacggcagcggtcagtggcgcttcactcccgccacgctggcagatggtacttacgcgttccgcgcggttgccaccgacgccgccggtaacgtcaccacttccgtcaccctgacggtcaccattgataccgtggcgcccggcgcggcaggcgatctgctgctgaccggtgacagcaatggcagcgtgacgccgattgccgccggcggcagcagcaatgacaacacgctggtgctgagcggcacagcagaggccggcagcaccgttacggtacgcgatggcaacgtcgtgctcggcacggctatcgtcgccagtaacggcagctggagcttcaccacaccagcgctcagcgacggcaatcacagcctgactaccacggtaaccgacagcgctggcaacaccggtccggcgtcagcggctattgtggtcaccgtcgataccaccgcaccggcggcgatcggcgatctgcaggtgatcgacaacgtgggtgccagccagggcccgctgacgtcgggcgctaccaccgatgacaacacacctaccctgagcggcagcggcgaagccggtgcgctgatcagcatttacgacggcagcacgctcctgggcaatacccttgtcggggccaacggcagctggagctttaccacgccagcgctcagcaacggcagccacagcctgaccgttacgcaaactgatgcggcgggcaacgtcagcagcgcgaccgcggaatttgtggtcaatgtggacgctgcgctgccgccagccagcgccagcattgagctggtgggcgacagcggcaatacccttgtctcactgcaaaacggcgccgtcaccaatgacgacagcccgatcctcgccgggctgacccgggcgggcagcctcgttcgcatctttgacggcggcgatctgctcggcagcaccaccgccgatggcaatgggcagtggagctttgccctgagcaacctgagtgagggcggccacgcgttcagcgccaccattaccgacgttgacggcaatgtgattgacaccgtcaccctgaacattacggttgataccacgccaccggcggcagccagcgatctggcactgctgaacgatgccggcagtaccgcacagccggtaacgggcggcagcgcaatcaacgatgcgacaccgctgctgagcggcacggcggaagccggcagtatcgtcacgattcgcgacggcaacaccgttctcggcagcgtcagcgtgggcagtaacggcagctggagcttcaccacgccagcgctgggcgagggcaatcacagcctgagcaccacggtgaccgatgccgccggcaacgtcagcccggcatcaacgccgatcgcctttagcgttgacaccattgcgcctgccgccgtcagcggcctgcaggtgacggataacgcgggcagcgccaccggcgcgctggcttccggccagaccaccgacgatcgcacgccaactctgagcggttcggcagaagcgggcgcggtggtgcgtatctatgacggtaccacgctgctcggtagcgttaccgccggcagcaacggtagctggagctttacgccagatgcgctcaccaacgggcagcacagcctgaccaccacggtgactgacgcggccggcaatgtcagcccggcatcgccggtgttcacggtcaacattgaggcgggcgtgccggccaccagcagcctgctgattgtcaccgatgataacggcagcacgctggtcgaactggccaataacgacagcaccaccgacagcacgccgattctcagcggccaggccggggcgggcgatctcgtcaccctgtacaacggcagcacggttttgggcagcgttgtcgcgggcagcaacggacagtggagcttcacgccagcggcgctggccgacggcacctacgcattccgcgccagcgccgataacggcagcggcacggtgacggattcgccggtgatcaccatcaccatcgacaccgtcgcgcccgcggcaccgacaggcatccagctgaccaacgatgacggcgatccgctgggcacaggcagcactaacgtctctgcgccaaccctgagcggcagcggcgaagccggcggtgtggtcattatctccgatggcggtacggtgattggcagcaccacggtgggcaacgatggcaactggagcttcaccacgccgtccctcagcgatggcagccacagcctgaccagcaccgtgaccgatgcggccggtaacaccggaccggcgtcaacaccggtaaccgtcaccgtcgatacgcaggcaccggcggcggcaggcaatctgcagctcagcaatggcgacggcacaccgattgccgcaggcggcagcaccaatgacaccacgccaaccctgagcggtaccgctgaacccggcagtacggtgaccgtcagcgacggcgatacggtgctgggcacggcaacggcaggcagcgacggcagctggagcttcaccccgaccgatccgctgagcgaagggcagcacaacctgacgtccaccgttaccgacacggcgggcaataccgggccgggcagtacggcggtgattgtcatcgtcgataccagcgcaccgctgtggccagcgagctgctgctcagcaaacgaccagagcgggcacaccggttgccg

SEQ ID NO: 40050 - DNA, 288 bp, Glycine max
  Peptide Sequence Number=SeqID_156828
atgaaaaagttgccggattttgctgctactgcgccggatggaaatttcctcattctgcttatcttgcctcagcaggttaccgtgcgccttactgagcttagccggcgctcgtgtcgggataattaccgcagcgcagaaaacttcgacgagagaaaagagcagaactggaaatggaaaggcgtgccagcgcgccagaacggcgccgtgaaccgaagagagcgaaaatgtggttcattgtttttatcacctccagcgcctgctaacagcatgcggaaacggagtggatga

SEQ ID NO: 40051 - DNA, 1647 bp, Glycine max
  Peptide Sequence Number=SeqID_156829
atgggtgcttcgatccctatctatacgaacaaaggtgatatacaaaattgcacaaatttcaggggtgttaaactcatgagccataccttgaagctatgggatagggttattgtatctggttctgaagttgtgcaagcaacaaatgtggatcagcaaaatgccagagaagagccagctaaacagagttcaactacatcagtctttgtgaactcacaaccaatgcgggaagaacaaattcagaatgctgtgaaatttctatcacacccaaaagttagaggttcacctgtcatgtataggcgatcatttctagagaagaagggccttacgaaggaggagattgatgaagcctttcagcgtgttccagattcagctccaactgtgcagacaggtggtgtaaatcaagatgggcaattgaaatcatcatcaaacattcagcaacaagcccaacaacaaactttgcagccgggtttacctgcttctactggtgttaatacttcatcgggaaccttatcacgctccagatttcactggtcccatgcccttattgcagttggattactggctgcttcaggtgctggaacagctataataattaagaattctgttctccctcggttaaaatcttggatacgtaaggttgtcttagacagtgatgatgaacaattaaagaaaactgacaacaaaccaacaccgatggaagaagctgtgcaagctgcaaaatcagctgcagctgcagctgcagatgtggcaaaagcgagccaagaaatgctggcttcaaaaggcgaagagaggagatactttgtggaagttgtgagccttttagataagcaagtacaagaaatgaagtcaatgaccaatgccataagaaggttggaagttcttgctgaatatttgtttctgacaaattgtggacaaaatataccttctaatggagtttctgtctcagggcaagaagatcttcgaatcagtcaaacaagttcaaagcaactgattgtgaatggaaaagcagactacgacatgagttcaggttgtcatgttgtgagatcttcatccccacctacatctgttgaaccatcaagtggtcttcatccaaaggcatatgcggagataatggccatggtccaaagaggagagaagtcttctaatattaagcatcgggaggttagtcaggtgcaaagcacatctacccagatgcttcagtctcaagtaaatggtgaagacttgaataccaaggccctggatgcccctctattaaatggggatgacccattaccctggtggcagaggaaaaatgtcagaattagagagattgataatgaaaatgagtctaatggagtacccaatggtgctgcatccagtcagcagccaatccaacagccagttcaacgcgtatgggttcctcctcaacctccccccatagctatgccggaggctgcagaagcaatcaggcggccaaagccagcggcccaaaaggaacagatgtctgataatcagtcagtagctcattctttagacggttccgatgatgtacatatggacccaaaactattggaatctgaaggtgcagttgagggaagcagtgtcagctcggttcccacttctagtgagatacaagaggagcatgaagtcaaatatgatgagaaatga

SEQ ID NO: 40052 - DNA, 126 bp, Glycine max
  Peptide Sequence Number=SeqID_156830
atgggtgaattgaagggcaaaagtgaccctacgttgacgaatcatgtgatacagaaatattgggactcaacgtgggggttggaggacgggaagtgcgagctactcaaattacttagaggacaataa

SEQ ID NO: 40053 - DNA, 1982 bp, Glycine max
  Peptide Sequence Number=SeqID_156831
atgccagagatcgttacaaatggagttaatgatgaaagaagagtaaatgaaatgaatgagattgggaacatttcacccttgagggaaaccccaagtccaatcaagaacctgaggagttccttgagtccacaaagaagacaaagtgttggtccaaattttcctgttaatagggtgattgacacttcctcaattgataggcttcatggaaatgtttgtgacaagcaaagttctagtcaatcaccctcaagacaaagttttggatccgatggcaatgagtcaaaaaccgattcagaattgcacaatctagtgaaagagggagtaaagaaaaagacaaaaggggattctagaagtgaagcatcttccaaaatgggcagtttgtcaaatgataagaagttggataggattcggccagcaactgcaagtggtgttgtttcacaaaaactaaagaaagcatcacaatcacagttggcccttgaatttccatcaagatcaagaccaaagggaaaaagccctcctccaaaacctcctgttgataggaagaatgataataaccctttggggaaacaaaatacaagagttatccgcgtgaaaaaaactgttggtggaagatcactgtcacaaagtcacattgagaatttcactggatcagcattggataggcctgatctgggactagctttactaaaccaagcaaggaacatgatttcatcgggagataatccgatgaaagctcttgaattatctcttcaagcaatgaaattgtttgagagagctgctgcttatgggaaaccaagtttggatttggccatgtgtttacatgttactgcagcaatatattgcagtttgggacatttcagtgaagcgattccaattatagagcgctcaattgagattcccactattgaggaagaccaccaacacgccattgctaaatttgccggtcacatgcatctaggagacatatatgccatgttaggccatcttgagaaatcaattaagtgctacactgaagggttgaaagtacaaaggaaggctttgggagaaacagatccaaaagttggtgaaacttgccggtatgtggctgaggctaactttcaagcattgcaatttgatgaagcagagaggctgtgccaaattgcccttgacattcatagagcaaatggttcaccctcatctcttgaagaggcagctgataggaggctaatgggacttatatgtgaagcaaatggaaaacatgaagcagccttggagcatcttgttttggccagcatggcaatggtagcaaatggccaacatgtggaagtagcatctgttgattgcaacattggagacacatacttatccttggctagatatgatgaggccatctttgcatatcagagagcattggcagtttacaggactcacaaaggtgagaatcatccttctgtgggatcagtctttgtacgccttgctgacttgtattgcaggacatggaagataagggaatcaaaatcatattgtgagagtgcacttaaaatctatgagaatcccatgcctggggtccctccagaggaggttgctagtggttttatgaatgtctcagccatttatgagtcaatgaatgagctagaacaggcacttaagttacttcacaaggcactagagatacttaatgaagcctctggtcagcaaaacacaatagctggtattgaagctcagatgggagtcatgtactacgtgttggagaactacactgaatcttacaatactttcaagaatgctgtgtcgaagcttcgtgctactggggagaagaaatctgcattctttggtactgttcttaatcaaatgggacttgcttgtgtgcagcttcatgccttagatgaggctgtcgaattatttgaagaagcgagggtcattctggaacaagagaatggaccttatcaccctgaaacacttggagtatatggcaatcttgctggcacgtatgatgcaattggaag

SEQ ID NO: 40054 - DNA, 694 bp, Glycine max
  Peptide Sequence Number=SeqID_156832
cgccccactcacctctccgttcctcccgctctccgataacggcgaccccttccactcgccggaaaactcgccgcaaaatgacctccgcgacaactcccgcgccatcgtcatcgtcgagacaacatcaactcagttcgcccaggccgcgccccccgcgccggaatccgagcaccggaacccgccgccggagaccttcatcacccgtcccgtgaggccggatacgaggtctccgggcgttgttggtcggacgcgaccgagggcggtggcgccgcccaggccgatggtgccaaaaagagaggtgatggcgaaaaaggtggcgttttgtttccggttaagcgaagtagtgctgtgtctgatttcgttttcggttatggccgcggataagacccgtggttggagcggtgattcttttgaccgctacaaggaatacaggtattgtttatcagtgaatgttattgcatttgtatacgcagcgtttcaagcgggtgatctggcgtatcaagttttggcgtatcttttgatatcggctgcatcatctgctgccacaagggttgatgactggcaatcgaattggggaaaagatgagttcacagagatggctagtgcttcaattgcgttggcctttcttgcttttgttgcctttgctattagctccttattctctggctacaacctctgcactctgttctcatag

SEQ ID NO: 40055 - DNA, 864 bp, Glycine max
  Peptide Sequence Number=SeqID_156833
atgagtacaaattgtactcttgttaacaagcttttgatgcataatgcaatcaattacttgcagttgcctgaagtgggtacaaaatggggctttctcatctggttactttttagctactgtggactcctttgcattgcttgcatgtcgctggggaagtggttgactcgaagacaagcacatttattgcgtgcccaacagggtatccctgtatctgaatacggggttctggttgacatgatccgagttcccgattgggcatttgaagctgcaggtcaagaaacaaggggcatgggccaagatgctgctgcatatcatccaggactttacctaactccagctcagagagaagcagttgaagctttaattcaggaactcccaaagttcaggttaaaggctgttcctactgattgcagtgaatgccccatctgcttagaagagttctatgtaggaaatgaggtccgtggcctgccttgtgctcacaattttcatgtcgaatgcattgatgagtggcttaggttgaatgtgaaatgtcctcggtgccgttgctcagttttcccaaaccttgatcttagtgcactgtccaatctccgtgctgagcctgaagaatcttctgccagtgttgtgacaacaaccagatatgtgagaggccaaccatctagtcaaagttaccggctaagattgcagggtcttctgcgtccagtcggtgctgaaattgcaggaccagttggtgacatagataatgtgttggaaaatgccgagaatggcagcgtatcaattgtgactcaaaatgcatcatctggagaccatgcctcttctgtcgaatgtatgcctgttactgtcagtcattcctctgcacaaagttag

SEQ ID NO: 40056 - DNA, 249 bp, Glycine max
  Peptide Sequence Number=SeqID_156834
atgttcatgacgatggtcacaatggtggttgtggcagcaatgataacgacaacagtcatattagtgacaacgatgacgacagttgataatcatggtggtgttgcggtggcggatttaaaagaagaaaaattacaagtgtttagaggaagattgatgaaaaaacgtaaagaaaaagccttgaagaaaaagttgaagattgggacaactcgcttagcgtacaagataagtccagcacatcacctcgcttaa

SEQ ID NO: 40057 - DNA, 237 bp, Glycine max
  Peptide Sequence Number=SeqID_156835
atgttgaacagaaatgaggtagctcacttagaggattattgtataggtccgaaccgcaagcagttttaccctgttgcaactactcaactagttcctagacatcaagggatctccctaggccctagggaggatttcccaccaagcgaggaaagcaagttcaaatccacacccactgggaaggcactaagcgatctccctgaggagggttgcccactaagcaaggaaactgacttctag

SEQ ID NO: 40058 - DNA, 1632 bp, Glycine max
  Peptide Sequence Number=SeqID_156836
atgcgttctcaatctctctctcctattaaggaacacaaacggagatggcttgaaacgcagatgttgccctcagtttctgttactcctctcatggacattgaaacaaacctcacagaaaactgtgcctcacagtcacagccaatggatttgcatgaaaactacttgaaaccaagcatggaagatcagcttccttttggaactccttccacgcagggtttcttgcaagattttcatcatattgatcatcagtttcatgtgaatggctcctcatcatccaatcccatttttggggtgcaaactccaaattttgatccctttgatcaaaatgtaacatgtgagtctgcacctcctgattttgaagcttatgagtgcaagcccttagctgagagtaatggtattggacatgctcatcttatgaacaatttccaatatgcaggttacagtttgaacctccctcggacgaatcaactggatttgatggttgcaaaccaaagttatatgacctttaatgctcttgaaaccaagcctttgaactttgttgtaccagatgaagtctcatgcatttccccaccaaattattataagagagttggcttgaataaaaacctcagggaatctccaagcactagaagaacattcaaggcccggaagaagtccaacatagtgaaggggcaatggacatcagatgaagacagattgttgattcaactggtagaacaatttggagtgaggaagtggtcacatatagctcaggcgttgcctggaagaatagggaaacaatgcagagaacgatggcataaccatttgaggccagacattaagaaggacacatggactgaagaagaggataagatactgatccaagctcatgcagagataggaaataagtgggctgagattgcaaaaaaattgcctggaagaactgagaactcaatcaaaaaccattggaacgcaacaaagcgaaggcaatattccaaaagaaagtgtcgttcaaagtaccctagaggctctcttcttcaggaatacatcaagagcttgaacttggacaaaaatccacctatagactatcgaaaaaaatctgccaaaaatgctaatgccaatacaaacagcaatggcaaagcagcagctcagccccagtgttcagatcaattttgtctcaatagccagatggtgccaaggtatgattttaacgaggtcccagatttttgtttggatgataatttgtttgaagaggggtgcagcattgattccctgctagatgatatgcaaagtgcatctactatggatgagaaaggctttgatgaaaaaataatgcaatgtgctcctactatggagggaaaacaatctcatcagggtggcatgcagtgtgttcatgttgttgatgttgatgtgcatcatgagactgagatgatggcacacacgaatgggattgaagttaagaaggaacttgatttcgtggaaatgatgtcccacatgaatggaaaccattataggatagagagcttggactcagttctcatattgttactattatacgttcacaccaatggaagagagaaatacagagattttctaccatccagaaaagggaggaaaacaggaaatagtatcaacaataataaattgaaataa

SEQ ID NO: 40059 - DNA, 705 bp, Glycine max
  Peptide Sequence Number=SeqID_156837
atggctggttgtacacttgtactaccttccaaggcaaatattttgaatgctttctgggaatgctcaccaactatggtaattgtgcttattactccacctccacttagcgaggaaggacgcctggcttacgcaagatccgtaaatggtgagaatgctaccaaaatacctgaaagaacaaatgaagtaactggtcaatatgcaaacgcctgtgttgaggtagcaaaggaaatgggcgtgtggtatatcaatctatggtccaaaatgcaagaaacggatggctggcaaacaaaatttttgagtaaaatcaattccaatacctttcttgaaaattatgggagattccacctgacattgatgttttgctgtataagggatgggttgcacctgacaacagaaggaaatgcagtagtctacgaagaattgataaaggtgttcgatgaagcaggactttctgctgttaacatgccaatggatttccctcaccactcaaaaattgattccaaacatccagagagagctttccagcagcatgtgacagcaacacaaactcaagcaacaacacagactcaagctaccacaatggcagcaactcagactcaagagcaggatgaatatacagagactacaacagagcagagggtgcaattagtagctaggcccaagagagcagtcatcaaaccatcttacctgaaagactacgtctga

SEQ ID NO: 40060 - DNA, 720 bp, Glycine max
  Peptide Sequence Number=SeqID_156838
atgtcaaccatgttctcttgcttctttttcttcttcttctctatctttcaaactcgctccctctcattctcacccctttctccatgccagagcagcctccgtgccggagagaagcgccggcgagttctccgacggcaacactctggaacctggagccctgtttgggctctggatcatcttcaacatctacaacaaacaggtcttaaaggtctaccatttccctttaacccgatattaccactggctctggtacatactttagggaaccttttcaccaacatgagtctcggacaggttgctgtgtctttcactcacacgataaaagccatggatcctttttattcggtgctcctttctgctatgttccttggagagatacctactgtatgggtggttagttcccttgtgcctattgttggtggggtggcgctggcgtctgctaccgaggcctctttcaattgctgcaattgtcaccgcaatgcagtcgtggagagcttaaagcccttgacattgccgccaaaattgaatttaacatcgatttttgaaaacattgcgatcatgtgtcgcataccaagaaatattccaaaagcagtagaccaaggctatccaacaacgatccagcgaatcctcacacataatcctcctgcagggactgctatagctcttgctagtgttttcctgtattccagggtgaagcgacttaagccaaagaaagtttaa

SEQ ID NO: 40061 - DNA, 2136 bp, Glycine max
  Peptide Sequence Number=SeqID_156839
atggaagaaacatttgttcccttacgtgggatcaagaatgacctcaaaggaagacttgtgtgctacaaacaagattggactagtggattccgggcaggcatcaggatcctggccccaactacatatatattttttgcttcagcaattccagttatctcttttggggagcaactagagagaaatacagatggaactctaactgcagtgcagacccttgcatcaaccgcactatgtggcattatccattcagtcttaggagggcagcccctcctcatactaggcgtagccgagccaacagttctgatgtatacattcctgtatgacttcgcaaaaggtagaaaggatttggggcacaaactattcctgccttggactggatgggtgtgtgtttggaccgccgtgttgctcttcttgctggccattcttggtgcatgctccataatcaacagattcacacgccttgcaggtgaactatttggtctgctaatagcaatgctctttatgcagcaggctataaggggactagtggaagagtttggtgtgccccagtcccagagagaaggtaccaatcagattgcactccaatcctcttggctgtttggcaatggaatgtttgctttggttttgtcatttggcctgctgtttactgcacttagaagccgtaaggctagatcctggcgatatggggcaggatggttgcggggatttgtagctgattatggagtcccactattgattcttgtgtggactgctgtgtcttatataccaaccaataaggttccgatgggaatccctaggcgacttttcagtccaaatccatggtctcctggtgcacactcaaattggactgtaattaaggaaatgttgaatgtgcctctcatctatattattggagcatttataccggcaactatgattgccgtgctttactactttgatcacagtgttgcatcacaacttgcccagcagaaggagttcaatctaagaaaaccctcttcttatcattatgaccttctcctcttgggcttcttgaccatattgtgtggacttattggaatccctccatccaacggcgtgattccccaatctccaatgcatactaaaagcttagctactctaaaacatcagctcttgcgcaataagcttgtatctgttgcacgaaaaagcaagcagaaaaatacgaacctgtgtcagttataccgaagtatgcaagaagcatatgatcaaatgcagactccattagcccgccaaataccacctgccttggggctaaaggagctgaaggaatccaccatccaactggcttcaagtcatggatacattgattcccctgttgatgagactgttttcgatgtggataacgatgttgatgaccttctgccagttgaagttaaagaacagcgcctcagcaatctgctgcaggcattgatggttgcggcttgtgttgctgctatgcctcttttgaagaagataccaacttcagtgctttggggttactttgcttttatggcaattgaaagcttgcccggaaatcagttttgggagagaatattatatcttttcactgctccaagtcgaagatacaaagtgctggagaaacagcatgcagccttaattgagaccgtgcccttcaaaacggttgccatgtttaccttattccagacagcttacttgcttctctgctttggtctaacctggataccaattgctggggtccttttcccattgttaatcatgcttcttatcccagtacgccaatatttccttcccaagttttttaaaggagcccatcttcaagaattggatgctgcagcatacgaggaagcacctgctattagtttcaacttgtcattcgatattaatgtttatccacctcacaggattcaggaagtcagacaacaacagtcaataataatagtggggaaattcttgacgaaattattacaaggagtcgtggggagatctgcctcaatcaaaaatcaaggtgttcaactccaaaatcatgtgaagacactgtacctgcttatggaaatatctcaaaggattcacagctctcgagtaactaaattcagaaggaaaagcagcctaggatcaaatcatgatcatggaggcgatcaagttcaagaagagtgctag

SEQ ID NO: 40062 - DNA, 927 bp, Glycine max
  Peptide Sequence Number=SeqID_156840
atggcgcacacaggcaacacagttcaatgcaccggtccagttcacggcctcagctggatctcagcaaagcagaaattcaaggaaacttcgaagagaagtatccaaccattttgttacccaatcagtctcatgatatatctcacctcgctcttgacattggagttgggtctaacggaaggggctagtcttccacaacttggtgaaccaagttcgactttgctccgagcaggattatctcccatcctgagaagctatcctattcttggtggaaggcttcattttgtgaagttcgaaactagcaagattaacgagtgcctagacttcattaactcaaagcagcttcactgtggtgaaggggaatcacgttattctgatgccacgactgattcaaatgccataattaaggctactggtggtggagcacacaaatttgctgaccttttcaaagaaagactcggacttagtcttgacaaagaagatgaaatgaactgccttgtagcaggagcaaatttcttgctgaaggcaattcgtcgtgaagcttttacacacatggagggtcagaaagagtttgttcaaattgacactaatgatttgtttccttatcttctagttaatattggatctggtgttagtatgatcaaggttgatggggatggaaaatatgagagggtcaatgggactaatgttggtggtggtacttattggggattgggaaggctgttaacaaagtgtgagagttccaactttgatgaattacttgagctgagtcagaaaggagataatagtaatactgacatgcttgttggggacatttatggtggcatggactattctaaggttacctcagaaaaaaagggacttgatgattacagacctgaagatatatcactctctcttctccgaatgatttcatacaatattgcccag

SEQ ID NO: 40063 - DNA, 3051 bp, Glycine max
  Peptide Sequence Number=SeqID_156841
atggaacccctccgactgaagaccaactaccgctgcgtccccgctctgcagcagttctacaccggcggccccttcgtcgtctcatcggactcctccttcatcgcctgcgcctgcggcgagtccatcaagatcgtcgattccgccaccgccgccatccgctccaccctcggcgccgactccgaatccttcaccgccttggctctcagccccgacgaccgcctcctcttctcctccggccactcccgccaaatcaaagtctgggacctgtccacgctcaagtgcgtccgctcctggaagggtcacgagggtccggttatgtgcatgacgtgtcacccttctggagggttgcttgctactggtggagctgatagaaaggttcttgtgtgggatgtggatggtggttactgcacgcattactttaaaggtcacggtggtgtcgtttcttgtgttatgttccatcccgatcctgagaaacagcttcttttttctggcagcgatgatggtggtgatcatgcaactgtaagggtttgggatatttccaagaccaagaaaaagaactgcattgcaacactagataatcatagctcagcagttgtaacgttgtgggaccttcatgattatagcagcaagaagactgtcattacaaatgaggcagttgaagctgtttgtgtacttggttctgggagtccttttgcttcatctctggattcatatcagcaaaatttaaaaaaacgtgatggttcccaaatattctatttcattacagttggtgaacgaggcattgtacgcatatggaattccaaaggtgcaggttgcatctttgagcaaaaaacttcagatgttacagccaacatagatgaggatggctcacgtaggggtttcacttctgctgttatgcttgcctcagatcaaggattgctttgtgtgactgcagatcagcagtttctgttttactctctggaatgcactgaagagttgttgcaattaaatctaaccaaaagacttgtgggatataatgaagagattgttgatatgaagtttattggggatgatgaaaaattccttgctctggctacaaatcttgaacaggttcgagtttatgaccttgcatctatgtcatgttcgtatgtcttatctggtcacactgaaattattctatgccttgacacctgtgtatcaagttctgggaaaacactgattgtaactggaagtaaagacaacagtgtaagttttctcccctttgatcttaagattgttctaaaggctttaaattttcttttatgggaaaaagtgcttgaggttaggttatgggaatcagaaagtgcaaactgcattggagttggtattggtcacatgggagctgttggagccattgccttttcaaaaagaaagcaagatttctttgttagtggcagtagtgatcatactcttaaggtgtggagtatggatggcctctcagacaatatgacaatgccaattaatttaaaagcaaaagctgttgttgcagctcatgataaagatataaattccgtagctgttgctccaaatgatagtttagtatgtagtggttctcaggatcgtacagcttgtgtttggagacttccagatctagtatcagtagttgtatttaaagggcataaaagaggaatttggtcagtagaattttctcctgttgatcaatgtgtagtaacagcatctggtgataagacaataaggatatgggctatatctgatggctcctgtttgaagacatttgaaggacacacgtcaagtgtgttaagagcattgtttgttactcgtggaacacaaattgtttcttgtggtgctgatggtttagtaaagctgtggactgtaaaaactaatgaatgtgttgctacttatgatcatcatgaagacaaggtttgggccttggctgtaggcaggaaaacggaaaagcttgcaactggtggcggagacgctgttgtcaatttatggtttgattccactgcagcagacaaagaagaagcttttcgaaaagaggaagagggagttgtgaaaggtcaagagctagagaatgctgtctcagatgctgactatactaaagcaatccaaatcgcatttgaactgcgcaggcctcataggctttttgagctatttgcagaactttgcaggaagagagaggctgaagatcatatggacagagcacttaagggcttgggtagtgaagagcttcgtatattatttaactatattcgagaatggaatacaaaaccaaagctttgttatgtttctcagttcgtgcttttcagagttttcagcatctttcctccaacagatattgtccagattaaagggattggcgaatttcttgaaggtcttatcccatatagtcagaggcattttggcaggatagacagacttgttagaagcacatttttgttagactacattctatcgggaatgtcagttattgaaccacaagttcaaccgacagaatcaaaggctgagttactgttgcagtctgaaattgacattccagacaaagaaaatggcatcgagaagaaagatcatactcatgaaattaccgcttcaaagaaaaggaaatcaaacaaatcaaaacatggttcccataagaaagttaagaatgtagcttacaacaagcaagtggtcgtgaacgaacccaaacccttcgattttcacaaattccaagaactgggcttgcggttcccggtaattgcgaaaccgttggcggctgacggcggcgccggctctcacgagctgcgcttggtctttgacgacgaggggctccacacgttgagcgttccgacggtgctgcaagtttttgtgaaccacggcggggtcgtattcaagatttacgttgctgggcagcgcgtgaattgcgtaaagcgcaagtctttgggtgacataaccgaagagaagctgagaacgttgaaggggtcgctgccattttctcgtatgtcgaacttgggcgttgaagatcaggatggcgccgttgagaacgctgaaatgcctccgcagggtttggtggttgagggaggcattgggacttaa

SEQ ID NO: 40064 - DNA, 945 bp, Glycine max
  Peptide Sequence Number=SeqID_156842
atggcaggcacaattcacgaggagtgtggggtggataattcttcttcaccatctggcgaaatgcttccatgctcgaggccaatgacagagagtaggctaagacccccccaagagcaagccctcaagtgccctaggtgtgaatcaacacacaccaagttctgctactacaacaactacagtctctcccagcccaggtacttctgcaagacatgtagaaggtactggacccaagggggcactcttaggaacattcctgttggtggtggttgcagaaaaaacaagaaagtttctaccaagaaacacaatgaccaacaccaaccagctgttaatcaaaaccaacctcaccctggaccctcttatcttcataatcacaaagatcttcaacttccctatcttgatgtgcaatttccccacctcaacaatttacttgggactaatgctggggcactgcagggaaaccctagttttatggagagtaagtataacatgggcatgcttgagaaccctaggcctattgacttcatggaaagcaggttggatggtatgagtatgattaggggttccactaggagttttgagcttcttgaaaacagtgatatgagtgtgggtggtggtgttgggtttggtgatgtgagtggctacaatggattgccattgaattatcaaggtctttcgtcttcagcatttggaggcatgtctctagatggaagcattaacaatgttggaacttatataatggactcttgccagcgacttatgttgccctatgatggaggtgacaacaccctcaatggttcaattgatgtgaagccaaaccctaagctgttgtcccttgaatggcaagatcagggttgctctgatgctgaaaaattgtcactgggatatcttaatggttcaggatcatggaccgcctatggatcttccacagcaaaccctttggtctag

SEQ ID NO: 40065 - DNA, 162 bp, Glycine max
  Peptide Sequence Number=SeqID_156843
atgtcacaggtcgcagcattggtgccatcagcattgcaagttgcattcctcagtggcactagcgctggaagggtttcttcacctaagaaaacgacaatggtattagttgtatgtgtcggagctggagataaaaatttaaaggggctagttaagtttatgtga

SEQ ID NO: 40066 - DNA, 876 bp, Glycine max
  Peptide Sequence Number=SeqID_156844
atggatccattggggaaacgccctgctgccgaggacgattccctaatttccgattgcgagagcggggtttccgctggagacacgccgccgccgttcgtcgaaaacgccgacctcgtccggaccagattcgttcgtggcctcgtcgcgcactgcttcaaacccgaggttctggcagttcgcagaaacgtgtgttcctccgtcatggccctggcgcgtcaacattcctttcacgtcttcgcgcgtgccgtggccgaattgcgcggcggcaatgccaacgtgaagttcgcctgtgtgaagagttccgttgtggacgaagacggtttgaggcacttgttgctgtgccgcgttatcttggggaagacggaggtggttccacgtggctcctaccaatgccgttcgagttctcaagagtttgattctggggtggatgatctttccaatcccaaggagtatgttatttggtgtaaccagatcaacactcatgttttgcccgaatatgttttgagtttcagacttccttcaccattgaaagggattgtgaagattggggaacctttgaggccttcttcgccgtggatggcattcccagctttgatttcgatgctttcgaagattttgcctccgtccgaggttgcctccattgccaagtttcacaaggattatagagaaaagaggatttctcgacatgagctgatacagaaagtgagagtaatagcaggcgacaaattgctactttccgtcatcaaatctttcagagccaagaaaatacctgcaaactttaaagatgacaaggcgaaagaatggcaagcggacagccagcagcttgaacggaatgattgttcatatgggagttctattagctattacaggaagtga

SEQ ID NO: 40067 - DNA, 327 bp, Glycine max
  Peptide Sequence Number=SeqID_156845
atgagaatcaactcagaggcagctgctggaaaaatgaagcacaacgccaagcagagtggttcaccacagtattcttgtgagtatggtgatttctctatattgatgataataagggatgctaagaaacatggaaagagagaaggcacactgaagttaaaggagaaggataatattggtcttggagaagaagggaagctgttgaatgatgagaatacaaaggatcaagccgatgttttgatgatgccaaaagatcacatgcgtctcaaagctttattcaagacaaagcaattaaagatattcaagatggatgatcaagacagtctatag

SEQ ID NO: 40068 - DNA, 177 bp, Glycine max
  Peptide Sequence Number=SeqID_156846
atggtggctccaaaaaacaatgcaatccagattatgttctcacttcgctcacacaggaaaaaagaaaaggcatatagttatatggataacaaatcaccgagcaaggagtccaaggaggtgacacgtgagtcgcttattgctatttctaactctttacctcataagactcttgaatag

SEQ ID NO: 40069 - DNA, 237 bp, Glycine max
  Peptide Sequence Number=SeqID_156847
atgttagggttgcccttgcttggggctattcctgaggacactgaggttattagaagcaccaatagaggctaccctcttgtgctcaacaagcctcccactctggctggcttggcgttcgaacaagccgcttggaggctcgtggagcaggatagcatgcaggccgtggtggtggaagaacaacccaaacgagggtttttctccttttttggtggcatcaattctgaacttctaacatga

SEQ ID NO: 40070 - DNA, 696 bp, Glycine max
  Peptide Sequence Number=SeqID_156848
atgtcttctccttttatcatatcggaggccggtgacgcggtcggcgtcgcggaggctggtgatgtcgggggtggtgatgaggacggcctcgttggcgggagtgatggcggtgatgaagccggcgtcgatgccggcggggcaatcgatgaggatgaagtcaggggagccctgtggacgcgctttcagcgcgtccacgagccaggtgagggctttaccgccgaagccgagggggagcttggagcggggtttggagatgcagaggagttcgaagttggaccagcgcttgtcgcggacgagggcttggtcgaggcggcagtcgccgttgaggacctcgatgacggtgtagttgacgcggttctcgaggccgaggaggaggtcgaggttgcggaggccgacgtcggcgtcgatggcgaccacggagaagcccaggcgggcgagggagaggccgatgttggcggtggtggtggtcttgcccacgccgccctttccggaggtaatgacggtgacgcgcgggatggagccggagagctcgggcttgcggttccactggaggagggcactggggggtttgggtttgggttttttgggggaggaatgtggagttgggggcggtggtggcgccggggagaaggtggagagagggcattgggaagaggagagagggagaaagagaagaagaagaagcacagtggctga

SEQ ID NO: 40071 - DNA, 324 bp, Glycine max
  Peptide Sequence Number=SeqID_156849
atgccgaaccattgcctatccatcacggatctcgataagcttatggtcggaactgctctgcaaacactggagcaaggccaatcgctgctcaacactaccttcgacagaggagagaccgtggtgctgatgaggattaactacattaggtgcaagactttgattttggaggtggatttggcagaaggtaataagaggttgtctcctgattacgacgacaaggattatgacaatgatccttttgcacccaagaaggctgaaacaaaagctgaagaagcttttggtgtaacaacaggaatgatcttgtcacttcatgaaagtctctag

SEQ ID NO: 40072 - DNA, 641 bp, Glycine max
  Peptide Sequence Number=SeqID_156850
atggacaaatacaaagcttggttagtagctaaagtctacacgcaacaagttggaatagatatttcaggcattttttcacttgttgccaagcttacctcaatgaaagatctatttgaggaagtttatatggacttgcctctaggatacaaaaccactacttctggtcttgttttgggctctttgaaatatttcttaggccttgaaattgctaaatctagtaaaggcatttcactttcccaaagaatgtacacactatcattgctagatgatacatggtaccttggtagtaagctagcacaattacctatggatccaaatctgaaattgaacttaactgatggtgatccaatccttgatccttctctgtataggagacttgttggtaggctcatgtacttgaccattttgtggcttgacattacttttgaagtacacaagctaagccaaggtactcgcaagactacaattggattctgtgtatttcttggtgatgcactgatttcatggaagtatgtgaagcaaggtactgtctccaaaccctttgctgaatctgaatatggagcattatcattagtggctggtgaagttgtatggctcaagcatttgctaggacattttgaagttgatattggatcaaccat

SEQ ID NO: 40073 - DNA, 285 bp, Glycine max
  Peptide Sequence Number=SeqID_156851
atgactaaagcacgtcaaaagggggtacagaaagaaaataggggaggagcttgccacccagctcgcccaggcaagccaggttgcttcctccagaagcaaccgccttctggaggaacatcctggaggcccaagtgggcctggttacggaaccttacgggtcatgtaattactccttttttagctttcggaatgtcacggaaactcacggattgcgtaacaatacttccttttgattttcggcatgttacggaatttcacggattgcgtaacaatgcttccttttga

SEQ ID NO: 40074 - DNA, 795 bp, Glycine max
  Peptide Sequence Number=SeqID_156852
atggccagaactaaagcagtagctattaaaaacccctcaaattcttctagcttagaaagtgagtttgttcactcaccctctcatagaaccctagataagggtaaagacaaagcaatctatatctcttctgagtttgactcagaagcaaccatgaccttaacaccccctcatgctaaggacatagtgattgactctccaaggaagatatgcattaaggagaagtttgacaaaagctgggttcagaagaaagtggtctatgggagatacattgatctccttgagataaaaaagaatggttgggacgttctctattttatcaagaagctgaagtggattgggttctttgagatgtatgaaccagtctacctaagcttggtgagggccttctttgttactattgaggaagaggaagaagaagacctttatgagcctcaaaatgagctttctacaactaatgaaggtggtcaacttgttcaaaatgaggaagaaagagctcggaatgcagaagataatgatgttgatgttgctcaaaatgcaccagaagcaaaggaggatgttcctcatgttcatattctaattcatcctactgttgttgctgaaccctcttctaaaaccatgaatgagctcttcgagagattcctcaaacttgaggggtggatcttagacaaggcaacacctaccttgattcctgaatttgtaactatgcagcacgagccaccaccacctccaagagctaccaccatgctttccttatcttcatcatcaacaaactcatcccctaccaagcctatatga

SEQ ID NO: 40075 - DNA, 225 bp, Glycine max
  Peptide Sequence Number=SeqID_156853
atggcaatcatcggcaatgcactttgccaggcgttcatgatgaagcacgagtataggagccttagagaagaagacaaggcatggggtaagcttcagagacccataatggtggcttccgtggccatcatcatgctcgcaatcatcgtgttcattgttatatgtttgaaaattgtgtttccgagtagcgatggaagaagaacgttctacgtcaatcgaaggctttaa

SEQ ID NO: 40076 - DNA, 174 bp, Glycine max
  Peptide Sequence Number=SeqID_156854
atggcacttgatcctaattgtgccggcaccagcgccagcaccaacgctgtcgaagacgacaccgttaccaagaaaaaggtcgaaaatgaagatgtgtccgatgaggatttgtctttgaagcaacaattggagttgtacgtggagagggttcaggatcctgaccagggattgtag

SEQ ID NO: 40077 - DNA, 1666 bp, Glycine max
  Peptide Sequence Number=SeqID_156855
ggctaatgtgatggattgctcagacatgtctaattctaccatcggtctgggtggcagcgattctgggggctcgattgagcaacccatcatcaggagtgggggcgcttctcgccctcgtagaggggtgtggccttccgatgctaccgggaagcctgtcccggttaatgtgatccttcccccgtcttctttcgggggtgtgaggagacatagtggaggtggagattgggtgagggacgatgtgctgaaatataagtcatgtctgacctcagtagcgagggtcacagcgcttaagcgccaggtcttgggtgtcattctacccttgaccgcttttcggtgctcagctggagcacttgaatgtggccccttcccaacattacccaaacagttaagcgatgctactgatgtcatggctaatgacatgccactgatgcttaataggggcagggatccctgctacccattctactggaagtctaatcccaccagcgatcctctcgctgccttggatgttgagtgcctaaccttgccctcgtttgtgtttgaggtcaaacctgtaggtgggactgtgccaccgtttattgttgctccgtctgttggagaagggggccaacctgctggtgaggttggtcctgttgctgaggctgtttggccacaagaagtcgaaggcccttatgagtatttgtgccctgaggcaggctgcagggcttttgctgctacttttgcgactcctgctactattgctccttcacctcctcccattgtttttgttcaggaggttactcctactattactgaagctgttgtgccagccactcaggctgattatgttatggcgttgctatccactatcgcgacacctttgttaagtgctggtgtggcggccactagtgctcccacagtgttgccttattcctctgcgactctggtggcttctccctctgttgttctggcaacggtggcgtcatcttctttgtcctctcgccttcatatcttgcttgatcacttgtacacctctagtgatgctgactcactatgggccttcaataagaaccttattaggtcgaccagggtgcaaaatgctactgactctgccaaagtggctattgctcgtactctttggcgagtagagcaccctaagggggccaatgccactattgcttttgctaaggctgtaaggtcgaaccgccaactgcctgccaaaattggtggtgtattggtcaagttgttgtgtacccgattagatggtgataaactgtttagacgctacaaggacttgcatgttgagaagatgaacctgggtggcaaagtagagagcatggtggcagagaaggatgggcttgccaaaggaggcagcatggagcttaaggaagagttgattctgtacaagaaagaggtcgtcgagcagcatgagaaaggctttcagaaggctgaccgtggtggtcttgtgaaaagtagaatgacgcgaagtcatctcaggtttaagttcaacctagttaaaggtcttgtcacccatttggtagggtttccttctattgtgtggagcttctcccctgatggttgtgaggagttgtgtttgactcgcccctggttgaaggtcttgcctaaccagtgtagggataggtcaattgaccggctaagttcctcctctgatggttatgaggagtaa

SEQ ID NO: 40078 - DNA, 1281 bp, Glycine max
  Peptide Sequence Number=SeqID_156856
atgctcatgactagtgaggtccctactgagccgtgtgcactaccccgatttaggtccgagttgcaactggacaagctctttaatgggtttcgggcctatatcagaggtgtcgacttgcggatctacgtcaaactctctgcccaagctggcttggctctcggatgggaggatatggtgctaccttcaagctttctgcatagcactattgtgcttgcttttgctcctagagagcttgtcctgaccgaaagtggtcatcaagtccacgtagcatatggtctcaactctcttgccttcaaagtcgaggagtggaatggtgtgagggtggacagtgttggcggaactgccctagtcgatgaggaccctggacaccacgaagttagttatgatgatggagacaaccacagggtcgtcttggttgatggggttaatgcccttgaagttgtggctctcgccgctattgctggtgtctttgtctgcctcggtcttctactcttcttctgtctacttcctatgctactcctcttaatgtcctttgagtcttggtcctacttgggcccaacagtctttggtgttgtgaccaataccgtagtgatatctgcagtatttggggtgtgtaacgctcgtacatgggccctttgtagagaggctggtgtttatctggtttgtgcctcttgtttgacttgtgtgagtcagctttggtctgtgcttcgcgcttgttgcgcttctgcccggcttggcggacttcattccggaatcgagacatttcttccatctggatatagcccttgtctcgggcatggaatgcaatgctacctcgaggttgagatttcggatctagatggttgtgctctcaaatttgtccatgaactttttgagggattcatcgtctgcttatcgcagactagtcaagacggtcgaggtcatgcagtgagacctgctagtggcgtactacacactgaatcgttcgacgagtgtgtcaaagttgtttgtcaacctaggttcaactatgttaggaaggcgtgcagatgctcgtctggatctatggtcccatcttactgcttgaggttaagtggtttcaccctaaggtcatctgtagtgtttcctgtgcgtcaagggtgcgattccccttgggtgcgttcaggcaaggtgtgggcaaattgctcgtcgccctggggacgtctgacacgagcctctagccgatcatggtcagcctttagctttgttgatatgaaccctcatggcacaagggctgacttaggatcgtctaggattagaccttga

SEQ ID NO: 40079 - DNA, 861 bp, Glycine max
  Peptide Sequence Number=SeqID_156857
atgctgggaatccatcccggcataatattccacaaactagccatctatccctatgccaaacctatatcacagaagaaaaggaagataggagaagagcggcgtaaagccgtcaaagaagaagtcaacaagctcctccatgcaaacttcatcagggaagtgctaagctttttggagacctactttggatacaaccagatcagaatgcattctccagaccaggagaaaacgacattcatcactgaagatgctaacttttgctacaaggtcatgccattcgacctcaaaaatgcaggcgcgacataccaacgactaatggaccgagaagtattcagggaactatgcaaatacaacatgggcctcaaccctgaaaaatgtacttttgtggtaggtggcagcaagttcctcagcttaatgatcacacgtcgggggattggagccaatcccgaaaaatgcactatcatactggagatacgcaaccctaccaacattcaagaagtccagaagctcaatggtaggctagcatccctgtccaggttcctcctaaagcttgtcgaaaaggcgaagccattttacaaactgctcaagaagactgagcccttctcatgggacgagactcgtgaacaagcattcctggatttcaagaagaccatagtcacaccgccaattatgagtcgacccaagccaggagtaccactattcctatatctctcattagctgacaaaaccgccagctcagccctcgtacaagaggaaaagaggcactggccccctatcttctttacaagccacatgctccatgacaccgagaaacactaccaaatgataaaaaatgtggcgctagcactcatcacctcggcatga

SEQ ID NO: 40080 - DNA, 201 bp, Glycine max
  Peptide Sequence Number=SeqID_156858
atgggagaggcgagatcctatgtgtggtgtgtctcgccaatggagaaagcggcaccctccatgtcagcgcgtatcgccagttccactggcggcaccgtccacgtcaaccctgtatcgccaatggcaatggcagctcatgctttctcgccattatcgttggcggcttccatgcaaaaacggaccccctccgtaaatacttag

SEQ ID NO: 40081 - DNA, 338 bp, Glycine max
  Peptide Sequence Number=SeqID_156859
gacttcacctatttgttgatcatctgtccagtaaacatgttgttgattttcaaggtggaaatatagccgctccactgtcggggaacgcgcatgcattgggaatgcaaaaattttccaacatgcttctggggagatacatatctattgattcaagcagcgcacatatattgttgaagatagaatcagatgttggtgagaatagaaggatacctgcaatcaagatattgcttaatttcatcttgatttccaagagaagctgtgatacagtcagaacctttgttgatgtatttgaacagatatttaatggatgtactttgattacaccattccacgtttaa

SEQ ID NO: 40082 - DNA, 198 bp, Glycine max
  Peptide Sequence Number=SeqID_156860
atgtggaggcctattggtgtagtagctccgtgtggagcttgtaggccttggatcttcttcatcaatggagtctttggcttcttaaagatcaatggtagcggaatgaaggaggaaagctatggttcagcactaatacaagatcaagtccaagattctccactaagtgtatttaggtgtcatgaggcatgtaaagcatga

SEQ ID NO: 40083 - DNA, 786 bp, Glycine max
  Peptide Sequence Number=SeqID_156861
atggtgggatgccaatgtgtgatagcaaagtgtgagggaaaaagacttcaagcctcttcgtacttacacactcaagggttggagggttgtgtgcccttctcaatcatccaccaactgaggaagactttcaagcctcttcgtgcttacacactcgagactgaaggactgttttcccttctcgatcattcgtcaaccgaacaagacttcaagcctctttgtgcttatgcacttaagcttggaggattgtatgttaagtctcttcatgcttatgcactcaaggctagaggactatgtacccttcacaatcgatcgccaactgaagataacttcaagcctctttgtgcttacgcactcgaggctggaggattgtgtacccttcctggatgcttgtcaaatggtctaggattccctaaacatatttgtttcaagttggtgatcgaccacgcatatgattgttgccattatattgcacttgtaacccttctttccctctttgaggcaattaaggtggaagataatgaccaccagtcagagaggaagaccctgttaataagaattcttctgtcaaatggagttgcaaacaaccattccacatcaggaacacccattatttctacgatgttggaatctctaatggcggagatgaggatacaaattgaggtgtctaagaggatagtgagtaaggcactgagaggtcaagacacccgttgtctccaaaatgaagaagccaggaggatagttgatgaggcattacaggcacagggtgtttgtgcagtagtggaatga

SEQ ID NO: 40084 - DNA, 433 bp, Glycine max
  Peptide Sequence Number=SeqID_156862
tcgtgtaaaggagtttgatggaacctgtatttctgagggactcatcgtctgcttgtcatggactagccaaggtggcctaggtcatgcggtgagacctactagtggtgtactgcgcactgaatcattcgacgagggtgttgaagttgtctatggacctaggaagacgtccagatgctcgtttggatctgttgtcatatcgtaccactcgaggttgagtggtttccaccccaagatcatctatagtgttgcctgtgcgtcaaggtgcaattccccttgggtgcattcaggcaaggagcctctagctggtcatggtcagcctttagctttgtcaactcttcctaatgacgtcgctccatctccgcgatgcggttttggagttgttgtagagtgtctgtgtctatcatggctgccggacgaggatgagagtctgtga

SEQ ID NO: 40085 - DNA, 2550 bp, Glycine max
  Peptide Sequence Number=SeqID_156863
atgaacaggagaattccaaggattatgactgtggctgggttgatatctgatgttgatgatgacccagtggagagtgtgtgctctgatccgtcgtcgtcgacagcgcaccgagaccggataatcatggtggctaatcagcttcccataagggcccagaggaggccagatgggaataggagttgttggtctttcgagtgggatgagaatgcacttcttcagctgaaagatgggttaggggatgatgatattgaggttatttatgttggatgccttaaggaggaggtgcatccaagcgaacaagatgaggtttcacagacacttcttgagaccttcaagtgtatcccaacttttctcccagctgaccagtttactaagtactatcatggtttttgcaagcagcagttgtggccactgtttcattacatgttgcccttgtcaccagagcttggtggcaggtttaataggtcactgtggcaggcttatgtgtcagtcaataaaatttttgcagataggattatggaagttattaaccctgaagatgattatgtgtggatacatgattatcatctgatggtgttgccaactttcttgaggaagagattcaacagggtgaaactggggttcttccttcacagtccattcccttcatcagaaatatataagacattgcctgttagggaagagatcctgagagccctccttaattcggatttgatcggcttccacactttcgattatgcgcggcatttcctctcctgttgtagccggatgctcggccttacctatgaatccaagcgaggttatattgggattgagtactatggtaggactgttagtatcaaaattcttcctgttggtattcacttgggtcagcttcaatcagttttgaggatgcctcagactgaagaaaaagtttgcgagctcattagacagttttctgataaaggaaggacattgttgcttggggtggatgacatggatattttcaagggaataagtttgaagttgttggccatggaacagcttctcattcagcaccctgagtatcgggaaaaggtagtgctggtccagatagcaaatcctgcgagggggcgagggaaagatgtgaaagaagtgcaagccgagacgaaggccacagtgaaacggataaacgaaacatttgggaaacccgggtttgatcctgtcattctgattgaggagcctctcaagttttatgagagagttgcttactatgttgttgcggagtgttgtttagtcactgcggtaagggatggaatgaatctcataccgtatgaatatatcattagtcgtcaaggaaatgaaatgttggatgcagttttgggtctagcttcctcccctaagaagaaaagcatgttagttgtgtctgaattcattggctgttccccatctttaagtggggcaatcagagtgaacccttggaatattgatgctgtagcagatgcaatggactctgcgctggaaatggctgattcggagaaagagcttagacatgaaaagcattatagatatgttagtactcatgatgttgggtactgggctcgaagcttcttgcaagatttggaaaggacttgtagtgatcatgtgcgacgaaggtggtgggggattggttttggattaagctttagagttgttgcacttgatccaaacttcaagaagctctcaatggagcacatagtttcagcttacaagcggacggcaactagagcaatccttcttgactatgatggtacactaatgcctcaatcatccaccattgataagagtccaagcagtaaatccattgaaattcttagtagtttgtgtagagataagaacaacatggttttccttgttagtgctagaagccgaaagatgctttccgaatggttttctccttgtgagaatctgggagttgcagctgagcatggttactttctaagaatgaaacgagatgaagagtgggaaacacatgttgcagcaacagacactagttggaaacaaattgcagaacctgtaatgaaactttacactgaaacaactgatggatccaccattgaagacaaggagactgcacttgtttggtgctatgaggatgcagatccagactttggatcgtgccaagctaaggaactccttgatcatcttgagagtgtgcttgcaaatgaaccagtaacagtcaagagtgaccagaacaatgtagaggttaaaccacaggtatgcatcatagaccagagaaaggacaaagaattgaaagaagaaagcttgtcaggtgtgagcaagggactagtggccacacgcctactttctgccatgcaagaaaaggggatgtgccctgattttgttttgtgtataggagatgacaggtctgatgaagacatgtttgaggtaattaccagttcaatgggcggtctgatcgctccaaaggccgaggtatttgcatgcacggtttgtcgaaaacccagtaaggctaagtactacctggatgatacaactgaaatagtgagattgcttcagggcttagcctgtgtttcagaacagatagacaaatag

SEQ ID NO: 40086 - DNA, 403 bp, Glycine max
  Peptide Sequence Number=SeqID_156864
atggcacctccatactctattcctacagtagagcagtttagtgagatggtagcctggcccaggacccaaccttctcttcataaggaagacgaaggtcccacagcccaggtacctcaacatatggaggatgagtcatctgaggccaccatcccaaagccatttaatataggagaagaggcagaagagacacaggtgagacaggtagctgctaccactcctgagcgatcccttgaggctacttcagagccttctgcactagtggtaaacctacccttacctcatcctgtagcagacccctccactcctcttctacagatgccagaggacccaactacaccagtcctagctgtagacacttctcctcccactattgtagtgcttcagttgacagatgaggaggatg

SEQ ID NO: 40087 - DNA, 276 bp, Glycine max
  Peptide Sequence Number=SeqID_156865
atggcaagaggagcaggtgtacaccgtgagatagacgcgtgggaagtagcgtgcaatgttctcatgagttcgtccttatcttttgtccttcggcaagtccgtcaccgaggattatgtttcgcgtgggacccacctgcgaggggttgtctgaaattagctgcaaagctcgttggtcgcgccacgtttcgcgcgctcattgggtccgccatcgtcctcgggacacgtggcatgttcttggccgttcgtcgccgcattgagattcgtcactgtttttga

SEQ ID NO: 40088 - DNA, 1278 bp, Glycine max
  Peptide Sequence Number=SeqID_156866
atgtcaatgttggcaagcacgccccaagagaatgtcgagaaatccttcgggaacgaggaaccagacaaagagggcggaggcaatggcttcggttcaagagagcatggtgggctgatgagggcgatcgacggggatataaaggagcaggaagcggcgcttgaggggctcaagaaggttctggagagaggccgcacgtcgaccatgaggaagctcattatggttaaaatcaaaggaatatgtcgggctttaggcagagttatagaaagagccttaaggtcagaagttagtggtgatgcagatgaaactcatcaacggcaaaggtcgatagcatctgtacataggcagcgggcagctacacttgttgctgaggatgttgagcatgtggatcatgcagctgacgaggttcatgaccagcctcaggaggcagttgttgatgtccagggttttccaggtaggcctcacaatacattagttttgatggactatattcatcatgtggtagtcatggaacgtcctgggttgaagttgtcctcctatgaaaggaaggtacagaaatttggaaggtttgctccagagattgaaggtatagtagttgtcacaggattaagtcctttgattgcatattctttggacactggtcacaagggaattatatctgcttttgcagagagctacgcatggggagttgttgcactaattgatatgtatgagaatttgaatgatgggtcaaagagaagcgctagccaaattgtaggatatatcacacttttacagtgttcgatctacgagcattttcctactgtcgtttcttctattgttgttgaaggttatcatgagagaaaaccatgtgcttgctattggaagtctggaaagatattaccagtgtcagcgtatcataagcgattggatacattggcgtctcatgttaccattcttccacaccctattgctcaatctttatttatagaggatattgatgatagatggattcagttttctaaataccttacactagtgggtcagatttgtgttgctcttggacaacatccactcgtgatgcacgatgatacatttgttgaaccttatcatcctcagcaattggtcgccacaacagctatgccagaaccacctacagctgcacctactgatgtagacatgcatcgacatacactgagggtcgtcactgaaggaacagaagcatacactgtgattgaggaatacctaaggatggccaagggtgtgactgcgcaagggaatgtatacgttcgatcgagatga

SEQ ID NO: 40089 - DNA, 906 bp, Glycine max
  Peptide Sequence Number=SeqID_156867
ggtgtttggctagaagaggaagaagatattaagcacatggtgagtgagtattatcatgatctctttatagataatggagtggagaagtatgctataactgaattcacctttcttgcagtccttcttaaagagaaaatatctttgaatggtcctttcaaaattgaagaaattaaaaatgccctttttgatatgagtttgtggaaggcctcgggtttggatgggcttcctgcatctatggttgtgcccgaggttgagagggagaaattgaaggagaaggatgagaaggctggtgcgattcaacaaattgatgacgtgtttggacttgtagacagtgaagtcagtgatttctgtgcagtcaaggtggttaagattaagacagtggtggggagaatgggtggcacggtggctggtgctagtgttgcggtggctgtggctgctcttatgcctaggttgatttttccaaatcagaccagatttattcccactggatctacttatgatcgtatgcagtggcctttcatcaagaatgtcatggaagaagttgtccttcctgcagaccttattaagggtctccttcaaggaggccttctatctccttatttgctcattttgggaatggacaagctttttcacttaattctcaaagaagtgaataatggggaggagaatttgtggactcaagttttgaaaggcaagaatgggagatcttccaattttgaagatgcacttgtgctaaaacctttagattctactctcaggaaggttgtggccagttactatcctttcttgaaggagaatgaaatcatatcctccttgagttacaacaagctcccagatttagtgaatgatggtggagattggaatattgagcttctgagggacatcctcccaagggaaattgtgtag

SEQ ID NO: 40090 - DNA, 1110 bp, Glycine max
  Peptide Sequence Number=SeqID_156868
atggcgaattcggagatgtgcccaatcactctccataatgtccggttagatgcaacaccgcccgtggagttcgtgttcatgaaccgagaggggatgaacatagatttctttacatgtacgattacttgtttcgtgatctgcatgccagtcgccgagaaagaccacttctacgacttggtggggaacccattgttcgccttctattggtaccggtgtccttggtggtacgacaattcttctgccaattggacaccaaggcctcatgaggttctggctgatgtggtgtcccttgccgacaaagaccttaggggaaaaaagcataagaagcagagtcaccaggagcatcggaacgacttgggggaacacttcgggcaccaagaaggcacctcttgggagaagaggcttaagcatccaatgcttaggtttcaacctactgctgccaccaccttgggcaacatctcagccctaatgaatcaaggcttcttcaaccactctttctggccagaccgtctcatccagcaggaatgggcgttggtgattgcccaacatcttcaggggttgtccaatgccaatgctttgaaggaccagctgctgaagggcgaggactccttgaacttgatacttcaggacaacatgaagctgaccggagataataagaaccttgaagattgggttcttctactgacgaacgatgctaaggggctgcagacgcttgccctaaatgatgaggccttgattaggtctcagtatactgaaattactaggctctggtcggccttggttgatgccaacaaggaaacaaaggaggttaatgctgagatggaacatattcaacagaaggccctcaatgatgtgtacaatgcacatgaggccaacttcgaccacggcatttggcaggttttgcacatgtgctatgttttcgaccctaaggtctttaacattagcaaggatatctatgaaggggagcttgttttaattgatgacatcccaaaagaggatgttgctctttcacccccaaggtcggtgaccccaacagatgagccacaggtcaagggagtcgaggatgccgaggacggagaacaagtagggcctagggattgggtctcttag

SEQ ID NO: 40091 - DNA, 828 bp, Glycine max
  Peptide Sequence Number=SeqID_156869
atgttaggcaaggatcaccgaaggacacgtgttgcaaatgcttattactccctgtttatggcaattggtaatattcttggatatacaactggatcatacagtggttggtacaaggtctttgctttggcacttacccctgcatgcaatattagttgtgcaaatctcaagtctgctttatttctcgacattattttcattgctgtcaccacatatataagcattgtggcagctaaagaagtgcctctaagttcaagtggagcactccctgttgaagaagcagcagcaggggaatcaggtactgcaggagaagctttcctgtggcagctatttgggacattcagatatttttcgacccctatatggacaatactgactgttaatgctctaagatggattgggtggtttccatttctcctatttgatactgattggatgggccgagagatttatggtggtgagccaaatgaaggccctaatcatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttatcgttcttggatttccacatgcaatcacttacagctttccatatgccttgatttccacacacattcagtcattggggcttggtcattgtgggcaggattga

SEQ ID NO: 40092 - DNA, 1542 bp, Glycine max
  Peptide Sequence Number=SeqID_156870
atgtcccgcaatggctatttcccttcgtggcgagccatgctccaggctctggagtcacgattcgccccttcttattacgacgatccccagggcatgctattcaaactctggcagaccggtacggtcaccgagtatttgacggagttcgaacgcttggcgaatcatacctttggtctcacaccttcctgcttgcttaactgtttcatgtccgggctcatcccgaagcttcgccgccaggtgcaagcgctccgccctatgtccgtgccgcaggcgacgaaactcgcgcgactccaggaggataagatgctggatcgtcgttccaaccaccgtagttactcctcaccttctccggctccgccgaaaccccaccccccttccgcgaaccctacccctcgccttcctatcaagcgtcttatggcggaggaactagcggtccgtcgtgaccaaggcctttgttaccattgtgatgacaaatggtctcctggtcatcgttgcaagatgcgtctccacctgttcattgccaatgaggattttgatttctcctctgaccctttggtttcccctttgcatgccacgcctgagccagcgttagttccccagatcagcttgaatgttatggaagggacacctgctccccaaaccttccacctcttgggttctctgcgcaaccaccaggtggtcattttggtggatggcggctccacccacaatttcattcagatgcgcatggctaaattttttgccctctcttttgtttccacccttgtcgtttgtgtcatggtaggaaacgggaacaccctagattgcgatacccaatcccttcaggtttcgatttcgatccagaaccactgctttacccttgatttattccatcttcccatatgtggtgcaaatatagtattgggtgttcagtggttaaagctattgggcccagttaccacagattaccaatccttgaccatgacattcaaccatttgggccgagatatcaccctctgcaccgatgcacccccgtgcccatcatctgcctcaacccatcagcttaagagattactccaaactcagagcatctctgctttattccatatcacttacaaggcacctcctatatcaatccccgtcgcattcaaactacagttaccggaatcctcttggattcatccagtctttcatgtttccctgttaaagcttcatcaaggacctttaccaccttctccagctgctttgttggcgtatactatcgacaatcatccattggtcgtaccactaaccattgttgactggaaatgggacaccttcgttcatcctcctcttaaacgcgttttggtccaatgggatagcttagctccagaagacacttcctgggaattgtgggatgatctgtgtcaaacatataaccttgaggacaaggccaaagaggattgcaaggaagcccaattacctgcaggacttcgtctgaaaagcaccaaagctatcaacaagggagttaggagccacgagctcgtgaaacagattccactaagtatccactccactaagtaa

SEQ ID NO: 40093 - DNA, 210 bp, Glycine max
  Peptide Sequence Number=SeqID_156871
atggtgtcggttgaaggttcatcgttgaggaagtcgcttagagccaagtctgaggttcgaaggtgggtgaaagcgttgcgactttggtggtggccgttgctgctgaggtggggacatcctagagggctgcttctcggcctaagaagtgctagtgctataggagaagtatctgcctcccccaatcacacttccggagtacacgtgggttga

SEQ ID NO: 40094 - DNA, 4542 bp, Glycine max
  Peptide Sequence Number=SeqID_156872
atggcagaccacggaaccaggaagacaactaccgatcgtcttgaagacgccatagctcgtctcaccaacagccaagcctccatcaccgaacgctgcaacgacctcgacgggaagatcgactcgatcttacaacatctccacctccaagcatcagaaaataacaataacgccacgaatcaccaagcgcatcatcaccatcgccacgccgtcaaaatcgacataccgtggtttgacggacacgatccactaggatggatcttcaaggtaacacagctttttcagtatcaacaaacgcctgaagaagaacgcattacagtggcgtctctgtacctcgacggtccagctttaagctggtatcaatggatgcatagtaatggacttatcacttcttggaacggcttccttcaagccctagaatcgcgcttcgcgcctacattctatgatgatcctaaaggagcactgtttaaactcacacaaacaggtacggtcaatgactacttaactgaattcgaacgattagctaaccgtgtggtgggacttccacccccattccttttaagctgtttcatatccggtcttaagcccgacgtccgacgcgaagtactggctcttcagccattatcattcttacaagcctctgcgttggccaaacttcaagaagagaagttgcgcgatcgagctcttaccccagctcgaaactctcttcctccaagacccttcgttcccaatacatccaatattccggccaaggttaggcctccgtttgtgcagcgtaccccggcggaaatggccttccggagagagaagggtttatgttataattgtgatgaaaagtggagcgtcaatcacaaatgcaagggcaaggtactactgttcatcacggacgaacattctccgctccctgagtccaccacacatgactccgaggtgtctacagctacagttcccgaaaccgattccgaaccaccttccgacgtagactcccatatcagcctccatgcccttgccggcgtaccatcatcggacactttccggatttatggcatgatcaagcacgctcgattgacgtttttggttgatagtggaagtacgcataacttccttcaacctcgaatagcacagttcctcaagctctcctcccagcacactgcccttttacaagtaatggtcggaaacgggtctatgttgacttgtgatcaaatttgcccaagcactcagttaaccctccagggccaccccttcgtagtatcatttcatctactccagataagcggtgccgatgcggtgctcggagttgattggttacggcgactagggccagtcactaccaactacgctgactccgtcatgcggtttaagcacttgagccacgacattaccctgacggcagacgtttccaccaagcctgagtccacctccgcggcccaattgaagcgccttttacagacagggtccacctcagccttttaccagttgcatgttctacccatcaaccaacccgacccacccacacagtcacatcctctcccagctgtggaccaccttcttcttcaacacgatcatcttttccagaacccatctcagcttccccctccacgtcaaattatgcatcgcatcacgcttaaaccaaacactccaccaatctcggttcgtccctaccgctaccctcatttccaaaagaatgagattgaacggcaggtctccgagctcctcgctgccgggctcatcagaccaagcactagtccttattcatccccagtgcttctcgttcgaaagaaagatagcacgtggcgactttgtatagattaccgggctctcaactctgcaactattcgcgatcgattccctatccctacgatagatgaattgctcgacaaactcggacaagcctcatggttttccaaactagacctccggcaaggctttcatcaaatcttgatgaacgaaggggatattgagaaaaccgcttttcggacgcaccatcgacacttcgagtacttggtaatgccctttgggctctataatgcaccttcaacgtttcaatccgctatgaaccagcttctccggccgttcctacgccggttcgccacggtgttcttcgacgatatcctagtttatagcacctcactagccttgcatctgcatcatcttgaactcgtcttcaacacccttaaccaggccgcattcttccttaagcgttccaaatgccttttcgcccagaacaccattgagtacctgggtcacattgtttcagacaaaggcgtctcaccagatccttcgaagatacaggtcatgctgcagtggcccaccccagcatcggtaagggaactgcgggcctttctgggcctcactggcttttacaggaagttcgttcgagattacgcctccatcgcggccccactcacatcccttttgtgcaaagatgccttcgaatggtcgccggaatcacaacaagcctttgaccgcctcaaacgggccatgaccagcgcccccgtactcgccctacccaacttctctgaaccctttgtagtagagaccgatgcttccgggattgccattggtgccgtcctactgcaacaaggtcaccccctcgcatatttcagcaagtgtttaggaccacacatgcttcacgcttcggcttatctacgagaactccacgcagtagtggctgccgtaaggaagtggcggcagtacctcttgggtcggccgttcaccatacttactgaccataagagtctccgtgagctgatgacacaagtcatccagacgccggagcagcactattacctgtcgaagctgctgggctacgaatactccatccaatacaaaaccggtgccaccaacattgtagcagatgccctctcacgggtacctccccaagctggtcaactactcatccttagcattccccaactcgacttcctcaatgaaataaaacactccctcaacgctaatttggagttccagaatctcactcaggctattcaaagcaatcctactctctactcggactactctctaggtgacggcttaatactattcaagggacgcatttgggtcaaccacgataacccctttatccacaacctcatcactgaacatcactcgactccgttgggaggccatttgggggttactaaaactactcatcgtcttgaagcaagcttcatctggtccagcctcaagcacgacgtcaagaaatttgtccgggagtgcgtcacatgccaacaaagcaagaatgtccacaaacgcccagctggcttattacagccattaccggcaccagagggggtgtgggaagacctatctatggacttcatcacccacctgccaacctccaatgggttctctgtcatcctcgtggtggtcgacagattttcaaagggcgtccacctaggtgcgttagcctctggattcacagcattcaaagttgccaagctcttccttgatattgtttgtaagctgcatgggttcccaaaaagtatcgtatcggatcgcgacccgatctttgtgagcaaattttggacggaattattccggttaagtggaacacgcttacggctaagcaccgcgtaccacccccagtccgacggacaaacggaggtgatgaaccgcattatcgagcagtaccttcgttgtttcgtccatgacaacccatcctcgtggttccaatacctgacccttgcggaatggagctacaacacgtccatccactccggttccggtctcacgccatttgaaatcacctacggcaaaccgccccccacaatggttgactaccttccgggagccacgaaaactgaagccgttcaaaccatgctcgaaactcggcaagctttgcactcgaagctcaagcataaattgcagaaggcccatgatactatgaagaagcatgccgacacaaaacgcgacgacgtgtcgttcctcgaaggtcagtgggtgtacgtccgattacgaccgggccgtcagacgtcccttacgggtccactccacccgaagctttctaagcgtttttttgggccattccagatcctcgagcgaatcggacccgtggcctatcggctcctccttccaccggagtcactgatacaccccgtgtttcactgctccctcctccgccctcatcacggtccccctcccaccaccacgtacacatggcccttacaggttcgagatgcacaacccctcaggcgtccactgtgtttccttgactataaagatgacaccacaaccaccccaccaacacgaatggtccttacccaatgggaaggcgagccaccggaggacacctcgtgggaagaatggtctgacctatgccaggcctaccaccttgaggacaaggtggttttcggggaggacggtagtgttaacaatgccggcaactgcaactccgataacgagcatctccgtcacgacaccaacccaagaccagtacgtatcaggggagcgccagcacgtctgcgagactatcacgtgcaatacccccaggaacaaaagaataagctcgtacatacaataatagaaggtgcatgtacagattaa

SEQ ID NO: 40095 - DNA, 1614 bp, Glycine max
  Peptide Sequence Number=SeqID_156873
atgtgtaatccgaaaccatcgtcatcatccccatttctgtgtcccacaaaaaaccacatcataactcccgaccccaaactcataaatcaccctcctcccgttgatgatcaacttaaagatgaacttcacagatggccaacgcctaatgaggtgatagcagaaatgaaggccatagggaagatatcaggcccaacagctctaaccggtttaatcctatattccagagccatgatctccatggtcttcctgggctacctcggcgagatggagctcgccggaggctccctctcgatcgggttcgccaacatcaccggctactccgtgatctccgggcttgccatgggaatggaacccatttgcgggcaagcctacggcgccaagcaattgaagaccctgggcctaaccctccagagaaccgtcctcctcctcctctcaacctccctccccatctccctgacgtggctgaacatgaagaacatcctcttatggtgcggccaagaccagcagatctcctccaccgcgcaaaccttcatcatcttctccatccccgacctcttcctcctctccctcctccaccctctgagaatctacctccgaacacaaagcatcacgttacccctcacctactgctccgcaatctccgtcctcctccacgtccctctcaacttcctattagttgtccactttaaaatgggagtgtctggcgttgcaatagccatggtgtggaccaacctaaacctcttcatcttcctttcttcctttgtttacttctctcgtgtctacaaggactcgtgggttccccctagcaccgactgcctcaggggatggtcttcccttctcgcactagctgttcctaactgcgtctccgtctgtctcgagtggtggtggtacgaactcatgatcattctctgcggactccttctcaacccaaaatccaccattgcctccatgggaatccttattcagacaactgcgttggtctacgtcttcccttcgtctctcagcctcgccgtctccaccagagtggggaacgagttaggcgccaaccgccccgccaaagcccgcatttccatgatagtctcactcgcctgtgctgttgccttgggcgtcgccgccatgctcttcaccacactcatgagacaccggttggggagattcttcacctctgaccgagaaatcctccaccttacgtctattgcgctgcccattgtgggcctctgcgagctcgggaactgcccgcagaccacgggctgcggcgtgttaagaggcagcgccaggcccaccgtcggagcgaatatcaatttgggctcgttttatttggtgggcatgcccgttgcggttcttctcgggtttgtcgggaaaatgggctttcctgggctctggcttgggttgcttgcggcccaagcctcttgtgcttctctcatgatattcgttctctgcaccactgactggaacgcgcaagtgcggagggccaacgaacttactaatgctaattctgctccgttcaagcaaacggagtactgtaacaatgttcgtcttcgagagattgttgccacggaggatcatgatcatgagattaccaacagaccctctcattatacacactataaataa

SEQ ID NO: 40096 - DNA, 234 bp, Glycine max
  Peptide Sequence Number=SeqID_156874
atggagacgacggcggtcggaccagttgttaggggtttcgaaggagagggagaagatgatggagtctcgcagacgtgctggcgctcccctgatacgtactggtcttgggttggtgtcgtgacggagatgctcgctatcggagttgcagttgccggcattgttaacaatgttccattcatagaccatagtagtagtggtcttggagtgagccctgaggtggtggggaagtggtaa

SEQ ID NO: 40097 - DNA, 315 bp, Glycine max
  Peptide Sequence Number=SeqID_156875
atgtccaacatttccctgggaagtggaccatgggatcagctatttggtgggggaaactctccagcctttggtgtggcagctgttgcagcccttgccagtggactcatagctgtcttgtttattccccgacctggtgatgagttcttacacaaacatcccatctctatactctctacagtctacccgattgtggaaaagaatgaaatactgatggctgaagttgctctgacggcaagggaagagaaaaagaaagagttcatctggagtgttttggttaataacggtgcagaggtggttctgtttcctcatatataa

SEQ ID NO: 40098 - DNA, 759 bp, Glycine max
  Peptide Sequence Number=SeqID_156876
caccgccgggacatcagcgctggcaagtgtagcggtcacgctgcgcgtaaccaccacacccgccgcgcttatgcgccgctacagggcgcgtcccattcgccattcaggctgcgcaactgttgggaagggcgatcggtgcgggcctcttcgctattacgccagctggcgaaagggggatgtgctgcaaggcgattaagttgggtggaaaagcgcatccgtggccgcgtgaagcgccagatggaaaagagtcagcgcgagtactacctgaacgagcaggtcaaggccatccagaaggagctgggcgaaggcgaagagggcgccgatcttgaagagttggacaagaagatcaaggccgcacgcatgcccaaggaggccaagaagaaggccgacgccgagttcaagaagctcaagctgatgtcgccgatgtcggccgaggcaacggtcgtgcgcaactacatcgacacgttggttggcctgccgtggcgcaagaagagcaaggtcaacaatgacctgtccaacgccgagcaggtgctggacaccgaccactatggtctggagaaggtcaaggaacgcattcttgagtacctcgcggtgcaacagcgcgttgacaagctgaaggcgccgatcctgtgcctcgtggggccgccgggcgtcggtaagacttcgctggggcagtcggtggcgcgtgcgacgaacatcaagcttatcgataccgtcgacctcgagggggggcccggtaccagcttttgttccctttag

SEQ ID NO: 40099 - DNA, 267 bp, Glycine max
  Peptide Sequence Number=SeqID_156877
atggagagagagatgataacaatgataatggacacgttaccggtgttctactgtgagaagatggtgggttacatgccttcaagctctgcagattttgtgtttgctggcgagaggatcaaagtgggtctgagaatagacaaatttgattatgctgctttgatgaataggaagcctagggtaaatggagagaataagaaggagggagaaacccatgctgtgactatcattcctacatggccaaatttcccactagctcaacaatattaa

SEQ ID NO: 40100 - DNA, 276 bp, Glycine max
  Peptide Sequence Number=SeqID_156878
ggcaaccctgagttgattgcgcagcacaccaaagagaaagagaagctggcgacggagatcgagcgcctgaaaaacgtgcgcggcgagaagctgagcgccgaagcgcagaagctgagcaagctgccgttcagccgcgaaatcaccaagaaagagcaggccgacatgggcgcgctgaagaaaagcgcgcgcgggctgatcgtggtgcatccaatgaccgcgctgggccgcgagatgggcctgaaagcggtcaccggttacgccaagaaagcgttctga

SEQ ID NO: 40101 - DNA, 744 bp, Glycine max
  Peptide Sequence Number=SeqID_156879
atgaccaccccgacccattcgattcatcacgccgccgccgagggctatcaggccaatgccgatcgctatatgaaaggccggccggattatccgccggaaatcgccgcttggctgcgcgagactatcggcctgcacgccggcatgacggtcatcgatctcggcgccggcaccggcaagttcaccccgcgcctgctggaaaccggcgctcaggcgatcgccgtcgaaccggtgccgcaaatgctggaaaaactgtcggcggcgctgccgcaggtgaaaacgctggcgggcaccgccgaggcgatcccgttgccggacgagtcggtcgatgcggtagtgtgcgcccaatccttccactggttcgccacgccgcaggcgctggcggagatccggcgcattctcaaacccggcggcaaactcggtctggtgtggaacatgcgcgatgcgcgcgtcggctgggtgcgtaaactgaatcagatcgtcgatcgccacgaaggcgatgcgccgcgtttctataccggcgaatggcgcaagctcttcccgttcaaaggctttgaaccgctgcaggagcaggtctttatgttgagccaccgcggcgcggtggaggacgtgatctacaaccggccgcaacaggagcaggttatcgagcagttgcgccagctggtggcggaagaagaggagctacggggccaggacacggtcaccgtgccctatcagaccaaggcgtatttcaccaccaaggcctga

SEQ ID NO: 40102 - DNA, 231 bp, Glycine max
  Peptide Sequence Number=SeqID_156880
atgaattgcgttttcgttcatgtgtcctccacctttgagtttggagccatgcgtagtgtttgcatagtgcaatcctccattctccagagtttttcatcgtcaagggcggatcctcttgactggaaaataaaagaagaaggagtagagacgagagtcatcatcatggaaagggcaggacggacgaaatcagtgtcttatctttgctttcctcttatctccgataaaaggtaa

SEQ ID NO: 40103 - DNA, 831 bp, Glycine max
  Peptide Sequence Number=SeqID_156881
atgtttgagacaattgcacgaaagccaaaaattgatgcttatgacacaaatggtgttgtcttggaagacataaagggatatattgaactcaagaatgttcacttcagataccctacaaggcctgatgttcagatcttttccggattctcattgtatgttccaagtggcacaactgctgctttagtgggccaaagtggaagcggaaagtctactgtggtcagtttattggaaagattctatgatcctggtgctggagaagtactcatagatggtgtgaatttgaagaattttcaagttagatggataagagaacaaattgggctcgttagtcaagaacctgtcctatttgcaactagtatcagagaaaacatagcctatggaaaagaaggtgcaactaatgaggaggttacaaaggcaataaaacttgccaatgctaaaaagttcattgacaagctgcctcaaggccttgagacaatggcaggccagaatgggactcaactttctggtgggcaaaagcaaagaattgcaattgtaagggcaattttgaagaacccaagaatccttcttcttgatggttacgagaggcctgctcacacaggaaacatgcccctgcttttttcatcagggaagaagaagacaaacacacaagagttttatactggttcggcaataacccgtgcctacatccagtccccaagcgacctgcggtccttgagatttcttttcaacattgtaaattcctttacaagcaaagatccacaagggatgtaccctcccttgttctctttgaacaacctagtggatgcatcctccactagaactgatccataa

SEQ ID NO: 40104 - DNA, 203 bp, Glycine max
  Peptide Sequence Number=SeqID_156882
tggagcgggtgctatccgagaacaattggccgatctggatttgagaattcttatggattcttcgttgatagaatggaaagaattaggggaagagggatccccggacaatgaaaacgaatgggaagatcgaaaagagaaattggtacaagaagccgtggatacacttcttgataatggaatccgcggacaaccgatgagggacg

SEQ ID NO: 40105 - DNA, 192 bp, Glycine max
  Peptide Sequence Number=SeqID_156883
atggcctttgtggataactgggcggtgggtaaggagaaggaatggcagtcacagcacgggcttctccttcatcctcaccctcttcatttgccccagttttctcatttgtccaaagccggattactaaatttgcctcttttcagacccacatcgatcctttcacaggcaaagaccaaatccgcaaagctctga

SEQ ID NO: 40106 - DNA, 572 bp, Glycine max
  Peptide Sequence Number=SeqID_156884
ccagattgcccagtccagcacctcgaggctcgggttcccaacgttgattatagcgctgtgtgacattcagggggtggtttctgataccctgatctttgagtcactcagacctgcgatcaacctagcctatgtgaagaagaactgctggaaccccgccgacccatcgatcacgttccctgggcctcgccgcacacgtaccagagcttcagcatcagcttccgaggcccctcttcctacccagtctccgtctcagccatcccagcgaccgcgacatccacctgcttccacctcagcatccatggacacgcatgggcagatgctgaggtcccttcacgttggacagcagctcatcatggagaatatgcacaggctgtccctacacctgcagatggaccccccgctcaccactccagaggcttatcgtcagcgagtcgcctggccaggagaccagccctccactgacaggggggaagagccttctggagccgctgaggatcctacagtcgatgaggacctcattgctgacttagccaccgctgactggggcccatgggcagacttgggcggaggca

SEQ ID NO: 40107 - DNA, 742 bp, Glycine max
  Peptide Sequence Number=SeqID_156885
agaactgggaagagatgccttggagtgcaaggagatcatggacctcatcaaggctgctggactgctgaaaacagtcaccaagttgggagattgttatgaaagcctagtcagggaattcattgtcaacattccctctgacataacaaacagaaagagtgatgagtatcagaaacatcaaattgccaaggaaatcactgccaagcaagtccagcattggccaaagaaagggaagctttcagcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagactctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaggcaaccatcaaagccaccacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 40108 - DNA, 204 bp, Glycine max
  Peptide Sequence Number=SeqID_156886
ttaagcttagctcatcagtgggctaagcgcgcatccaccgctaagcgcagcttcagtgcgcttagcgcgacagaagaatccaacagagcatcaatatcaaggtcgcgcgctaagcgcgagatcagtgagctaagcgcaacagttgtattcagccaggctcagcacacgactggcgctaagcttaaatctacttactcgcgctaa

SEQ ID NO: 40109 - DNA, 574 bp, Glycine max
  Peptide Sequence Number=SeqID_156887
atggcggtaccgatgccgccggttccgccggtgaccagtgcgacgcgagatgtcatggagtgctgtccgggtatcaggtgggggaagggtgattctgcaacatcggcgcggaaagtgcgccggctggcagcaggatgtcggtacgtggcagccgcgctgggtcgaaggcattccgagcggccgccagcagcgtgtccagatcgtgcgcaggttccagcgcttcaggtgcttggccgagcagttgccagagctggcgcagcacgggcagcgggcgcgaactgtccaccggcagcgccgccagcgacttggacagcttgtggcccggggcatcgagcagcagcggcaggtgccagtagcgcggtaccgccagccccaaggcctgctgcagcaggatctgccgtgccgtggagtcgagcaggtcggcaccgcgcaccacttcggtcaccccctgcgcggcgtcatcgaccaccaccggcagctggtaggcccagcagccatcggcgcggcgcagcacgaagtcgccgacctcggcatgcacgtcctgctgctgcgggccgcgcaggccatcgtcgaa

SEQ ID NO: 40110 - DNA, 531 bp, Glycine max
  Peptide Sequence Number=SeqID_156888
atgaccgaacgcggctacagcgtgtcgatcttcccgggcgatgtctccgatccgggcagcgccgaagcgctggtgcgtgcggtcgaagccgcgctgggcccggtcgagatcctggtcaacaacgccggcatcacccgcgataccacgttccatcgcatgcgcgcggaccagtggcacgatgtgatcaataccaacctcaattcggtgttcaacgtcacccgtccggtcatcgagggcatgcgccgccgcggctggggccgggtcatccagatcagctcgatcaacggcctgaagggccagtacggccaggccaactacgcggcggccaaggccggcatgcacgggttcaccatctcgctggcgcgcgagaacgccggcttcggcatcaccgtcaacaccatttcgcccggctacgtggccaccgacatggtgatggcggttccggaggaagtgcgcgccaagatcatcgccgacatccccaccggacgcctcggcaagccggaggaaatcgcctacggcgtctcgttcctg

SEQ ID NO: 40111 - DNA, 681 bp, Glycine max
  Peptide Sequence Number=SeqID_156889
atgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtcaataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcgccttcttaattgcctcgacttcgggcaaatttggttaa

SEQ ID NO: 40112 - DNA, 348 bp, Glycine max
  Peptide Sequence Number=SeqID_156890
atggcatcagatagaatgcaactacagaacatgtgtaaaaaggagcatgaatctttcaaagaatacacccaaaggtggagggatctggcagctcaagtagcgcccccaatgatggagagggagaagataacaatgatagaagacacgttaccggtgttctactatgagaagatggtgggttacatgccttcaagctttgcagatttagtgtttgctggtgaaagcatcgacgtgggtctgagaagaggaaaatttgattatcctgctttgatgaataggaaacctggggcaaatggagagaataagaaggagggaggaatccatgttgtgactatcgttcctacatag

SEQ ID NO: 40113 - DNA, 522 bp, Glycine max
  Peptide Sequence Number=SeqID_156891
atggaggccatgaaagagaaaatgaccacaatgatggaagccatgataagtatgagaaaaatgatggaggtcaacacggctacagtcattgccacaagtaccaccactgaggtggaccctacttacccatctagcctcaatcaagtaaatcgtccagtctcggatatggtaggtcagggaggcgaagcgttgggaagtacgggcggcccccattttgtgcaggtccagagtaaacattctttttcaccatatggcttgcctcccaactatacaccacccaatgttgcacatattcccaatgagaatgtcgataactctgctcccatactcattgagagccaacacccccaatttggtcatggacaggtccctcaacccatgggggagacacatgaagtaccccaagaccacactctaatcgactttgagcctcaccttggatatgccactgaggggcaggcatttggtggcatacccttgccaaacactttggggggccttcagtatcacctacaaccataa

SEQ ID NO: 40114 - DNA, 150 bp, Glycine max
  Peptide Sequence Number=SeqID_156892
atggagaattgcactaagcaatcactacgcatggctcctaacacgaagatggaggacatattaatgaaaacgcaattcatggggctccgaaaaacgttgagaatggagaattgcactaagcaatcactacgcatggctccaaactcgaag

SEQ ID NO: 40115 - DNA, 2416 bp, Glycine max
  Peptide Sequence Number=SeqID_156893
atgtctcaggttgagaacaaagccggcgttaagccgcaggatctgtcgatggaaaactgggtagagtcgcgcatcgcccgcttcgaaggccgtaaatacgactggaacgcgctgaaattccaggccgactttgatccgaaataccgccgtgcgcagatgcgctacatcggcaccggcgccaccggcgtggccagcgacgccaacaccattccggcgggcaacttcaccttctccaccatggtgctgccgtcgaagtgcgagggcccgctgcacctgcacgacgacgtggaggaagtgttcttcatgctgaagggcagcatcacgctgatgattcaggacggcgaagagtattacgaaaccaggctgaaagagcgcgatctgatctcggtgccggcgggggtatatcgcggcctgttcaaccacggtgaggaagaagcgctgatgtgcgtgatgctcggcaccgccaagccggagatcccgacctatccggcggatcatccgctgtccaaagggcggccggtggtgttgctgcacggcatcagctccggatcggcctcgtggatcaagcagctcaacgatagcggcctgacggatggccaccgtctgttggcgtgggacgcgccgggttacggcggcagcctgccgttggcggatccgcaggccgatgccgccggttatgcggcggcgttggcggcgctgattgatgagctgcagctggcgcagccgctgatcgtcggccattcgctgggggcgctgatcggcagcgcctatgccgccggctatccggacgggttatgtggattggtgttggcggatccggcgcagggctatgccacggcgccggaggaaaaacgccggcaggtctatggccagcgccaacagatgatagagacgctggggccggtgggctacggcgagcagcgggcggcggccttgctgcgtgaaggggcggatccgcaggatatcgcctgggtgcgcaacggcatgcagcagctcgatcccgacggttttctgagagccgcctggatgctggccaacgacgatatcggccgctatctggcgcgctatcgcggcccgctggaggtgtggtgtggtgaacaggatcgcattacgccgccggagaaggcggccgagctggcgcgtgagcaggacgcgacgctgcgtttgatcgccgccgccggtcatgccagctacctcgacgcgccggccaatccaacgatgaattttcagcttgaaaaccgggtggcggtggtgaccggcggctcgtcgggcatcggtttcgaaaccctgaagctgctgctggccgaaggggcgaaggtggcgttctgcggccgcgatccggacaaactggccggcgcggaggccagcctgcgtgcggacttcccgcaggcggagatcctggcgctgcgctgcgacgtgctggacgcgcagcaggtggcgcagttcgccgctcaggtgacggcgcatttcggcggcgtggatctgctgatcaacaacgccggtcagggcttcgtcgcccattttgaccagacgccgcgcgaagcctggctgcatgaggccgagctgaagctgttcggcgtgatcaacccggtgcaggcgttcttaccggcgttggaacggtcggcgatcgcgtctatcacctgcgtgaactcgctgctggcgctacagccggaagaacacatgatcgccacctcggcggcgcgcgccgcgctgctcaacatgacgctgacgctgtcgaaagagctggtgggcaaaggcattcgcgttaactcgatcttgctggggatggtggagtcaggccagtggcgccgccgtttcgacgagcgcagcgataaagatcaaagctgggaacagtggacggcggcgatcgccgaacggcgcggcatcccgatgaagcgcctgggcaagccgcaggagccggcgcaggcgctgctgttcctcgcttcgccgctggcttcctttaccaccggcgcggcgctggacgggccgataaagatgaagaagatcatgatgattggctacggcgcgatggcgaaggaagtgatcgcccgtttgccggaaggcgtggaggtcggcgctgacccatcccgagcagtgtttgcagcggccggatctggtgctggagtgcgccagccagcaggcggtggcggagttcggcgaagcggtgctgcagcgcggttggccgctggcgctgatctcgaccggcgcgctggcggacgccgcattgcaacagcggctgcagcaggtttgccgccgccatcacgggcagctgatcgtgctgtccggtgcggtggcggggatggatgggctggcgtcggcgcgcgaaggcgggctggagagcgtgacctatcaggccagcaaaagtccggccagctggcgcggcagcccggcggagcagctgatcgacctcgatgcg

SEQ ID NO: 40116 - DNA, 843 bp, Glycine max
  Peptide Sequence Number=SeqID_156894
tgcgatctgacgctggtggccggttcgcgcctgcgcagtaatgaaacccgcacctggacgctgccgctgccgcgtccgctggtgcagattgacatcgatccggcggcggccaaccgcaactatctggccgatgaacagatcaacggcgactgtgcggcgctgctgtcggcgttggcggcgcggctgagccccggcgagaaggtcaacgccgagtgggatgccgagatcgcgggggcggtgcagcaggcggagcgcgcgctgcgccaacagtccggcgaatacgccaaactcaacgacgccatcgacgccgcgctgccgcaggacgggctgttggtacgcgatatcaccgtttccggcagcgtctggggcagccgtctgttccgtgccatctcgccgctgtgcaacattcactcgctggcgggcgccatcggtatggggctgccgatggctatcggcaccgcgatcgccaacccgcagcgcaaggtggtggggctggtgggcgacggtggtttagcgctgggcctgggcgagctggcgaccatggcgcaggaacaggtgaacatcaccctgattatcatgaacgacggcggttatggcgtgatgcgcggcattcaggacaagtacttcgccgggcgtcagtattacaacgagctgcatacgccggcctttacccagatcgccgaagcgatggggttgaaagcctggaaggtggacgcggcgtcgcagttcaacggcgtgctggccgaggcgatcaactacccggggccgtcggtggtcgaggtggacatgaagcaggtcgggccgctgaccttcgccgggccgccgcagaagacgctgtattga

SEQ ID NO: 40117 - DNA, 202 bp, Glycine max
  Peptide Sequence Number=SeqID_156895
atgggtcaatgtactggagatccaatctgtcttgtcctgggtagatcggtaaccagaggtggagagacaacttcaggtgaatttggtgagggagatgggacaacacggacattatggtctgagttatctagaggacaaggagaagagataggaagaacctcctggagagacgaagagtggtccacggaggatgagaataagg

SEQ ID NO: 40118 - DNA, 372 bp, Glycine max
  Peptide Sequence Number=SeqID_156896
atgtccgtgttgtcccatctccctcaccaaattcacctgaagttgtctctccacctctggttaccgatctacccaggacaagacagattggatctccagtacctgaagcctctcctcatgatcctcgttcttcttcaaccagtcctccactcatggatccttcctcgtctttcacttctccttctcattctgactcacattgacccattgccatcaggaaaggctcttgaaaataatggtacttgggagctcgttcctctccctcctggtaagatgaccgtgggttgcagatgggtctacactgttaaagttggacccaatggtaaggttgatcggcttaaggctcgcttggtagctaagggctacacacag

SEQ ID NO: 40119 - DNA, 524 bp, Glycine max
  Peptide Sequence Number=SeqID_156897
ggctacacgcccccaccttcagaggactatacgccttcgccttcagaggactacacgtcctccccttcagaggactacacatcatccccttcagaggactacacgtcctccacttcaaaggagtacatgtcctccccttcagaggactacacatccttgccatcaaaggactacacgtcctccccatcagaggactacccgtcctcaaattcagaggactacacttcctccccttcgaagggctacacgccctcgccttcagaggactacagatcctcggctttagtgggctacacgcgctcaccttcgtaggagtgcatgcccttgccttcataggactccacatctgtgccttcagagaactcaagaccaactgtgcgagcacaaccagagagggaggctatcacgtagctactgtgcataacggagcaagatttcacctgtgccgctacaaagagacgagtgtggatcatgcgcaccaacatgacccctcttacaaagatatggatgacgttgctacttag

SEQ ID NO: 40120 - DNA, 207 bp, Glycine max
  Peptide Sequence Number=SeqID_156898
atggctcgtactcatgacgcgatcctgtattacaacgggaaatggaacatgtcaccgcagaacaaatttgttggatgcgcattcacaggaaaaaatcctaagaaatttcaaattccttcaacatgtaccatcgatgaactgaagaatttaatcaagcaagttgcacctaaagggattccccatcttggaattcatgaatcacaaacg

SEQ ID NO: 40121 - DNA, 321 bp, Glycine max
  Peptide Sequence Number=SeqID_156899
atggaagagacacatgaaattccccaccataatctagccgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttgttcctaatacccaaacatggtcattcccaagttcaaggtgctggactttga

SEQ ID NO: 40122 - DNA, 195 bp, Glycine max
  Peptide Sequence Number=SeqID_156900
atggagcaagttagcataggataccagaattggggtgaattctacaggctttttactgcaaaattccttccttggttggtgttttggtttgtgctaaaggtggtgtttagcattggttgtgtggaaggtaaggagaagggttgttattggctaagtaatgacatcgttgggttggtgggaaacttggccgtatag

SEQ ID NO: 40123 - DNA, 444 bp, Glycine max
  Peptide Sequence Number=SeqID_156901
atggctcttgggtcaaaaagggtgctccacccgctgatgatgaaggcaaccaaccagttgaagataattcctctcttcttcgaaagcttttggaaaagttcgatggtcttcaaacttttgttggtgactagtttgataatatggaattgcaagtcgacatgcggtttgatgtcatggaatcaaggatcaccaaagaagaagaagatgtctccttcatccgtacttgctttgatccaccaccaccgccttcatcatcctcttagcttatatgttattattaagactaagtattgtcatcatcaaaaagggggagattgtagacaaaggatcaagctgaaagttttgatgatgccaaaggattacatgaatcatatgcttctaaaagatttactcaagacaaagcaattagagttaatcaagatggatgatcaagacagtctatag

SEQ ID NO: 40124 - DNA, 123 bp, Glycine max
  Peptide Sequence Number=SeqID_156902
atgtctcgcatgtataagttttacagtctcacattaagttcatgtttgagacatgcaagactccttgaggatattgagtttggagtggaaggaaacacaaggagtgttgtctttaaagaataa

SEQ ID NO: 40125 - DNA, 300 bp, Glycine max
  Peptide Sequence Number=SeqID_156903
atgttgaatgccaattacagtgcaaagcaacgaaccaaaaagagggacaaaagggtcttttcattgagtttcctgaaccctagctcacccaggctagcctttggctcgcctaggctcccaaattacttcagggtgaaggaaccagctcacctgggcgagctgctgctcgcctgggtgagcatgctagggaggctgaggaggggttccaaggtccagagggtgaggaaattgagagaagagagaaagaagaagaagaaaaagaggaaacgaagccgaggcgccactgaatcgcgaccgtga

SEQ ID NO: 40126 - DNA, 749 bp, Glycine max
  Peptide Sequence Number=SeqID_156904
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgttccgactccggaaaactccaagtcagaaccccttctgggagatacaatgttcacaatgttagctatgctgatccacacattctaatcactgatccattcatgtggaactgtgacgatggtgagaattaccgtcccacaaggccattcagtttggacaccagcacacgcttcaagctttcccctcataatgagtatctattcttcaattgcagtgaggatcatgtgatcgttaagccaaagccaattttctgtgagcgcttccctgagcgttgtgactcttcgtgtgacagtggtagtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 40127 - DNA, 192 bp, Glycine max
  Peptide Sequence Number=SeqID_156905
atgtcagtgaaaaatctcgtcggacacctaagagtacatgacaagacaaaccacacactagcaagtcaagtcactctcactagacttaaaagagcactcaaaccgggtgtatttacccccaaggcctacactccgaagagtccatcagggtctctccctcctgattcaggtccaacccagaaaacattttag

SEQ ID NO: 40128 - DNA, 210 bp, Glycine max
  Peptide Sequence Number=SeqID_156906
atgcatggcgccattggtgatggcgccttcgacagggacgagccacgtggctgtgtcgccactgtgactggcgacagcagcgatgtcgccacctgcaatggcgctttggccatgcagggtggagtcgctggtcaaaccagcgcttccctacgcgtttgctttttgcaggtgcagcttttgctgaaaacgccagctcctttggcgatttag

SEQ ID NO: 40129 - DNA, 675 bp, Glycine max
  Peptide Sequence Number=SeqID_156907
atggatcagcttggaattattcaaccctcttcttcaaccaaggttgaaagaaggctagtggagaaaaacagaagaaatcaaatgaagatcctctgcaacaaactcaactctcttctccctagctataaccccaaggaagcattaccactgcctgaccaagtggacgaggcaatcaactacatcaagagtttggaggcaaaggtgaagatggcacaggagaagaaagagtgtttgcaaggaattagaaagagatcccgtgattgcttctccaataatagtaccaattttgctgcaacttctgcaggtttcccaaaatcgccacaacttgagattcacgaagtgggttcttctttacaagttgttcttacttgtggattagaccaccagttcattttctctgagatcattcgaatgctgcatgaagagaacattgatgttagaagtgccaattcctcacttgctggagactcgatgcttcatgttgtgcatgctgagattcctcaatctttacttcaatttggagccaccaaagtaagccagagattgaaaaggtttgtgaatggatcctgcagtgatgtggaaacacagcccgagttgtgggattttgaaattggtactgatgatatgtggggtttgtatatcttacaaggatgcattttaccaaatgttgtgtaa

SEQ ID NO: 40130 - DNA, 339 bp, Glycine max
  Peptide Sequence Number=SeqID_156908
atgataaatgatggaacatacgaatttggggattccacggtcatgtggctccgcatgccactggactcttgggtcacggtaacaaaaggtggggtggtcgacaaaagcagggcttttgctcctacgtatcctcaatttgtgatgaggaactcagacctacgaaacactgggtccaacaaagataggagaaaatcactcaaagtgtatcaatctcacacagggcaaggattgacattctcaccctgggtcaaggtttatgataagttgggattttggctcaaggcttgtagaacggctggtcatgatatatgtcaggtttggccaacggttcggggataa

SEQ ID NO: 40131 - DNA, 486 bp, Glycine max
  Peptide Sequence Number=SeqID_156909
atggtccatgccttggagcttccttcccatgggagagtaccatatggtttgagatggtgggagaatcttggcataaaagaagacttgagcttagcaagaaataggttggttgaaagcttcttgtgtgcagcaggagttgcttttgagccgaactatacatctggtaggaaatggctcaccaaagtgattattttcgtgttagtcattgatgatgtttatgatatatacgcctcatttgaagagttgaaaccgttcacaatgacgtttgagagatgggatgagaaagatcttgaagagcttccagagtacatcagaatttgtgttcatgcacttaaagacgtcagaaatgaaattgcttatgaaattttgtttctacgtatgttgtcagaaatgaaattaccttacctaaagaaagtggtaatggtattgttaatgactgctccctccgttcatttttacctgacttttaaggttattattatataa

SEQ ID NO: 40132 - DNA, 255 bp, Glycine max
  Peptide Sequence Number=SeqID_156910
atgaaacaggctgaaagagaaaggggtgatactgcttcgtcaatcctgtgctatatgaatgagatgaatgtttcagaggaaaaagcaagaaagaaaatacaagacatgataaacaaagcatggaaaaagataaatggacactgctccactcaagttgcttccatgaagccatttcttaatcaagccataaacgcagctcgtatggctcataccctttatcaaaatgaagatgcatggttttggtacccaggatag

SEQ ID NO: 40133 - DNA, 534 bp, Glycine max
  Peptide Sequence Number=SeqID_156911
atggtagaagaatttgaagagatcctgggatgtcctctagagggaaggagaccataccttttctcagggttctatccctcattagctagaatttctaagatagtccaaatctcggcacaggaattagaccacagaaagcaagtaaaaaatggggtggttggaataccgagaaagtatttggaggctaaagcaagaatcttggcaggtaaaggcgaatgggccccgttcatagacattctcgcactgttgatctttggaggagtcctctttccgaatgtggatgggttggtggacctagcggcaatcgacgcttttctcgcctatcatgaccacaaggaaagcccgattgtcgctatgctagccgacctatatgacaccttcgaccgaaggtgtgagaagagcggtacgaggattgtttgctgtactccagctctttatgtatcgttggtttcgcacctttttcgccaagaggtaaggcatgcttgctcgctagaaagtcaccattcatgcacagagaaaggaggcgcaaattag

SEQ ID NO: 40134 - DNA, 1209 bp, Glycine max
  Peptide Sequence Number=SeqID_156912
atgagatggaaaagggtgcaagtgaatcctgaagagcatgtaaaggttcctagatttcctgaatgcaattcagcagaattgtatgaccattattttgatgaatatgtgacaaggattctaaatgaacggacacctcagaacaagccactatgggaagtccaccttattaagtatccaacaagcaatgctgcaggcacaataattttcaaatttcatcattcgcttggagatggttattccctcatgggtgcccttctttcttgccttcaaagaactgatgacccttctcttccacttacttttccttcaagagtatcatcaaatccgcagcatgcaaagaaaaccatatttaagaagttacattcagtgatatcctccttttttagctccatgttagattttggatctagcgtaataaaggcaaaaatgattgaagatgacaaaacacccataaggtctggatatgaaggaactaagcctcagcatttcaccttgtcaaacatatcattatctcttgatcatatcaaagcaatcaagtccaatcttggagtgacaataaatgatgtgataactgggataattttctatgggattcggttgtacatgcaagagattgactacatgacaagaaaagcaaattccacagctttggtggtgctcaacacaaggaatattagagggtaccaatcagtgaaggagatgcaaaaaccaaaggtcaaaggtctatgggggaataaaatttctttcttacaaataccaattccaaagctagaccaacccaaaatctccaaccctcttgagtttgtttggaatgctcgtaaacaaatcaagagaaagaaacattctttcagcgtttatctcataggtctgcttttggatttggagatgaaattaagaggccctgaggttgcatctaaaaccttctacaatactctgggaaactgtagtgttcttatatccaacatgtttgggccattagagcaaatggctttagcaaatcatcctgtaagaggtgtttatttcgccatgtctggtggacctcagaatgtaaacgtagcaattatgagctatgtgggagaattaagaatcaccttgaaaactctaaagggattcatagatgaacagaaattcaagttttgcattgagaaagcctttgatgaaatattcaaagatgctatggagatctatgagatacccaacaaaatttaa

SEQ ID NO: 40135 - DNA, 429 bp, Glycine max
  Peptide Sequence Number=SeqID_156913
atgccactaagtagggacaatgatcatcatgttgacaattgttaccaaactgtacaggtcttggtcatcttaccttgggctattgtttcggctgtcactagtggaagtaaacgatttttccttggaactgatagtgctccacatgataggcgtaataaggaatgttcctgtggatgtgctggcatatacaactcaccggtcgctctatctctatatgccaaagtttttgaagaggctggtgcacttgataagctagaggcttttacaagctttaacggacctgacttctatggcctccccagaaacaagttaaagattagactgaggaaagctccttggaaagtacctgattatttgtcgtttccatttggagacattgttcccatgtttgctggtgaaacccttgaatgggaggcattgccttgctga

SEQ ID NO: 40136 - DNA, 222 bp, Glycine max
  Peptide Sequence Number=SeqID_156914
atggtaacaaaacaaaataagcactggcagaatcagtgtgagacagcgcaagagattactttaaaaccttcaggagatagggacctgaacgtagggcgtcaaaagagagagctgcatggcctaaccgaattggatgccggcggcgacggtcgaactgagagcgattggaagacggcgaatggaggtcgatccggcggtcgacgtcgacgactaacgcagtga

SEQ ID NO: 40137 - DNA, 450 bp, Glycine max
  Peptide Sequence Number=SeqID_156915
atggagctcactattacacaacctgatgattggcatcttcacctccgtgatggttcccttcttcaagcagttctccctcacagtgcaaaacaatttggaagggccatagtgatgccaaatttgaaaccacccatcactaccacgtccgctgctgttgcttatcgagagtccattttgaaagcaatacctaaagatagcaacttcaatcctctcatgacactttacctcactgacatgactactcctgatgagattaaacttgcaaaaaaaagtggacttgtttatggtgtgaagttgtatcctgctggtgctacaacaaactcccaagatggtgttacagatatttttggaaattgtttttctgttctcgaggaaatggctgagaaaaatttaccattattgaatgtaattactacatacggcaccaattttggagcatgtccactttga

SEQ ID NO: 40138 - DNA, 351 bp, Glycine max
  Peptide Sequence Number=SeqID_156916
atgtactcaaatggaagcaagcaatataatcagaatttcctctcctttaatcccccttttctggagtatcacataggaagaggtcatattggagcaacaatgaaagctaaactttatcacttgctggagcatagagcttcagaatgccgatattttgtcattcctttatggaggggaagtggatacacgacaatgtttattcaaggtcctggacagtttatggattcatataaactactgttgacaccctttgaatataccttacctatcaagaaatcaaattccaatctctccctgcacatggctaaggacatgcttcctcttaacaaattttctacttacaaaaactga

SEQ ID NO: 40139 - DNA, 390 bp, Glycine max
  Peptide Sequence Number=SeqID_156917
atggaacgtcaacgcctcaaccaaaatgaagagaccgacaaaaggaaaagaagcatagcactcaaagccccctcctcaatgcaagaagaagaagaatctgatgatgaagaagacttctcactctttgtgaagaagtttcataaattcgtcaaaaatagaagaatggagagaagccataacttcaacaatgggaagagatcccaagaagcaaactgtccctcaaatgagtcatggcccgagaagaatgagaagaaaagctataaagaaagaagatccaagaaggcgtatatggcttgggacgacgatgactcgtccgatggtttaaagaaggagatcaaccttctatccaagggctatgaaagtgatgagaacatctctcaagaagtttaa

SEQ ID NO: 40140 - DNA, 330 bp, Glycine max
  Peptide Sequence Number=SeqID_156918
atgtgggccatcattgaccaatacaaagaaaagctaagcctagtagaagcccatgaacaaaggctagaggatgagtatgcaaaggtttgcattcaccttgaatggaagtcaagagcttccgagattgctagccaaagccaaggagaaaacaccataactaaacacgctctaaggcacccctatcgaacctattctaagactagagtcatgggtgacgtagaagaggtgcaagaacagatgaaggccgatatggtgaccttgaaagatcaaatggcttccatgatggaagctgtaacgacccgcctcgtcactacggtatccacactctaa

SEQ ID NO: 40141 - DNA, 102 bp, Glycine max
  Peptide Sequence Number=SeqID_156919
atgacggacagcatagggaattcaaataggcgcccaaatgcaatcccaagcttaggaacccaagcttttagcttcaatgcaaggaaacatacttatggctaa

SEQ ID NO: 40142 - DNA, 595 bp, Glycine max
  Peptide Sequence Number=SeqID_156920
atggtaaccagagtacgacaaaccgctgcggcgttgcttctgtgcggcagtagcgtaatggcctccgcacaggcggcgacagtgaaagtcagtgtgacggtgatgcagcctttgccctgcaccatcaacggcggacggccgattgaggtggattttggcgatgaggtgatgacaacacgcattaacggtaacttttaccgtatgccgatagatttttcgttcacctgtaataatccctataaaaacgccatgcggttgcaggtgcagggcggcaccgccaatttcggccaggggctgctcggcaccagtcgggatggtttggctatcctcatcttgcaaaggcaaggtggggatcaactgccgctgaattcctggcacaatttttcctatcccaatccggttaaattggatgccgtgccgggggctgcgctggctgcagaggaggttgcgatgcaatttcgtggcggcttgattgccccgcctccttgcacgattaacgccggggcgaaaatagatgtcgattttggctcgcgcgttgggatcaaaaaagtggatggcgttaactaccgccaggcgatcgattaccaccttgatt

SEQ ID NO: 40143 - DNA, 339 bp, Glycine max
  Peptide Sequence Number=SeqID_156921
atgtggctgtcgctcgacgcggcgggcagcggcatggatgagggcgcgggtctctggtataacttagcgcagccgccgtcggtcgggctggcggcgccgcgcgacgccgaaggccaggacttccagctttatcccggcgacgtcggcaagcgcatctacaacgagatctccaaggaagcctggggcgagtggatgaagaagcagaccatgctgatcaacgagaaaaagctgaacatgatgaacgtggacgaccgcaagctgctggaagaggaaatgatcaagttcctgttcgaagggcacgacgtgcacatcgaaggctatacgccgccgagcgaataa

SEQ ID NO: 40144 - DNA, 1353 bp, Glycine max
  Peptide Sequence Number=SeqID_156922
gacgccaacgtggagtttatccgcgataacgtcgagctggtgccgatcggccaggcggaagggcgcatcgcggcggaaggggccttgcctgtggggcggcgcggtgcagcgttacttcctggcgctggaagagggcatcaaccgcctgccgggcttctcgccggagttgcagggggtctacatcgagaaaaaagatcacggctggaagcgcatcttcggctatatgatcaagccatagaaaaagggccggttcgcaccggcccttctcatttatccacgcggaacgcgttactttctgcggtagctcttctgcgcggtattcactttcaccagatagcggcgcgactcggcggccgggtgcttggtggtcagcgtctgatacacgtcgcccggctgcatggcgttgatgatgcccaccgcgcgcgttctgtcgctggagaacacccgcagcacgctgccggcgccgccgttgtaggcggtgatcaccgcatagcggcgcgaggtcgggttctgaatgccgcccaggtagttgttctgcaggatcgccaggtaggcggtgccggtgtcgatgttgttctccggatcgaacaggtagctgcggctcggggtgccccacttgccgcgcatctggaacacatccttgccggcggtgtgctgcatcacctgcatcaggcccagcgcgtccgaaccgctcaccgcatacgggttgaagctcgattcggtctgcatgatagccaggatcagcgactcgtccacgccgtatttttccgacgccttgcgcaccatcggcagatatttgtgcgcacgtttgtccaggtggttcggcaccagctggatggtgaccgagtagatcacgtgcaggccggaggtgcgtttttgcagcttggtctgcagcaggtaatcggcgaagtgcgccgcgcgccattcccagcggatcggcgcgcccttgttatccagcacctggccgtacaggaacggttctttgctgatctggatatcgttggcgtcggaatagagatcgatggagccaggatcgtcacccatcagcagcgtgctgatgatcgcctggcgcaggtgcgcggccggatcggtggtggcgatggtctcgatggtaatggcgccggtgtcgaagttgatgtggctgcgggtttggtattggtcggtatatttgacgtagtctttcggcccggcgatcagaacttcgttcagaccccagatgttctcgatgttgtgggcgaattggcccatcagaatgtcgaagccgttggtatctttaatccaggcttcgttgatttcttcactttttttgccggaacaggagatcagcaaaggcgctattacgagcaaagctaa

SEQ ID NO: 40145 - DNA, 1369 bp, Glycine max
  Peptide Sequence Number=SeqID_156923
atgtcttcatttttgtttgactccaccatcggcataggtgacagtgattctggggattcgattcaacaacccctgatggatcgggaggttatttccattggtggttccttcttggaggatactcgttgtggtacctccgatagtgagtcctctttctcaaaaagggtaagggcttcgtgtcgtactgatggaggcacttcttgccttcacgagagggcctggccttccgctgatttcggggagcctatctcgattaatgtaatcctcccctcttctgcttctggggaagtgaggaaagtgagggacgatgttttgaagtataggtttgttctcacctttacggcgaacgtcgttgctctgcgatgccaggtgaagatggcaagccttgaggactgctacaagataaccgtccatgcttgcgggagtgatgacttccctttcttgagggtggcgtcggggcttgttctctccttggtcatcttccagtgtgctctgcttgagcaattgaatgtggcttcttctcagctctacccaaacagttgggcaatggtgagaacttttgaatttttgtgtcctttctttaacatccagcccaatgtgtcggtcttcttatacttcttcttgatgaaactagcaggaaagattggttggatcttcttgaacaacgtgtccaagaagttgttcgagtttgactcaaaagtctttcgccgtttcaaggactgtttcttcaaggtcctggactcgggtgtcgtgactgatggttttccactgatgctcaacaaggacaaagagcctcacttcccgttctactgggaggttgatcccaccatgtttaagtctttcgatgaagacctactggtcctcatggagaagatgcataaggccatcttaaagcttgaactaacacttgctcgtgttgttgttgctcgttttgcaggtattatgggtgacttcgcttggaggccactcatgaagcaggtcggacttgcagttgggattatgccaccatctgctactgctgccactgaagggggtcaacctgttgttgagattggccctattgttgttaatactgctaagattgctcccaatgccccttcattgcctattcctctgtatgggctaagaggaagtaggatgatagtactggttgcgtattatgcactaaagcgttcgacgggggtgtcgaagctgtctatggatcttggtgggagtccaccgtaccaggcatccatatgctcatgtggatcgatggtctcatcatactgctccaagttgagtggtttccaacctaaggctttctcagctcctcctcatggtgtcgctccatctctgcaatgcagttttggagttgctgaagagtatctat

SEQ ID NO: 40146 - DNA, 249 bp, Glycine max
  Peptide Sequence Number=SeqID_156924
tctgtttggaagtgcaactcttcgaataaagtcttggctttttcatggaaacttttacatgaccgtttggcaactaaagaaaaccatgattatgaagggccaagtagccaagatgagattactacttcaccttcctctagtgaaagtgaagaagcaaaagaggaagaatcaagtgaagaaattgattcccaagaagaaagggaccttttaatggtcagaagacttctaggaggccaatcttgtaacttg

SEQ ID NO: 40147 - DNA, 336 bp, Glycine max
  Peptide Sequence Number=SeqID_156925
atggaaaggacaccacaagataaaccactttgggaaattcatgtgatcaaataccctacaagcaatgctgctggaaccttaatattcaaacttcaccatgcacttggagatggctactctcttgtgggtgctcttctctcttttcttcaaagagctgatgacccttcccttcctcttttgtttccgtcgcgaaaaccctcagcatcaccatcttccacgaagggcttcttcagatggagcaccgtgaaaagctcaattattgttgaagatgacaagacacccataaggagtggtgaggaaggtgttgatcttagaaattttataattcctagttaa

SEQ ID NO: 40148 - DNA, 237 bp, Glycine max
  Peptide Sequence Number=SeqID_156926
atgaagttagggggcaggcggaaatacccaagtggttatccgcataaacattcttttgctacctataagactcaacgcatgatagtatgtgtcggaacctacccttcggcgggaggacgactcgagactcgcgggggcgagttccaagaaaggaatacgcacggagtcgccaccaacgtttatttgaggaaaacgtcggaaaaaccgaaaaaaacgttatctacgaactttaagtga

SEQ ID NO: 40149 - DNA, 303 bp, Glycine max
  Peptide Sequence Number=SeqID_156927
atgacaaggactctccaaatagcctttaagtgtgtgctttggtccaacctgggagctagggtaagtaagtatctcgatcaacaacaacaaacactctttcatttgttcctctctggtgtggttgtgaaagagttgcgactgggcttcgcggcgaggctggcaaagaaggcggaggtgcgtgcaatgttctgggtgggttctgatgaacgctcgttgcacaacattgtgaatctcattgatgctgtagagtactctctctctcttctcagaaaaggacaacttcctcctcgttacatcaaatga

SEQ ID NO: 40150 - DNA, 393 bp, Glycine max
  Peptide Sequence Number=SeqID_156928
atgaattccaagtttttatctttgctcagcaaaggctcttcacatggaattaatgtaaatttcacttcaatttcagaagttgttatctcgctaaaccaagaccgtgcacttaacgagtatcatccgctaagtgaggcagcagctcgcttagcgagtaagaggaatcttgaaagaaatctgtcacgccagcacgcgctcagcgcgtcatcagctcgctcagcgagacgtttgtctcttttggcacttagcgtgcctggctcgctgagccaaaatccacttactcgcgctaagcgcgaaaatgacgctaagtatgccttcgagctgaaaggtgatatcttgccatggaaggctaagccccctcagttggagaatcctactgggaatttgacgtaa

SEQ ID NO: 40151 - DNA, 324 bp, Glycine max
  Peptide Sequence Number=SeqID_156929
atggcaatattccataggtttctggggctcttgattttgatggctcctatgttgttgcttcatgttgtggctaggcaatttgatgttggtggcaaagatggttgggtgctgaagcctaccgaagactacgatcactgggctcaaagaaacagatttcaagtcaatgacactcttcatttcaagtacaataaagggattgattcggttgtggtggtgaagaaggaggactttgattcatgcaacatcaacaaccccatacaaaagatggacggtgtggtgattcaaccttccaactttccaattctggccttttttacttcataa

SEQ ID NO: 40152 - DNA, 144 bp, Glycine max
  Peptide Sequence Number=SeqID_156930
atgggccacggtggaggatttgggccgcaacagggcccaggtactgttgctataccggcaaataatgcggggcctaaactcgctggagttgtggctgggctttgcggcgaggctggcgaagaaggatgttttggcacttggtaa

SEQ ID NO: 40153 - DNA, 204 bp, Glycine max
  Peptide Sequence Number=SeqID_156931
atgggccacggcggaggatttgggtcgcaacagggcccgggtgctatcgctgtaccgacaaatactgcggggactgaactcgccggagttgcggctgggcttctcggcgaggctggcgaagaaggcggagctgcgtgcaatgttctggaaaatgacaactccctcctggttacatcaactgatcaatgttatttttcgatgtag

SEQ ID NO: 40154 - DNA, 498 bp, Glycine max
  Peptide Sequence Number=SeqID_156932
atgaaagataagagggctgaggaagaaaaactagaaaaacaaaagaaaaagaaggatagtaaggccttgtcttcaaaggccaaggggaaggaaaaggaggaaaaggattcctccaagaagattgttaagaaggaaaatcattttgcaacaaaaggtcatattacaagggcactccttcttaaacaatctttctaccttcttaaacatcccttagcaccgccatacctcttgagcttgaggaataatcaacatgaaaacaaagaaaaagtgatcaaagggcttcccatggatcctaagagaataaaggtcattcctgagtggcccactccaccaagtgttcaggaaagaatccatgagtttcaagaacctctggatttgaggtcaaatccttgtcaagggggagggaatgatgcaatcttactcccccaagggcattggatagaagactccaagaagattggaccaaagatgcaagagaaggccctagggttgtcatga

SEQ ID NO: 40155 - DNA, 663 bp, Glycine max
  Peptide Sequence Number=SeqID_156933
atggtagaagaatttgaagagatcctaggatgtcctctagggggaaggagaccatacctcttcttagggttatatccctcattagctagaatttctaagatagtccaaatctcggcacaggaattagactgcagaaagcaagtcgaaaatggggtggttggaataccgagaaggtgtttggaggaaaaagcaagaaacttggcaggcaaaggcgaatgggccccgttcatagacattgtcgtgatgttgatcttcagaggagtcctctttccaaatgtggaagggttggtggaccaagcagtaatcgacgcttttctcgcttatcatagccacaaggaaagcccggtgaggcatgcttgcccgctagaaagtcaccactcatgcacagagaaaggaggcgcgaattgggaccaactcttagcaaacaaagaaggagcgtctatcaaatggttccctcgatggaaagaaggaagaaccagagttcttatttcgtgtaaaggatttccgaatgttccctcgatggggacgaggggttgcatcagttacaatcccgttcttgctataagacaacttggctaccctatgagaggggcaccactagaggaagaaatcgcgcctgtcatttcacgaggtttcaataagaccaacatggagacgctttag

SEQ ID NO: 40156 - DNA, 387 bp, Glycine max
  Peptide Sequence Number=SeqID_156934
atgttgcggaactttacggattacctaacgatgggagttaagtatctcgaggtggtcaagcgaaggttgcatgccaccaaacaatggtccccggatgaaattagggtcatcatcatcgtcttgaactccttgaagttgatgtatccgtcaccgtcggcatcgatggacttgatcatgtcgcggcattcatcgacagagcacttgaggccaaggtggttgagcgcgaggtggagccccgcgacggagataaggccatttttgttatggtcgttgagatccaccgtcggtagaggcgtcagagcgacaaaaggtggcaaactttgtgaggctgatgaagccgtcgcggtcagtgtcaaggtcttctatgatgcggtgaagatcctctag

SEQ ID NO: 40157 - DNA, 171 bp, Glycine max
  Peptide Sequence Number=SeqID_156935
atggctgctgtcagaggagctgggttggatgatgaagggatgtcatcggttcttgccctttttcttgatgccatctgcaagaaagggatccaaacaactgcaaaagtcaaggtcgttcagctcaaaaaattccgcaatgaattgcacttggcctatggaagctcggcttag

SEQ ID NO: 40158 - DNA, 138 bp, Glycine max
  Peptide Sequence Number=SeqID_156936
atgacggtcgttgtcggtagtggtagcggtagcgataacaaagaccatgatcgccatagcagcgaaggtggtatgattaacgatggtgctagtagcaacaacgattatggtggtggaacctataatcatgaaatttga

SEQ ID NO: 40159 - DNA, 1179 bp, Glycine max
  Peptide Sequence Number=SeqID_156937
ttaacactacacgtcctcgcctttagagggctccacgccctcgcctttagaggactacacgtcctcgccttcagagcactacatatcctcgccttcaaagggctacacgccgtcgccttcagtggaaaacacgtcctcacctttagaggactacacgtccttgccatcagagggcttcacgccctcaccttcagagggttgcacgtcctcaccttcagagggccgcacgccctcaccttcagagggctccgcaccatcaccttcaaaggactacacgtcctcgccttcagacggcttcacgccctcacctcaagaggactacgcgtcctcgccttcaaagggctacaggccttaacctttagagggctacgcaccctcacctttagaggactacccgtccttgccttcagcggggtgcacaccgtcgcctttagagggccgcacgccctcgccttcagagaactacacgtcgtcgccttgagggggttgcacgccctcaccttcaatggactacacgtcctagccattagagggttgcacgccctcgcattcagagggttgcacaccctcaccttcagagggctacgtagcctcaccttacgaggactacacatcctcgccttcagagggccgcacgccctcgccttaagaggactacacgtcctcgccttgagagggctgcatgccctcactttcagaggactaaatgtcctcgccgtcagagggctaaaggccctcaccgtcaaaggacaacacgttttcgccttcagagggctacaggccctcaccttcagaggactacacgtcctcaccttcagaggactacacatcctcgccttaacagggctacacgccctagccttcagaggactgcacgtcctttccttcagaggactacaggtcttcgccttcagagggctacacgccgtctcctttagaggactacacgtcctcaccttcagaggactacatgtcctcgcgtttagagggcatcacgccctcacctttagaggactacatgtcctcgccttcagagggctgcatgccccaacctttagaggactacacgtcctcaccatcagagggttgcacgccctcgccttcagaggactacatgtcctcacctcagaggactacaggtcctcgccatcagaggtctgcccgtcctcgccttcatag

SEQ ID NO: 40160 - DNA, 276 bp, Glycine max
  Peptide Sequence Number=SeqID_156938
atgttgcggctgatattctctctcgttttgcaggaatacaacagaatgaaaccttgtaaggtttcctaccaaaacataaagcagaagatgaagttcggtaatcaagaattgccgggtatcatatgtgctctatacaatgtctgcattgcagataaccaaggagttcctcttcttacaaaagtctctccttctggaaaaggctatacagcttttgtcttgttattagaaccacataaaggtgtttataccaatttcaaagacctttgccttgcatag

SEQ ID NO: 40161 - DNA, 456 bp, Glycine max
  Peptide Sequence Number=SeqID_156939
atgatggcatcaaagaagagaaaggcgactgccacaccttccaaggtccgatatgaccgatccaagttcacttatcctgaagcctgggaaaggaagaattggagaggaagaagatgggatgaagaattgaccagctttgatgaaggcagcattgatgttgccatagtagaattctatgctaacctctatgatccaaaggacaaatcaccaaagcagctctgcatcccagggaggggatttaagcttaatgctgatggtcagcctctgaagatcctcaagaagaacatgaccatactcgctcagacatggagtattctttcttactccatcttgatccccacctcccacacttctgactgtagaagcaagctttatgatgaatcaagattgattcaaagagttttgatgataacaaagaagatgacaaaaagatcaaatgtcaagaacacttcatga

SEQ ID NO: 40162 - DNA, 426 bp, Glycine max
  Peptide Sequence Number=SeqID_156940
atgatggactacattgccatcaagataaccacctgcccgagcaacttcactgctcagaattatccttgccatgttatgaaactcttaccagaggatcatagagattatccctacctattcaatgatgaatatgagagctgggatgtacaaggcaatacacaataccagtacaaccttatgagggcacaaattcagggctatcaatggttcttctcagaagaagacaaacttttccagaaagagaaaaaagacaaggagatttatgaagccagtgggtgccatggacaacaaactcctcatttcccttctattgatctttcaatggaagattcatctgacattttctgttctggaaatatccaagatgaagaagatgttacgattacaaaggcaagcaagagtttaagaccaatgtatcctgcctaa

SEQ ID NO: 40163 - DNA, 894 bp, Glycine max
  Peptide Sequence Number=SeqID_156941
gttcctgcatctataaactgtaaactgcttgagtatcaaagagagggagtgaggtttttgtatggtttgtacaagaacaatcatggaggcacacttggagatgacatggttcttggaaagaccattcaagcaatagcatttcttgctgccgtctttggtaaagaaggacaatctactctaaatgagaaccgtgtagagaaaagagatcatgcattaataatttgcccaacttctgttatccacaattgggagagcgaattctccaagtggtctagcttcagtgtttccatttatcatggtgcaaaccgggacctgatatatgataaattggaagcaaatgaagtggagttactcattaccagttttgacacatacaggattcatggaagttccttgttagatatcaactggaacattgttattatcgatgaggctcatcaacttacgaatgagaaatcaaaactctataaagcatgtttagaaattaaaaccctaagacgctatggtctcactgggactgcaatgcaaaataagatcatggaattgttcaatctctttgattgggttgcacctgggtcccttggaacacgggaacactttcgtgagttctatgatgaaccccttaagcatggccagaggtcaactgctcctgatagtgatgtgcaaaaacgtgtttacagaagaatgttacagcttcctgacattcaatgccttataaataagaacctgccttgcagttgtggtagccctcttactcaagtggaatgttgcaagaggttagtaccagatggagctatatggccttacctgcatagagataaccatgatggttgtgattcatgctccttttgccttgtccttccatgccttgtcaagctccaacaggttgaatga

SEQ ID NO: 40164 - DNA, 543 bp, Glycine max
  Peptide Sequence Number=SeqID_156942
atgtgtttgtttgtccctctcaatgtgggcctaagcattggtccacgtcaacaaccactggcaacagtcttcgttagggttaaggttgttttagacgttaaaagaaaccctcacacttgtcgttatcgtgctcccatttctatttcttctccttccctcactcttttctgcttctgcttacatgatcgacatctcgggtacagaaaaattcgtgctattccccgatttggtttcttataccatagtgatccttgtattatccatgggaattcgaaacctagtaaggttctccttgatgccaactttgctaccaaactcaatgacttgggcattcctagtttagttcagcaaagtttagattcaactggcataagcacaatatgtaataacccaaatgaacgtttggaatatatggatccagagtattttgtcactggcaagcttacaccagaatcggatgtatattcttttgtggtcatattgttacaacttctaactagaagaccccttttggggctagttagaggtacctcgttgatataa

SEQ ID NO: 40165 - DNA, 495 bp, Glycine max
  Peptide Sequence Number=SeqID_156943
atgaagggttcggtgaaggtgaaggtgccgatgttcattgttgcagtggttggttcgtcggcggcggcaaacgagatcaagttgattcataaggcttttacggatcaaaccttgcagatcaacttgatctgtaacctagttcacggtcaaaactacttgcgtatcatctttatcctaacctatactaactacggaagacctaaatccctatgcggatcaatactatcctacgaagtacactacaaaacaaaaaatggaagcacgaatatagaagggagaacatgcttacctcaacatcaatggagtagcacaaccagaagaagaacacacaaggtgaagagcaccaccaccacgtcgccaacaattgtgaagaagcaacaaccacgccgccggaagcaagaacgcgcaaagcccagtcgaggtcgcggaagcaagaacgcccagaaggaagaagaagaagaagcactaaggtcgcggaaggaagaagaagagtaa

SEQ ID NO: 40166 - DNA, 177 bp, Glycine max
  Peptide Sequence Number=SeqID_156944
atgttgaaatctggtaataatggtgacaacatccttagtggtggtgacaacattgatgaaaacgatggtggtgttaacaataatgatagtaatgatggtaatgacaatgatgatgttggcaacaacgacaacaataataacaatgttggcaacattggtggtgaccaaataagttaa

SEQ ID NO: 40167 - DNA, 246 bp, Glycine max
  Peptide Sequence Number=SeqID_156945
atggaactcattatttaccgtcttttgagtttccgttctctatcacctgccaacagttactggaacattgagctctggaagactttcttcactaagatgctaaaccaatacccccatgatgatgataggagtttgctgcaggacctgaagaagtccttccaagactacttgagctccaatccgcagcttataaagaaactaaaggagttactctcaaagcaaagggcttccttgtgctctgcttaa

SEQ ID NO: 40168 - DNA, 1260 bp, Glycine max
  Peptide Sequence Number=SeqID_156946
atggcctcagcttcagcatcttattcctttaccatcagtgtgctattcctcatttttgtgcacttgtcatgtttcataaacaacctcaatgcaaagcacaccaatgccagcagtcacaaccatcatcacaaacaccaacacactcagaatccttccttgaacacaaggcttcacatggcgtttcttggcctacaagcatggaagcaagtgatctactcagacccaaataacttcacttccaactgggtaggtccttcagtttgcaactacacaggtgtgttctgtgctccctcacttgatgaccctaaagtgacagttgtggctggcattgaccttaacttcgcagacttagcagggttcctacccaatgaaataggccttctatcagaccttgcagtccttcatctcagcaacaaccgtttctgtggaatcctcccaaagtccttcacaaacctaactctactctatgagcttgatcttagcaacaacagatttgtaggaccttttcctttggttgtgttttcccttcctttgctcaaatacctcgaccttcgctacaacgagttcgaagggccgttgcctcctcaactcttcaacaacaccattgatgcaatctttgttaacaacaaccgcttcataagcactattccaccaaacttaggaaaaatctcagcttctgtccttgtctttgccaacaacaaatttggagggtgtcttccagaaagcatagtgaactttgctgacactttggaggagcttgtgctaatcaacacaagcttgtcagggtgtttgccacaacaactggggtttctctacaaactaagagtgttggatgtgagtttcaatagtattgttggccctataccttatagcctttcagggttgtctcacttggagcaattgaatttggggcataacatgatgagtggcactgtccctgtgggggtttgtgagttgccaaacttggcaaacttcactttctcttacaacttcttctgtgaggaagagggtatttgtaagaacttgacatcaaagaggatagtgtttgatgataggaggaactgtttgccagagaagccattgcagaggagtgaaaaggaatgcaaggcaaaacttgaacacccagttgattgctctgagctttgttgtgttgttgggagcaataataataatgtctctgctgctggctcagtggctgttccacctgcagcagcagcaatgcctgtgtctgcacctcttcttgcaccaagccacccttaa

SEQ ID NO: 40169 - DNA, 120 bp, Glycine max
  Peptide Sequence Number=SeqID_156947
atggatggatataaagatggagtgccctacttgccgacgccctcttccacctgcatgaagagatttcaagttgggattgaatccatattccgtataattgcaccttcagtacaatactga

SEQ ID NO: 40170 - DNA, 1179 bp, Glycine max
  Peptide Sequence Number=SeqID_156948
atgctcagctactcacccccgcgtttcagaatcgccgccgtcgacgctcaccacgatcctctcttaccctttctccggtctatcaagaaagccctagaagcttccgacgactccgcttcgagtctcagtaacttactcaaagattgcatcagaaacttcaagaacaatgaccgctaccgaaacgacgtcagattcctcaagatctggctcctctatatgggagttagtgatgattttgatagtgttttcaaagaaatgctggacagtaatgtatgtaccaataattcttcactttatgtgtggtctgcaagtttttttgagttgaagggaagattgcatgatgctctcaccatctatcagcttggcatttgcaggaatacggagccaattgagtggttgaagaaggcacggaccttatttctcagtagaatttctgaaatacagaatgctgcttcaactcagaaggttgatgataaagaatccaagaatttggaagataatggcattaatccttggggcacttccaccatggatagccttttaaagaagatatatcctttaattatgaaatttgatgggtatcgttcaagcactaaaccatacacaggaaaagtggccttatctaccttgaagaattcatcaaggaataaagttttagagatagataatcatgttacagaatggtttatactagaactaggtggaatgaagtaccatataaagggctgtgctggacagggtggttttgcccaagtatataaggctaatgtcgacagtgatcctgacaatgttgttgcactaaagatacaaaaaccagctttcccttgggaattttacgtttatcgtctgcttgataagcgcatcttagatagagagaggtcaagttatggttttgctcaccgaattcatgtctattctgactgtagtatactcatctgtgactatttagctaatgggacactacaggatgtgataaactcatatgtggtcataggaaaatccatggaagaagtgttatgcatttactacacaatagaaatgttacacatggttgaaactttgcatggtgttggcttgattcatggtgatttcaagcctgataatctgctaattcgctatgctaggggtgaccttacagaagatgggttcttgagccgaagtggtccttggtgtgatcag

SEQ ID NO: 40171 - DNA, 1392 bp, Glycine max
  Peptide Sequence Number=SeqID_156949
atgaatatcactctatgggtggttttggatagaaaaagcaattttatgatgaattcttttttatgctatgtttggttgggtgaaaagaaagtgaggaaggagaggaaagttttacatttgaatagaagtggacagaggaatcttgatgatgatgaaactcagggggattggaaacaccgacataatttgatttgtcccatttacagtttgcttcagttgtggatcataatcttggctaagtcagggatgcatatcatatttgggagctgcaagattagctttcattctcatggcttctgctgtcattttctaattctctacccaagcgtgtcatttggggaatgcattgacaagtcgatgcgactagggaacaatgaatgccctgcttgtcgaacacactgtgccagtcgtcgttctttgagagatgatccaaactacgatgccttaattgcagctttatatcctaatattgagaagtatgaacaagaggagcttgaatttcgtgaagaggacaagaaccgcaataagcagattcaggcttcaattgcaaaagttgttcaacgacaatctgaagcactggttaagagacgtagagatacaccaggttcatttgtgacaagatcacagcgcaatcaacgaaatgttctctctaggagacaaaaccaagggatggataatcaaggatctgaagataatgaggaggaaaatgacaataatgaaaaggactcatcttccacagatgagcgatgtacagaactcaggcagagaaggcgaaagaggcggaccagaggtcgtccttctcagccctcatcatcgacggcaagtcctgatggtggatgcatagaaagtgacatggacataagaatttcttctagactggtgtcaaaacctcaaaaactaacttggggaaggggtggttttaggagtcacacacggcatggcagtggcaatggtagcaatagcaaaagttcccgcagtagtcgcttggctaagttagttgattatctccatagcttgaatgaaaacactgatgagttagatgtccatctcattcttttgtctttagacaaacaaattacaccaagcttgcagcagccacacctttgctgtcggccaacattgtctgtgaagcatctttgtgaatatgttgctcatcagacacctttgctggttgaagaagttgagatattggcagttaaaggatgctgcagtacagtttgtgacaagtcatttgatgagacttcatcctctgatgagctaactacgctggttatagatcctagcaaagatgaactggaaactctgcaagggcatgaatctctggcagggattaaatctaaatgcatatctaaaagggagcatttgattctggcatacaggaggaaggaatga

SEQ ID NO: 40172 - DNA, 2286 bp, Glycine max
  Peptide Sequence Number=SeqID_156950
atggcggtgaccacggaagaaaccggcggtggcgccaccgtgattgaccacacctacgagttctcggcgccgcgattcttcgatttcgtcagaggagagtctgatgaggaatcgcttaaggctgagctctggttcgacaccgctctctcctacgctccttcgccagcattcatgcctaaaatcaagactggtagatctattactgtggataccttgtgtgattttaatgaagctgacaaaatgcagaagatgttagctagtgttgatgataatgttctggaaaccaatatacaacaacagagcatgactaccaaagcaaaggaagatgaagctgacaaagtgcagaagacgtcagcaaatgttgaggatatagttctggaaaccaatataaaaccacagtgtgtgactactgtaaaggaagatgatgcaccttgccctgacaaggaaagaagtgagaatgattataaagaagatagtgcatgcttaaaggtttcatctggagaagcattcgttgaagtagcaaaagatgcttgcacgccaaaaccagcactactgaaaaaagttgccacatccactaattccaagaagacacaaaataagaagatggccacgaatacaaaaactcagttaaagtcagcaacagtgaagagcattgcagggactcctcacttggtccaagagaatcaagccattaagaggcaaaaattggatggaggaaaatctagacagatactgaatgccaagcatcagacattgcctcataataagtcaaaattgggtttaaccgtgtctgctagcaccagtaaatataacaaagaggacagaaaggtttatgttcgtgaaacaccaacaacaccagcctctgtaccatttgtatcaatggcagaaatgatgaaaaaatttcaatctagtaccagagacctgtcattgcccagctttgtttctcacacaaaaccaaaactcacattgactaggcctaaggagcctgaatttgagacatctcagaggattcgcccacctagggtgaagagtagtgctgagcttgaggaagaaatgatggctaaaattccaaaattcaaggctcgaccagtgaataagaagattttgcaaactgcaactttgcctcccgttccaagaagtacaccacagctaccagagtttaaggaatttcatctggaaactttggctagggcccatcagaatgcagatacagcttcaatagcttcaacagaggtgtctcataagcagagttcatggaagcatcatattacagaaccaaaaacacctttactacaaacttcactaagagcccgcccacccaaagtgaaaagctcattagaattagagcaagaggagcttgaaaagatccctaaattcaaggcaagacctctaaataagaagatctttgaaagcaaaggggatattggagtattctaccataccaagaaacatgttaccgaacctcaagaatttcactttgccacagacgaaaggattccgccacctgctgccatggctgatttatttggcaagctttctttgaagtctgaaccttcacgtaatcacaacccaatcccaagaaacacgactccaaatccgtttcatctccacacagaggaaagaggtgctgagaaagagaagaagctggtcgtggaccttctgcagaaacagtgggaagaggaaaacgcaaggattcccaaggctaatccatacccttacaccactgattaccctgtgatcccaccaaaaccagaaccaaagcaatgcacaagaccagagccattccaattggagagcctggtgagacacgaggaagagatgcaaaaggaacacgaagaaagacgcagaatggaaaaagaagaggctcagatgagagcgttcaaggcacaaccaatcataaaagaggacccaatccccgttccagagaaagtccgcaaacccctcacccaagttcaggaatttagtttacatgtgaatcatcgggcagtggatagagcacaatttgatgaaaggattaaggaaaaggaaatgatgtacaaacgatacagagaagagagtgaagcagcaagaatgatagaggaagagaaagagttgaaacagatgagaaggacaatggttccacatgctaggccagttcctaattttgataatccattttgtccccaaaagtcttcaaaggacataacaaaacccaagtcaccaaatttgcgtgtacttcatagaaaggaaagacggaaggtattcaatggaactgcgttctcgagtccagctgctaacatgagatga

SEQ ID NO: 40173 - DNA, 171 bp, Glycine max
  Peptide Sequence Number=SeqID_156951
atgaatcacaaaaaagattggttagaccgaatgcctatgcaaaatggaaaccgagaaattgatgaagctcgcatttggagagagagagggagagaaaacatgtcaacgaaagacagagagggagagcataggttggagagatcagacaaagatagctcagattacgattga

SEQ ID NO: 40174 - DNA, 1467 bp, Glycine max
  Peptide Sequence Number=SeqID_156952
atgggttgcatatgttctaagagttcagctatagaggacagcaaggaaagtgtcactaagaaatttcaatcgtatagcacacggccttcagagttgaatgttttacggttgaattcaactaggagggttgatgagggtggggtgaaagatgtgttaatagatggtggtcatgtgaagggttcattgattgaaaggaaggccaatggttcagggcagttgtatggtgatcatcatgatgtgaagaagaaattagagaagccgggattgactgtcgtggatcatatcggccctggaagggttccaaaggctatagaaggagagcaagttgcggcaggatggccggcatggctttcttctgttgctggtgaagctattaagggatggataccacgtagtgcaaatacttttgagaggttacataaaattgggcaaggaacttacagtactgtatataaggcacgggatgtgattaaccaaaagtttgtagcattgaagaaagtacgctttgacaatctggatcccgagagtgtcaagtttatggcaagggaaatccatgttctgcgtaggcttgaccatccaaacataattaaattggagggcttgattacatcacgaatgtctcgcagcctgtaccttgtttttgagtatatggagcatgatcttacgggacttgcatcaaatcctgatattaagttctctgaaccacagctgaaatgctacatgcagcaacttcttagtggattggatcattgccatagtcatggtgtcctccatcgtgacataaagggctcaaatcttctcattgacaataatggagttttaaagattgctgattttggtttggcaagttcttatgaccctcaccacaatgttccattgacaagccgagtagtaactctatggtatagaccaccagaacttttacttggagccaatcattatggggttgcagtggatttatggagcactggttgcatactgggggaactatatactggaaggccaattttgcctggaaaaacggaggttgagcagttgcatcggatttttaaactttgtggctcaccatctgatgactattggcttaaattgcggttgtcacattcaacagtattcaggccgccacaccattataggaaatgtgttgcagatacatttaaggactacccatctaccgcggtaaagcttatagagaccctactttctgtagagccagcacatcgagggtctgcagcagctgctctgaaaagtgagttctttacgtcagagcctctgccttgtgatccatcaagtttaccaaaatatgctcccagcaaggagattgatgctaaattacgggatgaagccagaaggcaaagagctgttggaggtagggaacaaaaagttgcctcaggagttggacaggaaaaagggcatagagcaaatgttgcaacaaaagacaatgctgacccaggcttattggtgcag

SEQ ID NO: 40175 - DNA, 339 bp, Glycine max
  Peptide Sequence Number=SeqID_156953
atgtttgcacattcgattaaaggctgccgtcccttgggacggacgtgtggggtgctaataccttccccgtgcgtaaatacaactcccgaacctttcaacttaaaagttcgtagatcgcgtcttttccggtttttccgatgttttcctcgaataaacgttggtggcgactccgcgcgtattcctttcgtggaacacgcatcccgcgagtctcgcgtcgccctcccgccgaaggacagtcttggaaaatggtccataagtttgccaaccaagggacaaccaacaattatagccactttggtgaagaaacccatcacaacaactggcaaaaggcttggatga

SEQ ID NO: 40176 - DNA, 189 bp, Glycine max
  Peptide Sequence Number=SeqID_156954
atgggagaggaaagaggcaacaaagaagtctcactcactttactgcctgaaacactgtccactaagttattacaaccgaacaacatcacatctgcatcattgccattcgttttgccctatgaggatcttcagagcactgaggctagatctaaggatgacaaaatgaaaagagatctaaatttcagttaa

SEQ ID NO: 40177 - DNA, 126 bp, Glycine max
  Peptide Sequence Number=SeqID_156955
atgggaagacaggctaaggtgtcggtagcaggagcagcaagtttaaagcaagatgtccccacaaaaggaggacaagggtggggtcaagatgcggttttggagataaatgaggagcgttggctttaa

SEQ ID NO: 40178 - DNA, 255 bp, Glycine max
  Peptide Sequence Number=SeqID_156956
atggatcttaataaatttgggatgtttgatgcatatgatttggtcaacatcattgcagaggacatggggttgctatcgtgtcatcctttcgtgcttcggtttaggtgcaccaatagtggcaaaattctaccagttgagaccgataatgtgacagcaacaaagattggtcagaaagtggcaaatgatactgatctagagttctcaaaaggaggaaatgaagatgagtatgattatgaagtgtcaatgaaagtgtaa

SEQ ID NO: 40179 - DNA, 630 bp, Glycine max
  Peptide Sequence Number=SeqID_156957
tattttcccaaaaatgagaaatatttgcctttgtttaccgccggtgatgattcggagatagttgacaggagaaatgggctgcgcaaacagattgaagataggttgattgcagctgctgcaagtggcaaggatttagaagagactggcagtgaggatgatggtcttttggatctgagtgatgatgattttttccttgctgggagttctagtgacgaagcagatgcggatgatgaatggacagacaaaagtgcaagagagcaggcttctagtgcttctgggaaaggcgtgtctggcatgtccagtgacgaaaaaaatcagaggcagatttctgctagagctttgatgcctcctcctcgcccttcaaacatgaagttgtcaaggtttgggtcttcttctggccaaaattcatctagacagagatctgagatttccacatcgagcaacacatcaaatagcaaaagcagctcagacttcaaagtaaggggaccctcaagatcagggactggtcatggtagtagtctaagctccaactccgatgctcacaagccacggaggaagagaagacctaagaagaaaaagaagcaggaaggtctggaaacatctttacacactcttgtcatgttcatttag

SEQ ID NO: 40180 - DNA, 2028 bp, Glycine max
  Peptide Sequence Number=SeqID_156958
atggaagggattattcagatccgatcagtgctgctactactatccataaccatggcatctctcactctggctgtggccgatggcgtttctcgagaagaagctaaagaacttcgagatgaggttaaggatatgttttatcacgcctttaatggatacatggaccacgctttccccctcgatgaattgagacctctctcctgcgcaggacatgatacgcttggtggctatgcgttaaccttgattgactctttagacactttggctttacttggtgaccgccaacgattctctgcttccgttgaatggattggtaaaaatcttcgctttgatataaataaaacggtttctctctttgagactactatcagggtcctcggaggattactttcagctcatcttattgccactgattatgctacgggcatgagagttccgttgtatgataatcagttactaaacttagctgaagatcttgccaggaggttgttacctgcatttgatacccctacaggaattccatttggatctgtaaacttgttacatggagttgataaacatgaaagcaagataacttcaacagctggtggtgggaccttgactcttgaatttggagttctaagccgattgacaaatgatcctagtgagtttgccattttccctttaggtctattgaaagcatacattatgcaaggaatccaatttttgaacaagttaccaagaatgcagtgcgtggactttgggcacggcgttcaaagcttaacctggtcggtgctcatattaatgtttttacaggtgaatggacacaaaagctactacagctatctctttggctacttgcaggatgctgggataggaactagtattgactctttttatgagtatctattgaaggcttatttattatttggagatgaggagtacttgtatatattccaagaagcttatgctgctgccatgcattatctttaccatgacccttggtatgtggaagtgaatatggattctgctgctattgtctggccattatttaacagcctgcaggcattttggcctggccttcaggttttagctggagatatcaatcccgcaattcgcacccatgctgccttcttgagtgtctggagaagatatggttttactcctgagggctttaatcttgctagtctcagtgttcaggatggaaagggaacttcagaaatcagcaacacaacaatgctgctcattaatgagacactcttgaaaaagcacaagcagtactgtgaagagaaatgttcggtgttgcaaactttacgctctagttgtctagtcctaggtcatgggcagaagagttacccgttgcggccagagctaatcgagagcacctattggctatacaaagctaccagagatcctagatatctcgatgctgggagggacatggttgctagtttacagtatggaactcgatgcccttgtggatattgtcacatttctgatgttgagaatcaccaacaagaagatcacatggagagcttcttcttagctgagacagtcaagtatctgtggcttctgtttgatttggctgtgggtcctgacaatcttgtggaaaatgggccttacaagtacatatttagcactgaaggtcatttactgcctgctactcctcaaatctccttagtgagggaacattgtttatactatggggcttattgtagaagtggtgatttgagacaaacatactttgtgccagagtctgacaaagataagaaagaatccaatgatactggattttatgagagttggactaaacctacttattcttcggactacactactgttgagccaagtgctgtttcaggtttgatcaagactgcttgggttgatgtattagcatcctatccattatggtctgtaagccataatgccacagacagtgtgaaatttcagcattggtctaacattttactgacttttcatcagtcaatgctccagtgccaagcatctcgcgttaatttctctcaagcatgttttaacttggaagtgacataa

SEQ ID NO: 40181 - DNA, 237 bp, Glycine max
  Peptide Sequence Number=SeqID_156959
atggtcgattctgatgatggtgatgacatggactcggaggacttagtgaagatcactgctgaggttgttgattttaggaggccttatgtcgttttaaggaggtctagtaggtatcacttaaataaattcacgtgggtaaaaggttcacattcatttcactgttatcaaataaaacttatcaaaaacattttcggctctaaacaaggtcgttcacatttacaaaagaattcaaggtaa

SEQ ID NO: 40182 - DNA, 714 bp, Glycine max
  Peptide Sequence Number=SeqID_156960
atggattcaacattatgtgggagttcaaaaactttgatgattgtgaatgtgtgtccaagtatttcaaatttatctgagacattgtcgtctgtcaatttctctgctagagctcgaaattctacattaagccttggaaaccaagacacaattaaaaagtggagagatgttgcaaatgatgcgcgaaaggagctgtatgagaaagaaaaagaaatccatgatctaaagcaagagggtttggaactcaagcaagcgcttaaagatgcaaatgatcagtgcattctgctcttcaatgaagtgcagaaggcacggaaagtttcttctgtattgcaaactgatttaaagtcggaacatgttttgctgtcagataaacacaatatagagaaagaacaaaataatcagcttagaaatcaagttgctcaacttttacggttagagcaggatcaaaaattgcagatacaagagcaagattcaaccatccaaagtttgcaggctaaaattagaactcttgaaactcaactcaatgaagctattaaatctagtgaatctaggtcaacatttgtctccgagccagagtttgctgatcaatccaattccagaccaactggtgatggcatagactcttctgcagtaaccaaaaaactagaagaggaactcaagaaacgtgatgcactgattgaggtctgttatgcttggcaactgcgtctgattgcgtag

SEQ ID NO: 40183 - DNA, 225 bp, Glycine max
  Peptide Sequence Number=SeqID_156961
atggcctcaagacgcgccgacgaggcgtttggcactggtctggccggattccggcgccgggaagacggcgcgtggtggccacgcgccggtgagggcaacgaacggcgagggcgcgtgacggcgcgaagaaagggacagcttgacgagacaagccatactgctgtcttctacaacaagctaagcaggaaaactaagaaagctaaacaacagaaaatctctcaatag

SEQ ID NO: 40184 - DNA, 1047 bp, Glycine max
  Peptide Sequence Number=SeqID_156962
atgacgatgcgtcgaatgcagggtcaaggagatcgccgaataggcagggtgaaggagatcacaaaagggaaatatcacaggcgtaaaattcagcaggaggacttggaggctgtgaactccattggaaagggcgtgtcaaaactgagcgggcctcaatgcccaattctgaaagtcttccattttgtggttggttttgcatctgatggttttcttggtgattgtctcatcaaatacggggcactgaaagttactattgtggcgatggtccatgtgttacggcctgttcaatttgttgttttttttgcgcatttccacttggggtgcaagtttcaacttttttatggattcccggtcattccctcaactactccaaagcttctttctttgtttttgcttcatttgcttattgctgagtgttggatggtgctttacttgcttcatttccttgctttgcttttcatgcaggtagtccctaaggctatcttttgccctttcccatcaccaagtataaggggtgttcttaaaatccaacttatgcttctatttctgcctgctgcaggatgctattcatccttagttagcaattctttgctcgcttctaagttggctattaatcagctggtggaatggaagcaacaattaaatgagaggatgcatttgttaaaggagctcagtccagtgttgtttggccacaataattggatttctgggatgagggatcccataatgacccggccctgcatattacagtttattgcagcatttcacaatgagaagatgcttccacctattgcagcaatacaccttccttcttgtggtttccatatgaccattttaagaaagttcgggcctccattacactggcctatcgtcccacttggccctggctttcacggcaagtatgttgccgagccatggtaccgatttcttgctgaaggtgattttgttcatggagacgaacttttattctattacagaagtcgtgaggatatttgggaaatggttattagaaaacagaggaattggggtgacaacgatgattggtga

SEQ ID NO: 40185 - DNA, 226 bp, Glycine max
  Peptide Sequence Number=SeqID_156963
tgtgacaacagactgggtttgcgagaaggtggacacagggttagagaagcacagtgacacgatggtgagcgttttgggtttgcgaggtggacatgatgatggaaacgacggtcagagaagcccaattctggtcaacatgaaggtggaaacagggtcagaggagcacagtgagagcagagtggatttgcaagacggagtgcaagcaggaaagggttttgggttttaa

SEQ ID NO: 40186 - DNA, 507 bp, Glycine max
  Peptide Sequence Number=SeqID_156964
atgcatagatctcccacaggcaacctagttcctctggacttggaaattgaagccaccttaagaaggaacagagccgagaggagaaggaagttgttgcaagataggacaatagcttccattctagaagaagaagctcaatcttttgactctacatcatctgactcactatcatcaagggaatcagctatatacttaccaaaagcctctgtcgtggatgatgaacaccagcaaagggttacccttgacgattattctagtagctcagtgtcacaattctttacaagtattacgcgtcctgaagggaacttatttcatggattaccaattgaggactcttatgcacatctagcaacatacatagaaatttgtaacactatgaagattgctggagtaccagacgatgccatcagactcaacttattttcattttctttggcaggagaggccaaaaggtggcttcattcatttaagggaaatagtctgaggacgtgggaggaagtggttgat

SEQ ID NO: 40187 - DNA, 393 bp, Glycine max
  Peptide Sequence Number=SeqID_156965
atgggtaaaaataaagaacaatgctaccttaaaaatctagaactggtactcactaggagacttatcgtgaatactattgctaacgcttttatgtcttcaggagatgtatgctttatactgttcaagaaggcggtggaggcgaaatcttaccagaggttgtctggtgcggacaggaagaagttgagacgaagcattaaggacaaattcccaagggttttttattccgatttagatgccttgcttcctcccaagactagtagattcctttattctcttggacaagaacctactttaccaggaaatgccaagtttttgctccaggatggttattgtgctgttggattcaacccatatttgtggccacctagaaaaggtgggcatccccttttctaa

SEQ ID NO: 40188 - DNA, 426 bp, Glycine max
  Peptide Sequence Number=SeqID_156966
atgcctaatttccttctgattctctcccctacaatgagtctcatacaatgcaatacagaacagtcaaaaccagccatagaaaaagtctttgtgaggttagtgaagcatgtatgtaatcttattgagaaacaaaattcgaaaaaccaacgacatgcttaccttcacgaacactccaaaggtctcaaaaaccaacgacttcgcctacgtcgtggtaccggtggtgtgagcagcgggtcacggcgagaaggacttcacggtgacaaccaaaacatgaggctggaagcgggacagagttcacggcggaaggaagtagttcaagggctaggtttttcgagctcgagggttagtacgttcatgcaagcgagggggctggtgcttacggcgagactatatataaactccaatatctacgacggtgcttcttaa

SEQ ID NO: 40189 - DNA, 198 bp, Glycine max
  Peptide Sequence Number=SeqID_156967
atgggtgttaagtgttctagagtgatcaacaacagtccccggacaaaattacaatccatttacatcccccactttgctaaatacacccctattttttgcgttctttaccgttccttttccagaatgcctcggaacttcatggattccattgggacaggtctcaagtgttcgaaagtggtcaaacgagttttaaagtag

SEQ ID NO: 40190 - DNA, 198 bp, Glycine max
  Peptide Sequence Number=SeqID_156968
atggggggtgaacttagtaaaaaggagggtgcattaggaagcttcctgaggaagccacctgttcgcctgggagagcaaagctcgcctaggcgagttaggcggcaaacaccaccccttttccctataaataggggaaggctattttgggtgaaaaaacatattttcgtgaagaaaaaccgagtcgaagtgctttcgtaa

SEQ ID NO: 40191 - DNA, 258 bp, Glycine max
  Peptide Sequence Number=SeqID_156969
atgaccagacagttagggagttacattataacgcttgtaatcgattacaatgaaacttcaccaaatggcagaatcatcaaagaggcgcaagggctcattatcctccaccaccaccaccatagtccttccggtgaccttccaacaccacccaatccatatctttcctcaccgcgctttctcactctgttttccactgatgttcagcatggggtgaatttcatgactaagaaattgccctattaccctgaattggtttga

SEQ ID NO: 40192 - DNA, 108 bp, Glycine max
  Peptide Sequence Number=SeqID_156970
atgggagtgtgtctatggattcatgatagtggagacagttgtgaagtgtatggtggtatttcattgtcttcaggtgctatctgtcaaggagatattgttatacattag

SEQ ID NO: 40193 - DNA, 471 bp, Glycine max
  Peptide Sequence Number=SeqID_156971
atgctatccaatttaggattgaataagagtttatgggctgaggcaattagcataacatgttatcttgtaaatccttcaacatccactgtcatagacttcaagaaccttattgaggtatggtctaacaaaccagctgaatactcaatgttaaaggtaagcaagagcctagagccaagaaaggattctttatgggctatagatggagtcaaaggatttcaagtttggtttccatttgaaagaaaggtcattctgagtagagatgttgtctttgaaaaactctttatgctacattataaacctgatgaagatttaggcaaggttaaggatgtcactaagcaggtggagtttgagagtttcaaaatcagaaatgttagtgatcagaagcaatttgaagcacctgatgagactggtcgggttcttcaaatgcaccatcaacatcagaattcaacaacaactgagggaactgactag

SEQ ID NO: 40194 - DNA, 438 bp, Glycine max
  Peptide Sequence Number=SeqID_156972
atgaaggacatagtagctgctaaaaagattctgggcatggagatcaagaaggatcatgtccagaagaaactttttctgtatcaaaaggaatacattcaaaaagtctcaaatcgttttgggatgatatcctcaaaaatagtatgtactcctctaacaatgtccatttgtttatttgaactcaatattgctcagttagaattagagaaggaatacatgtctcgtgttccttatgcaagtgttgtagcacaagcagttagtatagcgagtgggtatatgggtaatcttgaaaaggaacattggcaagctgtgaaacgtatattcaagtaccttaagggtacaactgatataggacttgtgtaccatgtagacacgacctgtgctcctactggttacttaagttctagctatgctgtagatttgatgcaagaagatctatga

SEQ ID NO: 40195 - DNA, 225 bp, Glycine max
  Peptide Sequence Number=SeqID_156973
atggatgagttgggaattgctggaagcaagttgctgtttggctttcaacaagcacttgtggtggaggttcacgcctggggtgccgggacaatgttgatgagaacacaacgacacaatgagagagtggattctacaggtaagagcaaagcaaatacgggtggattctacaggctacaacaatgcgagagtgttcttcacactagggttttaaatttataccactaa

SEQ ID NO: 40196 - DNA, 369 bp, Glycine max
  Peptide Sequence Number=SeqID_156974
atggcatgtagatggcaaaaaaatgatggattcctccaacatccggtcgattctccgcaatggaagacaattgataatttgtatccacattttggggaggagccaagaaacctaaggcttggtcttgctttggaagggatgaatcattttggtaacttaaccacaaaccacagttcatggcttgttttgctgatgatttacaacctccctccttggttgtgcatcaagcgaaaatacattatgctttgtatgatgatagtgggtccaaggcagtcagggaatgatattgatgtgtatctcactctgttgattgaagacttgagaaagttgtgggaaaacagggttgatgtgtgggatgggaatctctag

SEQ ID NO: 40197 - DNA, 408 bp, Glycine max
  Peptide Sequence Number=SeqID_156975
atggtcaacacaatcaagattaagaaattcataggaaagaattgcttcaatctttggcacatcaaaatgcatgccttgttgaaagaacatagaatatgggcacctctcttcggtcaaccatggaaggttgataaagaaaatcgttattgcattatggataaagctggagaaacttttcatgacaaaattaatttgcaacaagttgcttttgaaatgacatttgtttggcctctgaatgagagaagaaactttggacatgaagtagagcaaatcagtatcaaaataggatttctccatggaagattggaggaagacattctgatgcaacaacttgaaggtttggaggttgaagaggtccctttatggcttgaagcaatctccaaggtagtggtacaagtgatttcatga

SEQ ID NO: 40198 - DNA, 336 bp, Glycine max
  Peptide Sequence Number=SeqID_156976
atgattatttggctgaatggcttcattggcttgtacagacaaaatttaacctgctatttcttcgataatgtttacaataagctcaaagatttcttgttttattctagcttgattagaaatggtgttgctgaatgtggttgtggtgccaactcttgtttgctacggagcagtagtaaacccctgttagggtgggctgcttttctgaatgatggtactaagccaacgagttacattgggtcatttgtctgttttacggtttcccattggggtactcttgctttgaggacttgttatggtggtaaagttggcttggcacccttaaaatgtaaagggtga

SEQ ID NO: 40199 - DNA, 327 bp, Glycine max
  Peptide Sequence Number=SeqID_156977
gaaatcagaaccgtggacatggaagggaaaaccgtcaagctgcagattgtgagtattctcaggaagtccgagattccgtccatgtctcacttgagactctcaatgaacgaaagtagcaagccttcatttaaatggcgaagggttttgctcaaagttagcggagaagcacttgctggaaaccactctcagaacattgaccctaagtgggatggagctggacaggagcgattcaggactataacaagcagttattatagaggaggggatgccaaagataccagtagatcatcaaagaaaaattcaattgaagaagagattgaaacttaa

SEQ ID NO: 40200 - DNA, 234 bp, Glycine max
  Peptide Sequence Number=SeqID_156978
atgtcaaaaattattaaagagatgttacccccagatgtacgtgttgcaagagatgcccaagatctattgattgagtgttgtgtagagctggctatagtggtgctacaccgctgtgttgcggctatgggcccctccattgaagcccatccattgcctggagtgctgtggattgcggccacattgacggctatttgctttgtggtatcagcgggcacaactttgactattgattga

SEQ ID NO: 40201 - DNA, 285 bp, Glycine max
  Peptide Sequence Number=SeqID_156979
atgagtaacaatgacgatcattggttagaggagaggcaaaaagctactaggcatatgttaagtggttccagaggtctagattttggtgaccacaacactcgttattttcatggagtgactaagttgaggaggagtcttataagaagtatttttggtgacctttctaagatttcagacctcgatgaaaccattgttgctcttattccaaaggttgaggtggtggtgaatataaaggtcatggataagattattgacctatacaagtgtagcttcatccacaaatga

SEQ ID NO: 40202 - DNA, 498 bp, Glycine max
  Peptide Sequence Number=SeqID_156980
atgagaaggaagaagaggaggattatcgtcactaaagaagtacttgaagaaagttttgaggttgaggccatcacctctgagatggaaatgcatgaagctatcgataatggcttgcacatcttctttagtggccttctcttgcctctgtacttcaaccaggaatctcttgagatgcaaatttgtcatgagcttattcttagagtactcatcgaatatggtcttgattttttacggtgccttctccagcaccagcttgaactgccaccgccagcagaagcacacgctacatgtctgtttaaacatcaccacttactacttcacttatggtgcctacaacacaggtggaagtggatcgatgcttcagcacagactcccttgctagagaagtgtgcctatctagcttttggcacttccggctattttctggcagcaagactaacacgtgcgaaatgggcgagaggtgggttcgatgggagaagaagtctcacatcaggttga

SEQ ID NO: 40203 - DNA, 836 bp, Glycine max
  Peptide Sequence Number=SeqID_156981
gaacaatgtctgagaaaaccacagctgataaccttattgaaaatcttgtggacacatttgttgataagaaaaaatctgtatcattctttgaagatgataagtcagactcagtgagttctcagatcaatagactgtttggacgccagaaacccgtgcaccatgttttagggggtggaaaatctgcggatgtcttgttatggaggaacaagaagatttctgctagtgttttaacaagtgcaacaattgtatgggtgcttttcgaatggcttaattataattttcttactattttatgctttgctttggttcttgtcatgcttgcccagtttctatggtcaaatgcttccggcatgtttaacagttcaccgtctaatgtaccccgtcttgttctcccagaagaactctttgtgaacattgcaactgtggttggtggtaaggttaacatgggcttgaggtttcttcaagatgctgcctgtggaggaaacttgaagcattcgtctttgtcgcaaactggcctgcgcttccgtgactgcaaccacattgtggagatcgtgtttgtggagtcgaagaaaactaggaaaggaaagagtcccggaaagggtactcccagggcgttcttgttgtttctccttttgcctgagttcgtgtttgtcgcaaagtgggctgcgcttccgtcgaagaaaactaggaaaggaaagagtcccggaaagggtgggactcgattttggaagtccattgtgcctggctttaagactcccagggaagccatcgaaggtatgtctctgttgtatgttaatgatgaaaatccattgttcaatggtctgtctctgttgtga

SEQ ID NO: 40204 - DNA, 282 bp, Glycine max
  Peptide Sequence Number=SeqID_156982
atggcgcaaatcagatttgacgaattttataagaattacgttgacgtacgtacatggcagcaagacatactaattaacacagattatacaacatggaaggtcatcacaatgatcttcccagcaaacaagaattgtgacacagcgtcgaaggatatagaacctggccctatgctccttctccagcctggtgcatcttcttctgaaggatttgaagggtccacaaatgtgcgtgttgtcgtcttcttgcttcatcactctatagctagcaagcttgtgaattga

SEQ ID NO: 40205 - DNA, 1863 bp, Glycine max
  Peptide Sequence Number=SeqID_156983
atgccttactttcagttgtcaagtccattagcccatggatcagcaaatgttcagcctcgggatattggaaggaatggcaccaacaacaatacaagttctcgttctatggatgttcttccttcacctttggccactgataaaaatgatggcacggttgctctagttaaaactggctctgaaatagttaagactacccctgccggtgaatatctgactgctgccctgaatgatttcgatccagatcaatatgaagggcatgctgctatatctgatggtgcaaacaagcttttgatgctgggaaattacactaatcccaaggttagagcacattacactcgtgagactcctgttgtatgggacacaacaccagtctttgttgattgtaaggtgaccagtcaaagggcgagtgcatggccaacttggatggatgttggggctgttgagtgtggatcatggtgggatgctaagatcctattgcaactttgcatgagagtcaagacaccagagaaatatactggaaatggcaaagcattgccagcaaaagaaaccagaggacaactagctccttgcactggttctgaacctcttataatgggcagtgagacagttctggctgctgtcatcaaagctggtgcctctagagaacatgagatactcgctgaaattagggattctgttttctcttttattagaaagatggaaccaaaacaagtaatggacaccatgcttgtttcccgtgttagaattctgtatataagatctttgcttgctagatccccagagttgcaatcaattaaggtaataacagtagaggctgttggatttctctttgaaaagaaaataagttctaataaggttttcgctgtgtacttttgggatgctttattgagtctagtgactaatactgggcgcagtagaagttccagccgagggagtagtcctggtaggtctcctgtgttatatgttgatgagcagatccagggatttaaagtgaatctaaagccagaaaagaaatccaaattttcatctgttgtgctgaagatacgtggtattgatgaggacatctggagacagcaagtaactggtggaaagcttagggaaattactgaggaggccaaaagttttgcaattgggaacagggctcttgctgcactatttgtacatacaccagcgggtgagctgcagcgtcaaattagatcctggcttgcagagagttttgagtttctatctttaacgggagaagatgcatcaggggggtcaactggtcagttggaacttctttcaactgcaattatggatggttggatggcgggacttggtgctgctcttcctccccacactgatgcccttggccagctattatttgaatattcaaaacgtgtctatacttctcaattacaacacttgaaggatattgctggtaccttggcaacagaggaggctgaagatgcagcccaagtagcgaagctacgttcagctctagagtcggttgatcataaaagaagaaaggctatgttgtcaatcacgggtgtcgcggcggagcggcccccatccgcgatggggatggacgtagcggcgcggttcaacgttgcggttggcacggccgctatcgcggcggagcggcacgggatctggatcggatttttgcgccgctacactgaagccgtggaaattccaaaaatgccctcacttaatgcgggaaagctgcgacaccccggcgaggctgcgaccccggcgacgctgcaacaccggcaagcgccgccacctcctccatgcccaggagcacgctgcgagtctgcgacactgttcatacctttctttcccaatacgctgcgagtctgcgataccgtttccttgcttgag

SEQ ID NO: 40206 - DNA, 720 bp, Glycine max
  Peptide Sequence Number=SeqID_156984
atgcctgataatggagatccacaggctagaagcatgatacaatttatgtcattgtacatcatactgagaatgacccataagcagttgtatgatctgatgataaatgttggccaagcagtacttccacatgtgtttcagatttgtagtgcaacaagcttgccttttgcttgtgtttctaacgccttgaataaacctaagcctcttaatttagatgtgtccttgccttctattcatgatattagatggagcttagcacggttgttatacttatttaacatgcagcttgatagaaatgttgccatgttccttgcggtgctccttttagtgtgcttctcatttgttgtcgttggtggtctcctgttctttaagttcaggggtaacaaaaattctctggaagattgtctctgggaagcctgggcatgtctttgttcatcgtctactcatttaaaacaaacaacacgtgttgagcgttttattggttttcttcttgcaatatggggtatattgttttacactcgacttctaagtacgatgaccgaacaatttaggtcttcacaacagagtaatatgcaaaagctcagggacggaacccaagagcaagttctggagactgatcatatcattatctgtgggatgaatagtcatcttcccttcatattaaagcagttaaataagtatcaggaatttgctgttctcttaggcacagctacagctaggtaa

SEQ ID NO: 40207 - DNA, 1149 bp, Glycine max
  Peptide Sequence Number=SeqID_156985
atggttgtcaaaacgcacaccaccactgcatgctatgcctggtttgaacgtcaacaggaggggttgttctcttggggtggtggagcaatgacgctactaccattgggagttgggggtggagtttctgtggtctctgctgcatatgtaaggaataatagaatgagagcgaagagaaggaaggttagggtgaagaaagaaggtgcagtagcagccatgagcatcagcatgtgtcttcttttagaatgtgagcttggacctaacacaaccccgaaagttaactcatgggtcgaaggttgccctccacttgtatattttatcttggtactatttctatccgatatgagacttgggtttttcacaatataccccttacgcccaacacttttgggcttgattttgcaacaaatgaaaagtgatatagctttattgacgttagaaaatggtggtttccctattcaaaatccttctactgcagctgaagatgcgcgattagcatctcttatttcgcttgatagcatattaaagcaaatcaaggatatgacaagactttcttccgtgaacatcttgaccaaaagtaagaaaaaaacgatgcttgcttctcttaatgaattaacagaacagatgccttcgcttcttgaaattgatcatccatgtgctcagaggcacatcgcagatgctcgctacatggttgagtcaattcctgaagaagatgaccccattcaagatatatctcatgatcgcatgccatcaacagatctgggctctggatctgaaactgacgttacacagtggaatgtactccaatttaatactggctcgacctcaccatttataataaaatgtggtgcaaactctaattcagaactagtcattaaagccgacgcacgagttcaggaaccaaaaggtggtgaaattgtgagggttgcccctagaccctccgttttggacaatatgagcttggatgaaatgaaacaaatatttaatgaactacccgaggctctaagcttgctggctctagcaaggactgcagatggaactcgggcacgatattctagattatacaggaccttggctactaaggttccatcgcttaaggatttggtcggtgagctcgaaaaaggggctgcactcagagatgtgagaacatga

SEQ ID NO: 40208 - DNA, 924 bp, Glycine max
  Peptide Sequence Number=SeqID_156986
atgaaacacgaaacagacaacattaacaacaacaacggaacccacgacgggtccgaagattccgtcctccgcccctgtctatccctcctcaagtgccgcagcttcgccgcgtgccacgtgtccgctaacaaaatctcaagatccgacccgaacgtctccctccacgtggaccaaatcctcgcggtggcggacgtcctcgcggcggcggagcgccgccgcgtcccctcccacccgcacgactggtactccatcctccgcctcctccccggcgacggcgacaaccgcgacctgacacgtcagcacttcaaaaccctcgtgcggctcctcgaccctaacaagaacaagctccccttcgccgatgaggctctcatgcgcgtgcgagaagcgtggttcgttctctcagacccaacgcgcaaggcgcgcttcgataaagagatcaacgacgccgccaaaacaaaaacgacatcgttttggacaatgtgcccttactgttggtacctacacgagtacgaacggaaatacgaggactgcacgttgaggtgttcgaattgcaagagaacttttcacggcgcggcggtgacgtcgccgcggccggaggctgtggcggcgggcaacgaggagtattactgctaccacgtgagcttgccggtgaggtatccggtcggcggcgaacggtgtcgttttggggatggggcgaggaagaggatgagggttaaaacggtggctaatagaatgaaaaagaaagggtttgttgttgatgctaataatgatgaatctgatttggatgggatgaggaagactaatttgggttttagagaggtaattgggaaatatcttgcacttatgaatagctggaaggactttgattctcttgttgaagaagatttggttctgttcttcaatttgctggaatatgagttatga

SEQ ID NO: 40209 - DNA, 573 bp, Glycine max
  Peptide Sequence Number=SeqID_156987
atgatggtttttgtgcttcccgagaagttgaacatattgctttggggtgttgctagttacttccataataaatttaccaaccatcacacttccatacagtgcagtccttatgaggttatgtttggtcggcctcctccaatttaccttccttatttgtcgggtgagtcaaaggtggaggtaattgacagaagtttgcagaaaagagaggaggcattaaagttagtaaaatttcacatgaagcgggctcaggagagaatgaagcaattagcagataagaagagaagtgacaaatcacatgagattggtgatattgtgtatgttaagctccatccatacaagcagatttcagtagcattcagacctaatgcaaagctagcacctaaatactttggaccatttcagatcaagggtagaattggggctgtagcttccaagttgaagctgccacaggggtctaaaatccatgatgtttttcatgtttcacagcttaaaaggcatgttggtgaagcaccagtttcaaattttcttcctacagttctgatggtgttatgggaggcaaagaacttcaactaa

SEQ ID NO: 40210 - DNA, 3754 bp, Glycine max
  Peptide Sequence Number=SeqID_156988
ggaggaggagaaagaaaaggccatggtttccaacgagagaaatgctaaatcctcctacagttatcagcaccgcatctacgctttactcttctccatcaccaaggccaagaaaaccaccatggccagcaccaacagcagcaattctggtggggccttcaccaccatccaagaaagggtcactttcgagaaagagatcaaaaagagcaagttcattgccattgctggccccatcccggacgaaaaatctgccatgtctttcctttcccaggtgggggatcaataccggtccaatgatgacggtgagccttcaggaaccgctgggaaaccaatacaaactgctattgattcttcaggaatcgatagagtaatggtggttgtgatcagctctgtagttcctcgaatattctctattcctagttctaccttcatcagtggtatcagcttggaccttccattggcagttatggcagaagcaactcgtaatcaagcagcgttgcgggaacaagaagagcacttggaacaccggatcacgtcaaaactcgaagcgtgcataatggagatcacatcttcaatacggaaagcgattgactcttccatcgatcgacgaatcttggaaacgttacaaaagaactttgattcagagattaatgctatggaccgaggacctcatcatagagacgaacgccatgcaaattccaattattcttgtggaacgcgtttggcgcaaattgatttcccgcgctttagtggtgatgcagttcaacaatggatctaccaatgtgaaacgtatttcgcgattgatggcactcctgcgaaatttcgggtgaaattggttgtaatacacttcgaagggaaggcactacagtggcatacctcctttgtgaagactcttccagaaggtaaccttcctaagtggactgaatttacaaacatattgatcgatcgttttggtgaagtatgtgacgacccaatggctgaacatatgcaattaagacagaatggagggttaaaaaaggatattcaaatgatagttaaaatgtttcagcctcaagatgtaagaaaggcattccaattggctaaactgtatgaatccgcttccagttcatacatccctaccaaaaccttccctaaattccaaaaaacacaacctagtacaaaagccattttacccacacctaaccctacccacaagcctattgattcacaatttaccttaaacccaactcaacgacaacctaataaaaaactcacacctgcctttatggctgagagacgatccaaaggactttgtaatttttgtgatgaaccatatagccccaaccatgctttaacacataagaaacttgagattcatgttctggaggtgagtgatactgaggaggagattgtagatcagtttgacaacaccacccataattttttggatgagggggtggctaagaaattgggttgtcttataacaaacattcctaccttaagtgtggcaatagttgatggagctcgggtaaacattacttctactgttaagcagttttcctggatacttcaaaacattggatttaccttagatatgcttcttatacccttgggttgttatgatgtggtgttaggaattgagtggttagttactctgggggacattacctggaactttgataggttattgatgcagttttatgtccaaggtaagaaattggtcttgagaggggcagcaggtgcaagactaaaaccggccagaaaaaaacagttacaaaagacaattgcctcaggtgtgcatttatccatgctgcaattgtgtgacgcggataataatttcctactgcactcattaaccacacatgctaccaatcaagctactcctgaatctatagaggagttactattgcagtttgaggacattttccaggaacctaccagacttccatctaagagaaaaggtcatgatcataaaattcccttggttgcaggggctaatcctattaataagaggccctatagatatgctaagcaacaaaaagatgttattgacaagttggtgcaggattctcttaagtctggtataatacaaaaaagcagcagtccttttgcaagtcctgttgtcctagttggcaagaaagatggctcttggagactctgtgttgactacagagaccttaataagcagacaattaaggacaggttccctattcctttagtagatgatcttttggatgagttgcatgggtctaagatgttctccaaaattgatttacggtcaggttataaccaagtgagaatggagaacagtgatatccacaagactgcatttaagacacatggaggccactttgagtacttagtcatgccatttggcctaaccaatgcaccagccacattccaagggtactatagacggtttgttcgagggtttggtgggattgcaaggcctttaaccaacatgttgaagaaaaataatttccattggtctgacgaagcaaaagcaacatttcaatccctcaaggatagtctgattcaatcaccggtattagcattacctgacttctctaaggtgtttgtggttgaggtggatgcttcaggaagccgtagactatcaaacaatcataactctcataccggaaagcaacatgttgaacagaatcatagctcttggcaggctgatcctggcattcaaaaattgatccaagatttgcaaaccgatgcttcttcacataaacatcatacttggaaccataatgaactcagaaggaagaggagattggtagttgggaaggatctaactttatggaatgatttgttacaatggatacatgctggtcctactagtggccactcaggtctagcaaattccaaaggaaaacaagtgatctatgtggtagtggaaagattaagtaaggcggcccactttatgtccctaacacacccctacactgctactgaagttgctcaatccttcttggacaatgtgttcaagttacatggttttccaggctctataaccagtgacagggaccctatctttgtcagccaatttatgaaggatttgatggcctttcaaggggttcagttacaactctcttcagcttatcatccacaaacggatggtcaatccgaggtggtgaatagatgcttagagacaatcttaagtccttatgaggttatgtttggccagcctcctccaatttaccttccttatttgtcgggtgagtcaaaggtggaggtaattgacagaagtttgcagaaaagagaggaggcattaaagttagtaaaatttcacatgaagcgggctcaggagagaatgaagcaattagcagataagaagagaagtgacaaatcacatgagattggtgatattgtgtatgttaagctccatccatacaagcagatttcagtagcattcagacctaatgcaaagctagcacctaaatactttggaccatttcagatcaaggatagaattggggctgtagcttacaagttgaagctgccacaggggtctaaaatccatgatgtttttcatgtttcacaacttaaaaggcatgttggtgaagcaccagtttcaaattttcttcctacagattctgatggtgttatgggaggcaaagaacttcaactaattatggatagatcaactgtcaagagaggtaacagggctgtcacaaaggtgttggtcaagtggaaacaccaattaatcgaagatgctacttgggagttcttctatgatttgaagatgacgtatccaacttttaatccttga

SEQ ID NO: 40211 - DNA, 384 bp, Glycine max
  Peptide Sequence Number=SeqID_156989
atggatgtgccaatcaaagaattcaaaatcactgaagttaaacaaccttacattggagaagtcaaaccatcatctgtgactgcagaggttacttatagtgtttccagttataaagcacatattacatcacaatgggatgcactcaaagagcatgatgtattgctcaagaatgggatgcattgtagagtgtcaaatcttcctatcaagcaggttgaagcaatcatctgtggcattcagcctggtctaactatggttgtgggaccacctagtataggaaagactgatacagttgtacaaattctaaatgttgtttatcataattgtccttctcagagaaccttaataattactcattcaaatcaggcttttagtgcaccaatttga

SEQ ID NO: 40212 - DNA, 252 bp, Glycine max
  Peptide Sequence Number=SeqID_156990
atggcctcgtccaattcactgaacaccgagaacacgctgcgaagcgtctccatcgtggtcttgtggaaggaaaggaaaagggaagccatgggagcttgcaatggtgcgacttatgactcgggcaattctgatgagagaacggtgcaacaatctttgagtcacttagatcttagagccccaattcggtacaatgcaaccatactctttgtcaaggttttaaaatttaaattaaaggttgaattgtactggtaa

SEQ ID NO: 40213 - DNA, 348 bp, Glycine max
  Peptide Sequence Number=SeqID_156991
atggttggtggaatcgacagagaaagcaatgaaaatgaaaaaagaatcctctctggagagggcgatggcagaggaacaggggtggaaccggcacaatgggcgaaagaagaagctgcaaaaaccctaactaatcaagagttagggaaaatagaagccttggcaacaacagagggtaggatgctagctatgaattcaagcaccccaatgacacaggcgaagatggcatctgaaatagtgatgatgcctacaacgggaccatcccttgttgttttagctgttgttcttgctgaggctgaggttgaggttgaaccagaggcggtggagagtgagagggacaggaagaaatga

SEQ ID NO: 40214 - DNA, 144 bp, Glycine max
  Peptide Sequence Number=SeqID_156992
atgttggatttgaccaactttcaagagtcggtcgaaatcggtgacttcggcatgggcttctcacacgctctctggtttgaactagccgcacattgtgcatcagtggttttgcgtttcctaatgaaggaattggaaccaatttaa

SEQ ID NO: 40215 - DNA, 819 bp, Glycine max
  Peptide Sequence Number=SeqID_156993
atgaattgtgttttaattcatgtgtcctccaccttcgagtttggagctatgcgtagtgattgcttagtgcaattctccattctcaacctttttcggagccccatgaattgcgttttagttcatgtgtcctccaccttcgagtttggagctatgcgtagtgattggttagtgcaattctccattctcaacctttttcggagccccatgaattgcgtattcgttcatgtgtcctccatcttcgagtttggaactatgcgtagtgattgcttagtgcaattctccattctcaacctttttcggagccccatgaattgcgttttaattcatgtgtcctccaccttcgagtttggagctatgcgtagtgattgcttagtgcaattctccattctcaacctttttcggagccccatgaattgtgttttcgttcatgtgtcctccacctttgagtttggagttatgcgtagtgattgcttagtgcaattctccattctcaaccttttttggagccccatgaattgtgttttcgttcatgtgtcctccaccttcgagtttggagctatgcgtagtgattgcttagtgcaattctccattctcaacctttttcggagccccatgaattgcgtattcgttcatgtgtcctccaccttcgagtttggagctatgcgtagtgattgcttagtgcaattctccattctcaacctttttcggatccccatgaattgcgttttcgttcatgtgtcctccaccttcgagtttggagctattcgtagttattgcttagtgcaacactcaattctcaacctttttgggagcccctag

SEQ ID NO: 40216 - DNA, 162 bp, Glycine max
  Peptide Sequence Number=SeqID_156994
atgttagccatcgtcagcaagtaccaagaagaattaaatctagccacggctcatgagcacaaagtggcggacgagaaaaacgccataactaaacgcgccccaaggcatccctatcgcaccagatccaaatctaagacgatgggtgaccaagaggagatatag

SEQ ID NO: 40217 - DNA, 186 bp, Glycine max
  Peptide Sequence Number=SeqID_156995
atgcatctttttcagccttccacttcccaggttggttttgaatatataaaatcagctacagaagaaagaaagaaacaagcattggcattggtgaaagatgagtcagaagacacaagcgctcaatctagttcaacaccagggcttcattgcatcagcacaaagtaccaaatgatccagaaaccctag

SEQ ID NO: 40218 - DNA, 524 bp, Glycine max
  Peptide Sequence Number=SeqID_156996
atgagaaactgcataaggtgctgcatctcttgcatcctcccatgtggggctctcgacgtgatccgcatagtgcactccaatggcagagtagaagaaatcggtggcaccatcaaggccagtgatgttatgaaggcacaccccaaacacgtcctcaagaagccgtgctcctccgccgcggatgccgccgaaggcggcgtcggcggtggggtcccaaagatcgtggtggtgccacccgacgcagagctccaacgtgggaagatttacttcctcatgccactccctccttctcctccacaagagaagaaccagcagaggaggaagaagaagaagaaggaacacagagagagaacaaggaacaacaccaacgtgtccacgactatgtctatgactagcttgcttgtctctgatcgctacttgaatgatatactctcagagaaggtgtcaacgcaaagagacagaagaagagggcgtgttgctgtgtggaggcctcacttggagagcatttctgagtcacctcctcatat

SEQ ID NO: 40219 - DNA, 843 bp, Glycine max
  Peptide Sequence Number=SeqID_156997
atgggtttccttgtgttgcttcttttctccctcttaggtctctcttctagttccagcatatctcatcgttccatattggaccttgacctagccaagttcaccacacagaaacagaataacttgaactgtatcagggacatgaatgcaaacagaaaatcaccccactctcatcgtttgggattgaacaagtttgctgacatcactcctcaagagttcagcaaaaagtatttgcaagctcccaaggatgtgccacgacacatcaacatggccgacaaggaattgaaggaggaacagcattcttgtgaccatccacctgcatcctgggattggagggaaaagggtgtcatcacggatgtaaagcaccaaggcttcggtacatgcaatagcaacaggagaccttgtagcctttctgaacaagaactcgtagattgtgtggaaagcgaaggttgttccagtggatggcccgatgattcgttcgtatgggttttagaacatggtgggattgccactgatgctgattatccttacagagctaaagagtgtagatacaaagccaataagggaatttatggtggaggaaactgttcaaagtattgggttaatcactttgttttacttgtgggatatggttcagctgatggtgtagattactggatagcgaaaaattcatggggggaagattggggaaaagatggttacatttggatccaaagaaacacgggtaatttctcaggagtgtgtgggatgaattattttcctgtttatccaactaagaagaaatcagaaacactggtgtctgctggcattaaagctcatagaagagtggatcactctcccctttga

SEQ ID NO: 40220 - DNA, 1563 bp, Glycine max
  Peptide Sequence Number=SeqID_156998
atggaagattcatttgttattccacttaagggagcactcaaaaattacctcaaagctgtcattgctgtggcactgccactgttcaagctaggaaaggctactcctcatgcctatgaagagaaatactgtaaaaatctgactagctctgatgaatcagattttggccatgatgagtcagagtttggccagaatgtaccaaatataatcaattcagtacgacgtaagttgtttgatcagtccagtaaccttgcagctgcacctttcagtggtgggcctactatagagatcagttctgttccaattacccagagcagtggagctttcccagctgtgccagacaccaataagaaacaaaatcagtcacctgcaccattgccttcatcttctaattctccacctgtgaatcaagcaagtcaacaaaattcacctaatggtgcatctggaaaattatggaagtatattattataatcgcaggtgttgctgtcttggtcattgtttttgtgatcatgctttgcatttggcgtaaacgagcagcaaaagtaataaagccttggaagacaggaataagtggacagttgcagaaagcatttataacaggggtccccaaattgaatcagggagagctggaaacagcctgtgaagatttcagcaatattattaatagttttgatgagtgcactatatacaaaggaacactatccagtggagtcgagattgctgttgattcaactattgttacttctgcccgtgattggtcaaagaacatggagacagcctatcgcaaaaagattgctgctttgtcccgtgttaaccataagaactttaccaaccttattgggtactgtgacgaagaagaaccattcacaaggatgatggtgtttgagtatgctccgaatggaaacttatttgagcatctgcatgttaaggaagttgaacctcttgactggagcgcaaggatgagggttattatgggcacggcttattgtcttcagtatatgcaccatgatctaaatccaccagtagctcattccaacctcaattcaattgctatattattaacagatgactttgctgctaaggtaccaagtaacatatctccattctattgctctcagatatcagagatctcttttggcaagcatgcaaaaaccaacacaactggagatgaatcacagaaatcttctgagttgccaccacaggctgatcctgaaactgatgtctataactttggagtattgttgcttgaaatcatttctgggaaactaccttactctgaagaacaaggccaccttgccaactgggctgctgagcacttgaatgataagcgaagcatcggctatctgatcgatcccacgctgcagtccttcaaagaggaagaacttgaggtcatctgtgaggtgatcaaagattgtcttcaatctgatccaaggttaagacctacaatgaaggacataactcccagattgagggaagttcttcatatatcacccgagcaagctgtcccaagactctctccactctggtgggctgaactggagatcttatcaatggaggccacttaa

SEQ ID NO: 40221 - DNA, 390 bp, Glycine max
  Peptide Sequence Number=SeqID_156999
atggaaagcatatgggggccatttggattatggctccgaatttatgttggattgatttctctgtggggaactcgacagtgttggtctctgaacgatgaaggattaaccttgttggaatttcggggaagaataacttctgatccttttgctgctctggcaaattggaatccaaacgattgcaacccttgcaaatggctgggtgtacgttgtgttgatagtcaagtgcaaacgctggtcctacctgatctatctttggaagggacattggctcctgagcttgggaaacttcgtcatctaaaatccctttgtatcattttcatattccttaatcacactatgcccacattcccttctgtctggaatgtagccattaactcaggagaccaatag

SEQ ID NO: 40222 - DNA, 225 bp, Glycine max
  Peptide Sequence Number=SeqID_157000
atgcagcgtctccccgaaaggcgcgttcgtcgtaaaggcgacacgtggcagcacctgggacgcgccctgcgtacaggcgcgacgggtagcgctgctgcagcaggcgcgtcgggtcgtgttgggtacccaggcgcgacgggtcgcgctggggacccaggcgcgacgggtcgcgctggggacccaggcgcgacccagttgggtctgggagtaggaacatctatgtga

SEQ ID NO: 40223 - DNA, 195 bp, Glycine max
  Peptide Sequence Number=SeqID_157001
atgtatcctgattcactaccagatggattgaatagaatggctgttgcaagagattcagctgcttgcagaagccttgttggagcatttaggatgcttcgatggtggggtgcccgtttcgtagtagttaatcatgaagggaatgacgaggtctctctcccgtgtgacagcaagctaatgtttgtgataacgagttga

SEQ ID NO: 40224 - DNA, 210 bp, Glycine max
  Peptide Sequence Number=SeqID_157002
atggacttcaaggcttggatacaagtgagtgagggaagcaacgttcctgtaacagcagttgtgaaaacaactacaagattaaaatttgctggtgccagttttgctgagtctaattgttggtctatgcttaagggtggtctcacagtggatgaatcaggacccgctgagctctattttgaggtactacctattgttcttcaatcttcataa

SEQ ID NO: 40225 - DNA, 1803 bp, Glycine max
  Peptide Sequence Number=SeqID_157003
gtttcgggggtacgctcaattgcttttcatcctgatggacagatcctatttgctggatttgaggatagtttgaaggtttattcgtgggaacctgttatatgtcatgatgctgttgacatgggatggacaacacttggtgacctatgtattcatgacgggatgcttttgggttgctcgttctacagtaattctgtgggagtatgggtgtcagatatttcacttatagagccatataatggtggcttggaaactgagaaaaaggaaagcacaaagcagaaacttagtctccagggaagacaaatggagaaagtagaagctggtgtgggaccggcttttgggttgtgcagtatgtctgctgacaatgagtcaaaagagataaagaatatatatatagactcttctggagggaatcctgataccttaataagatccaggtcttataattctccaaaagtagatcttcctgaagaatccaaagaaatgctaaactggagtcctgcaacaagagctcatgcaaaacaaaatgaacaaacacttagaaagtcttacattatgccaaactttgtacctcgggatattgtcaatggtaagaactcagcaaccttttcaaagactaaacctggaatgttgcttaagccagttcatgttcagggagcatccactgacatacttgatgttgatgggttttcatcagatttggattccagaacattttgtgatactggaagcaaatctgatagtccaaaagatcctaacttccaaatgaagcttggatctcagaatgaagtcagagaatctattgaggataagcatcctatcaaaagtgtcacagagaagtttgaaaaaactttaacaccagacagattttctgaccaagataaatgtaatcaatcctctccatacagcaaggagatgagtccagttaaatatgtcaatggagttgctgttttacaaggaaggacccgttctttggttgagaggtttgaaagaagggaaagaactcccaccgatgagaatcaagctaatgcaacccccaccacaatattcgaaaataaggaaaaaattctcaaagaagatcaaactaatgcatcccccatcaccagcataacatctgagaagggtgaaagatttcctttcggcgatgatcaaaacaatatgcccaatgttcccaacacaaccagtgaaactgacaagtctgctaacttcctgaaagttgagcctcaagttcttggaagcgattcaaactctgcaaatgatggagagataattgaagggctgatgcaaactcatgatgtaacattaagtaatctccgttcacgtttgacaaaattacagggttatagaaagaaaggatccggctcccctaaagtagtgcagcatttttgggagcggaatgatactaaaggtgccatcagtgctttgagaaagttgcctgatcaatctgttcaagctgatgttatcagtgtccttgttgataagatggagattatcaccttagatttattttcttgtttacttcctgtgctcacaggtttgttggatagcaacatagaaagacatgtgaaggtgtcactggatatgctgctgaagcttgtggcagtttttggtccaacaatacgttcaaccatttcagcacctccctctgttgggattgatctacatgcagagcaaaggcgagaatgctccaatcagtgctttatgcaactgcaaaagatccgaatgattcttccaatattaataaggaggggtggtatattggccaagtctgcccaagagctgaatttagttcttcaacaaccctaa

SEQ ID NO: 40226 - DNA, 1042 bp, Glycine max
  Peptide Sequence Number=SeqID_157004
atggcaaagacaggatacaaactacgtatccttttttatatatataagttttgtgcctcagaaaatgctttctgttgcaatgtggaggaatttgcagctcattcagggaatgtaaattgtttaaaacttggaaggaaggcgaaccgccttttcattacaggaggggatgatcacagtgtcaatctatggatgattgggaaaccaacctctttaatgtattcaaagatcgtgtgggcacttgggattgtactaactacatcgacacaatccagtgagatggtgtcagcatggttaacacaaccaacacacctaggaagcaaaagtttgtgtggtcacactagttcagtagaatcagtgacttttgactcagcagaagtgttgattctttctggagcatcgtcaggggtaataaagctttgggatttggaagaagcaaagatggttcgcactcttaccggacacagattgaattgcactgctgttgagtttcatccatttggtgagttttttgcatccggctccttggatactaatctaaatatttgggatatccgaaaaaaaggatgcattcaaacatacaagggtcatagccagggcatcagtactatcaaattcagtcctgatggccgttgggttgtttctggtggatttgataatgttgtgaaggtctgggatctaacaggtggaaagctcctgcatgacttcaagttccatgaaggacacattagatccctagattttcatcctcttgagtttcttatggctacaggttcagcagatagaacagtgaaattttgggatttagaaacctttgaactgattggatctaccagacatgaggtttcgggggtacgctcaattgcttttcatcctgatggacagatcctatttgctggacttgaggatagtttgaagcttatagagccatataatggtggcttggaaactgagaaaaaggaaagcacaaaacagaaacttagtctccagggaagacaaatggagaaagtagaagctggtgtgggaccgccttttgggttgtgca

SEQ ID NO: 40227 - DNA, 164 bp, Glycine max
  Peptide Sequence Number=SeqID_157005
gtgctctcactggaaagtatactcctgataaaccaccaagtgggccaaggggcagaatttatactccagaattcctaacaaagctccaacctttgctgaacaagatcagtgaaataggggagaagtatgataaaactccaacacaggttcatgctgctccttaa

SEQ ID NO: 40228 - DNA, 4920 bp, Glycine max
  Peptide Sequence Number=SeqID_157006
atgacgacgacgggagtgatagtagcacgttatcacatggatcacgtttccgaccacgacggcacggtggtggtaacgaacggaggtattttggcgggagaaggaagttggagatccctgtttttaagggtgatgatgcttacgggtgtgatgattgcgatggaggacagagcgttgaattggttccaatggtgggaggatcaaacaccattgaggagttgggaagagtttaaggaggcagtgattcgaaggtttcaaccgggaatactccacaatcccttaggacctttattgagtctgaaacaagatagcaccgtcatggagtatagagaaaaatttgagatgttggtagccccattgagaagggaggagaggggaatgcttgatagcattttcctcaatggattgaaggaggagttgcaggcagagatgaagttgtatgactatcatgatcttgctgacatgatggatcgtgcattgttactagaagaaaaaaatgaagctctgaggaggaggggaattactgggagagatagaacagaatggaaggataaaggtggagggtccaagtttcgaaatcctggtgattttggtaaggacagaagggaaatacctaaagtaagtggagtaagtgagaaggtggaaggaaaaggggtggaaggtgtgagaggtaggagactgaatcctgcagagttagaggagagaagtaagaagggactgtgttttaaatgtggggacaagtggaatagagagcacatctgcaagttcaaacatatgagcttgaggctgtgtgaaggaggtagtgaggaagaagagatggaagaggagaaagagaaggtagacagtgaaacagatgttgttggggagttgaaaaccttgcaattgtcattacaaagcaaggaaggtttcacttctaataaatcatttaaagtctgggtgaccattaaggagaggcaggtacttaccttgattgactctggagctaccagtaattttatagcttcaaagttagtggaggaattgggattagaactgacagagacacctagttatgtcattgaagtaggcaatggtaaaaaggtaagaaatcagggggtatgtgaagacctgcagttccaaattcaaggtgtggaattcaaacaacatttcttcttgatggagttaggagggtcagagatggtgctaggaatggattggttggctagcttaggcaatattgaagctaattttggaaatttgtgcctaaggtgggaggctgaagggaagaagtatagcattcaaggtgacccaactatgtgtaataggcaatcatcttggaaggctatgatgaaggctctagctgatgcaggggtaggcttttacatacagtctatggaggcagagttggaagaagtaagggaagcagaagggttcaatcagtggcagcagatactgggagaatttgcagcagtttttgacatgccaacaggtttaccacccatcagagagcatgatcatcctataatgctcaaatctggggctgtcattcctaatatcaggccttatagatatccctattatcagaaaaatgagattgagaagattgtgaaggaaatgatgcaagctggaataataaggcacagtaccagtccttattcaagtccagttttattggttaaaaagaaggatggaggatggagattctgcactgactacagagctctcaacaaggtgacaattcccaacaaattccctataccagtaattgatgaattattagatgaattagggggctcagttattttttccaaacttgatttgaaatctggctatcatcaaattagaatgaaggaggaagatattgctaaaactgccttcaggacccatgagggccattatgagtacttagttatgccatttggcttaactaatgctccttcaacattccaggctctaatgaatgaagtgttgagaccatatctgaggaggtttgtgttggtattttttgatgacatccttatttacagcaagagtgaagaagaacacaagttgcatttgagggaaatactgcaagtgttgagaaggaatcagttatatgctaacaagaagaagtgttcctttgcccagaaggaagtggaatatcttggccatctgatatctgataagggggtgtcagctgaccccaagaagatagaagacatgctcaaatggccacaccctaaggaactcaagggcttgagaggattcttaggattgactgggtactacaggaaatttgtaaagaattacagtaaaatagcgtggccactcacccagttactgaagaaggatagtttcttgtggaatgatgaagctcaacaagcatttgaccaattgaaacaagcaatgactactgttcctgtgctagctatgccagattttgacaaggagtttgtgatagaaactgatgcttcagggaagggtataggtgcagtacttatgcaagaaggaagaccagtggcatacatgagccaaaccttatctgacagggctcaaggtaaatctgtttatgagagagaattaatggcaattgtcatagccattcagaaatggaggccatatttgttagggagacattttcaagtgcatacagaccagaaaagcttgaaatttctcactgagcaaagagtcatgggggaagatcaacaaaagtggattgctaaattaatagggtatgattttgaagttaagtacaaacccggaaaggagaacaatgcagctgatgcattgtcaagacaaatgacttatgccactatcaccactgtgcaatgtgaagtatgggagggtctggaagatgaagtgcagaatgatgagaagctgaaggttctggtgcaagccttagttggtgatcctctcagtcacccagggtaccagttgaagggagggaggttgtatcatgaaggaagagtagtgattcccaagaattcacccagaattgcttggttgttacatgaattccatgctactgctgtgggaggtcattctgggtacctcagaacttataaaaaaatttctggattagtctattgggaaggcatgagaaagcagatcaaggagtatgtacaggcctgtgaggtgtgtcagcagaataagtaccagacattgaaacctggagggttactccaacccctgccaatccctaaacaaatatgggctgacatctcaatggatttcataggtgggctacctaaggtgcaaggtactgataccattatggtggtggtggacaggttaactaaatatgctcattttttacctgttagtcacccttacacagctaaggatatagctagtttattcattaaagaaatagtcagattacatggatttcctacttccatagtttctgacagggacaaggtctttcttagtaatttctggtcagaattgtttaagcaggcaggcactaaattgaagtatagtagtgcatatcaccctcagtctgatggacaaacggaggtggtgaataggtgcgtggaaacttacttgaggtgtttaactggaaggcaaccaaagcagtggcctaagtggttagcctgggcagaatattggtacaataccaactaccatgcttcactcaaaactactccatttgaggcactatacgggagagagccacctatgctagtcaagggtgatgtcagtctatctgcagtggaagaggttaacaaactcacagctgagaggaatgcgatgttaaaggaaatgcaggaacaactattgagggcacaagatgttatgagaactcaagctaataagcacagaagggaggttgtttatcagattggtgacatggtatatctgaaaattcaaccttacaagttgaagaaactagcaaacaggttcaatcaaaaattgagcccaagatactatggcccttatgaagtagagcaaaagataggtgaagtagcatataaattgaagttgccagctgacagcagagtccatccagtgtttcatgcttcattgttgaagaaagctctagcacctaatgttgagcctcagcccttaccagcttgcatgaatgaaaactggcaattagagcctgagccagaggaagctttagacacaaggaagaatgaacagggagtagtggaagtcttggtgaaatggaaagaccttccagactttgaaaattcctgggagccagtggaaaagctcagatcagaatttcctggatttcttcttgagggcaagaagagttttgaaggcgggggaattgataagcaacagatagtatacacgaggaaacatggtaagggaagtgtaggggatcatcccactagaggagtaactaacttagtggggaagttagaaactgcatgggagttttctaagcagctcgaaatgcttagcctgttttctgcattttttcatttccattgttcatccattgtaattcacaagtacttgcatgagcactgtcaaccacctattgtgcaccgaaactttaggtctgctaatatactcctcaatgacaaattggaagtgcttgtctctgattgtggattaggttctttactatcttcaggctctgctagtcagttgttgggacgccacctcacagctaatggttacagtgctccagaatttgagtatggaagttatacattgcaaagtgatgtctttagctttggagttgtaatgctagaactcctcactggacgaaaatcctttgacagctcacggcctcgtgtagagcaatttttgatgagatgggcaatccctcaactccatgacatagatgcattgtcaaaaatggttgacccctccttgaatggagaatatcctaagaaatccttgtcgcgttttgcagacattatttcttcatgtattcagaatgaacctgaatttcgaccagcaatgtcagaaattgttcaggatctcttgcgaatgatgtag

SEQ ID NO: 40229 - DNA, 168 bp, Glycine max
  Peptide Sequence Number=SeqID_157007
atgggaagtttgtgggaagaagacaatacaaggagagacgatgtgaaaaacaccgacagccacgaacgccggcgaggacagatgatggataaggaagggaggaagataacgttgataaaaattcctggatcctttggcatgtgcttgaaattccgagggacgccataa

SEQ ID NO: 40230 - DNA, 207 bp, Glycine max
  Peptide Sequence Number=SeqID_157008
atggaatttgaaagggggaatcgaatgtttggagccttggatgatgccgttcattttgatcgttttcttcccaaccagaaaaaacgagatctagaacaatactccgcgtcacccaaaatcacgaaggagatagcagatcatgcaagccacactgatggctctgaaatcgtactggagaccatcgaagccaaagatgttggtgcgtga

SEQ ID NO: 40231 - DNA, 144 bp, Glycine max
  Peptide Sequence Number=SeqID_157009
atgagctatatgattggaatcttgactctgactttgaagacttccattcgtggaaatggagaggaaaagacaataggttttttgttaaatgatgaaaattgctctaactttcaggtgatcaaaacccgtcatcaggtatattaa

SEQ ID NO: 40232 - DNA, 1986 bp, Glycine max
  Peptide Sequence Number=SeqID_157010
atgatgaatgaaaggaaattgaacattgatgctcctcttatgtcggtgaggcgctcttttggtacatcaccttccttaactgaagcaaatagaaagatattagagaagccacaaacacttccaaactacaaatcagacaccactttggatcaggtaacagaacctgttgcagtgcctttcaattgggagcatatccctggaaggtcaaaggattatgatggatcagaacctcaacttcctacaaaggcttcaattaccccaattctcccccctggaaaatccacaaatgtagccaaacaatcattggaaaaggaacctaatgttgcaaataactttaggcccccaagcatatcaaattctttaagtgagaaaatagattgcaacaaagaacataaagatgagaaaatgaaaaaggtggaagagaatgatgactatgatgatgatggtgatgtttattctgatgcacttgaaacactgtcacctacagagcctttgtctatgaactgtagtgtgagtgatgtgagtggcttagataatgtggttgcggatatgtgtggagcctcttctactgataaacaagctcatgatttcatgatgagcaggtttttaactgcagcaaaggctatgactatacagcctcctcaatatgcttcttctagaaagcaaactgttctgactgaacaacctagggaatttatcaaattggttcctgaacaaaagaagtcatttgttagtagacatatcactgacattgtaccatatactggtcaatgtcaagaagaggaagaagaagaggaggaaagtgacaatgaaactaatgattatgcaaataattcagctaaaggttgcggattatttccccgcttatgtgttagaaattcattgtgcttattaaatccagtgcctgggacgaaaatggggaatcagtttcccttgtattctgcctatgaggttggaaaacctgataaaagttctcatattcgctcgcatagaccagctccatctataaagaaggcttgggatgctattaataagagcaaatcaagctctagagctgcatcaccagacaagcaggatgtaagaaaaaaatggactagtgaatcaagcaggtatacctactcaggtgaattgaagaagctaggtaggctctctccctttcgtcgttcaagagctgcttctgctggcgtatctccttttcaaagtaaacctcaacctccctttcctggagcaaagttgcttggtgattccaaacaagatgataataatcattctggcaaattgaaattcccgagtagagggcattcaagtattcaagaggtgctatcacaaggagcaaaaagaagctatagctttgggagccttactgttgaaaagacattgtacatagatactgcaagtacaataaaatcatcatgctctagttcgcattctttaggtaacacaatagtggtaggaaaagacagaactttcctactagattcttttcgagatatgaagcacctagaagctttggaggagaatttggattcccaagtgttgaatcctgtggatgccaattctccaactttgtctagcatgttacatctcatggccaaagaagataaagctgaaagattggcagctgatcaagaaattaatctagagtccatgtccttgcaacttgtgccaagttcatttgacaaagatgcagagataagcaagcagcaaattgtagtggttgatgattcaggaaaagttggcaatgaatatgttctacatcctctggccccaccattgccaaagtcaccttctgaatcctggctttgtcgtgccctgcctctagtttcttctaagaattcattcccactttcaaatcaaggtacacattcccaggctaaaaggcagggttttagtagagcatcaagctatactaagtgggaaacaatagtgaaatcttcgaatttgaatcatgatcatgtaacctgttctaaggcttatgggatttag

SEQ ID NO: 40233 - DNA, 687 bp, Glycine max
  Peptide Sequence Number=SeqID_157011
atgggaaatggaggaattattctagcaagtgattacaacgaccacagttatttccatggtctcatgcatccctgctccctatcacattcacatacaaaagccatcgatttaaggcgccaacaatggtacttcaataatcatcaaccttttagaagaccaagttactttagcaacgaagttgtctcctcaactgccttacaaacgcaaggaagatcattatcttcaaaccaaattaacctaatggatgccaccagcattgcacccatgagaccaagccagtttcttgaagagaaaaagtggcctcccttagatattatgaacaaccatcactggaagaaaaggttgcctgccaatattacttctaatgctgtgtcacaacctgttgtacatcaatttggcaccactgcagcatctctgcttagaccaagtgagttgaactttggaaacaacacaagaatcaaggagcatctatcaaactccgacgagcatcgcaactattccaacagtttcaagctagaatttgagcctccatttcggattaagtcgaatcaagaaaaattgcagaaagagaaccaatgggcgcctgatttgcgactgagtttaagtcagagagatggcaacaatgatggcaagactgatcattgcagagaaacccaagaaatcaacacgaaactttcactttcatag

SEQ ID NO: 40234 - DNA, 423 bp, Glycine max
  Peptide Sequence Number=SeqID_157012
atgaacaacagtgttcctgattggaattttgggagtgattcctgtgtcaccaccaccaatcaaaagaagcccatgataggggtggaccaagagcttgtagagcttcagtggcaaaatggccaggtagtgatgcacagccaaacacacagaaaaccgtttgtgaattccatcacgccgagaccgcttcggaggaattttcaatcaacattaaggactagtgagccatttgggaactcaagtaacttgattcaagatgatgagacagtctcatggatccaataccctcttgaggatccattggaacaagagttctgttcaaaccttttatctgaactggcaccttgtgaagttgagtcctataagcaaatcaagccatttgaagaggggaagtttaccaaattggatgcctctagtaccccccat

SEQ ID NO: 40235 - DNA, 327 bp, Glycine max
  Peptide Sequence Number=SeqID_157013
gagtgccatcagacgaaagcatcacgcctttcatcgcacggggtttcagtgaccacaacgcaagggtactccaaggagttcgcaaggcatgggatgcggcgtgaagaaaggacagagagcttaggggaagccactgtgagagatgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcacgggtcaaaggcatgatctggaaggacaagctaaaggcttgccttag

SEQ ID NO: 40236 - DNA, 1287 bp, Glycine max
  Peptide Sequence Number=SeqID_157014
atggcattgtgttacattattgttgcgtttttttacagcaatatggcacgttctccagacaagataaagaacatcgacgactcaaaagaaactcttaaacttgctgtgaggatcagtgatctatggtttattgggatgcctaacaaatctgagcaagttgagatggtttttatcaactccgatgtttattacttattgttcagcccattgtgttgtaactttaacgaaatccagggtgatgagatccatgatgtttgtaaacaagaccaactgaagtcttggaagatggacttgaaggaaaattgtacttatgtcatgcacaattttaaagtgctaaaaaacaacggtcagtatagagtctgtgatcaccaatttaaattggtgtttattggagttgctgttgtaaggcagtgtgttctaaatgacctcccttttagaaaatacaaatttgctggatttgccgatgttgtggctgggcagtttgaacctggcctattggttgacgttatcgatgttgtggatgaggttgtctttcgccatgtttcaagaaaaggtagaagggtagtctttaaactaaaggacttgaggcttgcagggttgggcattgaggcccggccagtttttaaatcccatggtcaaggcagttcccagctttcaggttctatccaattatcatcaaaggaatcattctttggaaaggctgaggcaaagactattgctgagattaacaccatctctgaagaaattgtttgtgtaactgttggcacaattactaggattgttatggacaatcattcatggtgttatatagcttgcattcagtgccataaaaaaattgatgcgaagatggcgcccttcacatgtgcatgtggcaaatacaatcaggaagttgtgcttaggtataggcttgaggtgatgatcaaccacagagatgaaaacacaaaattcctgctttgggaccgtgaatgcactgaattaattggtcaatcagttgatacagttaataggcttaaaaatgaagatggtgatgttgatttaaatgcttcaccccaagcacttgataagctgctgggttatgtgcttgcttttaagataaaggtgcaacccaagttcaggaaatttgccattttgaagtgttcaactgactcaagcttaattgatgttgtgatggacatgctacctaatgctgagacatcttcaaaaatcaatgtcccaacctttgattccaatcattctaccgagcatgaacctgtgaattttaatcatgaccttcatcctttaatatga

SEQ ID NO: 40237 - DNA, 270 bp, Glycine max
  Peptide Sequence Number=SeqID_157015
atgacctatcgaggtttaaaaatgaaacatcaccggattacgcggatcgaacattttctaaaagatatcatgcaaatattattcaggtcggctaggttttttcgttcgagctcaaccaaagttgtgttgtggccgacgccggcgttttttcatttccttggcaaggaaaacattagccaacctcggcaaaaacacatgcaggattcaccgatactgatcggaaaaaatgctagcgacgtcggcaaggaaagattaccgatcgaggtttaa

SEQ ID NO: 40238 - DNA, 282 bp, Glycine max
  Peptide Sequence Number=SeqID_157016
atggtgagctattttgtagaggaatttaaaaagaagaacaaagtggacattagtgagaaccctaaggagattgagaactacatgggaaaggacattgaaagtcatgatatgctaagacaaggtttcactcatgttttcttgatgacattcaatgggaaggacgagttcaacgcatttcagactcaaccgaatcactttgagtttactggagtattttcacctgttattgagaacattgtggtgctggatttcccatataaccttgtgaaagcaccagaatga

SEQ ID NO: 40239 - DNA, 132 bp, Glycine max
  Peptide Sequence Number=SeqID_157017
atggcccttggaaccatggcagctcgcccaggcgagctgatgcttcatcctgaagtaagttggctcgtccaaaaaccagtgttgaacaacacctttcgattagcgagaatcaaaaacatcaatggatggtag

SEQ ID NO: 40240 - DNA, 945 bp, Glycine max
  Peptide Sequence Number=SeqID_157018
atgggtgtcaaaggtttcgtcgaaggaggcattgcttctgtgatcgcagggtgttccacacaccctcttgatctcatcaaggtaagaatgcagcttcaaggagagacccagcaaccctcgaatctccgacccgcactcgccttccaccctagctccgtccacgcgccgccgcagccggcggccaaggagggtcccattgccgtcggagttaagttagtccaacaagaaggcgtggccgcgcttttctccggcgtctccgccaccgtcctccgccagcttctctactccaccactcgcatgggactctacgaggtgctcaagaagaaatggtccgatcccaattctgccggaggcaccttgtcgctatctcgtaagataacggcagggttaatttctggtggaatcggcgcagtcgttggaaatcccgccgatgtagccatggtccgcatgcaggccgacggaagacttccgccgatccgacaacggaattataaatccgtccttgacgccatcgcaaggatgacaaaagacgagggcatcactagcttatggcgtggttcatcgttaacagtgaaccgcgccatgttagtgacggcctcgcagctcgcttcttacgaccagttcaaggagatgattttggaaaagggtgtaatgcgtgatggtcttgggacccatgtaacgtcgagtttcgcagcggggtttgtggcggcggttacgtcgaaccccgttgacgtgatcaagactagggtgatgaacatgaaggtggaacctggggcggcgccgccgtattccggcgcactggattgcgccttgaagacggtacgcaaagagggccccatggctctttacaaaggctttattcccacgatttcgagacaaggacccttcactgttgttttgttcgtcacgttagaacaggttcgaaagttgcttaaggatttctaa

SEQ ID NO: 40241 - DNA, 435 bp, Glycine max
  Peptide Sequence Number=SeqID_157019
atgaaggctaacatggaggccatgaaagagaaaatgaccatgatgatggaatcattgatgagtatgagaaggatgatggagagcaagcaattcttcccacgatatgacttgcctcccatctatacaccacccaatgttgcacacgctccagatgagaacggccttcagttttgcccacaaccacaacccttgcattttgcggtgggaagagtccctcctgccatggtggaaaggggaaactttgatcatatagaggaaaggctgatggctattgaaggaggcggagattatgcctttgctgacatggcagaactgtgcctagtgcccgacgtcgttatccctccaaagttcaaggtgctggattttgataaatacaaggggactacttgccccaagaatcacctgaagatgtacagtaggaaaatgggggcatag

SEQ ID NO: 40242 - DNA, 321 bp, Glycine max
  Peptide Sequence Number=SeqID_157020
atgaagctttgcttctacattcgctgtagtggactggctagattgtcattcataggaaaaaccgctagcgatggtgttgattacacctctaacatgctggggggggttcttattctggtggaggttgtcactcacgccgctgttgctagtgtctttgtctgcctcagtctttcgatcttctgtttgcttcctagttcctgtgctgctcctcttgatgtcctccgagcattgctcctgcttggtgattgtctgtatttggttgtgtttgacctcggcctggggtgttttgtttgggtagctggatgggtacctctaggttga

SEQ ID NO: 40243 - DNA, 246 bp, Glycine max
  Peptide Sequence Number=SeqID_157021
atggacacccgtctctgtgtgattggtgatctcatgaatggagttcaacggtacaccaaaatgaaatttggcggagttgttccgtttctcattcctatgacgaggggtgggggtcacaactcactctttgaggattcacctagtgagtgtggtggtggggccgccactgtgagatatgggctaatctctaagggacactcacgaaacaagatacaagcgcaaggtcgtgtaacgcgctaccactga

SEQ ID NO: 40244 - DNA, 417 bp, Glycine max
  Peptide Sequence Number=SeqID_157022
atgaaggttgttatagctatatgtgcagtgtataaaaataatagtgatcatgttcacattgtacagacaggtgttgtccaacctttgatagagatgcttcaggagatgtacagctcagggaaattgccgctgctcaagcttcttgactcaaaaaatggccctttgcaacataatgccgcttttgctctttatggccttgcagataatgaggataatgcctccgatttcataagggtaggtggaattcagagactgcaggatggagaatttattgttctaggtttctgctcttacccttggatgcctaaattaaagaaacatctgaacatttgtaatttaaagaaccgggggaaaatagattcatctttgacctatattgacccttatggaattgctttttattgcaggcaactatag

SEQ ID NO: 40245 - DNA, 189 bp, Glycine max
  Peptide Sequence Number=SeqID_157023
atggcatttgcagggatctcaaatgaccaaaaaatgacaccattcgagctagagcatgttgtaaacaaattggatgtccataggagattttttgtgcatgggctgaagttacaagaagctttcaaatccaaacttttttggtggagcacatacatggaagggtcttcaaaaataagcaagctacaatga

SEQ ID NO: 40246 - DNA, 321 bp, Glycine max
  Peptide Sequence Number=SeqID_157024
atgggtggtcctgttaaagaaattgggccaaagattgaagtagatgtgttgtctctaaattgcaatgcaaaaaaagtggttaaggttgttcctgaggactctactcagaatggtattgaagatatggatgttgatggtgctaatggtgtgggtaaaggtggtccagtcgctaaaattgaagttgttagagttgaaactttagctaatgtacaagatgctgaaactgaagttgtatatgtgtctccagaagatgatggacaaacaagtgacacaagtaatgatggttaccactttgaagaatttgagtcttcccaacagtga

SEQ ID NO: 40247 - DNA, 495 bp, Glycine max
  Peptide Sequence Number=SeqID_157025
atggacttcaatcggcaccaattctggagtgccaagcatcagcaacactttgagaccatcaaggggtggtcattcgtcagagaaagatgggtccagctgagcaacgatgagttctctgactttcaggaggagatagcccgcaggcactgggcaccacttgtgacacccatggctaaattcgacctggagatactcatggagttttatgccaatgcctggcctaccgaggagggagtcgaagatatgcgctcctgggtaaggggccaatggattcccttcgacgcaaacgcccttagcctatacctaggccacccattggtcttggcagagggccagcagtgtgagtacaaccagaggaggaggcaggtctctagctttgatgaggaggccattgcccagctattgtgcataccggggcaagatttcacccagaccattgtagggagatgggtgtggatcatgcgcaccagcatgaccacccttacccagatatag

SEQ ID NO: 40248 - DNA, 219 bp, Glycine max
  Peptide Sequence Number=SeqID_157026
atggagcgtcttctcgtgaagaatacatggagtcgccaccaacgtttattagaggaaaacactagaaaaaacaaaaagacgaagcaaaagatggcattaggggtgatggcagctcgcctaggcaagttgttgcttcaacctgaagtaaccttgctcgcccaggcgagctggttacttcaccctgaaactatttgggggcccatgcgagctagaggctag

SEQ ID NO: 40249 - DNA, 576 bp, Glycine max
  Peptide Sequence Number=SeqID_157027
atgaatgccttgaagcgaatcattcgatacatcaaaggcaccatcactcacggtttacatctctctccctcctcagctgacaaactcaccacatatactgatgctgactgggggggatgtccggacacccgcaggtccacgtccggttattgtgtttatcttggagataatttagtttcatggtctgccaaacgtcaaccaactctttctcgttctagtgcagaggcagagtatcgtggtgttgctaacgttgtctctgaatcctgttggcttcgaaatttactcttagaacttcagtgtcctattgcgaaagccacactagtatattgtgacaatgttagtgttgtctacttatcaggaaatcccattcaacaccaacgcactaaacacattgaaatggatattcattttgtgcgtgaaaaggttgctcgtggccagatacgcgttctacatgttccttcacgctaccaaatagctgacattttcacaaagggccttccgctgcagctattcagcgacttcagagatagtctcaacattcgtcctcctcccgtttcgactacgggggtgtattag

SEQ ID NO: 40250 - DNA, 551 bp, Glycine max
  Peptide Sequence Number=SeqID_157028
gtgaagaacttcatcacggactcaacatatatgtcacgcagctccacaggaacgacataaccattaacaagttggagaagttttcttgggaggatgaagaagtgtttcaagagtggctgaaggagcaggcatattccaaaggaagtcaccgacgcagcatcgcttggagtaggacgaagaagctgcagaagggtgatgatgatgatgatgatcttcctgattctgtagattggaggaacaagggaaagctgtcactgaatgtcaccctatctgtacaacaactcgtggattgtgaccctgctagcaatgattgtgctggaggcttttacttcaatgcatttggttacgttatagataatggtggcgttgacacagaagctcattatccttacatagcccaaaatagtacttgcaaggcaaatgcaaacaaggttgttagtatagataaccttgaagttgtggttggacgagaagaagctctcttgtgccgtgttaacaaacagcctgttaatgtgaccatagatgcaactggccttcaattttacgcgggt

SEQ ID NO: 40251 - DNA, 1401 bp, Glycine max
  Peptide Sequence Number=SeqID_157029
atgaagccccttttttgcttattcttgattcttgtgtcgctattttctctggtggaatcttcatgcaacaacaacagtgaagagcacgacttgttgtcaaaggctttcaaatcagtctctggcttcaacgcttcctcctcctcgttccaaaccaacaactgtttccaaactcacatcatcaccagaatagtgcttccatcccaaaacctcagtggaacaatctcatggggttacctgaggaacatgtccaagttgcaggttatcgatctctctggcaatgccttacaaggtcacgtgccatgctggttttggtcgagttcatccttattggaaataaacctctctagaaacaggttcggagggagcatccttaaacccacagcagaaaacacctcgttttcgttttcatccattaaaacactcaacctctcccacaacaggtttactaattcaatccaactttctgttttccgaaaccttaagatcctcgacctttcccacaacaacctggtcacacttccttccgggtttcaaaacctcaccaaactacaacaccttgacctctcgagctgcaatcttcaaaccaacataaaagccatttcctctcttgactcccttaaccacttggacttatcaaacaacaacttcaccggtaatttcccttctgatttccctccactcaccaccctcaaattcctcaacatctcgttcaacaacttcacctcatcaattagcgtaaacaggctcactagattcggtaaatcggctttcgtccacgctggcagcaacttcacctacgacagtacgaaaaactcaacacaagaagaagccatcactcacaagcgaaagttcaaaacgctgattgctgcagcgtcatcagcaattgtcctaattctcttgtccatatgggcactccgcattgtgattcagaagaggaagcagagcgccaagaggaaaaagtgggcgatctcgatgccggtcccacaagggatgacgatgacgatgatgatgaaatcagggccgttcgcgttcgagaccgaatcagggtcaacgtgggtggctgacctgaaggaaccgtcttcggcgccggtagtgatgttcgagaagccgttgattaatctgagcttcaaggatctcattgttgccacgtcacacttcgggaaggactcgctgctggcggagggaaggtgtgggcccgtgtacagagccgtgctgcccggggagctccacgtggcaatcaaggtcctggaacacgccagagacgttgatcatgatgactccgtggccacctttgttgacctcgcaaggctcaagcaccccaacttgctgcccctctccggttactgcattgcagtaaaatctatcgtcgctgctgctagtggttatgattgtgcgtggtaa

SEQ ID NO: 40252 - DNA, 1341 bp, Glycine max
  Peptide Sequence Number=SeqID_157030
atggattcaaatgtttgtagttcagttgcgtctctaaactgcactgcaattactgaattggagtatagaggcatggagggaattcctgtgaggattgtgataccttcagcttcaacgtgtcactctcatgattttcaaaggaaaacaatcatacaagtatcatcttcatcaacaagaagggttcctacccacaacagatattttcgctttactgttccggccaaactctctccttctgattttcaagattttcagagctatgcgaggccttcacatctcttgccagcctctgaagtgaaagtgtacacaaatacatcagtagagaacatttcatcatctttgaaggaggatggatccaaatctttatttatggtcaagttagttacaagcaacgcatatggctctagtattagtgacttaaatgctggaattctactatgcttgatagatgaaaacggaaattccatattgcaaaggatccctgtgagtttgatgatggatcattctacagaatcaggggatatgactaatattgacatgcttcatttccaaagaggttctgtagatgaattcatttttgagggtcctaaaattgcacgacttaaggctctttgggtcagtgttgaatcaggtcagtggcgcctaggaagtgtatccttaatggttattaattgtgaagggcaaccatctggaccggaagatggggtaccaacgtacactggcttccagtatgactttcagattgatgatgtgttgcttggtgagggagttgatctgtccatgttggaattaagacctagccttgtgactgagctggaagggattgatcccataagcatcttcaataaaggacttaatgaccctaacttgctctcaagtcctaagatctcgaatgaagagagtatgaaggaatacgcagatttgaagttctcattgttattttatgatgccatgctgatgctttttggtacatcagttgcttccctcttggctggggaaaatgccgggattgctttcttgattggtggaattggaggcttcttgtatcttttactgttgcagagatcagtggatgaattgccagcttcagaattaatcaccaatgacaaagaaagaactgatgcattgttcagaggagtgaagggtccaatagcaagtgtagcattggctctaggcttggctgtaattgcatcaaggtatagctcaggaggtcttcaagtgatgctaacaccaaaagatctcatagttggaatgttggggtttcttgcatgtaaagtttctgtggtgttggctgcattcaagcctataacactaggttcaaagttaccaagtgatatgtaa

SEQ ID NO: 40253 - DNA, 642 bp, Glycine max
  Peptide Sequence Number=SeqID_157031
atgagtacggcaaggtttatcaagtgtgtaacagttggagatggtgctgtgggaaagacatgcatgcttatatcctataccagcaatacctttcccacggattatgttccaacagtgtttgacaatttcagtgctaatgtaacggtggatggtagtactgttaatcttggtttatgggacactgcaggacaagaagattacaacaggctaaggcctttaagctatagaggagctgatgtgtttttgttgtgctattctctcatcagcaaagccagttatgagaacatctccaaaaagtggatacctgagctaagacattatgctccaaatgtgcctatagtgctggtgggaacaaaactagttatgcattattcactctgcaataatcctcctgtgaatcttcaatggatgcaatactcatcaacatatatccaattgaatgttatgacttatatgccatggcagaaaacagaggaaggtgaagaattgaagaaaatgattggtgcagtcacttatattgagtgcagctccaaaacacagctgaatgtgaagacagtttttgatgctgcaataaaggttgcattgaagccaccaaagccaaagaagaaaccacgcaagaaaaggacctgtactttcctctga

SEQ ID NO: 40254 - DNA, 488 bp, Glycine max
  Peptide Sequence Number=SeqID_157032
cccaactaagcagtgctgcataccagcttcttggtatggctgatttgggattcataccaagaatttttggagaaaggtctaagtggtttaacactccttggatggccattttgatctcaacagttatagcacttggcatgagtttcttgaccttcacagagatcatatctactgtgaatttcttgtacagtttggggatgcttttggagtttgcagctttcctaaggttgaggaggaaattccctgctttgaaaaggccatttcaggttccattggggttctttggtttggtcataatgtgctttgtaccatctgtgcttttggtgtatgtgatgagtgttgcttccaaaattgtgtatgtggctagtgccttcttgacctctcttgggattgctttatattatttcatgaatctttctaagtctaggaagtggcttgaattcagccgtgtgggagataaattgggtgaaaatgattatgttttgtag

SEQ ID NO: 40255 - DNA, 1170 bp, Glycine max
  Peptide Sequence Number=SeqID_157033
atgtcttcttccaacagacattggccaagcatgttcaaatccaagccttgcaataatccccacaaccaatggcatcatgacatcaactcctctatagtttccaccggttgccaaagaagcccttatgctaattcaggaggtgacgagagaaccccagaaccaaagccaagatggaacccaaaaccggagcaaatccgcatcctggaagccatcttcaactcagggatggtgaatcccccaagggatgagataaggaagatccgggtgcagttgcaagagtatggccaagtgggtgatgccaatgtcttctactggttccagaaccgcaaatccaggagcaagcacaagcttcgtcacttccaaaacacaaagaaccaaaataatgcagaagcacaacaacagcacagggttgatgcttcttcttctctctctcagaccacaccactttcatcctcatcctcttcatctgacaaatcatcttcaaaggaattagcatacaaccccaatggattctcctttggcttttcaaatgtcaatgatgtagcagtgcctaattctcccactgcttctgtgaatcagacttattttcaccctcacaaccacagtgacaacaatttgctaccacaagagcctttctcctttaccatgcacaacaacaatgggcaaggttttgttgataataataccataacaacgcttgggttttctgtccctcaattctccagcaacatgatgcaatctcaacttcagtgtcaacaaaatgttggatcttgcactagtcttttgctgagtgagatcatgagtcatggaaccttctcaaagaaagatcaagacaaggcattgaagataatgcatccacaacttagtaatttccctcttacttcaactccaaccacaatcattgctcctccaatctcaaccgttctggatccaagccccatcactcaacttgaaggtgttggtgaggttgcagcaggagatagggcaaaatgtattacagtgttcattaacgatgttgtatttgagattgtgatgggacccttcaacgtgcgccaagcctttggagatgaagctgtgcttatccactcttctggtaaccctgttcccaccgatgagtggggcatcactctccacccactgcaccatggtgcttgttactatctggtttaa

SEQ ID NO: 40256 - DNA, 321 bp, Glycine max
  Peptide Sequence Number=SeqID_157034
atgggggcgtacagagccgacgacgattacgattacttgttcaaggttgttctgatcggcgactccggcgttggcaaatcgaaccttctttctcggttcacacgaaacgaattcagccttgaatccaagtccaccattggcgttgagttcgccaccagaagcattcgcgtcgatgataaggtcgtcaaggcgcagatttgggacactgctggtcaagaacggaggaatgaagaggttggagctgctggttactttgtgagaaacatttttagtaagcataagcaatggaagaattatgaagataatgtatcgtacggctag

SEQ ID NO: 40257 - DNA, 1119 bp, Glycine max
  Peptide Sequence Number=SeqID_157035
atggatttccaagtcgtcgttctcggcggtggcgtctccaagaagctcatccctctcgtttcgcaggagcttccgaacgcgttgcttccgttggcgaatcgccccgttctctcctacgttctcgagtacttggagcttagcaacctcaaagatctcattgtggtggtcgaaggcgaagaagcggctcttcatgttggggcttggatttcgggggcttatgctgatcgcctccacgttgaggttgctgcagttcctgaggatgtggggacagcgggtgcaattcgggccatttcacatcacctaactgctaaagacattttggttgtcagtggtgatcttgttactgatgtgccacttggtgctgttgcagctactcatagacggcatgatgcagttgtcactgctatgctttgctctgctcctgtaagtggacctttggagtcagtatcctctggtgggaaagacaaaaccaagaaacctggccgctatgatttgatagggctggatcccacaaaacagtttttagttcacatagcaactggagcagaagttgaaaaagatcttcgaattcagaagagcatgctcccagcagttggccagatagaaataagagctgatctaatggacgcccacttgtatgcattcaaaagatcagttctacaagaagttctagatcagaaaagtgcatttcatagcttaaagcatgatgtactgccatatctagtccggagccaactggtgataggagaggctagtcgcttatcagggtattccttctctactctaaacaacattatccatccttctgcagagcttggggcaaaaacaacagttggaccacattgtatactgggggaaggttcacagatgggtgacaaatgcagtgtgaaacggtctgtcattggccgtcattgtcggattggtgctaatgttaaggttgttaattcagtagttatgaatcatgttactatcggagaatcttgttcaatccaaggttctgttatctgcagcaacgtacagctccaagaacgtgctgtactaaaagattgccaagttggagcaggttttgtggtcactgctggtagtgagtgcaagggggaggtcttggcaaagaaatga

SEQ ID NO: 40258 - DNA, 744 bp, Glycine max
  Peptide Sequence Number=SeqID_157036
atgaaggttttgatgattctgaggtttaatcatatcatgcttaaacaattccggcaccaagtaatgttggtagcaaatgcaatagatgtcacattctcaaaaggagatgcaatcgccattgacatgcaaatgacactgatagctttgttccaaaagaaattgcaacgtgtttctaaagcaaagggtattttcactcagccagaggatgttgcttgtgttggtgaagtgggcttgtttccaatatatatgggagcgactgatagattgcttaatgcggataatgaggaggtttactttaagggaatgcccatttacaaaggaaaggttcttaggagacatggagatataatcaaaagaactgctggaggtcgtttcattggacaagggcgggctgatgacacgatgaatcttggcggaataaagacaagttctgtagaaattgagcatgtctgtgatagagccaacaaaggcattttggagacagctgcaatcagtgtttctcctgcaaatggaggcccggaacaactagttatatttgcagttttaaagaaaggatacaattccaatgcagaaactctaaaaaggaaattcagtaaagccattcaaagcaaccttaatcctttgtttaaggtgagccttgttaaaattgtgcccgactttccccgaacagcttccaacaaattactaaggagagttttgagagatcaaatgaagcgtgagctatcaattcagagtagactttag

SEQ ID NO: 40259 - DNA, 246 bp, Glycine max
  Peptide Sequence Number=SeqID_157037
atggcagcaatggtgccggcgacaacggtcatggtgactacagtggtgacagttggtggtggtggtggcaatcatggttatcacgatggtggtggtaatcatgatagtcaaggtagtgggaacgacaacaaagatcagtgcagtaaaaaaatcataattctgaagttctcaagccgtcaaatatggtcattgacggaggcacatgtgcaatttttggaaggagtcatttacgcaatttcgtcctag

SEQ ID NO: 40260 - DNA, 385 bp, Glycine max
  Peptide Sequence Number=SeqID_157038
gggttcgatggaacctacatttatagtagttgagcgtgactgttgctccttgtttgtagaggctgttatagcttttgcagataatttccagcttgtagataatagtcgggagcttatagataatggtgatgcaagctccattggagcttgtaggtctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctaaaatctgaa

SEQ ID NO: 40261 - DNA, 1635 bp, Glycine max
  Peptide Sequence Number=SeqID_157039
atgaagaaggttcccaagaatagctgcaagtctgcatcacacaggctctttaaggacaaggcgaagaaccgcgtggatgacttgcagctgatgttcctggatctgcagtttgctaggaaggagagccgcacggtcgatgctgcggtgcttgaggagcaagtccatcaaatgcttcgcgagtggaaggccgagctcaacgagccctcacctgcttcttcgctgcagcaaggtggcagtcttgggtcattctccaccgatatctgtcggctattgcagctttgtgaggaggaagacgatgcctctagtcagttagctgctcctaagcctgaacctaatgatcagactctgcaggttgggggtaaggtcatgttccaagagtggaatgttctgtgggctcatatctcagacgtgccatccctcctgtccagatggattgacttgatgcagcaaaccaataatcagggattggggatacatggctactccagtgacagagccactggtggttggatatggtctgtcaccagtggagaggctctgatggttaagccattccttagagtttatacttgtttgcttttaaagattggcatatttctccaaagggcagtatctgcttttacaaattgtacttttatccagtatttcagtactggtctgggacaacagcaacatgatttcccatttgttgatgagtgcaaacacttcacctcaagtgttcaaaatgtggcagctaacaacccagatggacatgatttagaatatcatcagtttgatttacatcaggactatgatcatggcttttatactggttttaatggcccaaaatgtgcactttgggactgtccaaggcctgcacaagggttggactggtgtcaagattattgcagtagctttcatgctgccctagctctgaatgaagggccaccaggcatggccccagttctacgacctgggggcattgggttgaaggataatttactttttgctgctcttagtgcaaaggcacaaggaaaggatgttggcatcccagaatgtgagggagctgcaactgcaaagtctccatggaatgcacctgagctctttgatctgtctgttcttgaaggtgagactattagggagtggctcttctttgataagcctcgaagagcatttgagagtggaaacagaaagcaaaggtcattgccagattatagtggacgtggttggcatgaatccagaaagcaagtgatgaatgaatttggagggctgaagaggtcctattatatggatccacagccactgaaccattttgagtggcacctttatgagtatgagattagcaagtgtgatgcatgtgccttgtaccgattggaactgaagcttgttgatggtaagaaaaactccaagacaaaggcagcaaatgattcagttgcggatctgcagaagcagatgggaaggctctctgctgagtttccacatgacaacaaaagggctgccaaaggcagagccaaaatcaacaccaaagttggcataggtggtggtgtctattcagcttcacacagagtgactccactgaatggaacatatgagtatgggttagctgcaccatatgactatcttgttgacaacatgggtgactattatggaacatga

SEQ ID NO: 40262 - DNA, 879 bp, Glycine max
  Peptide Sequence Number=SeqID_157040
atgaagctggcaaaccctgaggacttctggtgctctgctaaagcacttgaatgtggctccttcccaactccacctaaacagttgggcgatggtgccctttcttcatcatccagcctaaggccattcgtgaagcaggttggacttacaggtgggactgggccaccgtctagtgttgctcttgctgttggagaagtgggtcaacctgctgatgaggttggccctgtagttgttgttgctaaagtgacacataattcttcttcctctgttttggcaaagaggaagagggataatgttgttaggccatctagctgcaagaagtcaaaggcccctataagtctttgtgccctaaggcaagttgtagggttgatgtccagtgcgggtcgcccttcgactacacaggatgtgcccccgactccattgggcatcgaggcttctactgttgctgctattactcctgttactcctgcttcttcaccccctcccgttgttgttgttcaaaaggtcactcctactgctgttgaagttattgtgctagccactcaggctgactctaccgtggcgctgtcattcactgtcgcgacacctttgctaagtgccaatgtggaaaccaccggtgctcccacggtgctgcctccttcctcgtcggctccgatggcttctccttctactattttggcggtaagggcattgccaaggagaggaaggtcggaggctgtggcgcagcatgaaaaaggatttcaaaaggccgttaggcaggctggtttctttgcgaaggaccttgacttaggtctcttcgatcccttcaaggatgtgaaggatggtgtcctacttgatgaagaagacattgctgcggaggaggaggctgctgataaagggtag

SEQ ID NO: 40263 - DNA, 357 bp, Glycine max
  Peptide Sequence Number=SeqID_157041
atgtcagtgaaaaacctcgtcgggcgcctaggaggagaccagtcagggtcacagtgttttgcgagaatgctccaaccatatgggatcaacataggcttaaaggagcactcaaaccgtgtgacccccaaggcccacactccgaagagtccgtcagggcctctccctcctgattcagctagcgatagtaacatctttagcggttccctgagattccttcagttattcctccgagactgctccgatagaattcccaaacgtcagagagacggagaagagattgaaacctccacttgtactgtcttcatgcgattcctttttctccctccaagaatattatctcaaaaatcccaacggtaa

SEQ ID NO: 40264 - DNA, 159 bp, Glycine max
  Peptide Sequence Number=SeqID_157042
atgagtactactaagttatggttcaatggactctgccaactccaaattctttcaaactgtacattgacggaagttcacttggctataagggagtacattgcacttgattggaatattactttctctcgcacctgggaagaaaatagtcgcgccaactag

SEQ ID NO: 40265 - DNA, 426 bp, Glycine max
  Peptide Sequence Number=SeqID_157043
atgcagaagcatatcaccacatcactattgtgtgtcatccatgacgaagtggcatgtatgcaagagcatgatgctcaaaatccaggtcggacaactccctggtcaatcctcttaagggcttgcaaaactcaaggtccgtccttggcgagtcctattgattcaccccactatgtctccaatatgtgccactttgtaagagacacgtatgcaagagcatgccaatacgtctctagtacatgccacccacaacgagtgtcatgtacagaagagcacaacacttgcactgcacgcaagactcgtcaaacccaagctctgcatttggcctatccttggtatgcctcgacacgactccgaaggtttgacaaaacccggggcaaacacgtcctcggtccaaggctcgacaaacccatggtccacccttggtga

SEQ ID NO: 40266 - DNA, 348 bp, Glycine max
  Peptide Sequence Number=SeqID_157044
atgagtgaagattccagattgactcaagatgaaccaatcatccagtcttcattgttgaagacccgagcattacgcgccttccaaagaatccagcacgtcatcgaaaataaggaattcccagacccaagagttgtaacttgcagaagttctaggggtaaccaaagttcttgtgagccaaccataagttgttttggtggaaaaagactcatcttgagcagcctcccaaatgataacattaggagtattgtcattgagaaagatactgttgaatttttgccttatgtcaagtggaattatcatagcaacctcgttccaatgccaaatcacattccgaaagatgtcccttaa

SEQ ID NO: 40267 - DNA, 642 bp, Glycine max
  Peptide Sequence Number=SeqID_157045
atggctctgacaaagctttccacgaagaggtctaggagagacgtcatggtggaagggtccagtgccgcccccaagtttgatagccaccattttcggagcgctgagcaccagcagcgcttcgaggccatcaaaggatggtcgttccacagagagaggcacgaggagatagctcgcaggcattggatgtcgctggtgactcctatggctaagtttgaccctgagttagtcctggagttttatgctaatgcttggttcacagaggagggagtgcgagacatgcgttcatgggtaaagggtcagtggattccctttgacgcagatgccctcaaccaattcctgggtgaaccgctagtgttgcaggaaggccagcagtgcgagttcagccagagaaggaacagggctgacgggtttgacgaggaggccattgcccagttgttatgcacaccgggacaggatttcgcccggaccgctgcagggaggcgggtgcagatcatgcgcaccagcatgaccactttgacccagacatggatggcattgctgctcagcaatgtcttgcctagcgatcataactctgatctctctctgccgaagtgccagttggtgtatgccatcctgacacggatgagtgtccatgtggcccag

SEQ ID NO: 40268 - DNA, 1047 bp, Glycine max
  Peptide Sequence Number=SeqID_157046
atgggcgacagcattggccgtaagaaggtgctgttcattaccatcatcatgatggggatctgcaccacgctgattggcgtcctgccgacctacgcgcagatcgggatttttgccccggttctgctggtgacgctgcgcatcattcagggcctgggcgccggggctgagatctccggggcggggaccatgctggcggagtacgcgccgaaaggaaaacgcggcatcatctcctcgctggtggcgatgggcacgaactgcgggacgctgagcgcaacggcgatctgggccatcatgttctttgcccttgaccgtgaacagctgctcgcctggggctggcgcgtgccgttcctcgccagcgtcgtggtgatgatctttgccatctggctgcgtatgaacctgaaagagagcccggtctttgagaaagtgaacgatgcacaaatcgtgcagccggacacgtcgctcggttccatggtgaaaagcaaatccttctggctggcgacaggtctgcgtttcggccaggcgggcaactcggggctgatccagaccttccttgcgggctatctggtccagacgctgctgttcgataaagccatccctaccgatgcgctgatgataagctccattctcgggtttatctccatcccgctgctgggctggctttccgataaagtgggacgccgtctgccgtacattattctcaatatctccgccattctgctcgcctacccgatgctgtcgatcatcgtcgataagagctatgcgccggggaccatcatgctctctatcatcgttatccataacttcgcggtactggggctgttgcgctggaaaatatcaccatggcggagatgtttggctcgcgaaatcgctttacccggatggctatctccaaagaggcgggcggtctggtggcggtgggtgattggtctggtctcggcctgcctgatgcccgaagtgcgggatcgtgatttgagcgcagcggaagatgctgcggaggccacgccaaaagagcctgtggcctacggcacggtatcgtcacggcggtaa

SEQ ID NO: 40269 - DNA, 237 bp, Glycine max
  Peptide Sequence Number=SeqID_157047
atgagtagttgcatcgataggacaaatgtctcttgtgcgaccaagccttacattttgcatgtcattctcaagctaaggatttggataatcgtgatgatacaccaattgacaccaacaaatatgaggttcaacaactaccctaatgttctttggaatggagaggctcttgatacttttctcccttcaagaggagttttgcagggtgaccctatatcctcttacatttcagtgaattaa

SEQ ID NO: 40270 - DNA, 198 bp, Glycine max
  Peptide Sequence Number=SeqID_157048
atgaattttaacccaaatgtattgaagctgcatcaccgacaagtcaattgtggttcctccgttgtggaatgtaatggtagtaacgtcattttgtcggtcacgatagtggagttcaccttgaatgatgccaatggattggatttcttcaacgtgaatctcgtcaaaggttataacctctccatgattgtggaaccatag

SEQ ID NO: 40271 - DNA, 631 bp, Glycine max
  Peptide Sequence Number=SeqID_157049
atggtgggctcagtgccttgtttggcctttttctatctacttgccttgtggaaactgacacccaccaacactaaaatttattcatttttatttgcaacacttgccaatgccccagcccgcagcagcaccatcaataacccttcttcaatggagcccccagttctcagtttcaatagcaatgacaccaccaacaatggcaactgcaccactgactttgatatcattacctggtttgaagacgtttccaagaacgctggttctgttcagattcagacactctgcaagattcttaagcagaactatggggttgaatatctaaagacatggttggggagctacaatatctcagaaatggatgcatgtgccttggaatctctttttacttctgtggttccccttgcttcacatgcagatttcgagccatatatccaaaaaattgcagatggagacacaggtcctatactcacacaacaacccataaccactctctccttaaggttatgcagttctggaaccacagagggaaggcagaagttcgtaccctttacccgccatagtgctcaaacgaccctgcaaactttcactttagcagcagcctatagatcaagggtttatccgacaagggaaggag

SEQ ID NO: 40272 - DNA, 648 bp, Glycine max
  Peptide Sequence Number=SeqID_157050
atgcaactggaaaataggtcagtgtttgaatatttgcttcaaattcagtctcttgttgattttgttggttcgattggagtgataatttcttcagataagcatcttgatgctattcttaagggtttaactagggaatatgagtccaccatgtcattgatatgtcatgaagctaggcttgataaatttttaaaatgggactctctcgttactgttaatctgactcaaggggcttccacttctaatagatctattaacttcactcaaggggcttcaacttctaacaattttgcttatgttcaacctgttcaagttgttcaaaatttgccaagttcttccagtggcaattccaatagtcagtcctttcatgcccaagctcatctcactcgagggaattatgataattccaatgatacaaacaatggaaataggtttttcaattatggcagaggtggtggtagtggttacggtggctgcatcaaagatctcaacaattctgctagacgagatggtcgtgacagaggattaaaaaacactttagtaggattctcagtgcccatcaaactatctcttcctgatgatggagaattagaagacacttcaggaggattctcaacatacatctcatcatcttttcctgatgacagatga

SEQ ID NO: 40273 - DNA, 255 bp, Glycine max
  Peptide Sequence Number=SeqID_157051
atgggtggtggagtgactgagatgatgaagaacactagggtgagtgaaactctcgcccttcagtctgccgtgacctctaaagtctgttgcaagctctgtcatgcccacactactctatctcactctcgtcctaccgtcatagctagtgcattccctctattgcttccaactgtgatggaagcttgcttgtggggcttctatggagatgcagcggaagacaaaggagaagaggtgagaggaggcgccatctactag

SEQ ID NO: 40274 - DNA, 351 bp, Glycine max
  Peptide Sequence Number=SeqID_157052
atgaggctggaacaaggttcccattcttgtattccaagagccattgattcacatggagcatttgccattttgtacagtcgccactcaaagcattatattaagaaacctgaggtatttgagcatgtaaacaggttttacttggatgggcaactgaaagtgttcccgtggacattgacttgggcaaagaaggacatggcaatgcaatatcttgacgtcaacaaaataacgcatggtctttcttactgctgtaatgttgttttagataagagaaatgcagaaaacaaaagttctgttgatacatcagtagttctccccatttttcctcctaattttagcttcaaagagaaatga

SEQ ID NO: 40275 - DNA, 641 bp, Glycine max
  Peptide Sequence Number=SeqID_157053
cttttgcctatggcatagtgcaagcattttgcactttcgaagaggtttggagagacctttgcaatgacataagagatggcactttgagttcaagaatcaagttaccccaaatgagagaggctgttttgggtacaataacttcaaacccctctttggcctcaaaactagaagaagcttgcttggagctagaagtggtggattggtttggtttggttccaaaactttggccaaatgccaagtacctttattccataatgacaggttctatgcaaccttatttgaaaaagcttaggcattatgcaaatggggtgccactaataagtgctgactatggttcaactgagagttggataggggttaatgtggatccttgtttggctcctgagaaagtaacctttgctgtagtaccgacgttctcttactttgagttcataccactttattatagacagaaacaagatttcagctcagtagctgatcatgatttcatggaagacgagccaatcccactatcccaggttaaagttggccaagagtacgaaatagcgctcacaacttttactggtaattattcattcattcttcttctcttctataaaataataccgcctcctgtcattcatatatataactatgtatga

SEQ ID NO: 40276 - DNA, 466 bp, Glycine max
  Peptide Sequence Number=SeqID_157054
tttcaatattgccagaaacccctcgctcgaacccacaaaaccccctacactgctcttggaagtgtggatcgaagagaaccctacatacactcttggtactagggtgctgaaacacttgtgggtgctcaaagctcaaagctttctccgcgagtattgttgtatgaggtacgaggaaagcttcaagtttcgtgccattttgttagatctcactgccattgtcactatttgggttcgagggtctgagcagaaagttggtccatctattgtctgtgttgctttttctagtttcttcggcaattttcagtttacgtgtgtgaactgcaatgcattgattgctggtgttgctgcaatgtttgaatgttttgatgtaattgctaggatagcaataactccgagttgtagtcaattgatgaatactaaagaaatgcagagaaaatgcttgactctttctcatcatgctgactaa

SEQ ID NO: 40277 - DNA, 999 bp, Glycine max
  Peptide Sequence Number=SeqID_157055
atgatatcggagtttatactagtaattgttgttgagtctctcaagccacccgtatcgaattaccacaaatgtctaatcttgcaaatttcattgtctaaatgtctagtaccaggcctgagggagggttggaccctttatgagattgtaaggtatatacctgaacacaattggattgcctatgagcaagctctgaaagcaaacccagttttggctaaaatggcaataagtgggattgtctactcaattggagactggattgctcagtgctatgaaggaaagcctctttttgagtttgatcggacacgggtactcagatcaggtcttgttgggtttactctccatggatcactttctcactattactaccaactttgtgaggctctttttcctttccaagaatggtgggttgtccctgctaaagttgctttcgaccaaactgtgtggtctgcaatttggaacagcatctactttgtggttttgggcttgttgcgttttgaatctttgactaacatatatggagaactgaagtcaacattcttgcccttgcttactcaaagtgaacaaatagaatctactcaatctagagaaggtggtgtacctgtaaatgtccactgtgggaatgggcttgttgcagattgcccatttggtgttatagaaaccaaaaaaggaaaaggcagggtggaaactttggccttttgcgcatctgattacttatggtgtgattcctgtggaacaaaggcttctttgggtggactgtgtggagctcatctgggtcacaatactttcaacgtagctattcaaatgagaaatcagaagctcgaatatctgaggcagcatcagaaacagggtcatccacttcaagcgaaaattccaaggaataaacaaattgagaataggagaaaaaatcaatctaggttcatggcagttgcaaaatcaacctcagcaatgaatcaaagaatctatcagttgaaggtccagttgagcgacctgaggacatga

SEQ ID NO: 40278 - DNA, 339 bp, Glycine max
  Peptide Sequence Number=SeqID_157056
atggagagtgttggttggtgggggcgagggagagttgctattaaggatccatctgctccccatggagttcgacttttgattgaggactatccttatgcttctgatgggctagagatatgggatgctatcaagtcttgggtggaagaatatgtctcattctactacaagtcagctgaggaacttcaaaaagaccccgagctccaagcttggtggaaagaacttgtagaggtgggtcatggggatttgaaggataagccatggtggcaaaagatgcaaactcgtgaagagttggttgaagcttccgctatggattgcttcagctcttcatgctgttgttaa

SEQ ID NO: 40279 - DNA, 720 bp, Glycine max
  Peptide Sequence Number=SeqID_157057
atggcacttgacacatgtaaggaactcatggatctttcaattggggagttaacaaggtcacttgatggaatagatacttgcttggatgggtttgagaacatcactagtgaagttggtaaaaagatgaaagacttgttaatgacaagcatgcatatgagcagcaatgctcttgccattgtatcagaattggctgacacggttaataattggaatgtcacaaaatcacttgggtggcgtctccttcaagattctgagcttccttcttcattcaaacacaagcctaatgttactatagccgaagatggaagggaatatttcacaaccatcaatgaggcattgaagcaagtacctgagaaaaaccgaaagtcattcttgatctatatcaagaagggcgttcaccaagagtatgttgaagctacaaaggaaatgacccacatggtgtttattggcgatggtggaaaaaagacacgaaaaactgaaaacaaaaacttcattggtggaattaacacttatagaaaccgtcattattgtgagattgagaataaggcttaccttgctcgtccatggaagaattactctaggaccataatcatagaaacttacattgatgatttaattcacgcttatgggtatttgccttggcagggactagaggacccttctagtataaacacttgcttctatgttgagtaccacaacacttgtctcgattcaaactaa

SEQ ID NO: 40280 - DNA, 1425 bp, Glycine max
  Peptide Sequence Number=SeqID_157058
atgggctgttgtgtctcaacaagcagtcagagtacttgtagtagcaggagcaatggagacacgatcgctccaacctgtctagagattggattctgtggtcaaaagagtgcaaggagaacatcctctgatcatgttgtgtctctgcatcaattaccctcattaccaaacagaattttcaccaatggaaagagcaggtcttcttgcatatttacgcagcagggtcggaagggtattaatcaggacgccatgattgtgtgggaagatttcatgcccgaagatgtaaccttttgtggtgtctttgatggtcatggtccacacggtcaccttgtcgcatgcaaagtcagggaagccttgccgctgaaacttctttcatttttgcattcctccgaatcagggcaaaatggttcaggtaaagcttgttttaggggcaacataaagcctgaaagtggagaatctgagaaagatttgtctgctgaagataacgaaaattctatgtggagagaagctttcatgaaggcatacaaggctatggataaagagttgaggtctcatccaaatttggactgcttctgtagtggaagcacagctgtcactatagtgaagcagggttcaaatttgttcatgggaaatattggggattcccgagcaatcatgggatcaaaggacagcaaccactccatggtggcaattcagttgaccattgatttgaaacctgatttgccaagggaagcagaaagaatcaaacggtgcaagggtagggtatttgcgttagaagatgagccagaagttcatagggtatggttgccttttgatgatgcaccaggattagcaatggctagagcatttggagatttttgcttgaaggaatatggtgtgatttctatacctgaattttctcatcggctgctaacagacaaagatcaattcattgttcttgcctcagatggggtctgggatgttttgagcaatgaagaggtggttgggatagtatcttcagcgccaactcgatcatcagcagcgaggattctggtggattccgcggccctagagtggaaactcaaatatcctacttcaaaaatggatgactgtgcagttgtgtgcctatttttggatggaaaaatggactcagaatctgattgtgatgagccatgcttctcttctgcaaccatccagagcaaccattcagaaaatccggttgagtcagatgacggtcaaaagcctgagccatctttgcgaaggaactttactgtgagatcctcagaagaaaatgaaacctgtggaggaggagttggaggggtatttgttgatgttgacgatggaacatccgcagccgaagatcaaaactggtcaggtctggagggtgtcacgcgagtaaactcactggttcaacttcctagattttctgaggaaaggccaaactcttga

SEQ ID NO: 40281 - DNA, 717 bp, Glycine max
  Peptide Sequence Number=SeqID_157059
atgtggacacgtgagaaagtggatctaaaccttaaaaaccattggttgctttctcatccaaaaaccaaaacccaagataagacgataaggccacgtggcaaaaacccaacattcctcttcttccttctcagttctcaccaccacaacacaaaaactctcacctttctttccctcacgtctctctctcacatcatcatggcctccccaacactaataacccccaaatcagtgaaatcactcacacccatcaagcccaaacccaccaccaccatcgccgccactctcacaccacccacaacaacctccaccgccgccgccacccaccctcgccgccgcgaattcttgtccatcatcaccgccaccacatggctggtccctctgagcccggcactggcttcctcggacgaggaatacatgaaggagaccgaggaagtgatcaacaaagtgaggacaacaatcgtgatggacaagaatgaccccaacgtggcaaccgcggtggcggagttgagagaaacctcgaactcgtgggtggcaaagtacaggagggaaaaagcgcttctgggacgcgtttcctttagggacatgtattccgcgctcaacgctgtttctggtcactacattagcttcggaccaaccgctcccattcccgccaaacgaagggcaaggatcttggaggaggtcgacactgctgaaaaggcgcttctaaggggaagataa

SEQ ID NO: 40282 - DNA, 330 bp, Glycine max
  Peptide Sequence Number=SeqID_157060
atggcttgcaaaccttcttctttccttgcacttcttctcatcgccactatccttcttgccactacatggcaagcggtcgctagacgccacattattccaaaacactcaaacaaaggggacaagaaagagcctcaatttttgttccctccggaagggctgccacctttctttgggtttacacctcaaagcccaaacactggtggtagtggactagggtcaggaccactaggtcgtggttatgttccaggtggtgatgacacctttgtcccaaaccctggttttgagtttccaaaccctggcagtggtggtggagttccagttaatccgtga

SEQ ID NO: 40283 - DNA, 540 bp, Glycine max
  Peptide Sequence Number=SeqID_157061
atgacagaagaatatgactccttcatgaagaatcaaagttggaaacttgtggaaaggcctaaaaagcaaagactcataggatgcaagtggactttcaagaagaagcctaagattcttggtgttgagaagggcaaggatatcagagaagcaaaaaggattttgggaatggacattgttagggacataatcaaaggcacaattcatttcagtcaaggaagctatgttgagaaggtcttgaaaaagtttaatatgttcaatgcaaagccaatttctactcctattgcagggcatttcaaactgtcactaagtcaatctcctagcaatgaagaagagtacaaattcaagagtaatattctatatgcacatgcaacaagaagcctgatgtatgccatggtctgctcaataacatatatagcatatggagcaagcctagttagcaagtttatgggaaatctaggaaacgaacattggatgacagtcaagtggttgtttagatacttaaagaagactacaaatattggattgaagttcagcaaataa

SEQ ID NO: 40284 - DNA, 813 bp, Glycine max
  Peptide Sequence Number=SeqID_157062
atgacagatggatatgacaattctgatgttcttattgtcactgatcagccatgtagtgatgaatggattctagattcagggtgtactttccatatgaccctgaatcaagagtggtttgacacctacaagaaagtggatattggaagtgttctaatggatgatggatcagttaaagtcctcattgaagttaggcatgtgcttgagctcaagagaaacttgttatctcttggcatgctgggtgaggctggatgcaacttcaagggagaaggaggtacaatcatcattagcaaaggatccaatcagattatgaagggaataaggaagaatggtctctataggtttgatgagttcaatgagtttcacaaggataaagggataacaaggcacaagacagtcagattgacccctcaacataatggactagcagagagaatgaatagaaccattctggaaagggtaaggtgcatgctatcgaatgccaagctcatcaagcaattttggggagaaactgctcatacaacaacatatatcatcaatagatcaccttctgtaaccattcaattcaagacaccagaagaactctggaaagatatgccaccaagcctcaaacacttgagaatttttggttgcgatgcatatatacacaccaataagggaaagttagaacctagatcaaagaaaggtatcttccttaggtaccttgatggtgtgaaaggctacaaagtttggattattgagtctagaagaggaaaggcagccacaagtagagatgttgtcttcaatgaagaacacatgatgaagggcgatgagtag

SEQ ID NO: 40285 - DNA, 231 bp, Glycine max
  Peptide Sequence Number=SeqID_157063
atgacttatgcaaatgcaagaatgacatgttcattatgttggcatgaagagatgcatgatgtgatcaaggaacaagccagagaactatcagtgacaatgcatcaccaaaagaggaaaactctagatgaggcttcactattatcaagcgagtcggagactcagcatgactacagatcaacctccactccctatggctcacacagacccgggtataggacccaacatctaaag

SEQ ID NO: 40286 - DNA, 456 bp, Glycine max
  Peptide Sequence Number=SeqID_157064
atggatgttgagcatgtggattatgcaactgatgagatttatgagcagcctcaagagacaattgcttatgatgtagttgctgatgcccagggttttccaggcggaccccatgatacattagttttgacgaaatatgaacatcctaagttgaagttgtcctctcatggaaggagagtagaaaaatttggaaggtctgctccaaatattgaaggcatagtggctaccacaagattaagtcctctgattgcatgttccttggatactggagaggtcatcatcaccctcaatgatgtggcatcattgttacatcttcccattacagacgcattctatacctttgatgctcttcatgtaaaccaagtcatggactggttagttgagttgcttgaagtcagttcacaagaagcaagagatgagacatttcaatgtcatggggcatatgttcgattatcctag

SEQ ID NO: 40287 - DNA, 522 bp, Glycine max
  Peptide Sequence Number=SeqID_157065
atgaagggacttacggcggagacaatgacaacgtcgacgttgacgacggggcactcactagcggcacgacgtgaacggaggaatgaacgacggcctcttgatggcgtgaggaagcaaaatacaaaaacgaagaagaggaacattagcaggaatgtggtgtgcgtacaaaatataaaacggaaacacgcttccatgaataaaatcaacaacggaaatgtgtttccattttgtattttgtttgcaccccctatactacaatgggaacgggtttccattgtggattttatttctcaatccgtaatagacacaacttctttcttcaacaccgttctcgaccccgacaactacctctccaagctcctcaaacttaattcaatggtcaacctccaccattctcttgaagccaaggacattgccgagaacacccctgagtcacgtgttatgttcggtgatggtgccacccatggtgaagaggaagatggagagacgaagaaagtgaaccagatgaaaaggataagatag

SEQ ID NO: 40288 - DNA, 201 bp, Glycine max
  Peptide Sequence Number=SeqID_157066
atggcaactccactcattttctccctaggagatgaacgtattttctatcttatttttctttcatcgtccagtcgtgaggtaggttgcgacaaagctatcattgcaccgcctagggataggcctattttttcaggaggaggaagaatagacgaggatgaagacatggcagaccccactgattattacattggaggagattga

SEQ ID NO: 40289 - DNA, 1380 bp, Glycine max
  Peptide Sequence Number=SeqID_157067
atggtcaacacctcaattcaggacatcaccttcacggtggacctccatattttaccgttaagtggtgctaatgtcgtactaggtgtacaatggctaaagtctttgggcccaattctcattgattataatgctttgtccatgaaatttttccacaacaatcgcatagtcgagctaaagggtgatgttgaatctacacttcatctccttacaccacctcagtttcgccgtctactccgtaaagaaggtaaacaagaaattgaaagtcaggttgatgccatgttacagaaggggctcattcgccttattaccagtccattttcctaccttattctcttagtcaagaagcaggatagaacacagacattttgcatggactatcacgcactcaatgtgataatgatcaaggatcattttcccattcctactattgacgaattactagatgaattgggaggggagggggggagaggagcgagttggttctacaagttggaccttctacaaggttgccatcaaattcaaatgcataaggatgatgtctacaaaaatgtgtttcacactcaccatggccactatgaatttaaggagtcgaaccagtatcctctaaggtacaggccattcaacaatggcccactctgcaatccactagagccctgcatagtttcttgggtctcgccagattctaccacaaattcatttgaggattttacacttctgcttacattggaaatggacacgtcaggcattagcatgggagcagtcttgtcacataagggtcatccaattgcattctttagcaaaccattcaccattttgactgatcaccacaatctccaggagctaatgacgcagggtggcaaggctcttatgtcctttagcgatgccttgtcagccatgggaggacctttcattggacttcattactggtttaccaccgtttcgtggaaataccactatacttgttgtcatagaccatttttcgaagggcattcacctggggatgctaccacaccatcatatttctcattcggtagcagtcctattcatggacattgtcgaaaaacttcacgacatgccacggatgttcagttcaaaataggggaatgggtcatggttaaactccagccacaaaggcaatcatcggtttcgggtctacacacgggatattcgaagcttgctaaaagattttataggcccttcaagatactagataaaattggtccagctgcttataaacttcaactacccgagggtgcccgtattcatcccatgtttcattgctccatgctcaaaccattttgtcaacctccttcgaatgacaatgttgccccattaactttatcactccactggctattgtgggcactcaaagaaacttag

SEQ ID NO: 40290 - DNA, 273 bp, Glycine max
  Peptide Sequence Number=SeqID_157068
atggagactggcagaggagtgaggaagagagaggatcctagtttgttgtgggagacgctattgtcactgctgatggcagaggacatggaggaggagttggagaagacaatgaagatgttaggttttgtgaaatcaaaggttatactatgtgactgcgaaggggaaaaggtgactaggttagctggtaggcgagaatgttggaagtggaagggaggggtgcacgcaaaaatgggcatggttggtgtggcgtttgagaaaggatcgatgggatag

SEQ ID NO: 40291 - DNA, 696 bp, Glycine max
  Peptide Sequence Number=SeqID_157069
atggacaatgtcatggccatcaagagtatgatgagaagctttgagatagaggttcttgactcaaagtatagggattggagaggactaaattctagtgagtctctttcttatgagtcggagtggtggaggaatttgaaaaaatcatgtggggtgcatggtgaaggtgattggttccataaggggataaaatggaaggtggttgatggatctaaaactttaatttggttggataagtggcttgataatgagtccttggctgggattggtgataaactcggaatcaaatcaattggttgtcaatataggcgtgtggtcagaattgggttgggaatgggacttcaaatggcgttgaaactgcactctaaattatactcaatgtgcacggcgtacaagttgattcatgacatcaaggtgggatctggtgatgtggagataaatggttgtaatctcaaagaaagacagattggtgtagagaatgacaaccatctgtgccatttttgtgtgacttggaatttatggaaccatatgaacaactgcatctttagaggagctgtgtttgacatcaactcagttatggatacggcgttatatcatgcatatgagcatggttggaagcctatgacaaagacttcattctctccttccagcaatggtcgtgtaatgtgggtgcttgcgtccttaaatagttgctgctaa

SEQ ID NO: 40292 - DNA, 366 bp, Glycine max
  Peptide Sequence Number=SeqID_157070
atggcgttgggaaaagtgtatgacaatttgtccactatacataatgtcctttatgcagatgatgtggttagggtgagtgttgtcaaagtttaccacagtgacactgaggtcccttttccaacttcagagattcgatttgtgaggatttacaaaagcatcaaccaaaaccggttggatctactgaattgcacaatgcagtggctggagttgatccattgggagaatcggtttatgaatgattggagtgcaagcttagggtatggttcactttatggtttccttgagcctcagtctatacacaacgcaaaggacagacatcaagaatgtcaacattacattgaaacatgggttaaggaatcacaatga

SEQ ID NO: 40293 - DNA, 924 bp, Glycine max
  Peptide Sequence Number=SeqID_157071
atggggaacgttacggatatggaagtaggatcagtctcatccagtgttacttctattgctgctactggcagtggtggtggtgctagagatcctcagatacaagaaagggcgatcaacttggaaacaaacttagaatctgagagaaagatacaaagcttgatggaatcttacttgaaatttgaacgacaaaagcaaagattaatggaattagatttgaaggttgagaaggaaaggctaagattaacagaactgaaactggaagctgataaggaaagacgaaggatcatggaagatgcattgctttctctctttcatgaaatgcttggaagggtcactcaagagtttgctggcatgctttctcaaactcagttgctactttgttctcgaatgaaccaaatgaacaaagtgaagatcaggctttttgtgatgtatctagagagtattcctgaatcagttacgagtgttggtttacagggtctagatgacgacgcatatgccaaacatccattgtctagtgcacctgaaccaaaaagaaggtctattccttcaaagtgggaagctaaaaaggtaaccaatacttcatttacaacaatctgccagggattaatcacttttgacaagacaaaagaggaagatagtccatatctcttgtggggagatgattctggttcaacggaaagagcaaatcatttgacttacattcctgccccaaaccacaagttacctggccatgaagatgttgttacattaatttcactcgaagcttcaggacaatggatggcttcaggtgggatggagatgggtcccttattttctgttatcttcaatggctcaagtgatggaactgtttgtatctgggaggttgaaactggcacatgtcttaggcagtgggaggttgatgaatctgttagttgtgttgcttga

SEQ ID NO: 40294 - DNA, 2496 bp, Glycine max
  Peptide Sequence Number=SeqID_157072
atggctaacactgagaagaatcccaaggagaaatgtaaggttgtgcttacaagatgcaaaaggaagaagggtcttattggtgaggagttagtggagggggtagtagaagatgtgagtgatgaggagggagatgagagagatgatgaggtcttagcttctaagatcaagagtcggatggaaagggaagctaagaagggagcacctattgcccctactaagatttcccttatcccttggtttctcgatatctttaagaagttggagatcaccattccttttggtgaagttcctcaacatatgccaatgtacatcaaattcttgaaggaccttctcactaagaaagacaaatacatcaacaatgagagcatagtagtggaaggaaattgtagtgcagtgattcaaagaatcttgccacaaaatttcaaagatcccaaaaacatgacaattatgtgcttaattgggacgatgtttgtagggaaagctctcatcgatctaggggcaagtaacaacttgatgcctctttcaatgtgccagagaattgataacatgaagatagtgccaactcgaatgaatcttcaactagcggatcactgtttccctagaccttatggtgtcgttgaagatgtccttgaccaaaaggtgaccttcaatctctttgaagtaatgaagcatcctagtgatagcaaaacttactttagagtgaaggctattgaacatgaagcaaactatgttgtgcaacaattcaccatgcatttacctcttgaaaaagccttagtgaatgccatcgaatgcctcatgaatgaagaagagaaagatctcagggcttgcttggaagatctggataaattgaaggaaattcctccagggaaatatacttttgaggagccgaagaaggatactcttgcagagaaacctatggggattagtccatcatattgcacgcacaagatcatgatgaaagctgactatagacagatgaggaaacctcaaaggagacttatccccaccatcaaggaagaaggtggcatgacggtgatccacaatgataaaaatgatctcattcccacaaagactatcaccgactggagaatgtgcatagattgtcgcaagctcaatagtgccacaaagaaagatcattttgttttaccattcatggacctgatgttggagcggctagctggacaagccttttattgtttcttggatggctacttgaggaggatgccatgtaggttgtgtaatgcccttgccatttttcaaagatgcatgctagccatttttgttgatctcgcagagaacaatcttgtgctgaattgggaaaaatgtcatttcatggtccaagaagggattgtctttgtccataagatctccacaagagggatgaaagtggataaagccaaaattgatgtcatcgagaagctacctcctcttatcaacgtgaaaggcgacttttccaagatagccaagccattgagtaattttccgaacaaggatgttgtgttcaagtttgatgaggaatgtttgttggctttctgcactcttaaagagaagctcatttatgctcctatcattcggagaaataaggtgtttcattccatatattatgctagcaaagtcctgaatgatgcacaactgaattatgctaccatagaaaaagaattgctggccattgtctctgcactagagaagttcagatcatatttgattggctccaagtttgactttgagatcaaagacaagaagggctgtgaaaatatagtagttgatcacctttctagattggtaaatgaagaagtcactcttgaggaaaaagagattcatgatgaatttctagatgaatacttgttgtgtgtgagtgagcggccttggtttacagacatagccaatttcaaagcaattaataaagtgtcaccaaagagaaacccagaagtatattgtggcattgccacaattcaccttatcgaggacattgaactattgcgaaagtgctatagttcgggttcttttggccttatatcttcaaggatgctcgtgagcatgtgcaacattatgatcagtgccaaagaaccagaggcatttccaagaggaatgagatgcacttgcagaatattattgaggtggaggtgtttgattactagggcgtttgattttgtaggccccctaccatcatcatacactaatgaatacattttggtggctgttgattatgtctccaaatgggtggaagctgttgctactcagaaagatgatgccaaaactattgtcaagtttctcaagaagaacatcttctcccattttggagtcccaagagtgctcatcagtaatggtggatcacatttttgtaatgcacaactacaaaaggttttgggacattacaatgtgagacacaaagtagcttttccctaccacccccaaactaatggccaagttgaggtttccaatagggaattgaagaagatccttaataagacagttgctttttcaataaaggattga

SEQ ID NO: 40295 - DNA, 300 bp, Glycine max
  Peptide Sequence Number=SeqID_157073
atgatgaaatatctgccttccccttggtggtcttggattctagaaagaaatattggccgcttgcacatccgatctcacaatactagtgaagtattatggcattgtggaactcgagtaatcttcaagcgtcactctaggtggcctttcttccaccattggaggcttctcaaagataggaggagcaatggacactatcgattcctccaagataagtggatgagtcaaagatggtggaaaggaagaggctcctctttctccttgcctaacttgcttctcttgttgcgtttgtttcctccttga

SEQ ID NO: 40296 - DNA, 279 bp, Glycine max
  Peptide Sequence Number=SeqID_157074
atgacaagtcgatggcaccatcataccctaatttcgtccggggaccatccgttgttgggatgcgcccctcgtttgaccacttcgagaaaatccaagccgagacgctttcgtgacgtttccgtgggtgatttcgcgaagattttcaaccgttcttcgtcgttcttcgttcgttcttcgtcgttcttcggtcttcaaccgatttctaaaggcctaaaatcaacatgtaactttattacctctttcaaaaataaagagatcattaatggtccaatgccttaa

SEQ ID NO: 40297 - DNA, 258 bp, Glycine max
  Peptide Sequence Number=SeqID_157075
atgacccttcacttagcgaacatgcacaacttatccttcttcgagattcttcctcgcgctcagtcgaggagggttgcgctcagcggatggctcgctaagccagcagattggcttagcgagaagacacctagtgtaagctggattaaagatgataaacatatgggtttaaagttaaggcactttaagattgttactgctgtagaatggcaccagaaaggtgactacttttcgacagtgatgttggaagatatcctttga

SEQ ID NO: 40298 - DNA, 189 bp, Glycine max
  Peptide Sequence Number=SeqID_157076
atgatgaatccagcttcccgaaccagttcatgcagctcgaaccacggaatcgaaccgaatcaagcgacgattgagaacgattctgcggaatcgcgatcctcggcggaaaaacgagaagagtttgttcgaaaagctcgtcattcgtcccatccaaactgcaccgtccagttcacgcgcttgagagggtga

SEQ ID NO: 40299 - DNA, 867 bp, Glycine max
  Peptide Sequence Number=SeqID_157077
atgaatctctttcaagaagtacaacctctaatggcagaaaaagatcaacatctggacacctccaaccaagctcttactaccattgcttacccacttggtttgcacatctctaaggccactaaggccaagattgttgcagatagagtttgcctttgtctacccatatgggatgcaacaaagaataataaaggcttcaaactatatcattatgttgagatgccttgtagggagatgaagatagaagtgaatttgatacaagacccaaatgtgtttgacacaaagaccttatggaatcagattgtgtggaatgacacgttaaaatcttcattgttcggctatgatggaagcgataatgctaaacatcctgacttcgttcaagatgttgatagctatgccgttatcactaggttgaagaaccttcccatcatcttccatgaaactactcatgatcttacaaagatggatgaaaggaactctagagatcatgtgattcaactctataatgctcaaaagacaaagcgagataaatttgaaaaagatatagctactgcaaaaactgataaggagaaagctaatgctaaagcacacattgaagttgctaccaaagctatggatgacatcattgttaatgaggtgtccaaggcggctcaagttgatgaagctataaaacaacaacaagaacctgtgttcaagcattcagagacctcacatgaagctacatccaaagaaagggacgctccagatgcaatgattgcctattccataaactcaggtcctactcctatcaactatgcacctccaaacgttgtaaccataaatcaagttcaagatatgattggtcaagccatggacactattgctaagtga

SEQ ID NO: 40300 - DNA, 240 bp, Glycine max
  Peptide Sequence Number=SeqID_157078
atgttgattggtgataatccgactaagggcattttctggttagatcgggggactcacaagccttacttggcattcctgactagagcagagttgtatcatggttttgtgttagacttaacgtccatgtttgtggttctaaaagggatggagtactcactcctttattatgattttaaggaccagataacgagcctgacacgacatcccccattctacattgatgttattgataccaagtag

SEQ ID NO: 40301 - DNA, 309 bp, Glycine max
  Peptide Sequence Number=SeqID_157079
atggcggtaatggatcttagccttgggaatcccttatatcgaaagtcttcctggtgggtcatttctgaaagccatagtgcaatcagagagcatagcagatgtggtgtcaagtatctttatgtggttgctcatggcttattggtgcaaatatctctgatgtttactccactcaattccccaacaatggtatcagaaccgatggttcgacttggtgaccgactcaaacgagtaagatggcggcaatggatccttagcttggggatccctctggcggtggaccatgggtgtagcaacggtgcgagtacctag

SEQ ID NO: 40302 - DNA, 1104 bp, Glycine max
  Peptide Sequence Number=SeqID_157080
atgcttttctcacccttcctcactctcactttcttcctcctcttctcttcttccgttgctgcgatttactcagcggcaacatgttctaacatagtgccgctgagataccgcagcgacagaatctccataacggacttcggtggtgtcggcgacggccgcacgctgaacacgaaagcgttcagagcggccgtgtaccgcattcagcacctgagaaggcgcggcggcacggtgctttacgtgcctccgggggtttacttaacggagagcttcaacctcactagccacatgacgctttatctggctgctggtgctgttatcaaagccacgcaggagttggggaattggcctttaattgtgcccttaccatcgtatggaagaggaagggagctccctggaggaagcaatgttgtggttcgatatgtcacaattttggctcctcgtgactctcctaatactgatggaattgatccagattcaagttcaaatgtctgcatagaggactcatacatatctaccggagatgatcttgtggctgtaaagagtgggtgggatgagtatggtattgcgtacggtcgccctagctacggtatcaccatccggcgtgtaacagggtcatctccatttgccggtattgcaattggcagtgaaacctctggaggggtggagaatgtgctagcagaacacatcaacctcttcaacatgggagttggtatccacatcaagaccaacagtggcaggggagggcttatcaagaacataacagtggctcatgtgtatgtggagaatgcaaggcagggaataaaaattgcaggtgatgtaggggggcacccagatgaaaaatttaacccgaatgctctccctgttgtgaagggcatcacaattaagaatgtttggggagtgaaggttaaccaggcaggtttgatacatggattgagaaattcccccttcactgatgtttgtctgtctgatatcaattttcatggcatggaaggaccaagatctccctcttggaagtgttctgatgtgtttggatttgctcatcaggttagcccttggccatgttctcagctgagcagccaagagcctggatcatgtgctatttag

SEQ ID NO: 40303 - DNA, 570 bp, Glycine max
  Peptide Sequence Number=SeqID_157081
atgggtgagcttagttatccagtcacttctacaaaagaggtggctgataccatcaatgagagactgcaactgttgagatttagacatcctgttgttaaccaattgaatgaccaacagagagttcatctcaaatttaacatgaatttgcatccagaattgctgactgatgtcacagtcacgcaatatatggataatggtttaaggagctatcatatgccttttctttcgttcggtgttggctgccttgatagagaaacccttatcattagagtggcaccaaatgggggtgtctccacaatagggatgctacagagcatctctatcaactatgagttgccaagaaagcttgagaatataacacttattcagaagataaacattacgaaagccaaggccgagcaccttatccttgggtttacaaatgtcctcccaaaagatgaggtgaacttttcttcgatcatgggtgcttccccaaatgaaatattggcaaagattttcaatatctttgcaagcagatgctgggagaggagtgatctgcatgatataagcgaggatgctcagaagagatga

SEQ ID NO: 40304 - DNA, 831 bp, Glycine max
  Peptide Sequence Number=SeqID_157082
atggaagggagcattgaccctgcaacctcaagccttctgtatgaatctccttcattggaccacaaaaatcttaactttaacaatcagtatctgattaaggacaatcatcatggatcggaacatttgttggatttttctgtacagagcgatgaaactgttttgggtttggttgggagggagaaggaaaatttgccccaagatggttacctcaagagacttcttagtggggacttggacttgagtgttaggaaggaggctcttgattggatttggaaggctcatgcatactttgactttggaccctgtagcttatgtctatctgttaactacttggatcggttcctatcagtatatgaattaccaagaggcaaaagttggagtatgcaactgttagctgtagcatgtttgtcaattgctgccaaaatggaggagattaaagtgcctccttgtgtagatttacagaacctaagtttgcatttgaagctaaagacattcaaagaatggaactactggccctctgaaattgctgcagcagtggcaatttctgtatcaagggaaatgcaagcagaagagattgacaagaccttaacatgttttttcattgtagggaaggaaagaattttgaagtgtcttgaattgatcaaagatttgtccttgatccaagattctgctaacttaggcaccaacttagcatcatttgtaccccaaagccctattggggtgctggatgctgcatgcttgagctctataagtgatgaattaacagttggatcatatacagattcatcccttaatactccaaattctaagaggaggaggaaatctgactaa

SEQ ID NO: 40305 - DNA, 666 bp, Glycine max
  Peptide Sequence Number=SeqID_157083
atggctactgacgtcgtggctgatggcttgccactgatgttcaaccaagatggggagccctacttctcattctactggcagtttgaccctaccaggttcaagtttttcgatgaggatctattaacccttatggagatggtcaacaaggccatctttgagcagttgctagcctcgctggatgcatgggccattttgtctcttcctttagcgagcgatcccctcgttgccttggacgataaatttattatgggtgactttgcttgtaggtcactagtgaagcaggtcagacctactggtgggattgtaccaccgtctactatcattcctcctactggagaagggggtcaaccagctattgaggttggtcgtactgctggtattgttgaggtctccccaatgttccttcctctattttggttaagaggaagcgagatgatggggctgggggttgactctcggttcgggtcgcccttcaagttcgcttttgcttctactactaatgctactattgttgctcttgctcctcctgttgtgcctattcaagaggtcattccaactgctgaagttagtgccacggatgctttggccgatctagtcatagctcctacatccaccaccactacagcctttctgagtgccggtgtgacagccacatgtgctccctag

SEQ ID NO: 40306 - DNA, 447 bp, Glycine max
  Peptide Sequence Number=SeqID_157084
atggattctgccaaggttttcctccaacgaagtttgatgatcctaaaagagaatggacaaaggcaccaagaggcaccaaacaaggtggcatccttggaggctgaggttgccaaatggagggttgctgctcgcacagtctggagagtgaagtcccttaaggtagctaatgtcaccgttgccttcactgaagctgtgaagtcaaaccaccaactatcttccaagggtggagagaattacggtggagaaggacaagcttgccaaggtggtggcggacctcgaggcctggctgaaggattcagagtccagcctagaggaggcgtgaaggacgatgttctgcttgacgaggaagacatagctactgaggaggaggatgctggcgaagagcaaggcactaaagagaagcaagaccttggtggtgtaggaagcaagactttggtggtcttgtga

SEQ ID NO: 40307 - DNA, 486 bp, Glycine max
  Peptide Sequence Number=SeqID_157085
atggcctttgttaggaggacaagaggggagacttgcaaaacaaatgactccgacgctcaaggtcgcaagtttgtcgagcccccaagcatggacaattattgttcagtgttgagagtggcaaccttgacaagtggtggacatgcttttggctttacaggcgaaactagacgtgtcagacatgtgcagtgcacgaacaatattcttgcatacatgtcccttgtggagtgggcacatactgaagacgtggtcatctccatcggtgtttcctcctcgaaggagactcatgatggggcttctgataatgaatcctcttccttagagaggttgagggttcgcaccgtgctggtggaggcacttctcacctccatgggagggcgtaacctttcgctacttctttgtgctgagttgccatcgtccccacctgttactgctagctttgaatgggtgagggatgatgtgctaaagtataggtcctccatcaaatga

SEQ ID NO: 40308 - DNA, 246 bp, Glycine max
  Peptide Sequence Number=SeqID_157086
atggtatttttgtgtgatgatgacaacaatggtggtggtgatgttgatggtggggtggggttagtgtcgataatggttagtgaacgtggcaattgtattagtggtgccgattgtagtggtggtagtagtgtcgttattgttgttgttggtggtggtagtggtgatgatgatagcaagaacaacgaaataataattcaagggccactattggcttcaacaaaccaacatatttgtttaaggaattaa

SEQ ID NO: 40309 - DNA, 270 bp, Glycine max
  Peptide Sequence Number=SeqID_157087
atgaaagggagcgaggcaggaatcatcctcgaaggacctgacaatgtcattctagaccaagctctcaagcttaattttaaagcttcaaacaatcaggttgagtacaaggtgcttattgcagggaaaacaacaccagagcagatttgctctccaagctggccagcaccaaaaaagaccgggcgcttcaaggctatcatccaagagacgctccaaactcccaccatagacactgaggaagttatggctggagaagaagaggaaccagactag

SEQ ID NO: 40310 - DNA, 1050 bp, Glycine max
  Peptide Sequence Number=SeqID_157088
atgaagcttgacgcctgtaacagaaggctatctactatgtcatccatgatggcaagctattcaaaagaagtccccgtcgactatttcaccaaatggattgaggcaacaccattgggagaaatcatagccaatgaggtagagaagttcacttggaaacacctcatatgtaggtatggtctctcgtacaccattgtcactaacaacgacacccaattcaaagcttgggcttatgaagacttcctagcgaggctaggcatcaagcacctcataacctttgtcgaacatcctcaaaccaacggtcaggcagaggcaggcaatagagttatcctcaaggccctgcgtactagattgaacaagtctaaggacaacaaccaacaaaactccttttcgactcatatatggcacaaacgccatgatccctatcaaaattgggaaactgtcgacaaggaggatgcttttccaggaacagaagaacaaagaaagcccacgagctcctcaaacctaaggtcctccattaatgagtctcacatgctcgtcaaacccaaggctcgtcaaacccaaggtccacccttagtgagtctcatttctctaaagactcgtcaaacccaaggtccgcccttaatgagttttgtttctccaaaggcttgtcaaacccaaggtccgcccttgatgagtctcatttttccaaaggctcgtcaaacccaaggtccgcccttggtgagtctcatttttccaaaggctcgtcaaacccaaggtccacccttggaaaacaagtccgcaggaacactgcaaaccgaaggtttgcccttggtacaaaaatccaaggaaaataagtctacaagaacactacaaaccgaaggtttgccccgtggtgcaaaaatccaaggtccacccttggtacgcactcctacaatacccaaggcatgcccttggtcagctcattccttaagaactacgatgaccacagtcaaaggtctaagttccaaaagtctaaacaaactaccatcagattggtcaataagaccttcaaccaggtggaagtcatactaa

SEQ ID NO: 40311 - DNA, 1803 bp, Glycine max
  Peptide Sequence Number=SeqID_157089
atggagtatgcagttggtgaactaacggcttcgtcagctactgagagatatatgagtaggggtactcctggcccgagtcgactcaaggatggcggtgtggcaatggtcttcttgaaacctaagaagtcttgttcgcaggttgacttttattcctcgatatgtgattataaagctcaagaacttgcctctaccaaccccgaaaatgcatttttctgggttgaggcgtatgtcgtatttacggatttatctgaatacttcttccaagtctgtcacgtgttgggctatgttatgggatttgacgactatgtcattgacgtagacctcgacatttcgtctgatctattgtttgaagatctaattcatcaatctctgttggcatttgggaagcttagtactttgaacttggacactccatcgactagctttacaatggagtcggtgcacattcgccatttgccgttgacctttttgaccatgacgacattggcgaaccaggacatcagctatgcgtctgttctcatggctggtgaggtccctgataagttgcgtacattgcccaattttgggtccgagttacaacttgacaatcagggcttggactggaggcccttcgtctatgctcatgacttgagtggtaccatctgttgtgggatgaggcttggcaggctccctggtgggaggatagggtgccactatcaggcttttcacatagcattatcgtgcctacttttgatctgccttgatagtcacaatctctctcgtcaaggtgaggaactttatcttcaaatgcggtatggagacgatggctccgagctcgttgagtgttttcctgccaatcaaagcaaagtaagagatgtcagtggagctgccctggtcgatgaggaccttggataccatgaagttggcgattacgatggagttgatgttgatgttttggatgacgtggaggtgatgcttgtgggactggctagactgccctccgtaggaaaatccactcgcaatgaggttgttgatcgcgtctttgttggtggtgtctttgtcttcctagatcttttgctttgtcccttcttttgtccgcatcgtgattcctatgccaatcctcttggtgtcctccggtatttggtactgtctaaccccagcctgggtggaagtggcataggtagttttattggtacctccgcattgaaagcctcctcgaggattgtagtgcgattggccgtcaaggtcggtcttggtgctaccttctcacttgttgcgcttttgttcgacttgttgaacctcgttcttgaacctagacatctcttccatctggatgtagcttttgatccagacatgcgtccaaacctgtccatgaatttttggagagattcatggtctgcttgtcgcagtctggctagagcggcttatgtcatacaatgtgatcggctggttgcatattacgctttgaaatgcttgacaagagtgtcgaagctgtcgatggaccttggaggcagtccaccataccaagttaatgccgctcctttgagggacattgggaagacacgacacaggattgcatcctcatttgtgtataagtttgcttgggtgaggaaagcgtccagatgttcatctggatcggtggttccatcgtatcgctctaggttgagtggtttccaacctaaggtgctcgtcacgctgggggcatctgacatgagcctccaactgattatgagtattagtgtccatcatggttgtgggaggaggattggagccttcaaatggggtctcgtgtctgaggccagaccgcgtgctaaccatgggtga

SEQ ID NO: 40312 - DNA, 183 bp, Glycine max
  Peptide Sequence Number=SeqID_157090
atggatgttgaaaatgcaggaggaggaggaggaggaagcaatggtaaattggtaattaaggatcggtcggagggaacgaggaaagagaggtggagacaagggagtttctggagcttgacaagtgtcggaaaactacaaagccgtctacttcttctttctaacatgaaaaaagagaaagtttga

SEQ ID NO: 40313 - DNA, 696 bp, Glycine max
  Peptide Sequence Number=SeqID_157091
atgatcacatgcttgtccattgtagcgggaactaacacacactttctctctcctgccactgtgagtagtgtaatctcaattttgttagaaggtgactggcatggatttaaatcacgatgcaaagggtggtggtgtggtgcttgttgtggttggtggtggagtgcgcaggataagcggcaaagtaaggtgaaggttgttgcaatggggaaggttgtgttgttgtttctttgcatggtattggtggtggtgcctttggcttgtactgattcaattcagaagcttgaggttcagaagcacttgaagaacttgaataggcctcctgttaggtccatcaagagtcctgatggagatgttattgattgcatccatgttacacaccagccagcttttgatcaccctgacctcaaaaatcacaagattcagatgaaaccaaatttccatccagaagggcatccttttggagaaagcaaagtctcttcaaattcaaagcctattactcagctgtggcaccaaaatgggaggtgccctgaaggaacaattccggtccgaaggacgaaaaaggatgacatattaagaacaagctctgttcagcattttggaaagaagaagcaaagtagcttccctcagccaaaacctgcaaaacctctacctgacatcatcagtcagagtggccaccaggtattgccactaccatga

SEQ ID NO: 40314 - DNA, 1614 bp, Glycine max
  Peptide Sequence Number=SeqID_157092
atgggttccaccacgcacgtgatgaccaacaccaaccctactctccctcatctactaccctcttcacgctcccacttcaattcacgtcttctctcactgccacccaccagagtcgccaataaagttggtgtctttgccgagcgtagcaacaaaagtagaagcacttccaccgccgccgtcgatttcagcgaccctgattggaaaatcaagttccaggaagatagggaagcacgtttcagacttccccatctcactgatatctttccagatgctcctccgattccttccacgttttgtctcaaaatgagaactccgattgatagagactttcctggtcattattctttggatgaggagtggcatggatatattaataacaatgacagagtgcttcttaagacaatatactattcgtcacctacatctgctggtgcagagtgcattgatcctgattgtacatgggtggaacaatgggttcatcgagctgggcctcgtgaaaagatatactttaagccagaagaagtaaaggcagcaattgttacttgtggagggctctgccctggtcttaatgatgtcatcagacagattgtaatcacccttgaaatatatggtgtaaaaaacatcgtggggattccttttggttaccggggattttctgacgaagaattgacagaagtgccgatgattcatctaaagctgtctagaaaagtagtgcagaatattcatctttctggtggaagcctgttgggagtttcacgaggaggacctggagtcagtgatattgcgaacagtctggagaaaagagggatcaacatgctttttgtattgggtggaaatggcacacatgctggtgccaatgcaattcaccacgagtgccgcaaaagacggctgaaggtatctgtaattggcgtgcccaaaactatagacaatgatattttattgatggacaaaacttttggctttgatactgctgttgaagaagcacaaagagcaataaattctgcctacattgaggcacatagtgcatatcatggaattggcgttgtgaaattgatgggccgtagcagtggattcatagcaatgcaagcatccctatctagtggacaggttgacatatgcctgatccctgaggtacctttcaatttacatggacctcaaggagtattgagtcatctcaagtaccttttagaaacaaagggatcagctgtagtctgtgcagcagagggagctggacagaatttactccaaaagactaatgctacagatgcatcaggaaatgttgtatttggagacattggcgtatatattcaacaagagacaaaaaaatatttcaaggagattggtgttcatgctgatgtgaaatatattgatccaacgtatatgatccgtgcaattcgagcaaatgcatcagatggaattctgtgcactgtacttggacaaaatgctgttcatggtgcgtttgcaggatatagtggcattacagtaggtttatgtaacacccactatgcctactttcccatccccgaagtgatatctcatcctaggctggtggaccccaacagtcgaatgtggcatcgttgcttaacatcaacaggtcaacctgacttcatctaa

SEQ ID NO: 40315 - DNA, 324 bp, Glycine max
  Peptide Sequence Number=SeqID_157093
atggctgatgaagttgacatagatatggatgatactgttaaaaatgaagattgtagcaattattttacaactacggaggtcatacataacaagacaacttggaaggaagacacatttgtcgtcttggattatgagaggggtgacaaatatagacaatacaaaaaagatgcaaagtcgaccattgggactagaaaatatgattacccatttaggttgaaaggaagacaactaaagattggtgaaggatgggtacttagggttctgtgtgggtctcataatcatgatgttgctgagacattggtcaaccatccatatgttggttga

SEQ ID NO: 40316 - DNA, 216 bp, Glycine max
  Peptide Sequence Number=SeqID_157094
atgaatttagcctttctcaaatgtggattttgggtggctcttttggtcaagatctcaacagcattgaagcaggttggcaggtcagccctgatttgtatggagacaacaacactagactcttcacttattggacatgatatagccctgggagcaagcatctccccactttctaagtatagctcttcccaatatgatatcagcatcctggtctggaag

SEQ ID NO: 40317 - DNA, 315 bp, Glycine max
  Peptide Sequence Number=SeqID_157095
atggcaagtacaaaaatagttagttttgatggtgatgatgacaatgacagacacaataaacctacaatgtctaaacggagacaacatgtagaagctcaactggtggaccctttggagcaacctatgcaagtagaccttgtcgagcatgttgaccaacatatgattgatcataggtgggttacctatggcacaaatgcatattttgtgactgaagaggcattaacattagcatgtggagtaattgatgatggtactgtgaaaaccagtagggcacggggaggcaccagaggtggaagtggcagaggaggatgttga

SEQ ID NO: 40318 - DNA, 630 bp, Glycine max
  Peptide Sequence Number=SeqID_157096
atgaaacgaaaactgaaaaaggacagcctgccgcagcgctgcgaatggcgctattacgccgcgatgggcggcctggcgctgatgttgccgctgctattgccgaaagccgtcgcggccgacaactggcaggtggaaggcgccaacggcgtgttgcaggtgcgcggcgcgctgacggagagtgcctgtcggttggagatgaccagcgcgcggcaggatatttggctgggggaaaccggcaccgcacgcttgcggcaggccggcgatcgcgggctgccggtggcgttcgagctgcgtctgcaagattgtctgcgcgcctcgaccagccagcgcgatgcgcgcaccggcgcactgacctgggcgccgaaccaaccggcggtgacggtcagcttcggcgcgccggcggatatggacaacccacagttggtgaaagcgcagggcgtgtctggtctggggctgcgcctgctggacggccgtggccgcgacgttcgcctgggcagccgcggtgagccgctgatgctgacgccggggcagaataccttgagctacaccgtcgcgccggagcgaaccgcggcgccgttgatggccggcgcttatcgggcggcggtggattttaggctgagttatgactga

SEQ ID NO: 40319 - DNA, 399 bp, Glycine max
  Peptide Sequence Number=SeqID_157097
atgaaacgctccgcagaattcgagttcgattttcccgcggctgttaactatgtttccggcggcgtccccaacgacgtcgttttctgcggcaaagtcataacgcgccgacccgaagaagttgaaacccgggcgctgttgaggtcggaaacctccaacgggtacgtggcatggctctggttgccgtccgggatgatgaagtttccgttgcagatggaattgagtgacattaagatgaggcaggagcggagggagctccctccgccgccgatgccgatgccgatgccgagtgttgcagcgaagggcggcggcgcagagagctgctggaaactggtttggctgttgaggcgtcggggaacgctcaagaatgcgttgtttggatgccttgttcccattgtttag

SEQ ID NO: 40320 - DNA, 723 bp, Glycine max
  Peptide Sequence Number=SeqID_157098
atggaacttcaggagaatcatgaggaagctgagcttgggctgcccacagcagtagcagcaacgagctatgaagagtttggaatgccaccgaatcatgacgaacaagagccagtggtggaagtggtgccaatggtgtaccaagaatgcctcaagaaccacgttgtctcaatcggtggacacgctatcgacggctgcattgagttcctaccggggggtgaggagggcaccctggacgcgctaaaatgcgctgcgtgcaactgccatcgaaacctccaccgtaaggagacccacgacacctactcagtgcccttccgccaccaccaccacccactgctgccacccccagtgccattagcagcttactatcgtgccctgccggggtacctacacatgacggggcaccaatgtgccatgctagcacacccgtccttgtcgggaagaggtgggccccagcccccctgggaagacctggaggactcagaccctacgagtggtgccaccactcatgatgggtctgggtcgagcagcaaaaagcgcttcaggaccaaatttacccagcatcagaaagacaagatgttggtcttcgctgagaaactcgggtggaggatgcaaaagaacgatgagagcatcgtgcaagagttttgctccgaaatcggtgttcaacgtcatttgctaaaggtgtggatgcataataacaagcacaccttaggtaagaagccctag

SEQ ID NO: 40321 - DNA, 279 bp, Glycine max
  Peptide Sequence Number=SeqID_157099
atgcttgttttgagggttccgaagggagcaaacaaggttcgaaagtcgaccgcaagtacccccgttttgatgatgccaaagtattacctaaagatggttgtcatcatcaaaaaaggggagaatgtgaatgaatatcatgcgggttttgatgatgccaaaaagattgttcgtctcttgacttatgagaatcctgaacacaagagagaagaatcccaagatgtgttcagaagttgtaaagagtttacaaagatagtggaaaatctcaagtgggttgcttaa

SEQ ID NO: 40322 - DNA, 846 bp, Glycine max
  Peptide Sequence Number=SeqID_157100
atgcagcgtgctcacttcagatggatgtctctactgcttggcctggcgccggggctgtgctcggcacaaatctattcgtacgtcacccaaagcaccggctctccctccaacgctagctataagttcgtgcttgaaagctgggatatggacgacctgtcgcccaatccctgctatcagcaggcaaattgcgctatcggcattaaccaccggcataccagcaccaacaccgggggcacatcttcggtgtcaccgtctgcctacgttgtcggctcgacgcgttatccgcaaattactcaattggcgacgatgggcgagctcagccgtttttatcaaagcatctatccgttgccgatacaggggagcacttcgcacgtgggggagtcgatcactcaggagtgcgtcgggttgttttacaacacgcgctccggttccgcggtaacggggagcaatgcgcgcctgatgcccagcagcgtctgcggcatcgcgccgccgccggtcggggtgtgcggcattgatgagcagcagcttgatttgaaccatggcgtgctgcaggacactgaactggcgggtaataccgcgcgcggcagtctgcgggtggtgtgttcgcagaagatgaatatcgtcatgtatatccgcaccggcagcagcggccgtttggatctgggcaacaactcgggcgtctacagcacgctgcgcatcaatggcgtgttgggcaatcaggggtatccgttcactgccgacacgagcggcatcacgttgccggtcacttcaacgctcggcgtgaccggaacggtcaaagccggtgattactctgggcagtcggtcgccattctggcgctgccgtag

SEQ ID NO: 40323 - DNA, 861 bp, Glycine max
  Peptide Sequence Number=SeqID_157101
atggcagggcacactggatcttgggctttagcctaccctgaaattgtagcttgtgccaacatgttctggtggccagcagaaggtgacattcttgctgcagaaccaggaacaggtcatttgaaccctctaaaccccaagacttaccaagtcctaaagaacgtaattcgtgacatgacaacgttgtttccagaaccattttaccactcaggtgctgatgagattgtaccaggttgctggaaaactgatcccacaattcagaagtatctgtcaaatggtggaactctcagccaagttcttgagaagttcatcaacaacactctccctttcatagtgtccctcaaccgaaccgtcgtctattgggaagatgttttgctaagtgaaacagtccatgtgccatccacaattcttcccaaggagcatgtggttttgcagacatggaacaatggacacaacaacaccaaaaggattgtttcctcggggtatcgcaccattgtgtcgtcatcagacttctactatctggattgtggccatggtgactttgtagggaataatagtatctatgatcagcaaaatggggataacaaagacaacggtggctcttggtgtggacctttcaagacatggcaaaccatatacaattatgacatagcatatgggttgagtgaggaagaagcaaagttggttttgggtggggaagtggcactttggacagaacaagctgattctactgttttggatggaagaatttggccaagaacttctgcgttggctgagtcattatggtcaggaaatagggatgaaaagggtatgaagagatatgcagaggccacagatagattgaatgaatggagaagcagaatg

SEQ ID NO: 40324 - DNA, 309 bp, Glycine max
  Peptide Sequence Number=SeqID_157102
atggtaaggaatgcacatagatcaaaatggcccaactctcttaacacagtccacagtggagtcgccaactgtcgcaacctacccttcggtgggagggcgacgcggggctcatgggtgcgtcttccaagaaaggaaggcgcgcggaatcaccaccaacgtttattcgaggaaaatgttgaaaaaaccggaacgtgtggtctacgaactttaattgtgaaaggttcgggagttgtttttacgcacgaggaagggtgtttcccttgctcctacgtattcctcaattgcgacgaggaaatcagacctaagtag

SEQ ID NO: 40325 - DNA, 303 bp, Glycine max
  Peptide Sequence Number=SeqID_157103
atggaggccatgatgagcatgaagaagataatagaagtcaatgcagatgtagtttatggggtggacgcgactcccctatctggcctcaacctaataaatcatccaaccgtggatacgggcgacccccattttgtgcaagtccaaaacaagcaggttttcctgccatatggtttgcctctgaattatactctacccaatgagaatgtcaataactccactcctatactcattgagagccaacaacctcaatctgatcatacacatgtctctcaactgttagacatgtggcctcagaaatcttaa

SEQ ID NO: 40326 - DNA, 831 bp, Glycine max
  Peptide Sequence Number=SeqID_157104
atgcctcgtaccaacaccattactatgacaaaactagaaccaacactctttttactactacttttcatgttgtcatgcctaataacagtgaacaatgcacactcaacaacaatcatcaacgtgtggccaaaaccaagaaacctcacgtgggccccaccataccaagccaccctcattgcctccacattcaccatcatcaccaccacaactccccaccacaacaaacacctctccgccgccatcatccgctaccaaaacctcgtaaaatccgagcaccaccacccacttgtccccccaggggtgaacatctccacaaacctcccaccactgaattccctcaccctcactgtccttgatcccggtgcaggactcgtccacgacgtggacgagtcctacaccctctccatccccccttcttcctcctcagccaccctcactgcaaagaccacgtggggagccatgcgaggcctggagacgttctcccagctcgcatggggcaaccccacgtgcgttgcagtgggggtccacttgtgggattccccgctctacgcccaccgtggcatcatgcttgacacttcaaggaactattttccagtgaaggacttgttgaggacagtggaagccatgagcatgaacaagctcaacgtgttccactggcacgtcacggactcgcagtctttcccattggtccttccttcggagcctgctttggctgaaaagggtgcttatgcctctcacatggtgtactcaccagaggatgtgaaaagggttgtggagtttggtcttgatcatggggttcgtgttatgcctgagattgactcacctggttag

SEQ ID NO: 40327 - DNA, 1806 bp, Glycine max
  Peptide Sequence Number=SeqID_157105
atgccaactttgattacatctaggtttcttttgcttgttggagagtcactccacatgagaaggggtttggccacttctaggtctgttttattgcacactagtagtgtccagtgtatgagccaggtggaacctcatcatggttccgtcaccctctctagcataggtttgcaaactgaaactgaacctagaaacagaagcaaaacaaataaggttaagccattgggttcaccctctgagaatctcaagagcaaagggaagcccttcggcattaatgagaagaaaaaaacttttagggttgtagagaaacagcaaatagagtctgccccttttgctgcaaattcattttcagaacttggcctcccacttgtgttgattgagaggctagagaaggagggtttcaccgttccaaccgaagttcagtctgctgcagttcccaccattctcaacaaccgtgatgtcataattcagtcttacacgggttcggggaagacgttggcttatctgcttcctatactctcggttgttgggccactgaggggggaaattggtgaaggtgacagtgatggcggggagtgtgggaagaagttgggaattgaagcagtgattgttgctccttctagggagcttggaatgcagatagtgagggagtttgagaaggtgctaggaatggataacaagagggcggttcagcagcttgtagggggtgcaaaccgaaccaggcaggaagatgctctcaagaaaaataaacctgcaattgttgttggcacgcctggtaggatagcggagctcagtgcatccgggaaacttcgaactcacagctgtcgatttttggtattagatgaagttgacgaactcttgtcgttcaatttccgggaagacatgcacaggatattggagcatgttgggaggagatcaggtgcagaccaaaactcagattctagaaaggccgagcgacagttaattatggtttctgcaactgtgccattttctgttgtaagggcagctaggagctggggttgtgacccacttcttgtccaagctaagaaagttgccccacttggaactgtctctccctctgagcctatcagtttgtctcagtcttcacccagctcaagccctagcttggctatgccatctccagcagcagtagagagtctacctcctgcattgaaacactattactttgtaacaagggtgcagcacaaagttgatgtgttgagaaggtgtattcatgcactggatgccaaatttgtgatagccttcatgaaccatactaagcagctaaaggatgttgtcttcaagctggaggcccgtgggatgaaagccatggagttacatggggatcttgggaagcttgctaggtcaacaactctgaagaaattcaagaatggtgaggtgagagttctggtgacaaatgaattatcagcaaggggtttggatgtggctgaatgtgatcttgtggttaatctagacttgccgacagattcaattcactatgcacaccgagctggccgaactggtcggcttggtaggaatggtacagtggtaaccatatgtgaagagtcagaagtgtttgttgtgaagaaattgcagaagcagctgggaataccaattgcatcctgtgattttgcagaggggaagctacttgtcagtgaagaagagaaaacattggatggaaaacatcagtcacagaaaattgctcctctggtgaacagaagaaaaatggtgggaattagcaaggaaaaaccaaagaagagaattatgagggtgcataaaaaactggaaggggagaactatgggaagtag

SEQ ID NO: 40328 - DNA, 1469 bp, Glycine max
  Peptide Sequence Number=SeqID_157106
ctaaaggctatgctcagcaacaagggattgactacaacgaagtgtttgccccagtagcaaggtgggacacaatccggatggttttagctctagcagcacaaaagggatggaatgtgtatcaactagatgtcaaaagcgcatttcttcacggagaattgacagaggacgtgtatgtggaacaaccactgggttatgttcgaaagggtgaagaagagaaggtctacaagcttaagaaagctttatatgggttaaagcaagcaccacgtgcttggtatagcaaaattgcagcctattttgtgaaggagagatttgaacgatgcgatcatgagcacactctctttgtcaaaacaggaggaggtaaaagaattttaattgtgagtttgtatgttgatgacttaattttcactgggaatgatgcatgcatgtttgaaagctttaagaagtccatgaagattgagtttgatatgacagatttagggaagatgaaatatttccttggtgtagaaattcagcaaaattcagaaggcatctacttaagtcagaacaaatatgcttgtgaattacttgagaagtttgggctgcagaattgcaattcagtaaagaatcctataatgcctggttttaagttgtcaaagaaaggagaaggtgctaggattgatgctactgcctacaagcaattaattgggagtctcatgtacactactgtaacaaggcctgatttaatgtatgtggtatgtctcttgagtaggtatatggccagccccactgaattgcatatgcaggcagcaaagagggttcttcgttatttaaagggaactgtggagttaggtgtgttttataagagaggagatgttaaagacttggtggcttacactgatagtgattatgctggagatattgatgatagaaggagcacatccggatatgtatttttactgagtggtggagcagtctcatgggcatcaaagaagcaaccggtagtaacattgtccaccactgaggcagagtatgtggcagctgctgtttgtgcttgtcaatgtgtgtggatgagaaaggtgttggagaagattggtctctcacaaagcaaggatctaacaaaaaaggaagtggtgaggctcattcattgtggcacaagcaatcaagtagctgatattatgaccaaaccattgaaacttgatgtgttcctgaaattaagagtccagcttggagttcgtgagcacggacacaccgctgaagagttgtgtcccacgtcggaggcgcaccggacatgcaaacggcaaggggacacgcgcgacgatgcgcaggttaatgatcatgcacgctcctcctccgataaggactcaccgtatatagaattgcgggctgcgaatatcaaaagaaaagaaggaatcgcattagagcgagattcgaatgaaggagcagcgacggcagagagttacgccaagcgtggcggtggtggcgggttgtag

SEQ ID NO: 40329 - DNA, 279 bp, Glycine max
  Peptide Sequence Number=SeqID_157107
gtctttaatccagacttcccgctatacataaagcacgaagacctctcggaaatcgcccacggtggtcaatgtctcagcatatcagtgtcacagttgtggattctgcatctcactgaaacaagtatgcaagcggggaattctgatatctatggattcttcaagccacaatccattcagagtgctttaaaaggtcttgatgatgctccacaacctaaatcaaaggctcctgctaggtggattgtcgtcaagaatttcaacaaattcactgttgaagtttga

SEQ ID NO: 40330 - DNA, 468 bp, Glycine max
  Peptide Sequence Number=SeqID_157108
atggatggcgtgcaggagagggagaagaagcaaggatcgcgagagatggttttgagaaaaagatgcagaagcaatggccaatggttggcttcatcaaaagattaccttgatagtgataggattaggagattacctaatgatataatttgccatatctattccttcctctcaaccatagatgctgttaaaaccagtgttttctccactaggtggagatccctttggactcgaatatctactctttatcttcacaaagatatctttgggcactccaaaactttctttgcttctattgtttccggtgtcttagatcgacacaaagtaaaatgcataaaaaggctttctctctcaaactggtccaaatccaaatcccctagctttgacttgatgaacacaatgatttccactgtcctgtttcaaaaccaccttaaggaggtggacctcttatccaacgatccttatggttag

SEQ ID NO: 40331 - DNA, 273 bp, Glycine max
  Peptide Sequence Number=SeqID_157109
atggagagggagattataacaatgatagtggacacgttatcagtgttttactatgagaagatggtggaatacatgccttcaagctttgtagatttagtgtttgctggcgagagaatcgaagtggatctgagaagaggaaaatttgattatgctgctttgatgaataggaagcctagggcaaatggagagaataagaaggagggagaaacccatgttgtgactgtcgttccttcatggccaaatttctcactagctcaacaatatcaatattaa

SEQ ID NO: 40332 - DNA, 1845 bp, Glycine max
  Peptide Sequence Number=SeqID_157110
atggaaaggggaccaactacccgaacccatctcatagattcccaccacagaacatttgtcattttacagttgaagaacaagtgccccacatcctcttgcacacagccacataaagaacaggaggttagccttggtaggaagcctatttctaagaagtctccaacagaagattgccacccgggttggttgaaaaagaaagcaaatgtgtatgttcatagaaatttcatgaaagacacttgttgctatattttgggcagagctgtgctagaacctgcgatgcaaggacgtgatatgataggtcgagctagaacaggaactgggaaaactcttgcttttgggatacccatcttggacaggatcactcagtttaatgctaagcatggacaaggaagaaatcctttggctttggttttggctccaactagagaacttgcgcggcaggttgagaaggaattcaatgaggctgcacctaacttggccacaatctgtctttatgggggtatgcccatccagcaacaaatgaggcagcttaattatggcgtagatattgcagtaggcacgcctggtcgaattattgatcttctcaataggggggcactgaatttaaaggatgtcaagtttgttgttcttgatgaagctgatcagatgcttcaagtaggatttcaagaagctgtggagaagatcctggaagggttgtctccaaatcgtcagactcttatgttctcagcaacaatgccatcttggataaagaatattacccgcaattacctgaacaaccccttaaccattgatcttgttggagattctgatcagaagttggctgatggaatttcgttgtactctattgtgtctgattcgtacactaaagcaggaattcttgcacctctgataacagaacatgcgaatggaggaaagtgtattgttttcactcaaacgaaacgtgatgctgatcggttatcatatgtcatggcaaaaagccttagatgtgaggccttgcatggagatatttcacaaactcagagggaaagaactcttgctggcttcagaaataacaattttaatgttttagtggcaactgatgttgcttcacgtgggcttgatattcccaatgttgatcttgtaatacattatgatcttcccaattcatcagagatatttgttcatcgatctggacgaactggccgtgctgggaagaaaggaagtgccattctttttttcacacaagaccaattcagggccgtgcagactattgagcgtgatgttggatgcaaatttacagagctaccaaagattgatgctccaagtggatcagcagagatgtttagtggcatggctggtggtcgatttggctctatgagggatcgtcaatctggaggtacaggttttggtcgcagtcctggatttggtcgttctgggagttacggtaactctggatttggccaatctagttatgatggctttggttctggtcaagctcctcaatttggtggaaattctcgccccggtggaaattctcggcccagtggttttggtagttcaggtcaatctagtggttttggaaattttgggtcaggtcaatctggtggttttggtagttcaggtcaatctggtggttttggtagttcaggtcaatctggtggttttggaaattttgggtcaggtcaatctggtagttttggaaattttgggtcaggtcaatctggtggttttggaaattttgggtcaggtcaatctggtgcatttggtggcagaaagtcaaaccaaagcagcacctttggtaattcacatggtagtggtttcagtgcttttgggaatgacccaaataatgacagttacaatagatga

SEQ ID NO: 40333 - DNA, 1326 bp, Glycine max
  Peptide Sequence Number=SeqID_157111
atgatcctcgagtgcttgaaggaacgaacagcacggttgttttggccagttttttatgacttggaaccatcacacaggttcggcaccaaactgggacttatgcagaagctttggccaaacatgaggagaggtttcaggatgatgagaaggacaaggtgctttaaagggagagaggctttgtctaaggctgctaatatggttggctggcatttccaacacagatcacaatcagaatccgagtttattacaaagattgttacagaggtatctaaaaggatcaatctcagtcttttacatgttgcggattacccaattggcgttgagtctccagtgcttgtgacatctcttctaggacacggatttgaagagggagttagcatggtaggcatttatggggttggtggaatagcttttcagtttgaaggtttgtgttatcttgccaacataaaagaaagttctagtaatcatgatcttgcacaactgcaagaaacgttacttgatgaaatacttggtgagaaagatatcaaagtgggagatgttaacagaggaattccaataataaaaagaaggctccaccgaaagaaggtccttttgattcttgatgatgttaacaagctgaagcagttaaaggtacttgcagggggacatgactggtttggctctggcagcaaggtcataatcacaacaagagacaagcatttgctgaacactcatggggttgaaaaatcatacgaggttgaacaatggcatgccttaaaaagtaacaaaattgatccaagttatgcagatatttcaaaaccggcaatttcttatgctcatggccttccattggctttggaggtaataggctctcatttgtttggcaaaagtttacatgtatggaaatctacattagataaatatgaaaaagttcttcataaagagatccatgaaatacttaaagttagctatgataacttggaagaggatgagaagggaatttttcttgacattgcttgtttcttcaattcttatgaaatttgttatgacaaagaaatgctaaacttacatggtcttcaagtggaaaatgatggcaatggctgtgtgagaatgcatgacttagttcaagacatgggcagagaaattgtgaggcagggaactgctgcaattgaagtcgtagtcctggacttgagtaaagacaaagaagagcagtggagtggaaaagctttcaagcatatgaaaaacttgagaattcttataatcagaaatgcacacttttctagaggccctcaaaatctaccaaatagtctgagagtgctgcactggagtggatatccatcaccataa

SEQ ID NO: 40334 - DNA, 516 bp, Glycine max
  Peptide Sequence Number=SeqID_157112
atggaaacatcccaagctagcttcaaagccaatcaaaactcaattcaaaatctggagattcaggttggcgagagttactccatggaaaattgttggagggagcaagagttacaaccttacaatcaatatgaagaagaaataatttctaatcttgagaacatgttgatgcaattcatagaaacatatgaagctaatcaacacgtaattcaaaatctggaaattcaagttggtaagctagcaaaagaagtggctaaattaccctttttggtcacaagggaagaaaactttgtagaggttgaagctcgtgagaaaagtcttaaggccttcccgggatacatgagtttcatggagtctctagctaagaagcaaaagtgcaaggaagatgggggtgatagctttggtactggtgatgatgatgtcgcagatgctggagctgatgatgattatgttgcagacatcactgctgctcgggaagcttgggatccaaggcccacacaagattggggcctattttga

SEQ ID NO: 40335 - DNA, 1707 bp, Glycine max
  Peptide Sequence Number=SeqID_157113
atggcagaccacgacattgcaaagacggccttccgcacccaccagggccactatgaatacaaggtcatgccatttggcctttgtaatgccccattaaccttccaagctaccatgaatgagcttctcaaatcgttcctccgcaattttatccgaggttacgctgccctcgtcgtgtcgctaacatcattgcttcaaaaagacaacttccactggggagttgatgcccaaaatgctttcgacaaccttaagcttgttatgacccaagcccaagtattatcctttccagacttctctgtgttattcacactcgaaatagatgtctcaggcctggcaatgggcatagttcttatgcaacacgaccatcctctcgctttctttagtaagtggcggcaatacctgttaggccacttcttcatcattctaacggatcataagagcctaaaggatctcataggcaaggttatccagatgcctgaacaacaagtttacctatcgaatctgttaggttacaactacacaatacaatacaaaactggaaaatccaatgtggttgctgacgcattgtccagaattccccagtacaccagtgggcagtgtctgttgctatccatgcctaacttcgtcttcattgacgccctggtgtggctcaaacctgataaccccttccttgtttcgttgattgaagagtttcactccacccctattggcggccatctgggtttcgtaaagaccctcaatcggctacagatgagtttctattggtccaacatgcacaaagatgtcaaacaatttgttcgccaatgtgccacttgccaacagtttgtaaaattcacggctttcccagaagcttggtctccgaacgagaccctatcttcattgggaacttttggcacgatctgttcatctcgagtggcacaaaattacacacgagcatctcccatcatccagaaacggatggccagactgaggtcggaatggtgttacaacaccgctgaccactctgccaccgacatcactcccttcgaagcaatgtatggcaagcctcctccccccatctccacttacttgaaaggatcttctaccgtcgaagcagttgaccacctcttgtccacaagacaagatctttgggcctctctaaccactcgcctgcacaaaatgctgctagccatgaaggcacaagccgacaataaacatcgcaatgtcttgtacatggttggcgactgggtatatgttaagttgcaaccttaccgccaaacctccttttctcacacaagttttaacaaactatccaagccgtattacgaaccttttcagatttccgagaccattggtgcagtggcttaccgccttgctcttccggagagctccaaaatccataatgttttccattgttccatgcttaagccacatcacgaccctatagacgatgttacagaccccttgctgccgcaagccacggataaccacccattggtcgaacctttgagtattttagatactaaatgggacgacacgacctccccaccttcactattggtcttggtgcaatggagtggcctcgcgcctgaagaaacgtcgtgggaacactgggaggaactatgcgccacttaccaccttaaggacaaggtggttctgccaaccgtgggtattaatggaacgcagcagcttcgacccaagaggaaggccctaaggccagtgtatctgtag

SEQ ID NO: 40336 - DNA, 1368 bp, Glycine max
  Peptide Sequence Number=SeqID_157114
atgaaggttcatatcagtgatcaagaagagggaaaatttaccaaattggatgcttctagtgcccctcatgtgactgtaagttcacaattacctaccatgaaatcctcctcttttcaggatttctcaggaattcctataccggccccaagattccatgtttctgattcacctcagaaaaacaataatcacttgggtggatcatgtaaggtccaaaacttctctcacttttcagcaccccttaatgtttcttcagcatcggctaacgtgcattttggagacaaaattactggtaacatgtcaagaaatgagattagggagtgctcattgatgacagttggatcaagttactgtggtagcaatcacatcccccaagatccagatgctagcagggcatcaagcaatggtgtttggactactactttatcagtcgagccagaagctgttagagacgatgtgccgaaaacaattcctcagaaggagaaagggaaatcagagatgcttgaaccagctgtgacttcatcatctggtggctcaggtagtagtcttggaaaaacttgttcattatctacgagaaaccagggccaaaaaagaaaaggaatagacgtggaagaatctgaggagcaaagtgaggtgaagcctctttctctcgagacacagaacttaaatcagcacttggaaacaagtcatctcaacgcacagggtcggctcgaaggaaccgtgctgctgaagtgcataatctatcggaaagggtgggggattttgagaaggagagacaggatcaatgagaagatgaaggcattgcaacaactcatacctcacagtagcaagacagacaaagcatcgatgttggaagaggcaattgaatacttgaaatcacttcagctacaacttcagctaatgtggatgggatctggcatggcaccaataatgtttccaggaattcagcactacatgtcacaaatgggcatgggaatggctagaccgcctttccctcctcctattcataatccgatgcaattaccgagagtgccgcttgataagtctgtatctgcatctcagacaccaaaccagacattaatgtgccaaaatcccattttgggtgcatttaattaccaaaatcagatgcaaaatccagctctttcggagcaatatgtgcgttacatgggctatcatcttatgcaaaatgcctctcagccaatgaatgtattcagatatggtccccagggagtacaacatagtcaaacaatgattacacccagcagcaacagcagtggaaacatgagtggagcagcaaatattgatgaggctgtgagtggcaaaatggatggtgacaaacagacactaacttgtcaccatgtaaacagctaa

SEQ ID NO: 40337 - DNA, 549 bp, Glycine max
  Peptide Sequence Number=SeqID_157115
atggagtgtaggagcaaatttggtcacagggaagcatggtaccatttcctactattacctgcaatggtggggtgtgttcagtgggtagttggagagatagggtttggaggtggtggggtgggagtgtcaggtccagggtcatcgtcttcggctattaataagaagaaacatgcccgacatttgggagagggtaagagaggtggaggaggaggaggaggtaatttggccagtgaaatagcctggggaagggggattggttgtagtgtttgtacttcctttcatagctccggtgtgagaccggagataaagcagctaagtaagaaggaaggatgcaacggtgatgcgttcttcgtccgatgtgttatggtaatcgaagaattgggagatcttgaagatccatctcatggcatcattgccgtcaaaactagggacctccaactaaatggggtagcgggaagagggctgggaaggactgattttgggttaggcggagaatcttctcttctaaacagtttgtggtttttgagtgggtgtggtgttccgccatgg

SEQ ID NO: 40338 - DNA, 870 bp, Glycine max
  Peptide Sequence Number=SeqID_157116
atgaacaacagtgttcctgattggaattttgggagtgattcctgtgtcacctccaccaatcaaaagaagcccatgatgggggtggaccaagagcttgtggagcttctgtggcaaaatggccaggtagtgcacagccaaactcatagaaaaccggttgtgaactcaagtaacttgattcaagatgatgagacagtctcatggatccaataccctcttgaggatccattggaacaagaattctgttcaaaccttttgtctgaactggcaccttgtgaagttgagtcctataagcaaatcaagccatttgaagagggaaaatttaccaaattggatgcttctagtgcccctcatgtgactgatttctcaggaattcctataccggccccaagattccatgtttctgattcacctcagaaaaacaataatcacttgggtggatcatgtaaggtccaaaacttctctcacttttcagcaccccttaatgtttcttcagcatcggctaacgtgcattttggagacaaaattactggtaacatgtcaagaaatgagattagggagtgctcattgatgacagttggatcaagttactgtggtagcaatcacatcccccaagatccagatgctagcagggcatcaagcaatggtgtttggactactactttatcagtcgagccagaagctgttagagacgatgtgccgaaaacaattcctcagaaggagaaagggaaatcagagatgcttgaaccagctgtgacttcatcatctggtggctcaggtagtagtcttggaaaaacttgttcattatctacgagaaaccagggccaaaaaagaaaaggaatagacgtggaagaatctgaggagcaaagtgag

SEQ ID NO: 40339 - DNA, 630 bp, Glycine max
  Peptide Sequence Number=SeqID_157117
atgagcccaaaacgctcaaaggagagaaaggagaaacccctcgaccaaccaaggcgagtcataaacaccatcgcggaggaagggctaccgcctttgtacctcaaaggctttattcatcatggtatgcatttcaaggttgctccttcctctcagccttttactatcaaagccatgtgtgatgttgattggaactcgaatccaaatgataaaaggtctacctctgagatacctgaatctgaaatcctaccacatgatgaccccttgtttggttttcttggagaaaaggtagggacgaaggggtctatttggctttacactaagttcggacatgaggggatattgcaaaaaagtctaaagttagggtacatgataatgcatgctcacacatcatacaatatactcctcggttgtccctcactgaatgccttgggtgtgattatgtctatccctcaccttgtgatgaaatttctgtcgaacactggaaccatcacaactatgcatgccaaccagaggacgaccaaagaatgctatatggtcaaccttaggttatgtcctcatgcaagggtggaagccccaagagtcgcccactacacaaaggccaagaaaaaagccaaagaggtgatgaactag

SEQ ID NO: 40340 - DNA, 684 bp, Glycine max
  Peptide Sequence Number=SeqID_157118
atggttgttagtgatttgatgttgaatggagaaggaaaatggaacgaaacactcattgaggaaatactagacctagaagatacgatggtcatgtttagcatgccacttgctaatctccaggaggaagatgtgagaatatggagacataataggaatgacaacaaaaaggttctgcaaaaatggcaaagtgtttgccagaaagggagaaatatcgataggacaacctctgatagtgatcttgaagaatggaaaccacctgggccagggtttgtgaagtgcaacattgatgttgcttatttccaggagcaacaatggtgggggaaaggaatgtgcattcaggacgataaaggttggtttgtgagagctacaatgaatattagacatggaatgcctgaggttcacgagggagaagcactagtcttactacaaactctgacatggttgaagaatatggactaccaatatgttgaagtggagtctgactgcaaaagactcactgatagtcttgatcgcaacataatggatgattctgagtttgggatgattttaaataagtgtaaaaggatcttaatgtcttttccaaaccataaggttagtttgataaggaaacaagcaaattgcattgcccattcacttgcaagggcatcaaagttatatgttggtccatggtccatgatccattga

SEQ ID NO: 40341 - DNA, 471 bp, Glycine max
  Peptide Sequence Number=SeqID_157119
atgaactcagtggacaagaaaaagatgacattcctcaccaaattcgcaaactactactacaaagtcatgtcattcgaactcaagaatgccgaggatacctaccagcgtttgatggataaggtattcatgggtcagcttggacgaaacttggaagtctgtgtggatgacttggtggtcaagtttgataatttggccacacatatcacagatttggaagaagtttttcgccagctcaaaaagtataacatgagactgaaccttgaaaagcttcatgctaacccactgaggaatacatgcaaactcggaaaaatgccaagccatcatggagatgaggagtcccttgaatgtaaaagaagctcaaaggctagcttgcaggataggcttcttgttaagattttttcctacaattgcctagcaggccagaccaatcatgaacctcctcaagaaaaccaacaactttgtttgggatga

SEQ ID NO: 40342 - DNA, 510 bp, Glycine max
  Peptide Sequence Number=SeqID_157120
atggagtgctttctagcattatttctaactgagatccaaggtttacctcaagggcttgtgtcatggattgccttgggagttgggacgaggttttaccttttatggaattcaccaacaacaacaattatcatgttagcattgtatgataaaaggtgtagcacacctctttgttggtatcaagatggtgtgaacatggttgtggggccatggttcttacaatggactacaaagaagatcaagcttattcaagaaagaatgaaggcatcaaaaagttacatcgatgaatgtaggaaaggcaatcatgatgaggatcagacaaggaagcttacccctaagttccttggaccttatcagattctcaggcgtgtaggtcctgtagcttatgagttgaggaagtatattatggatcctaatgtcctagaaccggacagggtcactatgggatatataatgtgggagcttgaggacaagatgcataagcagtatctgaatctattcccttgtaactaa

SEQ ID NO: 40343 - DNA, 957 bp, Glycine max
  Peptide Sequence Number=SeqID_157121
atgcatatggacgactcttccaacttgcatggaagtggagctggggtgatcttagaagggcccaatggcatatccctagatcaatctttacgttttggctttaaggccaactgcaacttggtcgaatacgaggatctcctggcgagactaagaccttcaaaagagatccgagacccccaactcctgaagtactactgtgcatttgaaaggatcaaggaagagtatgagaaagttcagctgattcacataagtcgaacggttgaagaaaacccttcgggatggaagaatgagatagttaaatacttgaagcataagacactcccaacagacaagggaaaagcgaaaaagctaagaacgcaagctgccaggcgtctgaggtatgcatttcggggaaagaacaatggccacaagagtgttaagggtttgttactattggccaactttgaggacaaattattcaagctttgtgaagaaatgcctccaatgccaaaagcatgggaatttgatacttcggtcggccgaagaactacatcctatggtcttcccttgatcgttcgctatttgaggaatggatattctcatacctttccccatggctctagggcaaagaaaattcctgctagtggcaacaatggactacaattcattgatcaaaagctcaatgagtttttgggtagcctcggtagcaagcatagggtgacatcagtggaacaccttcaaaccaataaacaagccgagacatctaacaagataatcctaggtgagcaaaggaagcgactggatagagtgaatggaagatgggctgaagagcttgcgaagggacctagtatgaagcgcatagggagaagcccaaaaggtcccgtcagatggaaagttggcggcaactgggaagggtccttcagattccggcacaatttgaataatgaagcttacaagttagaagaactatctgggaag

SEQ ID NO: 40344 - DNA, 288 bp, Glycine max
  Peptide Sequence Number=SeqID_157122
atgacggaagatcctcccgacaacgctgccgacccaagcgattgcgactacgaccgtggaggttctatcgttgctgccgctatctacgattccaccattgaagctaatcgtgtcaccatcgaactcagtggaggagcaaggagtttgtggaacgcgatggattcaaagagcgagatgaggaagtcttatgactccaccactatcattgagagcacgagcttctttgcgaacccgttggatagaccgagagtaactccaggctctcatccgagatcaccatcctcttga

SEQ ID NO: 40345 - DNA, 354 bp, Glycine max
  Peptide Sequence Number=SeqID_157123
atgttgagttggcgaacgaagctggagaagttgttgtgcttgaaatatttaggaagcaaatccttgccgaaagcggtggtgttccaaacgatgaaggacgatcctgattatagttctagaagtgatcaaggggttcccatgaaccctaagagaataaaggtcattcctgagtggcccactccaccaacaccattcattgagttggtgagaaaccatgttctttcatgggaagatgcccaggaaatgggtgttgaggaaaggagcccagagtatgaagaacctcgggatttgaggtcaaatcctttccaaggtggagggaatgatgcaatcctactccgcaagggcattgggtag

SEQ ID NO: 40346 - DNA, 795 bp, Glycine max
  Peptide Sequence Number=SeqID_157124
atggaatttcagaagcatcatgaggaagctgagcttgggctgcccacagcagtagcagcaacgagctatgaagagtttggaatgccactgaatcacggcgaacaagagccagtggtggaagtggtaccaatggcggtgccaatggcggttccagtggcaccacccaccaacattgtggcccaaaacagtggcaagggaaagtaccaagaatgcctcaagaaccacggtgtctcaatcggtaaacacattatcgacggctgcatcgagttcctgccggggggtgaggagggcaccctggaagcgctaaaatgcgttgtgtgcagctgccaccgaaacttccatcgtaaggagacccacgacacctactcagtgcccttccaccaccaccacccaccgctgccacccccagtgccatttgcagcttactatcgtgccccgccggggtacccacacatgacggggcaccaacgtgccatgctggcacacccgtccttgtcaggaggaggtgggccccagccccccttggaagacctggaggactcagaccctacgagtggtgccaccactcatgatgggtctgggtcaagcagcaaaaaacgcttcaggaccaaatttacccagcatcagaaagacaagatgttggtcttcgctgagaaactcgggtggaggatgcaaaagaatgatgacaacgtcgtgcaagagttttgctccgaaatcggtgttcaacgtcatgtgctaaagccatcattccaagctagaagctcaacgttgaagcctgggagattgcgttgctga

SEQ ID NO: 40347 - DNA, 419 bp, Glycine max
  Peptide Sequence Number=SeqID_157125
gagcaagagcccagcttttgtcgacctcaaaaataaaaagcaatcaaaagttccctttgctatccgaagaccatcaagtccgatggcatgcagagacaaacatagccatcagcttcccttgtcaagagactcaatgcctgttgaccaaagctactgaagtctctcttgctatcccgagacaagtccatcaggaatcttctggaggaagcaacagctcgcctgggcaagcatgttgcttcaagcttaagccaccagctcgcctgcgcgagctgggcggcaagctcctcctctattttcctataaaatggcgttgggagctgaggggaaggggttcaacccttttggcaatcagatttcacttaaaattagtgaggagaagaagaaagaaggagaaaatcaaggccaaggcgcttccataa

SEQ ID NO: 40348 - DNA, 999 bp, Glycine max
  Peptide Sequence Number=SeqID_157126
atgtctaagttcgtccccttagcctatgaccatcaagctcttcctctaactagggacgatatatataatgttgggatgattatgatgcaatgccagttgattgatcaatggccaagctatccttctagtattcacatcaaatgcatcaccactgtcaaggtcatgcctaatcgcattgctttgaggttgccaccattggatctcagaaagaagaaaagtaaggttcctcctcatagcacgcctatgccttatcaaggcccaaaagacaatgtttccttgcatccaatttcttatgattggagcaggtactttagaagggatgttgctacaaagacaattactttaaagctagacactgagtttgatcaaaatgatgccatgctcttatattttaaagacatgtatgaaaactctcatcttgcatccaccttagattatgacaagaaagataactccaatcacatgcgtatgtttgtctttgacttgcacaagcactctgaagctgcaataagaagagccattgtcactgcttgggcaagaaccttgttagagataggggagcaacatgaagacttagccttgaagcttgaagaagagcttgaagaagaaacaagacaacctaaactgccaactgatgagatgaaaaaaaaggccaaagccaaacaacaacaggaaaagctcaaatctgaagggttgttcaaaaatcttcatgcatatcttggaccttgggtcgatggtattgaacctccattgtttgaagttactcttcacaacctccatccattgttgaagatgccttggcaaccattagcacttttagtactcctcgacaacctagaagagactatggaaaaagggtttcttgttgaatgcatggagaccaatctatttatcaagaataacttggaatcatcgctcaaatccttcaacgactatgctctattcaacatgaatatgttaatgcaacaacagctacctgtagacaaaggatcaagctga

SEQ ID NO: 40349 - DNA, 216 bp, Glycine max
  Peptide Sequence Number=SeqID_157127
atgacgattgtagattaccacaacccttcagggaatgatacttgtagtaacattgatacaaagactaaagcaaacacaagcacgaaggagatgaaaacagcaatagcataccaacaatatgaagcaaaggtggagtcacaagacacaggggtgcagtcagtaggaaagcccaagagggtcatcacaagaccttcttacctcaacgattacatatga

SEQ ID NO: 40350 - DNA, 489 bp, Glycine max
  Peptide Sequence Number=SeqID_157128
tctctgcgtgtcaacgggctcacttgcctctggttgacaaaaggtgcggataaccataaggtgtgtccgcgtgctaccgggcccttgggtcacgatagcagaaatgagacttttttgcggtctcggtcggttgtcgctgacatcttcgggaagggtgcagatgaccacattggtgcggataaccataaggtgtgtccacgtgctaccggatccttgggtcacgatagcagaaatgagacttttttgcggtttcggtcggttgacgctgacatctccgggaagggtgcagatgaccacattggtatctgcgtgtcaacgggctcgcttgcctctgaagacgctgacatctccgagaagggtgcagaagaccacattggtctctgcgtgtcaataggctcgcttgcctctgaagacgctgacatctccgggaagggtgcagatgaccacattggtctctacgtgtcaacgggcttgcttgcctctggttga

SEQ ID NO: 40351 - DNA, 147 bp, Glycine max
  Peptide Sequence Number=SeqID_157129
atgaagtgtaggggggaagaacatttgatatcagaggatgagggtgaaattaagcagattgtaggagatgcaaaggtagaggaagagcatttggtatcaaaggatgagaatgaactaagtgatgttgatattgggaatgatgaatga

SEQ ID NO: 40352 - DNA, 537 bp, Glycine max
  Peptide Sequence Number=SeqID_157130
atggcctggataatgactcatgggcttgcagaatatatagctcagactaaatatggtgctttgcattccttgtatgaattagtccttccttctacttctgattgggaggagatggatagaaaaactggatattggtttagaggcacaggaagaccacccttatccttttgcaggagcttgaaatctgaaagctccattacttggatggatcttctctgcgggggcacagaacagcaaaacaatgaggaggaatatttggcaagagttaattggatgcatggaaacattctcactgctcagattttgaatcggcaccacactaaaataaagatcgttaagtttgatattagaacaagccaaaggaaaaatatattggtggaagaaaatagcagctggatcaatatacatgactatttcacacctcttgataaaggagttaccaaattttcaggtggattgagttgggctagtgagaaaataggatttagacatctttgcccgtctgactcaaatggcaaaaattctaaatttagataa

SEQ ID NO: 40353 - DNA, 351 bp, Glycine max
  Peptide Sequence Number=SeqID_157131
atgcacaattttgccctcattttgaattttaaaaatattatctactcatctcacacaaacaacactaccacaccagcatcgttgtgccgcatcatctccgaccagaaccatcttctccacccttcatccaccatgaccaaaattcgaccaccaccaaataacattgttgcaccaccgccgccgcgcctcactaacagggggatgcaaatagcaaccaggcccacttgggccttccaggaagttctcccgaaggcggtgccttctggaggaagtaacctagctcgcctaggcaagctgagctcgcctgggcgagctgggtggcaagctcctccctcattttgctataaatag

SEQ ID NO: 40354 - DNA, 270 bp, Glycine max
  Peptide Sequence Number=SeqID_157132
atgacacccaaacccaacactgacagcggtgatgaggaacaactaagtgggggccccatcggtgctagtggtgccaaggagcgattacccatcagttcaaaattgcaaacaaaaaaggggttaggagatcgactaagagggagaatgatgcagagtcactgtttagggaggaagaggctaatgaaagattttaaggtcgctcatgagaatgcaccatctttcttaaggctggaaaaagaatgtgacctgcaattgtgcaaattaaactaa

SEQ ID NO: 40355 - DNA, 783 bp, Glycine max
  Peptide Sequence Number=SeqID_157133
atggaatttcagaagcatcatgaggaagctgagcttgggctgcccacagcagtagcagcaacgagctatgaagagtttggaatgccactgaatcacggcgaacaagagccagtggtggaagtggtaccaatggcggttccagtggcaccacccaccaacattgtggcccaaaacagtggcaagggaaagtaccaagaatgcctcaagaaccacggtgtctcaatcggcaaacacattatcgacggctgcatcgagttcctgccggggggtgaagagggcaccctggaagcgctaaaatgcattgtgtgcagctgccaccgaaacttccatcgtaaggagacccacgacacctactcagtgcccttccaccaccaccacccaccgctgccacccccagtgccatctgcagcttactatcgtgccccgccagggtacccacacatgacggggcaccaacgtgccatgctggcacacccgtccttgtcaggaggaggtgggccccagccccccttggaagacctggaggactcagaccctacgagtggtgccaccactcatgatgggtctgggtcgagcagcaaaaaacgcttcaggaccaaatttacccagcatcagaaagacaagatgttggtcttcgctgagaaactcgggtggaggatgcaaaagaatgatgacagcgccgtgcaagagttttgctccgaaatcggtgttcaacgtcatgtgctaaagccatcattccaagctagaagctcaacgttgaagcctgggagattgcgttgctga

SEQ ID NO: 40356 - DNA, 1413 bp, Glycine max
  Peptide Sequence Number=SeqID_157134
atgaatggtaaggatgaggatgattttaacttccttgaatcttgttgggaggtggttgaagttgatatcattagggatcttaatgaatttcatcttgtacaagattattgcaaaggtcttggcaaatatactaggaaggtcttgagcaaggtggtggatgatagacaattggcttttttgggtgaaaggaataatatatttgatgggatcttggttgcaaatgaggttgttcatgaagctaaggttgagaaggaacatgtttcattttcaaggctgatttcaagaaagcatgtgactcgatggatgtggtgtttcctacaatcttcatctacctctatccttgtaaacgggatcccaatggaagaattttatgctaaaaaaggacttcgtcaagaagatcctttggctccttttcttttcttgatggttgtggaaggcttgagtggattgataagggaaggggaagaaaagggattattctctggggttggtgtaagcgatggtgcgttgaagttaaaattatctatccaaacgcacttcaaaagtagtttggcggtcattcatgtggatcaagatgaagcaaggagatatgcaaaggttctaaattgcaatattatgactatcccatttgtctacttgggattgccggtgggagcagatgctaggaaggtcaatacatgggagctggttattgacaagatgaggaagaagttgacaccatggagaaggaagcatctaccctttggtgggagaatctgtttgatagaatcgaatgagcttgggtggtttcagaaaggcattgggagagtggtgggtgagaggagtgatggagcttttggaaagatgagaacatggtgtggtaatgagtggcggtgggagttggtatggagaaggttgtggttccaatgggaaaatagtcttgtgcaacaactgcgggaaataattgagaggaagggacctaaaatgaatgttaaagatgggcgggaatggaggaagagtactactcgaaaatatgttgttaaagaggtataccaagagttgaatgaagagggaaatgtggaggatcaatatttgttcaaaaagttatggaaactacttattccatcaaaggaaaatataaactatttgttgtttaaatgtccattctcttatgatatgtggatgaggtactacatgtggctgggagaaacaagcactttactaggggaatgtagaggccactcatggcagcacgcagggaacataaatggtaatagggcgagggaggcttggtggacttcatgggcatcaattgtgtggacattatggaactacataaatgacatcatttttaatcaagctggccaagattcacgagttgtttgtagatatcaagatatatatagagcttggtcatggtgtataaggctatga

SEQ ID NO: 40357 - DNA, 261 bp, Glycine max
  Peptide Sequence Number=SeqID_157135
atgaaacatacccaggtaaggtggcgaaggagaagaagcacagagttgtcacgatgctcaagtgcgacgaacacgatgctcaagcttagacaaaacgattctcagatggaggacagacaacttcaaggtatggtggcgaaggagaagaagcagagacttgtgatgatgctcgagtgcgacaaacacgatgctcagatgcagaacagagaccttcaaggtagacggagattagaagaagaagaagagagcatgaaagcttag

SEQ ID NO: 40358 - DNA, 138 bp, Glycine max
  Peptide Sequence Number=SeqID_157136
atggagcaacatcaaataaaagaactatctcctccaagttttgccaacattgatcttgacaaaagaatgtcaagaaatagaagatctttgcaagatatattgtccatgagatgggtatcaggttcaagatacaattga

SEQ ID NO: 40359 - DNA, 204 bp, Glycine max
  Peptide Sequence Number=SeqID_157137
atgagattagaagcacttattaaagaaaaggaagagagagagagagagagaaagaacttggatcttggccttgccgttgttgatggtgtcgttgctctccacctcaaagtggagaaagagatcatgaagaagatgaaggtgcaatgcttctgtcgcaacatgctcattgtcatgtgctttagtcatccatcacacacgaggtga

SEQ ID NO: 40360 - DNA, 507 bp, Glycine max
  Peptide Sequence Number=SeqID_157138
atggctaacactgtcaaatttatagagaacttcacaacttgtgagcttcctcttcaaattgaagttcccagttcatgtgctatagtagccgataactactacagacctgatctcaaaaaggcagctctagcaaggttgagcgctgtcaataggagcctcagagttgctaagtctggtgtgaagaagaggaacagacaggctgaatgcatcaaaggattacttaaagaaggtggacagttcatatgttgcaactcaactaaggatgaagatcctaggcctacaagctccaatggaacttacatcatgtggtatcaagagcatgttcatctaggtgttgaggaaagaatccctgagtttcaagaacctatggatttgaggtcaaatccttttcaagggggggagggaatgatgcaatcctaccccccaagggcattggatagaagactccaagaagattgggccagagatgcaagagaaggccctagctcctctatgatattggtttga

SEQ ID NO: 40361 - DNA, 399 bp, Glycine max
  Peptide Sequence Number=SeqID_157139
atgttgaatgtgcctctcatccatattattggagcatttgcacaatcaactatgattgtcgtgctttactactttgatcatagtgttgcatcacaacttgcccagcagaagaagttcaagctaagaaaaaccttttttcttatcattatgaccttcttctcttcgacttctttgtatgttatttctctgaaatgctcacctccccgtctaatgcaaagcatcgaatactcacttaatgcatcccatggacccaaaatctaccctaaggctcatgagaaccctaggatcttctcttgcatctctggcccgatcttcttggagtttgctatccaatgcccttggggggtaggattacatcattccctcccccttgaaaaagatttgaccttaaatccatag

SEQ ID NO: 40362 - DNA, 1152 bp, Glycine max
  misc_feature (677)..(677): n is a, c, g, or t
  Peptide Sequence Number=SeqID_157140
atgcctctccggcgtcgagtccctcttcctctgctcctcctcctcctcctcctctctcccgcagccacctccgccgtcgccttccgcaagaagcacaagatcccagggccgatcaaaaccatagtggtgatagtgatggagaatcgctccttcgaccacgtcctcggctggctcaaatcctcccgccccgacatcgatggcctcaccggcaccgaatccaaccccctctccgtctcctcccgttcttcccccacagtccccgtctccgacgacgctctcttcatcgattcagacccaggccactccttccaagccatccgcgaacaaatcttcggatccaacgacacttccgctgtccctcctccaatgaacggtttcgctcagcaagccgagtcaatactccctggcatgtccaaaaccgtcatgagcggcttcaaaccccaaaccctacccgtctacaccgctctagccaaccaattcggtttatttgacaaatggttcgcttcggttccggcttccactcaaccaaaccggttctacgtccactccgctacctcccacggcgccatgagcaacgtccgcaaggacctcatccacggattccctcagaaaaccatcttcgactcgctcaacgagaacaacctctccttcggtatctactaccagaacatccccgncacactcttcttcaagagcctgcgcaaattaaagaacgccgtgaagttccatgactacgccttgaagttcaagaaacacgccgagaaagggaagcttccgaattacgtggtggtggagcagaggtacttcgatgtcgaggtttttccggcgaacgatgatcatccctcgcatgacgtggcggcggggcagatgttcgtgaaggaggtgtatgaggttttgaggaagagtccgcagtgggaggagatggcggtgttgattacttacgatgagcatggtggattttatgaccatgtggctacgccggtggaaggggttcctaaccccgatgggatcattggaccccacccttattactttgggtttgataggttgggggtgagggttcccacgtttattatctcgccttggatcgacaagggtactggtatgtgctctaaagttttcagcttttttgaatgtgtgttgggtaattga

SEQ ID NO: 40363 - DNA, 435 bp, Glycine max
  Peptide Sequence Number=SeqID_157141
atgtcagcatgtcattgcagagttttgcaaccaaatgatttgaaactcattgaggaaacttgcaagagaaccccaaaacctaatctttgtcttcaactcctaaaaggtgacccccgtgcccctagcgctgatattgcaggccttgcattgattttggtcgatgtgatccaagccaaagcaaatgaagccgagaaaacaatcaagcaacttctaaagcagggtggtaataagaaagccttaagtgaatgtgctgtcgattacaaaaggattttgatacttgatataccagaagccactagggctgtgaggggagaccccaaatttgcagatgatgcggttagtgattgtgctgttgaggctgatatttgcgagaatcgcttcaatgggaaatcaccactcacccatgtgaataatggcattttctgtgtagtgtga

SEQ ID NO: 40364 - DNA, 741 bp, Glycine max
  Peptide Sequence Number=SeqID_157142
atgctgaacttgaagcacctctctataatttgcagcattcttgttgtggctatcatttcaatgtcagcatgtcattgcagagttttgcaaccaaatgatttgaaactcattgaggaaacttgcaagagaaccccaaatcctaatctttgtcttcaactcctaaaagctgacccccgtgcccctagcgctgatattgcaggccttgcattgattttggtcgatgtgatcaaagccaaagcaaccgaagccgagaaaacaatcaagcaacttcttaagcagggtgggaacaagaaagccttaagtgaatgtgctgatgattacgatgggattttgatgcttgatgtgccaactgccactagggctgtgaggggagaccccaaatttgcagaaaatacggtaagtgactgtgctgttgaggctgattcttgtgagaatggcttccatgggaaatcaccactcacccatgtgaataatgttcctaagcaaaaacttgaccggtcaagcactactacaaaaaacacatttagcatcgtcaaattaacatcggttttacacaaaactgatgttaagaacccgacccctagctactttcctcgcgctttgttcttcgcttgttcttcttcttcttcttcgcttcttcttcttcgggaccgtgagtacaacttcttcaggagttggtttatggaagtcgtgttcgctgcaaggattaggtttttgctcgcattgtgtcattttgagtga

SEQ ID NO: 40365 - DNA, 1245 bp, Glycine max
  Peptide Sequence Number=SeqID_157143
atgtgtcaatcacatgcagatccaaacgggccaatgtactacaatggagtgtaccatctgttctaccagtacaatcccaaagggacagaatggggtaacatagtgtgggcgcactcggtgtccaaggatctgataaactggaatggcattgaacatgctatttatccatcaaagccctttgacaaatttggctgctggtcagggtctgctaccatagtccccgacaaaaataacactcaagtgcaatgctatgccgaaccagaagacccaaatgacccacttcttcggagatgggtgaaaccagacaggctcaacccagttgtggtagataaagatgctaaccaaactgaatttcgtgaccccacaacagcttggtggggaaaggacggtcactggaggatgctggtgggcagtgtaaggaagcgcagaggaatagcttatctatacaggagcaaggacttcatgacatgggttccagccaaacactatccattccatgggtggtacgggataaggataggtatgtgcctgacaacacttctggatggttggggcggacttagttatgattatggcaacttctatgcttccaaatcgttttttgaccccagcaagaaccggaggatcttatggggttgggcaaacgagagtgataaaccaaaagacaatttttggaaaggatgggcaggaattcaggcgattccacgaactgtgtggctcgattttactgggagacaattggtgcaatggcctgttgaagagttaaacagtctcagaggcaaagaagttaacatagacaatcaaaggcttgagaagggagattatagtgaagtaaaaggaatcactgcagcccagatgttgaagttacgttcgccttttcaagcttggacaaggcagaggcatatgatcctaagtggagttttcaaaagtccaaataagcatattgttctcttatgctctgatgcgagaagttcatctttgaagagtgatctgtacaaaccccaatttgctgggtttgtagatgtggatttggccacagataagaagatttttcttaggagtttgattgatcactcagttgtggagagttttggagcaggagggaagacaaacattttgtcccgggtctatcctgagctagcagtgatgaaccaagcgtacttgtttgtgttcaacaatggtactgaaccaatcgtggtggaaaacctgaaagcttggagcatgatatctgctgatataaaatga

SEQ ID NO: 40366 - DNA, 321 bp, Glycine max
  Peptide Sequence Number=SeqID_157144
atgaagcacggacacgccgctgatgtgctgcgtcccacgttggaggcgtaccggacacgcaaacgggtacaactccggtatgacgcggtgtctgttgcctccgcctgtcactggacacggttggacacaagaagcgcgcgattggacgcggtccaccaagtagtggacatgcgcgacgatgcgcaggttaataatcgtgcacactcctcatccgataaggactcaccggatacaaaatcacaggctgcgaatatcaaaagaagagaaggtaggaaagaaaaaggacaaaagaatcggttgatgtttgaggaatcgcgttag

SEQ ID NO: 40367 - DNA, 297 bp, Glycine max
  Peptide Sequence Number=SeqID_157145
atgattcagaagatgtttgaacccagccgttctggtctaacaagaagctcctcccatgtagcctccattaacatcaatgtcggggcaagtataagtgaatatggtgttatgggtatggatgatcaaagaggttccctttttggcagtcctattcatgctggtgcattagatatctttaaggaagatgtttatggctttggtgtcattctacttcaattggttactgacacactctctcaagtatacacaaatcaaaatatagacatcattgatattggaaaaatgatcatcacctga

SEQ ID NO: 40368 - DNA, 744 bp, Glycine max
  Peptide Sequence Number=SeqID_157146
atgagcatctcattatcacgtggccaggagaaaaagaaacaatcgggttcttctaaatttaatgtcaaaataagaaaggatggacttcagaaacctttaaaagttgagccaattgtaaaagaagagggtgaaatgtccgatgacgaagaagtacatgagcagttcaaggaagtgctttcaaaaatccgcaactacttacagcttcttgggctaatgatagatcaaattgtcttagaacatgaagaggaaccctataagcaagatagaatgaccacgcaattgtggaagtctgtttccaccttttctcatctttcaggagagaggctttgtcaaatttattcaaaacttaaagtggagcaaaatgtggcaggggttggcccctctcattccaatggttcagtatctgatccatttagcaggaatagaaaccctaaccactcttatccatttcctcgccatatggagaagcagagaggaaacaaaaacatgactacctaccaaatgccagaacaaataaatattactgacatgtctgaaccatggaaacgtagaagagctgaaagtaatgttcatttccagggtcaattaccagctcaaagaaccatagtaatatccctagacatgggatttgcatccttgaacaaagtggctgacgccaatgagtatctggcatttggattgcaagatgaatgcaagcttgcccattttcttcctctttttcctattgattcttcttacccttga

SEQ ID NO: 40369 - DNA, 318 bp, Glycine max
  Peptide Sequence Number=SeqID_157147
atgtattacacaaaaggagatgtcaccacacattatgcaggatggtggaagcagtcaatactgtatcatcatcgtgattttgcaaagaatatactcggtgaaagagcagtctatgcaatgatgctggtgtttccacctgaattttgtcctttgaaaactattttatttggaaatccttctcaagacaccgttgaaccattgatggaggctttggaggaagattataaagatggaaatgaaataaatgaatcaaggcagtttattggaggagtattggatcttgaaaagacaatcaatagactagatacattgacttag

SEQ ID NO: 40370 - DNA, 1486 bp, Glycine max
  Peptide Sequence Number=SeqID_157148
acatgttggacggtcgttcctgcgttgttccgaggatgttttccggcacttgccaggcagagaacgattggtcttacatgaagtgcttgctggagttggacatcaagaatggcaagcgccctatggagattgatgatgttgaggaggatgagccccaccagccaaggaagtgtactaagaagttggattcttgccatagagttgaaatggctcgaatttcgtttcaacgtcaatctattgaggccaaggattctgttgttccccctatggatcaggagaccattgagccactgagtgtttgtcaaggagttgttgaagaagatggagctttgaccgaccagctattggatgagaaagaacaggaggttgatggttatttgatggattttggtgaccatcaatctgataaacagcagcaggctcagacgggggattcatcagatttcggtgctcagctatctgatgaagatcaattgcagcatgatgatgagaatttattgaattcgagtgagcagcaatccgaggggcagcagcagcaccatggtggggattcttcggattccagttctctcttgccacgcatgaaccgggacagttcaatcgcctgtctcagccgctgttcaaggtcagattatggttctctcgcctcgctgaataggagcttctggaacataatccgaagcggtgagctctatcagtggaggagactgaatggtatcatggaacactggatttatttttcctgcgccctcctcgaatgggaggcctatgatccgattcgccagcggtggatgcatttgccaaggatggcttctaatgaatgcttcatgtgttcagataaggaatctttagctgtaggtactgagctgcttgtgtttgggagggagctgagatcccatgtcacttacagatacagtctcttgacaaactcgtggacgtccggaacaaggatgaatgctccaagatgcttgtttggctcagcaagccttggtgagattgcaatattagctggtgggtgtgattcagagggacacatccttgactctgctgaattatataattctgagactcaaacatgggaaacactcccatgggggattggggggtgtgattctaagctcctcacatgtggagaggagtacaatttacagactaggacatggaccgagattccgagcatgtcccctggacggagtagtaggggtcctgagatgcctgcaacagctgaggcaccacctctggttgctgttgtaaatgatgaattgtatgctgctgattatgccgacatggaggttaagaagtatgacaaggagagaaaagtgtggttaaccattgggagactgccggaacgagcagtgtcaatgaatggctggggtcttgcattcagggcatgtggagataagcttattgtcattggtggacctaggactcatggcgagggctttattgaactcaattcatgggtgcctagtgaaggacctccacg

SEQ ID NO: 40371 - DNA, 303 bp, Glycine max
  Peptide Sequence Number=SeqID_157149
atgttgcttgtaagcacaatccgtgctgctttgccacattcctttataagttttggaggaaaaaatactaggtttctgcactcttaccctcaacaagggcaaagacaattggaaggtgtggaagcaatgccttccaaggttattttgatgatgccaaagaatcaagagttaagcaaagtttcaagcaaagattcaagaatcaagtttcaagtttcaagtttcaagtttcaagtttcaagaatcaagaatcaagtttcaagaatcaagaataatcaagatcaagattcaagattcaagaattaa

SEQ ID NO: 40372 - DNA, 459 bp, Glycine max
  Peptide Sequence Number=SeqID_157150
atggcatttttgggagaaacaagcagtcaaatgattgtgaactccacattggcttttattttcccgaatggatcgattatttacaatgaaactggtgtttatttccaaactttcactccaatacccattcgagtacctaacgctagtggttttgaaatgctaaaaagcagaatgcacaatatccttcagctaactgacaaacaatatttggatgaaatttactaccggcggccattcgtagatgcagccactatgacccttactcatgatgtcctgctatattataacgggaggtggaacatgtcacgccaacacgactttgtcggttactcgttcacaggaaaaaatccaaaaattttttacattccttctggatataccattgatgaactaaaagatttgatcaagcaagttgcatctcaaggaattcccccttatggtattcatgaatcacaaatg

SEQ ID NO: 40373 - DNA, 117 bp, Glycine max
  Peptide Sequence Number=SeqID_157151
atggtaacgtggccacagtttgccgcgcaatgtcgtttcctactttcaggggatggccctaggcctatggtgcattctgagataatggggcatgccacattgcccccattcccttga

SEQ ID NO: 40374 - DNA, 491 bp, Glycine max
  Peptide Sequence Number=SeqID_157152
atggtcgctgaagcttggattgtgaagatgggtaaccaggtaagcgccaatctcaagcacgctcttcttcttgaaccttccgcaaggagaaaacacaaccccaaaaggcaagataatagtaccagcagtaaagaagtaattgggattctttctttcgaagtagcaaatgtaatgtccaaaaccgttcacctccacagatccttgtcggagcccgagatcgtgaagctcaggaacgagatctcgaactcacagggtgtccaaaaccttgtttcctccgaagagggttatctcctcgagctggctcgagcagagaagctcgaggagctgaaccgcgttgcaaacgtggtttctagattggggaagaagtgttccttgcctgctttgcaaggctttgagcatgtttatggggacattgttagtggggtcatagatgtgaaggaattggggttcttagttaaacacatggaaggaatggtgaggaaaatggatag

SEQ ID NO: 40375 - DNA, 380 bp, Glycine max
  Peptide Sequence Number=SeqID_157153
atgaggactttcagcaaactcatttacaaaaagatattggtcgatttattgatgatagatctaggcagacacataccctgctgaagaacatagacttaggagttggtgttgggattcagctgcggggccaaagcgtaagggatgcctttattgttagagtttgtggtcttagttcctttgtcccacatcgcttggtctgtaaaacttgtgtggtcttagtcccacatcgcttgtttagtggaggcagtgggagcaatggcattagaagaggggaaggtgaagatcgagaagttcgatggcagagatttcagcttttggaagatgcagatagaggattatctatatcagaagaagctgtattagcttttatcaggggttaa

SEQ ID NO: 40376 - DNA, 549 bp, Glycine max
  Peptide Sequence Number=SeqID_157154
atggcgcctaccaggcaccctctggacccagataagtccaacagggccctgggatttcccgccttgatcacgggactctgccagtcgttcggcgtccccgtcacgcctagcaaggtaattcggccgcccatcacccgagcttttatcgagaagtgctgcacgcagagacaggtccagggtgatgtaccacaggccgcggacacgccgccacctcatcaggatggcccagccggattgtttgatacagagcagtatttgcggcatttggttcgccagcaggcggccaaccaccgggcacatgtacagactcatgattgtctatatcagatgagtctcagcctgcagagtcagggctttactcctttcccgtgccctaccccggaccagtttagggcagaggtcgcgtggcctggggattggcctgaggcccaggcagcagaggcaccagcaggggcgccagcagaggctcccgatgaggcggatgaggcccgcgaggacgaagagatgacggatttacttgatttcttaggagggagcggagccgcatga

SEQ ID NO: 40377 - DNA, 297 bp, Glycine max
  Peptide Sequence Number=SeqID_157155
atggcatctaagaaaaggaaggctccttctacacctacccaggccagatatgacagatccaggttcacatctcaaaaagcttgggagaggtatacagacattgtggggcctagaaaactactaccgaagaggaatatgatattttatgacactgagttcgacgagttcaaggaggaactcgacagaaggcactgggatgaggagttgatttattttaatgatagcagcatagacattgctattgtgaaggaattttacgctaacctctatgaccccgaggataaatcacctaagcag

SEQ ID NO: 40378 - DNA, 162 bp, Glycine max
  Peptide Sequence Number=SeqID_157156
atggatagtgctcacctgatagtggaaaacaaaggtagcagtaccgacaagtcctttaacctcagcaaagacctcaactacttagtcttagcttactttgatgaggaaaacttgaaggaaatagcaagcacggttcacaaaggacaaggacaaggacaataa

SEQ ID NO: 40379 - DNA, 288 bp, Glycine max
  Peptide Sequence Number=SeqID_157157
aaccgtaaggttaccaaagacccaacctcttacaatgtcaatatcagaggaatcaaatcagctgatacagcaacagatatcaagaaggcataccacaaggcaactctccgacatcatgcagacaagttgttggctagaagtgaagttggagatgaaggccaactttggaaggaaatttcacaggaggtgtacaaggatgctgataagcttttcaaaatgattggagaagcatatactgcgctttcagatccagcccaaggttatacatatgatttttctactagttaa

SEQ ID NO: 40380 - DNA, 234 bp, Glycine max
  Peptide Sequence Number=SeqID_157158
atgtgggatcggcacaggcttaaaggagcattcaaaccaagtgtatttacccccaaggcctacacttcgaagagtccatcagggccactccctcctgattcaggagaatctgataaagcatcagcatcaaggccgcgtgctaagcgcgagatcagtgcgctaagcacagcaggtgtcttcagccaggctcagtgcaagattggcgctaaacccaaacccacttacttgcgctaa

SEQ ID NO: 40381 - DNA, 192 bp, Glycine max
  Peptide Sequence Number=SeqID_157159
atgaaacgagcaaagcaacagaacaaacaggtcaaactactttcgatcaacaagccagaggcaactcagagtgggactgagaaagaagagtcacgagcagtcatagctgacaacaatgtggttgcaatcacgagcaatttgcggcagtcagtgctcaggcagaaagagaaaggagaaacaatagggttttag

SEQ ID NO: 40382 - DNA, 495 bp, Glycine max
  Peptide Sequence Number=SeqID_157160
atgacgaaaacacgaaatgaccctccaccagctcaacgaacgaacgatgctgctgctgctttggtaattgcatttgctggtgaggtgactcatctctctctctctctcatctctccctctctctcatctctcccttccaaaaaaaagcaccaattttttcgaacgccaacgcgaatcacgaagagggtcaccgagaaaatgggtgtttgtgggtcgaggcccaaagtgaacgaggacctctcagcgaagaagaagaacaaccaccaccgaagaagaagaaggagaatcctcagaagacgcgtctcttctagaaagatcgaagctaacaacgtttctcactgtaattcagctcttcaagcttctaatcgcgcttctgatgctgcttggtttgattctacttcggcattggattctgagtgtgatgacgaattttacagtgtctatgatggtatgtcagtgtttcccccatcaccccctaaatttggtgtatccgag

SEQ ID NO: 40383 - DNA, 378 bp, Glycine max
  Peptide Sequence Number=SeqID_157161
ttggacttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 40384 - DNA, 1797 bp, Glycine max
  Peptide Sequence Number=SeqID_157162
atgctgcgcctggtcactctgcttctgctgctgttgagcccgctactggccgcccagccgcagcccgaaatatttcagttgttcagccgtgaaaagctggcaccgatgcatattgagttgagcggtgacgagtggcgctggctgcgcattaaacatgagctgcgcatcgcggtgtggacaccggagctgccgccttatctgatctttcaggaggcagcgggcagcggcaacagcgtggaagggatctacgccgattatctgcaactgctggcgcgtaatcttggcgtgcaggcggtgatggtgcgttatcccagtcagacggcggcgcaggcagcggtgaaaagcggcgcggcggacgccttgtttagctcgccggggcgcgaactgcacgatgcggcggccttcagggcgacagacagttttctcatcaatcgtccggtggtgattgctgcggagaagcaggcctcacagccggtgccctacgatgcgccgctgcgcctcgccatgcgcgaaggctctcttaccgatgctcaaatcaaacagcgttttccgcaggccagtatagtgcgttatccctccagccaggcggcgctggaggcggtagccagtggcgaagcggactatgcgctcggcagcctgcaggcggcgacgtttttgattgagcgcagctatgtcaatcagctggcgctggcagcgattttgccggaagacgcgctgtacggcagccgtctggtggtgaaagccgataatcagccgctgttgaaagcgctgaatgccgccatcgccgccattcccggcgaacagcatcggctgatttctcggcagtggacgcagcggccggacgtctggcggctgcaggatccgctcagcctgacgccgcgcgagcagcagtggctgcagcagcatgcgcaagtgaaggtggggttcaatccgttctccgcaccgctggcactgctggatgagcagggagaatttcagggcattagcgccgatctgctgcatctgatccagctgcgcaccgggctgtttttcaccccggtgccggcgtattcgtggcgtgacggcgtacagcaactggagcagcatcaggtagcgatgctggcagcggtggcgcaggatggcggccatcaggaggcagtgcgctttacccgaccttacctgaaggtgccgctggtgctgctggtgccggaccagcccgatgcgccgcaggcgctctatcccggcatgaagctcagtatcgtcaaaggcaatccggcgcgtcaggcgctgctggatcgtttccccacgctgcagctgtctgaagtggacaacgccagcctggcgctgcaactgttgcaggagggcaaggtcgccgggctgatcgataaccagctgagcgtgaacacgttactggcgcgctacgcgcagcagccgctgaagatcgtgtcgcgtctggcgctgccgccggtggagctgagctttgccgtcagtcgcgatcagccggagctgttgagcattattgataaggcgctggccgacattcagccgagcgaaatctcgctgattgccagccgctggcagggcacaccgcagaccacgcgcaccacctggcagctataccgcgcgcagttttacgccatctctctgctgaccgcgctgctgctgatcgcctgtctggcttgggtttactatcgcggcaaagaggtgaagcatcgccgtcgcgcagaagctgacctgcaggctgaactgcgctttcgtgatgcgctgctgaatggcctgccaacgccggtctacgtgctggatcgcaactggaacgtg

SEQ ID NO: 40385 - DNA, 388 bp, Glycine max
  Peptide Sequence Number=SeqID_157163
ggatggatggattacccaacttatattcaagggtcaaatcttaatcacgattcttcaagcgctcgagacattggttcaagttctcgatcctgacgacgaggttggtgacgaagtagatgagctagtagaagaggatggcaaaggtgcttcgatagggtgcaagaatctccccatcggcggcagccgcaagaacgctaagcgctcctgcacccaccacgccactgccacatcatcctcctccaccatgatcttcacttcatttctgaacaacacccatggctctgggtttctcaccttgggtggctttgggcttggacacaggtatgacaacatgggctttggcatttggagattgagttgggcaacccgacgacctgacgagcagtga

SEQ ID NO: 40386 - DNA, 357 bp, Glycine max
  Peptide Sequence Number=SeqID_157164
atggaagcacagacagcttgttttcctcttgggtttttgtcgttgccatgctccaatgtgggaaacccagttttggttttcttgctgacaacaaagtcatcgggtaagtgtgcgtcactgatgagggacacgaccattgtcaaagatgacgatgacaaactattcttcttgttctatgtccccacaagtttcgttctcggcgaggaagtcggtggtggaaaacacgcttgccgtaaaaaatgtcgcaccgaaccattcgaccctctaatcgcacaatcatgctcagcaccaagtgccaatcctgaacactcaaaagcctcactgataatgattgccaaatcgttcccaaacaaataa

SEQ ID NO: 40387 - DNA, 279 bp, Glycine max
  Peptide Sequence Number=SeqID_157165
atgggtgttggtgatgtcattagttgtagaaggttgcttcttggagccttggtatctttaggagtcatctggtttatgttccttgcaatctcagtaaaccgtcaaaccaagaggacagtgctagttccaatgaatgttatctccaagcatttaaagttggttagcatgcagaggcatgccctgcattcaaattctggactattcatcgtgagcaagagaagagtgccaaatggtcctgatccaatacacaacaggcaatgtgcatctgaagagaagtaa

SEQ ID NO: 40388 - DNA, 759 bp, Glycine max
  Peptide Sequence Number=SeqID_157166
atggcggttttgttgcctccaacattctccccacttctactaaacaccaagacagattttgggtcaccaccatttcctcttctcaccctctcctcctcctcacccacctcctcacccctcttcgtctcttacaccaaatccggaaatgggttggccagtgaggacaaaaaaatcttgcttgagaagtatggctacgatattgatgctgatgagtacttttcacagtcatcttctaagtccaagaggagaaaggagcaaccaaggagaagaggagggaagcaagtgcaggacccaccagaggaccctaagcctcctcgtgtaacccataaattgcttcaggttcttggaggaacagctcgaagagtgaagctactttcaccaaagggcatggatgtgcgccccatgatggaagtggtgaaaggtgcagcctttgatatattacaggcagctggtggctgtcctgcagcattgagacctggtcgctggttagacttgtatagcggtacaggttctgttggaattgaagcacttagccgaggatgttctcaggtgcattttgttgagatggatccgtgggttgtatcagatgttttacgtccaaacctggaggaaactggattcctagatgcttcagtcatacatactgtccgtgtagaaaaattctttgagcgtgcagagcaatttgtaggcatgtgtatcttttcccttttaattccatttaatgcatatctacgtagcatcttagtcaactgggattag

SEQ ID NO: 40389 - DNA, 429 bp, Glycine max
  Peptide Sequence Number=SeqID_157167
atgaaccatagtagactaatcatccaaattcaatctagtggcattgtgcattggtctctgctaatactgaaaactctcaccggtcaccgccattatcacaaaatcaaactcaaccaaatctactatttaaaagaaacagaaaattttcataaaattcttcataatcgaagttcctcaaattttccatgggcgtcgatctacgagactaccacaacactcttgtgcggcaaagccaactgtataaccttaacacctcttacagttggcgactggcatgaacgttttggagtgttggtcgaggttgtagtgaagcaagctaagccagagatgacggctaccttaatggcttcgaagaagaataaacgttggatggagcaaccgttggaatctgtatgggtctgcctctttgaatctcttgtacatgattaa

SEQ ID NO: 40390 - DNA, 1940 bp, Glycine max
  Peptide Sequence Number=SeqID_157168
tcaatggcaccaccttcccaacaacagggctagacccttacccttctaaccccaccataaaaaccaaacctttcacaccccaacaacctcgtttccccctccatggatcgcagcaacaccttttcctcctcgttccttctgctgatcttgtcgaaggcgacgtgagatgtctcaagggcatcaaggaaaccctctccgaccctctgaaccgcctcagcgattggcgcttcgacaacacaaccataggtttcatctgcaaattcgcaggtgtgtcttgctggaacgatagggagaaccgtgtcttaagtttgaccttacgagacttcaagctctcgggtaagatccccgaggccttgaagcactgtgggaaaaacattcaaaagttggatcttgcttcaaactctttctctttggagatcccacgtgagatctgttcttggatgccttttttggtttctttagatttgtcaagtaaccagctttctgggtttattccacccacgattgagaaatgttcttatctgaatgagttggtgttgtcgaataaccagctttctgggtcgattccctttgagtttgggagtttaggtaggctcaggaagttttctgtggccaataataggcttagtgggacaatttctgagttcttcaacaggtttgatagggagggttttgaagggaatagtgggctttgtgggggtcctcttggaggaaagtgtggtgggatgagtaagaagaatcttgctattattattgctgctggggtgtttggtgctgctgcttcgttgttgctggcttttgggttgtggtggtggtaccatttgagtgggaagaagaagaaggggcatggggttggttctggtgttggtggtggtggtggtgattgggctttgaggttaagagggtataagcttgtgcaggttagtctctttcagaagcctattgtgaagttgaagttgggggatttgatggctgctactagtaatttcagcggggagaatgttcttttcgcgacgaggaccgggactacgtataaggctgatcttccggatgggtccacgctcgcggtgaagcggttgagtgcgtgtaggatcggggagaagcagtttgggatggagatgaatcggttggggcaggttaggcaccctaatctggcgccgctgttggggtactgcattgtggaggaggagaagttgttggtttacaagcacatgtcgaacgggacattgtattcattgttgcataagaatggtggcggtgcattggattggttgatgaggtttaggattgcattgggtgtggcgagggggcttgcgtggctgcaccatggctgccaccctccgattatacagcagaacatttgctccagtgtgattcttgtcgacgaggagtttgatgcccggttgatggactttgggcttgcgaggctcatggcttcagactcaaatggtagttttgtgaatggtgatttgggggagcttgggtacattgcgccggagtatcctagtacacttgttgcatcactgaaaggggatgtgtatgggtttggtattttgcttttggagttggtgactgggcgaaaacctcttgatgtaagcaatggggaggaagagttcaagggtagcttggtggattgggtgaatatgcattctagttctggccgaatcaaggattgcattgataaagctatatccggaaggggacacgatgaggagattctgcagtttctgaaaactgcaatgaattgtgtggtttctcgccccaaggatagatggtctatgtaccaggtttatcattccataaagagcatatccaaagaacagagtttctttgaacatgatgatgaatttcccttgatctttggtaagccagaaaacgagagttctcagaatcgtgctaatgtttatggtttgagcatgtccatgggtgaccctaatcag

SEQ ID NO: 40391 - DNA, 918 bp, Glycine max
  Peptide Sequence Number=SeqID_157169
gactacatgtcttcaccttcaaaggactacatgtcctcgccttcaaaggactacatgtcctcgccttcagagggctgcgtaccctcacctttagaggactacacatcgtcacctttagaggactacacgtcctcgccttcagaggactacatgtcctcgcctttagaggactacacgtcctcgccttcagaggactacacgtcctcacctttagaggacgacacgtcctcggcttaagaggactacacgtcctcaccttcagagggctgcacgccctcgccttcagaggactacacgtcctcacctttggtggactacacgtcctctccttaagaggactacacgtcctcaccttcagaggactacacgacctcggcttcaaaggactacatgtcctcacctttatagggctacacgccctcgccttcagaggactacacgtccttgccttcagaggactagacgtcctcaccttcagagggctacacgtcctcgcctttagagggctacacgtcctcaccttcagaggactacacgttgtccccttcaaaggactacacgtcctcaccttcaaagactacacatccacgcctttcagagggttgtgtaccctcaacgtcaaaggactacacgtcctcgccttcagaggactacatgtcctcgccttcaaaggaccgcacgtcctcccctttagagggctacacgccctccctttcagagggctacacgccctccccttcagagggctacacatcctcagctttcgaggactacacatcctgaccttcagagggctgcacgcccttaccttcagagggccgcacgtcctcgccttcattaggatacacgccttgatgagaataatgaaactggccaattacaggctaaaggcccaagtggagaaggacgaaggcccat

SEQ ID NO: 40392 - DNA, 642 bp, Glycine max
  Peptide Sequence Number=SeqID_157170
atgaaaattcaagtaccagaaatattccctccttctagatgtcctatgcaaagtcacccaatgaaaaatcagatgccacatcaccaaatttgcctagttccgagaacagattccaaacagggcaaagcagttttttgcctcgtttcagaaaaccagtgttattatttggttcacgtttacaattacctcgcacagtgggtaatcggaggcgctgagattgatgaaccagtcccaatccccgagctccctaagcaggatcgcggcggcgtggagcgtgttggcgaccatggtgggtcccctgtacgtgacgaggttcgccttcttgataaccctcacattcccgaaccgcttgaacagcgcgtggccctccacgaacctcaccaaatcggagcgctcctccgccgaggactcgaggtcgaggtggaccacgtagcgattgttggggtggtagagagcgaggaggacgcgggtgacggcggcgccgtcgcccttggagccggagacgaggtaggcgaggcgcggcgggggagggagggcggagacggggagggggcggagcttggattcgacgaagacggagtaggaggcggcggtgatggagcggtagaatgggagaatgggggtgccctccggggaggttag

SEQ ID NO: 40393 - DNA, 807 bp, Glycine max
  Peptide Sequence Number=SeqID_157171
atgatgtttgcaacccttagagacaaattgaaaaattacaaaggtgaggtgatgcctaagcccctgaaaaggttggattgggaggttgaaaagtttgggaattgggtagctacttggagaggagatggagatttcaaagtgacatcaatcaatggtatagatatgtggtcagctatagagtttgatgacattcaaccaccaaaatacaaaaaggggcctggtagaccaaagaaattgagaaagaaagaacctgatgagaaccctaacagaagtagactaataagggatcaagttccatataaatgtagtagaagtcgagcaataggtcataatacgaggaggtgtccattgccacctctaatagtacctgaagaacaaaatgaggaacctagtggagctgctgaaggtggtgtcactagaggaacaaaaaagggtggaactcaaggagcaactcagggtagaaatgagggtacacctgttagaggtcaaactcaacaactaaatgttgttctgggtagatttgaaggtgcacctgctagagttcaaactcagaataaaaaaaaggaaatcacacaaatcaaatgttcaaagacaaacaataagggaaaatgtgtacatcagtctataagaaaagttgttggtcctcaacaacatcagcagaccaaacctacaaataggcacacaatggggcactttggacacaacactactgcgaatgaaaaagtacaaaaacttgttcctaaacacaaagcaccaacaacaagcaaaaaacttaaagattgtcaactaacgaaagtgatgacgtga

SEQ ID NO: 40394 - DNA, 1626 bp, Glycine max
  Peptide Sequence Number=SeqID_157172
gcagggtcactcatggcctcaaccatgttcatatataccatgttcatgcgcttttttccctctcctcttcaagcccgtgttcgaaggtacaccaacaaattcaccagctttgtgtacccttacatcagaatcaggttccacgaattcaccggtgaacgcctcatgaaaagtgaggcttacaatgccatccaaacctaccttagtgaacactcttcccaaagggcatcaaagctcaaagctgaagcgatcaaggtgaaagacacacgcaccccgttgatgcttagcatggacgataatgaagaaatcatagaagagttccaaggagtgaaggtgtggtggggttcatacaaaaccacctctaaaacacagtcctttccttggaactcttcttcggatgaaaaaaggtactacaaacttacctttcacaagcactatagaagcctcataactgactcttacctcaaacatgtgttggaagaagccaaggccattgagatgaagaatagacaactgaagctttacaccaacagcaagacaaggtggagccatgtggtctttgagcaccctgcgactttcgaaacactcgcaatgaagccgaaggagaaggagtgtatcatcaatgaccttgtgaagttcaagagtgggaaaacttattatgccaaaattgggaaggcttggaaaagagggtacttgctgtatggccctccaggtaccgggaaatctaccatggtcgcggctatggctaatttcatgaactatgatgtgtatgatcttgaattgacagcggtgaaggacaattcagatttgagaaagctgttgattaacacttcaagtaagtcgattatggtgattgaagacattgattgctcccttgatctcactggtcaaaggaagaagagaaaagaaaaagttgagggtagagaaggaaaagattctagaaaaaggggtgatgaggatgatgatgatgatgatagaggtagcaaagtaacactttctggactattgaatgttatagatgggatttggtcagcttgtgggggagagaggatcatggttttcacaactaattttgtggagaagcttgatcctgctttgattaggagagggaggatggacaagcacatagaattgtcctattgttgctatgaggcattcaaggtgcttgctcagaactatttgggtcttgagtctcaccaattgtttcctaaaattgagaagttgttggaagagactaagatgacccctgctgatgttgctgagaatcttatgccaaagtcactggatgaagaagtggacacttgcttgcataacttgattcaagctcttgagaggtccaaggtagacttagagaaaaagaaggcagagacagaaaggaagcaatccaatgtgcaaaagactagtgaaaaccatggtgaaggaatggaagaaaatggtgttagcgttgagtttgagcctgcaattctggggtccaatagcccttcctatttccaagacacatgtgatgtaaggatcgaggatgagatcacggccaaaaggcatgactttgtagcagaagttggttgtgtcaatgatgaatgccgtcttttcttgatccagaggatacatcttgatctagttgtagcctga

SEQ ID NO: 40395 - DNA, 387 bp, Glycine max
  Peptide Sequence Number=SeqID_157173
atggatggaggatatagtacaaaaataaatagaacaagggctccttacaaatgccaacctacttgcttagaatgcctcagacatgtcaggcaaacacaagcttggagaagaaagaagaaaagccatggaagcagaagtagaaaaatgatccgagaagtgaactataccacttggctagccaatgtggttatggctacaactagatcaagatgtatcctctggatcaagaaaagacggcattcatcattgacacaaccaacttctgctacaaagtcatgccttttggcctcaagaacacaaaagcaacatattagaggctcatggataaggtcttcaagaagcagatcagacgaaatgtggaagtatacgtggacaacatggttgtaa

SEQ ID NO: 40396 - DNA, 1260 bp, Glycine max
  Peptide Sequence Number=SeqID_157174
atggttcagatcgcgaggaggaagaagggacggccgtcgaaggcggatctggcgcgccgctccggcgagtctccggccgccgcgtcgcagtccgatccccggcggagcctccggcgtcggagcgtgaggtacaacatcatcgactacgacggcgattacctcgacgacgacgaggaggacgagaggaggcgcaagaagaagaagctcaagctcatggcgaagctgaaccaggacggtgaagaagaagaagaagaagagcgagaagaagaagaagaaatcgagccgacgtcgccgagccgcactcgccccgagccagtggaagaatacggtgacgacgaaaaggaagagaacgaaaacgaacaagaggaagagaacgaagaagacgaagacgctgtggtaaagggcagaaaagtggaatcgaaagggctccactctgtttctgtttcagctccggtgattcttcaatctgggactccgttgcctgataggaggactctggaattgatccttgacaagcttcagaagaaggatacttatggtgtgtttgcagaccccgttgacccggaagagcttcctgattatcatgatgtgatcgagcatcccatggactttgccactgtgaggaagaagttgggaaatggatcttatactaccttagaacaatttgagattgatgtctttttaatttgctcaaatgcaatgcaatacaatgcaccagagactatataccacaaacaggcacgatcaatacaagaacttggacagaagaagtttgagaagttaaggattggctttgaacgctctcagattgagcttaaatcagaacaaaaagcaggatccaattatttggttaagaagcaaccaaagaagccactggcacatgcctcacaagaacctgttggctctgatttctcctcaggggcaactctcgctactattgcagatgtacagccaacttcccatctgatgcaaggtggtagatgtgagaggtctggcaatattgatggtattttggaggcaaatgctttctggattgatgcaaatcaagagaaagctgaagatgttttgtcaggtatgtcagtaatgagatcatgctattatctttctcccattacatttgccccaattattcctatacattctgttaaaggaggatacttatgtcaaaagctaggttattccatttttgattgtggttctatattgtttcagggaaaaggtcttctctctaagtggggaagggaagtcctttgtgcttga

SEQ ID NO: 40397 - DNA, 333 bp, Glycine max
  Peptide Sequence Number=SeqID_157175
atggcagcttcgcatctgcagaggatcacaattttcacaacaaactttgtggggaaacttgaccctgctctcattaggagagggaggatggacaagcacatagaaatgtcatactgtggctatgaggctttcaagttgttggggaagatcaatatgacacctgctgatgttgctgagaatctgatgcctaagtcatttgtagaagattctgagacttgcttgaagaatctggttaagtctcttgaggaggccaagaagaaagttaaagagcaagaggttaatgctaatggaaaatctggtgaagggctgaaagagaatggcaccgtccattag

SEQ ID NO: 40398 - DNA, 1344 bp, Glycine max
  Peptide Sequence Number=SeqID_157176
gttggacttcatgcagaatattcctatgctagtagtttggctcgttttggtgcatctctaggacctattgcttggaaaattgcttcgcacaggattcaacaggcactgcctgctggatgtaaatttggtcgtggttgggttggagagtatgaaccacttccaaccccaatattaaaggttaataattgtgcccaaaaagaaactagtttggttatgaagtttccttcctctactgaattaccaaacagtaaccaaaattgtaagaatgtgaaatccagcatcgagcatcctttaaatggacagatgcttgagggaaaacatccttcaatgcctgatttcaaaggaaaacttttctttggttctgctggagtaagactcagtgctcctgtcaacatccttaatcaggagcagaatgcccaatccaggaaatcaggcaagtctgagaaaaagggtttgaagcaagtggagttgaattctttaacctcaagtaatcaaaataataatggtctggttgcaaagtttacaagtaatgctcctgcagtagagtccaagcccagagagatggtgccaaggaacatgttcaaacagccagatactaatggaattgttagtggagagttgcctaatggaaaagtcacaaatacaagcttgaatatacaggtgactggttcatcacctgaaagtacatcacatcaatcaagcagagctgctcctgctgttgtccatgggcaggagcagggccttagcgacccagttcagttgatgagaatgttcgcagaaagggctcaaaagcaacacacttcttccaatcatttgcttgttgatactccaccagtgacactatcaggtccatctggacagagaaatgaattgggaaatgcttcagcagcagctgcccatgcatggatgtctgttggggcaggagggtttaaacaaggacccaacaattctagttcacccaaaaatcagatatctgcagattctttgtacaactcaacaagagagttgcatcagcatatttcaagaattcggggggagtttccctctggtggaatgcctttccaaccatttcaagcagttgctcctcaacctattcacacaggcgctgtttctcagtttcccaaccggcctatggttttccctcagttagcatctgctgaccaatctagatttcaaatgcagtccccttggcgaggtcttagtcctcatagccagtcaaggcagaaacaggaaacccttccacctgacttgaatattgattttgaatcaccagggtcccctgtaaaacaatcttctggtgtccttgttgactctcagcaaccagacctagctttgcaactatga

SEQ ID NO: 40399 - DNA, 265 bp, Glycine max
  Peptide Sequence Number=SeqID_157177
atggggcaatctaaaaaacaaggacatccactgtctctgtttttccgtgttgacgcggtaagtgaatgttcgagaaggcatggatcggtgcttaggttgaacagaggaggctcttcagtgaagtttgatcccacacgggtcactcagctctcgtggagtcccagggcttttctctacaagggctttttatccgatgaagaatgtgatcatttgataactctgccaatcaaggttctgaaaactgggattttggctgcaacacaag

SEQ ID NO: 40400 - DNA, 936 bp, Glycine max
  Peptide Sequence Number=SeqID_157178
atgaacgacaaccaagagatcatagatgagttccaaggagtcaaagcagggctattagagttcagaacaggacactcaagctgtacaccaacaattccatcaaagcaccctttgaagtttgagaccctcgcgatggaccctaagaagaaggaggagatcctaaacgaccttgttaagttcaagacaggtggagagtactatgctgaagttgggaaggcttggaagagagggtacttgctatatgaccctccagggactgggaagtccagcatgatagctgcaatggctaatttcatgaactatgatatgtatcatcttgaactcactgcagtgaagaaaaacactgagctgaggaagctgaagaaaaaagaaaatgaggatgaggagcaaccagagaatcctattatgaatgctgaagaagaagagaaggcaagcaaggtgactctatcagggttgttgaactttactgatgggagttggtcagtgtgcgggggagagaggatcgtaattttcacaacaaatttagtggagaagcttgatcctgctctcatcaggagagggaggatggacaagcacatagagatgtcatactgcggctatgaggctttcaaggtgctaaccaagaactacttgagaaaacaagaagaagaccaaagaagaggaagcaaagaaaaagaccagggaggaagagaaagcgtggctgaagagaatgaaaaggaacagttagctaaagcgggagaggctaaagcaaatgaaaaatctggtgaagggttttctaagcaacaaattgactggatggttattatgctttttgttattgggttatgttgtggccaagcttatacttgcacagctagaaactttcatggttatgtcattctcaaacgggcttctgttgctgccctgaatcttcaggatccaattgacttacagtga

SEQ ID NO: 40401 - DNA, 516 bp, Glycine max
  Peptide Sequence Number=SeqID_157179
atgagcatttccatctatcaccggtggtgttatgcgaacctccctctcctcacactttacgcatcagtgatcgtattcaggagaagaatattcacaatcctcattgattttggcagctcccagaacattttagagcaaaaaattggagagcttttggcactttctgtggtggctattaacccattttcagtgattgtcgtcaacggggaatctattcaatttgctggttatggctccaatgttccaatagtaatgactcacaaagttttccatattccctgctatatattgcttattcatggcgcaaacctcgtctttaggttgagtccatgcattctgtcacattattacctttggaatatgaggtgtcacactctatttcaagcggggacttggatacttcatctcttcccaagcgaaatgaccactctctcactcaatattcctccatttttgccaaaccacaaggattacctccgtaacaagcacaagatcactgcatccatcttcaattag

SEQ ID NO: 40402 - DNA, 252 bp, Glycine max
  Peptide Sequence Number=SeqID_157180
atgttgcagtcaaaatcgcggtcacagactgtttttaaaaccgtgatcaaggccaaggacaagctggagaagtctatggtggcagataacgagtctggtaaaagcataatgagtgaagtcagaacgagttctgggatgtttctcaacaaggcacagcatatagagaagtatggttggggatgttcttattttttatttttttggattgtgcttttattggaacacatggctcttgtcatcttccctgtatag

SEQ ID NO: 40403 - DNA, 387 bp, Glycine max
  Peptide Sequence Number=SeqID_157181
atgaacacgctaagcacagctgtcgtgctaagcgcgttcatcttctctgttgaactcgctaagcgcggttgtgcgctaagcgagtactatatggcttctcgtaaaaggaaggtaccagcttcagtgtcccaggcacgatatgacatatcaaaattcacatcacaagatgcctgggacagatatgcagacaatgtccttggtcggaagatccttccggaaatgaatgtgaagctgtacattacagaatttgatgaattcaggagaaaaattgagaggagaaattggcataaggagctcactaacttctcagagggaagcattgatgttgctattgttaaagaattttatgctaacctctatgaccctgaagacaaatcaagaggatga

SEQ ID NO: 40404 - DNA, 225 bp, Glycine max
  Peptide Sequence Number=SeqID_157182
atggagttgtcgctaggagaggaagcagacagaggcaatggcggggcatgtgaggtgggcgtgggtgtggatgcatttagatatgggagcgggtgtgggcatgagtgtgggaaaggaaagattgttgaaatggttcacacctttctagacaagattctagcaagtttgaagcactcctctaatcaagctcccaagaaaaatcttcattatgtgtggaatttttaa

SEQ ID NO: 40405 - DNA, 363 bp, Glycine max
  Peptide Sequence Number=SeqID_157183
atgcacattccttttccgtacaaagtccatgttgataggaagggcttaggaaggcataggtcacatcttagacctcactcccataggagagaaaaggaaagaaagcctcaagaggctaacactaactttccatacttccatgggaaggacaatgtaaaggcttactttgattgggaaataaggatagagcaacaacttaaaaggaagtctacttcaaaatctgatgaccctcactcttatccaaagaaagaccaaggtcaaggcatcttaggggtggcactttctaagcccaaagatgataaggggaagacaatagaaaagcaacccctaaggctagtatgcaagagaagactagctctataa

SEQ ID NO: 40406 - DNA, 1699 bp, Glycine max
  Peptide Sequence Number=SeqID_157184
atgaagggagtccggcataagctggagcgcagcaatgaggagagcggagtggagaagtggcgtaactggatgatagggatctgtctggtcagcacggccggcagcgtgtgggccgattcgctggatcagcaacgacagcgctatgcgcagatcaaacaggcctgggacaataaacagatggaccaggttgagcagctgatgccaacgctgcaggattatccgctctatccgtacctgcagtaccgcctgctggcgcaggatctcgatcaggagaccgggctggcggtgaaaaactttattcagcaatatccgacgctgccgccggcgcgttcgctgcagacgcgctttgttaacgtgctggcgcaccgccaggactggccgggcgtgctcagcttcagcccggatgagccgaagccggtgcaggcgcgctgtaactggtactacgccaaatgggcgaccggtcagcagcaggcggcgtttgacggggccaaagccatctggctgcgcgggaccgcgttaccgaacgactgcgacaagctgttctcggtgtggcgggcgtcagggcagctgtcgccgatcaccatcctcgaacgcatccgcctggcgatgaaagccggcaacgacagcctggtcaattacctggcgaaaatgctgccggcggattatcaaaccaccgccagcgcgctgattgcgctgcagcaaaatccccagaccgtcaccacctttgccagcaccctcggcccgaccgattttacccgcatggccaccagctacgcctttgcccgcgtggcgcgtcaggatatggacaatgcgcgcatgatgatcccgcagctggttcaggcgcagaagatgagcccggcggaagagcaggatctgaaagagacggtggtgtggcgcatgatgggtgccgatctcacctcggagcaggcgcgctggcgcgatgcggtggtgatgaacagcgaatccaccgcgctgattgagcggcgcgtgcggctggcgctgagtgaaaacgaccgtcgcggtctgaacacctggattgcccggctgccggtggaagccaaagagaaagatgagtggcagtactggcaggccgatttactgatggcgcaggggcgcaaagaggaagcggaagagatactgcgtaagctgatgcagcagcgcggtttctatccgatggtggcggcacagcggctgggcgtcgagtatccgctgcaggtggatcaggcaccggcggcggacaatagcgtggtgcaggggccggagatggcgcgcgtgcgcgagctgatgtactgggggctggataacctggcgcgcagcgagtgggccaacctgatcagcagcaaaacccatacccagcagcagatgctggcgcgctacgccaacgagcaggactggtgggatctcagcgtgcaggccaccatcaccgcgaagatgtgggatagcctgaaagagcgtttcccgctggcgtggcgcaatctgtatcagcaatacaccagcgataaaggcatcacgccaagctacgccatggcgatctctcgtcaggagagtgcgtggaacccgaaagcgcgctcaccggttggcgccagtggcctgatgcaggtgatgcctggcaccgccagccataccgtgaagatgtacaacattccgggttacgttaacagcagccagctgctcgatccgcagaccaatattcagattg

SEQ ID NO: 40407 - DNA, 227 bp, Glycine max
  Peptide Sequence Number=SeqID_157185
atggcatcgaccttcggttttacgcttcaggattggcaacgttgcgcacagcaggatgcacagcagatccctgcactgctggccgcacatctcgacgcactcgataaccaggataatgcctggctgtacctcgcttcgccggcccagctgctggcgcagttgaaccgctgctggcggcgtatcagcgcaatccggccgccctgccgctgtttggcgtgccgtttgcc

SEQ ID NO: 40408 - DNA, 1413 bp, Glycine max
  Peptide Sequence Number=SeqID_157186
atgcgcatgaccgcccagcagttcgtttcacctaatgaaatccgcgccagattctctcacgcgatgtcggacatgtatcaaaaggaggtgccgctgtacggcgatctgctggagctggtggcggaaaccaaccgacaggttctgcgcgaagatgccgcactggctcatcaactgcaaattaccggcgagatagaacgcctggcgatggagcgccacggcgccatccgggtcggcaccgcggacgagctggccaccctgcgccgcctgttccgggtgatgggcatggcgccggtcggttactatgacctgtcggtggcgggcgttccggtgcactccaccgcttttcgcgccgtacacgaagacgcgctgcagatcagccctttccgcgtgttcacctccctgctgcgcctggaactgatagaagatcccgcgctgcgtgcgctggccgagcgcttgctggcgcgccgccgcatctttaccgatcgcgcgctggagctgatcgcgctgcaggaagcgcaaggcgggctgaatgaagtgcaggcgcaagaatttgtcgaacaagcgctggaaaccttccgctggcacaaccaggcgacggtcagcgccgaagaataccggcagctgcacgatcagcatcgcctgatcgccgacgtggtggcgtttaaagggccgcatatcaaccatctgacaccgcgcacgctggatatcgatcgtgttcagcaggcgatgcccggccgcggcattacgcccaaggcggtcatcgagggcccgccgcgccgtcgtcgcgcgatcctgctgcgccaaaccagcttcaaggcgttggaagaacgcgtcgatttcgttgagcatgacggccgtgccgtcgccggccaccataccgcgcgcttcggcgagatcgaacagcgcggtgtggcgctgacgacgaaaggaagagaactctacgaccgtctgctgcaggccaccaacgatgcgctgcaagcgccgccgagcgagaagaatgccgagcgctactatcaactgctggaggaaaacttccgggcgtttccggatgattacgccacgctgcgcgagcaacagctggcctggttccgctatttcccgaccgaatgcggcctggcggccaaagagtcgctggataagcacagcactctggagcaactgatcgagaaagaacacgttcgcttccagccgctggtgtatgaagattttctgccggtcagcgccgcggggattttccagtcgaatctgggggacagccgccacgcgcagtacaacgccgcttccagccgggcagcgtttgaacaagcgttgggcagtgaggtgatcgacgagctggcgctatatcagcaaacccagcagcgttcgctggaagcctgcgcgcaagccctggggcttgccacgctgacatcctga

SEQ ID NO: 40409 - DNA, 1272 bp, Glycine max
  Peptide Sequence Number=SeqID_157187
atggcgtacgcgatggacttcatcaacaagatggaaaacggcctggatacggtgatcggtgaaaacggcgtgatgctgtccggcggccaacgtcagcgcatcgccatcgcgcgtgctttgctgcgcgattgcccgatcctgatcctggatgaggcgacttctgcgctggataccgaatccgagcgtgccattcaggccgcactggacgagctgcagaaagaccgtacttcgctggtgatcgcacaccgtctgtcgacgattgagaaggcggacgagatcctggtggtggaggacggtcgcatcgtcgaacgcggcgagcacgccgagttgcttgaacggcagggcgcctatgcgcaactgcaccgcatgcactggctgatccgcctcagctaccgctgtggcctgcgcaaaagctggcgcgcgccggtgccggtggtggtggtgggcaacctcaccgccggcggcaacggcaaaacgccgatggtgatctggctggtggaacacctgcagcagcggggctatcgcgttggcgtggtttcgcgtggttacggcggtaagtcggcggtctatcccctggtgctcaatcagaatacctcgacccgcgaggcgggcgatgagccggtgctgatttatcagcggaccggtgcgcccgtggcgattgcgcccaagcgagcagaggcggtgcaggccttgctgcaacaacagccactggatgcgatcgtcaccgacgatggcttgcagcactatgctttacagcgtgacttcgagctggtggtcatcgacggcgtgcgtcgcttcggcaacggctggtggttgccggccgggccgatgcgcgagcgtgctgcgcggcttggcagtgtcaatgcgcgcgtcgccaatggcggcgtggcgcaggccggggaaattgccatgcgcctgcaggcgcgtgatgcggtgaacctgctgagcggtgaacgtcgcccggtggccgagctgccgcacgtggtagcgatggcgggcatcggccatccgccgcgtttcttcgcgacgttggaaaaactgaacgtcgaggtggtgcaggaagtggcgtttgccgatcatcaggaatatcagcaggcgcagctggcggcgctggttgctgccgatcaaacgctgttgatgacggagaaggacgcggtgaaatgtcgcgcctttgcccagcccaattggtggtatttgccggttgatgcggtgctaccgtccgctcaggctgagcaactgctgcaggatatcgaatctctgctgaccaagtaa

SEQ ID NO: 40410 - DNA, 357 bp, Glycine max
  Peptide Sequence Number=SeqID_157188
atggtgtataaaaactcacacagcattcgttatttgctctcccttgatgagattctgctgtccctttcttcgggggggaaggatgaggattctcttcacagactgtcgcaacatgcccttttgcggctgagcgaggcgaggctcacgagtgcgctttccaaaggaggaaagatgcgcggagtcaccaccaacgtttatttgtggaaaatgtcggaaaaaaccgaaggaaaccgatcgaaaagaaaattccaagttcgggagttgtatttacgcttgaggaaggttgacaaaagcggggctcttgctcctacgtaccctccatcgaagaggaaatcagacctacgtagttctttttaa

SEQ ID NO: 40411 - DNA, 176 bp, Glycine max
  Peptide Sequence Number=SeqID_157189
atggcgctaaaggcggccggaagcgaggggacgcgggaaaatatgacctttcgcagaagcgggcgatccccccgtcgccggggggagaaggtcagcggatttcaccatggtgcggccggtgatttggttgttcaacagcgcggcggcggtggccggtgcctgctcgagggagattc

SEQ ID NO: 40412 - DNA, 861 bp, Glycine max
  Peptide Sequence Number=SeqID_157190
atgcggcaacaacacggtaaaatcgctgtggaagtagcgcgccagcagcgccgacggatagcgcatcacgaaggtagacagcagattgaccagcgaatacatcagctcctgcaccgccacgctgccgtgcgtctcgcgcagggtctcgaaatcgggcagccgcaccatcatcacgatgccgtgcgagccttcgtcttccagctgagtggtcaactggttatcgaagaacaggcgattattgagcccggttttggcgtcctgcgcggcgaaggcgcggatcagcgtatcgacccggctgcgctcttcccgcgcttccgccagatcggccagcaggcgatcgagcgcgccgctgacgttggccggccactcacgcacgtcgccctgcatgacgttttcacgctcgccgttcagaatgcgccgcgcgcggcgttccagacgatcttcgccgtcggcctgctcacgcagccagcgcaggctgaacagcaaaaccaccaccatcacgacgatcgacagcgtgacggcggcggtggattgcagcgtgcgcacgtcgctggcgaaggggtcgcggtaggtgatgtgcagcgtgctgcccggatgctgcaacaggggacgcgagacctgacgataaccgttcagcgcatcccagtgctctttttcctgcgtcggcaattgatagtcgagcagttggctggtaccggcctctatgcggatcgacacgatgccgagcgtgcgcatgacgatcggcaaccatttttcctgctcctgcggcggctcgctcagcatggcttgatcgagagtggtgaccagcgaatccaagcggcgctcctggcgatcctgggtaacgtaaaagaagctgtatga

SEQ ID NO: 40413 - DNA, 120 bp, Glycine max
  Peptide Sequence Number=SeqID_157191
atgacgactctttgcaaatccagaagaaaggtatcaaagggcaataattgtcaattttgtgaaattaagacatttccaaaaggattgcctaaagtagattccttacaatccaaaccataa

SEQ ID NO: 40414 - DNA, 284 bp, Glycine max
  Peptide Sequence Number=SeqID_157192
gcgacaaggacggtgtggataacactgtctatgaaaaatacagcattagcaaggagaaatgggctcagttttgtcagacccaccgagatccctcgtgggaggatgtgcggaaaaaagtacaagccatccagaagcaaaacaccgctccccacgtgttgtgtcgtgggggttatgattatttagaacaaaagctgatggctgagaagacaaagaaaaaactagaggaagctgctcagtccggaagcactgagggcgtcattaatcctccatctcccataagatga

SEQ ID NO: 40415 - DNA, 138 bp, Glycine max
  Peptide Sequence Number=SeqID_157193
atggaggagtcactcacagaaaaagtgactcggcagctgatggcatccttcaaccagatgcagtcccatcttcagtcacagatgcaatcacagggacttgcactgcctctggagcctgaggaattactaaagcattag

SEQ ID NO: 40416 - DNA, 1150 bp, Glycine max
  misc_feature (1025)..(1025): n is a, c, g, or t
  Peptide Sequence Number=SeqID_157194
atgagcattctctctaccggtactgactatgacacgctggcggcacacttccgaccgctgtttgcccgcatcgcggcgggcgcggcggaacgcgagcgtacgcgtatcttgccttatgaatcactgcagtggctgaaggaagccggctttggcacggtacgtattccacagcaaaaaggtggctggggcgcctcgctgccgcagctgtttcagctgttgattgagctggcggaagcggattccaacctgccgcaggcgctgcgcgcgcactttgcgtttgtcgaggaccggctcaaccagccggacaatgcggagcgcgacgcgtggtttcgccgctttgttgatggcgagctggtgggcagcggctggacggagattggcaacgtcaggctgggcgacgtgatcacccgcgttacgcctgccgccaatggctggacgctgaatggcgagaagttttacagcaccggtgcgctgtttgccgactggattgatgtttacgcacgccgcgacgataaccagggggatgtaattgcgctggtcaatacgcatcagccgggcgtcacgcgtgaagatgactgggacggatttggccagcgcctgaccggcagcggcacgacgcgcttcgagcacgcgcatgtggagacgcagcacgtatatgattttgccacgcgcttccgttatcagaccgcgtattaccagcacgtgttgctggcaacgctggcgggcattgcgcgcgcggtggcgcgggacggcgcggcagccgttgccgcacgcaaccgcgtttacagtcacggcaacggagcggcctcgcggcaggatgcgcaggtgttgcaggtggtgggcgagatcaccagtctggcatttgccgttgaagccacggtgattcgcgctacccattcactgcaatcagcatatgaagcgcacgtgagtgccgatgaagcggccatcgccgccatcaacaacctggcggaagccgaggccggacaggcgcaggtaatcgccagcgagctggtgccgcgtgccgncaccgaattgtttaatgcgcttggcgcgtcggatacgcgcgtcagcaaagcgctggatcgtcactggcgcaatgcgcgcaccgtttcgtcgcataacccggtgatctacaaagcgcgcgacatcg

SEQ ID NO: 40417 - DNA, 117 bp, Glycine max
  Peptide Sequence Number=SeqID_157195
atgtcgcacttagcgcgatgcgctgatgctgtgcttagcggtggatgcgcgctaagcccacatggtccgcttagcgcgactgctccttttagcacttcaagaatcagcctcatttaa

SEQ ID NO: 40418 - DNA, 516 bp, Glycine max
  Peptide Sequence Number=SeqID_157196
atggtgtggaagcttttgggagcacgccttttctcctcatatgcttcttctttgcttctcacacccctcttatttcgctgcaaaataagcttggttcatggccaggaacctatttttggacacctttgttacatgaaaccatctcctttcttggggaatgaaagctttcattcatatccatttctaaagtttaacgataaggttgtagaacaacaacatcaggattctcaaaaggcctcaagtgctaatggtgatggtgatggtaatgccaaagtaaagaggaacaatttgaaggggaaaagagcagttgttgttgaaatgagcctttcatatagtttggatgaaggttctgaggtaaaaatgcttgggggtcttcatgcgattggtacatctttacatgagtcccaaagaatagataaccagttgttgaatgacaataataatggcctaaaaagaaagggagctccaaaccagcgtaatcatatggttctttgcagtgctattcctgctcactaa

SEQ ID NO: 40419 - DNA, 225 bp, Glycine max
  Peptide Sequence Number=SeqID_157197
atggagcgacacgggaaacggcagggcgacttgcgattgacagagggaataatctcagttagggcacgcggtgttgtcgggttactagtcctacatttacgtcaatgtgcagcaaagctcccaacccaaagtcttcgtttacggccaatgattttcgagggagctcttatacatggaatgcacgtatcgcacggctcagagatggcagaatgcgttcctttttga

SEQ ID NO: 40420 - DNA, 417 bp, Glycine max
  Peptide Sequence Number=SeqID_157198
atgaattccaggttattgaagatcacctttcatgagaaacacggtactgatcgtatatgttgtactcatcatccaagctctgttatatgctcttcaaagtacaatttggagtttactggaggactaagatcacaatctatacgtaatcattattgtataagttcacttggtgggaactttcttgagcctcaccttttcttgaacccaatagggagagttttttctctctgcatgtctccaatcaatgatagcttcatgtctggttctctagaccacaatgttaggatatgggatctttggggcatcttacgtctacgtggtagacctgctattgcctatgaccaacaaggcctggtctttgctgtagcaatggaagggggagctattaaattgtttgattctcgttcttatgacaag

SEQ ID NO: 40421 - DNA, 180 bp, Glycine max
  Peptide Sequence Number=SeqID_157199
atgggtgatcaagtcaacttaattttcactcaatcttcgctcttgccacgcttaacgagtatggcgatactcgcgctcagcgcgcgtctcgcgttaagtgcgtcttcactttccagaattatcttcctgccgctaagcatgcgttacccgtcgagtccatgcatcatgctaaacgcctaa

SEQ ID NO: 40422 - DNA, 330 bp, Glycine max
  Peptide Sequence Number=SeqID_157200
atggcgggtcatagagctaaggcacccacgactccatccagctctctttttacagctatatcaccgctctttcttctctgcaccagagttgtcaacgcctccagttccaagttaggttggtgtcatggagttgggtcgccactggccactaagtttaagcctggtgtcaggcttcggagaatttgggttgtcgggtttggtggggaggagagaatggcagtggaggtgcaatttgaggtggcgccgctagtgtggatggagtggaagggaaatttggagatattcaaaattagtggaagggaaacaatggccataatttctctctcttag

SEQ ID NO: 40423 - DNA, 1017 bp, Glycine max
  Peptide Sequence Number=SeqID_157201
atgataggcaaggatcaaagaaggacacgtgttgcaaatgcttattactccctgtttatggctattggtaatattcttggatatgcaactggatcatacagtggttggtacaaggtttttgctttcacacttacccctgcatgcaatattagttgtgcaaatctcaagtctgctttctttctcgacattattttcattgctgtcaccacatatataagcattgtggcagctaaagaagtgcctctaagttcaagtggagcacaccctgttgaagaagcagcagcaggggaatcaggtactgcaggagaagctttcctgtgggagctatttgggacattcagatatttttcgacccctgtatggacaatactgactgttactgctctaacatggattgggtggtttccatttctcctatttgatactgattggatgggccgagagatttatggtggtgagccaaatgaaggccctaattatgatactggagttagaatgggggcacttggcttactgcttaattcagttgttcttggagtaacgtcagtactcttggagaggctatgcaggaagcggggacctgggtttctgtggggaatttcaaatatcctaatggctgtctgctttatttcaatgcttgttgtaacctatgtggcaaataacattggctatgtaggcaaagatctaccaccaactggcattgtgatagcttcattgataatctttaccattcttggatttccacttgcaatcacttacagcgttccatatgccttgatttccacacacattcagtcattggggcttggccaaggattgtcaatgggagtcctaaatcttgcaattgtgttcccacagatggtggtttccctgggaagtggaccatgggatcagctatttggtgggggaaactctccagcctttggtgtggcagctgttgcagcccttgccagtggactcatagctgtcttgtttattccccgtcctggtggtcaaaagcctcgaagccctgtatga

SEQ ID NO: 40424 - DNA, 273 bp, Glycine max
  Peptide Sequence Number=SeqID_157202
atgacaccatcatcatgcaccaaacacgagccaatagcggaattaggtgacgaattcgatgccaacttgagcttgcagaataacgttataaaaagaaatgcaaacaacgttccaatgagacgaattccaagcggagagattattgatggagaagagaactgtgtaaacagagtgacactgctacagtgcaccacctccggcggaaccgaagcctctctctctcctcctggtcttgcgcgatgcccagaggaatcggtcagaatgagattgtga

SEQ ID NO: 40425 - DNA, 327 bp, Glycine max
  Peptide Sequence Number=SeqID_157203
atggagattggtggactcgggaaggtatcacaacattatggatatgaatgttggattggagataatgaacgattactattgcttagtagacgagtatttagggtaatttgtgtagaaacaagcttcatgatgatgaatcaagttgattcaagtagttttgataatgacaaaaagtccaaagaatggtttcaagaaggagtcaataagttcaagatcaagtttaatttcaagtttcataagaagaaatcaagaagattcaagaatcaagagaagattgatttcaagattcaagagaagatgaattcaagattcaagagaagaaattaa

SEQ ID NO: 40426 - DNA, 3657 bp, Glycine max
  Peptide Sequence Number=SeqID_157204
atggcagaaaataaaaagcctcataccgatggtaccaagaaaacaccttctccttatgatctaaactcaaacgacaaccctgggaacttgatcacacaagtgcatctgcggggtgagaattatgaagaatgggcccgagcaatgaaaatctcgttgcgtgcccggagaaagtggggcttcatcgatggaacctatgaacagcctgacgatggctcaccagaaatggaagattggtggactgttcaatccatgcttgtgtcgtggatatttaatgtcattgaacctacccagcgttcaaccgtgacatatgcggaaaacgcaaaagatttgtgggaggacattcgagatcgtttttcagttgtaaatggtccgagaatccaacagctgaaagcgaaattagctgattgtaagcaacaagggatgatcatggtttcctactatggaaaattaaagacactttgggatgagctcgcgaattatgagcagatccctcgatgttcatgtggaggatgcaaatgtgatattgcgtccaaactcgaaaaacgaagagaggaagagcaggttcatcagttcttgatgggcttggatgatgcgagttatggtactgtgcggtctaacatattagttgccgatcctctaccttcattaaatcgagtatacgcaattctagtgcaagaagaaagggtgagaacaattagcagaacaaaggaagagagaggagcagtcatgggtcttgcagtacaagcaggacataaaagtaagtggagaagagaaatcaaagacaaatcgatggtgtgttctatttgtaggaaagcaggacatgatgataagaactgcttccaagtcgtcggatatcctgactggtggggtgatcgcccacgaagtgaaggcggatctagtggcaaaaatcagcaacgaaattggacttcagctggacgtggcagaggaggcatggcccgagctaacacaacacacgttgagaaatctgagctgcctggtttaagcaacgaacagtggcaaactcttgttgagatgctgaacaaccgtaagacagatgagattgagaaaatgactggtaagcatcctgataatttgtggataatagacactggtgcttctaaccatatgacagggtatttaaagaatttatgtcaacaaagaacaatacgaggatgtccggtgggattgcctgatggagaaaaagaccgcactttgaagacgctgattggagcgggtgagcggaaagatgggctttatctgtatcatggtgttcgaaattccaaggcttatcataccaatacaaaatatgaccttgatatcttgcacaaacgcatggggcatccatcctttaaggttgttaaattgatccctaatgtaactagtagtggttacttgattaatttgacaccatcgcccatccttgatggaaaaactccatatgaactcgtccatcgaacccctccttcctatgaccacttgcgtgtgtttggttcgctttgctatgcacacaatcaagatagaaagggagacaaatttgatagtagaagccgtaagtgcatttttgttggctatccatatggtcaaaggggatggaaattatatgatttagagagagaggtcttctttgtctcacgagatgtaaaatttgttgaaacagaattcccatttgaagaatcaatcaataatccttctccaacatcactggtgcccctcattaatccatgtatggatgaggaatgtatggttgaaaatggccatgataatgacacaaatgctgacgtcagggggggtgctagtgaagcaagcaatgaaccccaaagctttgcaccaccactagaaaaacaaaattgcatagatgttgtacaatgtagtagtgaaggaccggaaacaagaagcaactttcctcccacctctccacttggaaaaggtcatcggatcaagcgaccgtctgtgaagttaagtgattatgtgaccaacaccatgatcaagttgagcccatctacctgttcctccgcttcatcacatgattcaggtgcgcgttatcctatagctcactatgtaaattgtgatagattttcacatcagcatcgtcagtttcttgcagcagtaagtgcaggtcgagaatcgatgcatttttcagaggccgtacaagatgaacgctggcgagaagccatggcaagtgaaattgaggcactacaaaataacggtacatggaccattactaccttgcctccaaagaagaaagctcttggttgcaagtggatttacaaaatcaagtatcactcagatggaaccattgagagattcaaagcaaggctagtcattttgggaaatcaccaagttgaagggctagactacactcaaacttttgctccagtggcaaaaatggttactgttcatacagtgttggctgtggcggctgctaaagcatgggaacttcatcaaatggatgttcacaatgctttcttacatggtgaccttcaagaagatgtgtacatgaaactacctctcggtttcatgacagaacacaaaggaatggtatgcaaacttcgtaaatcactctatggtttgaggcaagctccaaggtgctggtttgctaagctttctactgcattgaagaattatggatttcgtcaatcttgctctgactattccctcttcactttacggactacaactgtccatcttgtggtgctagtttacatggatgatcttattgtttcaggtaatgattctgaagctattcttcggtttaagctttatcttcatatatgctttcatatgaaggatttgggaagattgaaatattttcttggagtggaagttgctcgctcacccaaaggaatttacttgtgtcaaagaaaatacgccacggatattattcttgagactgggttacttggagccaaaccaatgtctattcctcttgaagaaaatcatcggttagcattggctgagggtccgttgttctctgatcctggtcattatcgccgactttttgggcgactcatctacttgtgtttcactaggcctgaactctcttactgtgtccatactctatctcaatttatgcaacaacctcgtgaagaacattggcatgctgccttgcgtgtggttcgatacttgaaagggaaccccgaccaaggtattctcttgcgcagcgacaatgatctgaaattgtatgggtggtgtgactcggattgggctggttgtccacttactcgtagatcacttacaggatggtacatctctcttggtcactcgcctatttcatggaagaccaaaaagcaacatacgatttcccgatcctctaccgaagcggaataccactccatggctaacaccatatgtgaattgacgtggctgaaagctattttatctagtcttggtgtgcttcaccctcaaccaattcaactctattgcgataaccaagcagctcttcacatcgctaagaacccggtttttcacgaacgaacaaagcacattgaggttgattgtcattttgtacgggatgaggttcttaagaatactatccagccgttttatgttcctagtcgtactcagcttgctgatatattcaccaaagctcttgggacaaagcaatttttgttcttgttaagcaagttaggcatccaaaacttgcatgtgccaccttga

SEQ ID NO: 40427 - DNA, 3801 bp, Glycine max
  Peptide Sequence Number=SeqID_157205
atggctgaatccactcgctccaagtcttttgatcgacttaaggaggcaatcgtgaaactcgcctctagccatcttcacgtttccaaaaagcttgatgaccttatcaaccgcgtcaccgccctcgaatccaaccctcattccccttcgtcctcgtccactaaccctcctcaccacaacccaaccccttcaccccacaggctcaaacttgatgtacccaggtttgatgtgtcagacccctctggctggcggctcacggtcgcatcgttttacatggatggacctgccctcgcgtggtttccgtggatggcctgcaaccatcaacttcccacctggacagggtttcttcaggcgattgaagcccgctttgccctttctccttacgaggacccaattgggcaactcttcaagctggttcagaaaggcacggtcagagaatacctggctcagttcgagtctttggccaatcgcatcaccggattgtcaccctcttcgctcctgagttgcttcatatcggggctcgaacctgatatcaggcgtgaggaagaaaagctccaggattcccgacgaagcttccgcagtaggtcctccttcacaccctcaccttcaaccccacctcccctttcgatggtttctcctccctcaccattgcccttgcttccttccccacccaaaccccttcccttaccagtccgtcgtctcagcccggaggagcttgccagccgccgtgaacgcggattatgcttctattgtgatgagaagtacaatcgcgaccaccgctgcgcttcacgcttcttccttctggttgcagatgaagaccctgatgacgatccacttaaccctaatataagcccttctatttcccctaacccgccccgacccgatatcacaaataacccatccccaactcacttacaacccgacccacccctggcccagattagccttcatgcactctcagaccacacagcccctaagactttgcgcatgaccggccggatttcccaacagatcgtcgtgatcttgattgacgacagcagcacacataattttgtgcaagcacgcctcgtcaagtcacttggattaaacccccaacctacccccaccttacgagttcttgtcggtaatggcaatgaggtggtttgctctcaaatttgcctagccgtcaccattcaacttcagggccattccttcaccgtcgacctgcatgttttgcctctgtgcggagctgacattgttatgggcgtgcaatggttaaaatcattgggacctattcttactgattacaatgatttaaccatgaagttctttcatcaaggtcatcttatcgaattgaagggaactactaacatgcacctcctcgccgtctctccaccgcaattaagacgcacgcttcaaacccagagtgcgagtgaattctttcacattcgtgtgtgctctcccacttcaccatcaccgacaacctatcctgaaatcctcaccatccttgatcaattcgcccctttgtttcaacccccaactacacttccaccatcacgacccactaaccactccattcaccttcttcccaattctcctccttttaacacacggtcttacagtacaagtccattctcgccaccggtcctcctcgtaaagaaacgtgatggatcatggcgattttgtgtagattatcgtgcgttgaatgctcttacggtcaaggaccgcttccccattccgaccatcgatgagctgctggatgaattggggggagcccccttcagaacgcatcacgggcattatgaattcctcgtgatgtcgtttggcttatgtaacgctcctgcttcctttcaagctactacgaatcaaaccttgggaccttatttacggaaatttgtgatcgtcttctttgacgatatcctgatttatagtcagaccttctccgaccaccttgaacacttgcgaaagatattacaagtcttagctgaccatagcttcgtcctgaagttatcaaagtgctccttcgcaactcagcaagtggaatacttgggccacttggtatcggagaaaggggttgaaccagttccggcaaaggtgactgcagtgcaacaatggcctgttcctcgatccacgcgtgcactaagaagattcttgggattatcaggattttaccgccgcttcattaagggatacgcgtccctagctgctcctcttaccgccttactagccaaggaccaatttcattggagtgaagaggctgacagagcattttcacaattaaagcttgctctgtgccaagctctggtcttgggccttcctcatttcaattctccctttgtcattaaaactgatgcttccgggattgagattgctacaatcattgtcgcggttaagaaatggaggcagtacctcctagggcatcattttatgattctcacagatcatcagagcttaaaagagctcatggctcaagctgtgcaaactccagatcaacaaatttatttggcaggcttaatgggctttgattatacgattcaatatcgagccggaaaagccaatttagcggccgatgctctctcacgactgccaccacccaatcctgggcgtatatggcttcctccaaaatttccattgattccgacaattctagcagagtttcattccacccctaccggaggtcacatgggtgttatgaaaacacttgcccggattaagcccgataaccgtcgtccgccgggccttctgtttcctctgccaatttcggcgaggccttgggaggacctctccctggactttattgttgctcttcccttgcaccacgggaactcagtcatcctagtcattgtagaccgtttctccaaaggacttcatctgggttctctgccacagcatcacacggcggccggagttgccaaactgtttatggagatcttcggcaagtttcatgggatgcccaaaagccttgtatctgatcgggacccactatttttaagtcatttctggcaggaattgttcaaattaagcggcaccaagctctgcatgagctccgcttatcacccccagtctgatggtcagaccgaggccatgaatagagttgtggagcagtatttaagggccttcgtacatcagaaaccttcttcttggggctgttttctgatgtgggctgagtggtcttataataccttgaccctctcggccacgagcatgtcgccttacgaaatcaccttcggcaagaagccaccatgttttccccaatacctcgaaggagcatcgaaggtagaggctgtggatgaatggctcactcaacatgatataatgattaccagccttgtgaagaaactctctgaagcacaacaacatatgaaggagattgcggaccgacaacgtcgcgatgtgagttacaaggagggagatcaggtcttagtcaaattaagacctcgccgacagacatccatttcagggggtgctcactcgaagctagcgaagaggttctatgggccattttcagttattaagaagataggaaaggataatcaaccatgcatcactccattagtgatattagatactaaatgggaaacttcatctatgggacgacaattgatggttctcgtgcagtgggcaagtttgcttccagaagactcatcgtgggaatcttgggatactctcaagcatgattacaaccttgaggacaaggttgttttggaagcctgcagggatgttatgaacaaagaatcatcagaagcaggggtcaaagagtatggaacagggtcaaagaggaaaaaccagagaccacgatacctgaaggattacgtggcaaaatga

SEQ ID NO: 40428 - DNA, 195 bp, Glycine max
  Peptide Sequence Number=SeqID_157206
atgggtcttgctggcataccttttgctgagagtgtctcatgcctacttggaagtctggatattcccaaacgatggcatgaaggatcagttgatcctagcgcttccaatattggaagccatgagggttggaggttgggcacagatttgtgctgtcaacatagccaattaggtcaaagcctactagaagggcattga

SEQ ID NO: 40429 - DNA, 951 bp, Glycine max
  Peptide Sequence Number=SeqID_157207
atggatcagttaacactagcatttccatttttactaacacttcatctgttagtatcaggtgtagtagcaacaacatcgttcacactggttaacaaatgcgactacacagtgtggccaggcattctctcaaacgcaggaatcgccacgcttccaacaacaggtttcgttcttcaaaccggagagtccaaaaccgtaaccgctccaacctcttggggtggccgtttctggggccgcacactctgcacgcaagactccgccggaaaattctcttgcctcagcggcgattgcggctccggcaagctcgaatgcgccggaaacgccgccacgccgcctgctaccttagccgagttcactctcgacggcgccggaggcctcgatttcttcgacgtgagcctcgtggacggttacaacgtgccgatgctggtggctccccagggtggctccggcgataactgcacgagcactgggtgcgttggggacctgaacggcgcgtgtccttcggagcttagggttacgagcgtggatgggaaacagagcgtggcgtgtaagagcgcgtgcgaggcgttcgggtccccgcagtattgctgcagcggcgcgtatgggtcgcccaccacttgcaagccttcgccttactcgcagattttcaagaacgcttgcccacgcgcctacagctacgcgtacgatgacaagaccagcacgtttacgtgcgcttctgctgcggcttacaccatcactttttgtccttctcctagcagtaaccccagtcagaaatcgtggcaagggcaaaaccctaaatcagatagtagtggctcggcttcggcttctgcttctgggtcgccgcaacttaacaacggcacaatggtagtacccatgggccggaatctcaaaccattgcgggctttgttagtatcaccatcgctgtttggctcttgtgccacctctactaactag

SEQ ID NO: 40430 - DNA, 507 bp, Glycine max
  Peptide Sequence Number=SeqID_157208
atgtatatgaaagaatgcttcacttgtttcacgaaaggctctcgatccatgactgattatctccatggaataaaatctttgactgatgaattagccatcaccaatgatccactggacgatgcagaccttgtcattcacaccttaaatgggctaagtgctgagtacaaggaggtttctacagctcttcacactcatgaaaaaccgattgactttgaagagcttcatgatcttctcttgactttgagagttatctcaagagggatgacaacaacaatgatacctcatttgttgccattgctcatgcaatacacaaggggccttctttatactggaaatgacaccttatttgagtcaactggactttatggggagttgagggttattcttggtagtgatgcatgggtttcttgctgttgggacaagagtaaagatcctctttgtttacgggaaattttcagtgtacaagagaaaaagacacatatttcttgtaatgtatgtgtcttttaa

SEQ ID NO: 40431 - DNA, 2385 bp, Glycine max
  Peptide Sequence Number=SeqID_157209
aatgaagctggcaatgataatgatcctgcatcaggactaattggaagtgagaaatctctgttgaaaagctcggataatttaccggtacatagttctgataatgtgctccagttatctgccagtgtggaatgtattgacatcaaagtgggatcggaaaaccatgttgctggtgttccatcttctgctcaagaagttgctcccgctcatgaaggattgcctatatgcactacaggtgagaccacttcggctggaacctgtaactttcccattccaaatcaaagcagttttgaaggacagtcagatgtggtacagttaagtgacttagctaaagtggaaaagcaggagcaaaacattaatgaccctccagaaaaattaggagcaccagagatctgttctgtgtcctctaataagccagagtctgagcctgtttccatggttgcttgcgaagcaaaagcaccagagtctgtgaaaaacccagctttagagcaaaatgttgaacacaatgaggatgatgtttgtcgtaatttaactaattctgctagtatgaggacacctgcatctgataggagtggggaagatgatggcgcatcagtcagtgacagtaacttgggaaagactgaggtgttagacgtgtctgtctttggaacagaatatgtcacagcatcaaaggaaggcaagggccatgaagaagatacatcaattggttctgattctagtaaacccggaatagatttcagaagctctaacataattgacaagagaggttctgacaatgaacttgactgtggcattgtggatgctttagaatttgctcgaaaaattgctcaggaagttaatagagaagtcagctgttcttcagaaaaagtctcagaacacagaatcaggcaaccatgcagtccagattctgtaagaaaagaggacgagctcactcctgtcccacccaaggaggtttcctccagacaaagccatgctactgaggcatgttcaatggaggggcatgtgagtattttagacaacaatgaggctgagccggaatgcagaccctatgtggtgtccttagaggtgactgaaaaagctcaagattcaggaggtaattcagagaaacgactctgcggctttgatctcaatgaagttggtgctgatgatatggatgtttctgtaaatactatgtctaccccaataccagttgtctctgcttcaaggcctgcaccaactcctgggttgactggggcccctttgcagtttgagggaacacttggatggaaagggtcagctgccaccagtgcctttcgacctgcgtcgcctcgtaaaaattgtgataatgataggaatctttctgttgatatgaactttgatacttccaagcagaggcaggattggcttgattttgatctaaatgtggctgagggtgaagaaggcaatgtaaaacctactgctgaatcttcaggcaggccttctgggcaatcgtcatttgaatttagtcctaaaaaatcaagcaggcttgaatttgatttgaacagtaccggtgatgatggtgacacccaaccttcagatcaaagaatggagggacaactctttcttggaagaaatggctgttggagcccatcccctgcatcgtcgtcctcatcaatgcagccatctgttagaaacattgatttgaatgacaggccgtgccttcaaaccgatttggtagaccagggccccattaagtctgcccatcttatcaatgcatttggttctaaatcatcaaatgctcctgttatctctcttctgggtgccaaggtagaagttggtaaaaaagaatgtgttcctcaaaggttgtctttgcagaatggcaaggctactgaacctgcaatagaactaacaatgtcaagagcaggtagcgttttagggatgaccccaacagtacccttcaatcattcatctgtttttggctataatggagtggcgtcagcatcagtgacacccgcaatgtctttttcatcagccatgtacggatcaggtggcacaattccatacatggtggactcaagaggagctccagttgtccctcaagtgggtggatcttcatcaactgtcctttcatcttactctcagccaccaatctttatgaacatggctggtacacaacttggtctgaatggatttggaccttcacgtcctaactttgacctgaactctagcttcatgattgagggtgggaatagagacacattggctgcaaggcaatttttctttcctgttcagggaagggctgtggaggagcaagtaagatccatgccgcaaccctccagttcgggggttagtgggaaacgaaaagaaccagacagtggtttggaaccctacccatttatctacaaaaatccgcaacctccatggaagtag

SEQ ID NO: 40432 - DNA, 204 bp, Glycine max
  Peptide Sequence Number=SeqID_157210
atggctgcttccaagcttttttctgcttctctcctggtctccatggtcaccctcttggtcctttcgtcggacaagtgcctcgcgttgcaatgcggggtttcctatgagacaatcaccgtcgtcaatgagtttcctcacgatccacaagccttcactcaggttttcagttcaccaaaatttgagagactaattaaaagaacataa

SEQ ID NO: 40433 - DNA, 213 bp, Glycine max
  Peptide Sequence Number=SeqID_157211
atggattcaatgtggaagggtctccctcgtactagtctaagtgatatgaaagagctaaagcttggagcgcgagtgaggaccagcgaggcagcgacgacgacggaggacagaggaccagcgatgacgaggatcgcgactgagggctttcaaagtagaacaacgacggtgagtagctcagcttcagcacagcacggagtcacgactcacaagtaa

SEQ ID NO: 40434 - DNA, 291 bp, Glycine max
  Peptide Sequence Number=SeqID_157212
atgtgggtcagtgaagctagcctagacaagtttgatgaaggtggactgaatatacaaatgaaatggtatgtggacatggatagtggatattttagtggtgaggtggaattgaatgggttgaggagtatagcaatagcacccttcatatatttagcgcttttgggatcatttatttttcacttagtgagagtatggactatggactacaaagtccactgtgtcagctgtcatggcctctttattgtcccagttagctgcccggttactttcagttcatacatcaatatataa

SEQ ID NO: 40435 - DNA, 366 bp, Glycine max
  Peptide Sequence Number=SeqID_157213
atggttatagtcaatgtccaagtattgaaacgtcattcattgagcaagaggcctgtggcactggagagcggaaggaagagagtgagagagagagggtttatggagatatcttcttgggtctcatggcgtgttttgaagcctatatatgcttttgtttcggggagaaggtttagccgcggttatcttctgattgtgtccgccgcggttattctcgtcctcgtggccacgctcacctgggacgtctcgcgtaaggccacgtgtgcctttctcagagaccacactgacagccaagaggacgtagctgatgaacttgtggctgaacttgctgatccaatcaatggtgtttcaaatcctgaccaggtttag

SEQ ID NO: 40436 - DNA, 222 bp, Glycine max
  Peptide Sequence Number=SeqID_157214
atgacaatggcaagattacacaagtgggaaggaaacagtagagtcactgcagttttcatgtctaccacaaaaattcacaaatactctgttttagaaggattattgattactttgaaagcacactacacttttaaaaccgttgattcacagtcattgtcatatactcttaagccaactaaggcatatctttgtgttcctttaattaatttgcctgacctctag

SEQ ID NO: 40437 - DNA, 489 bp, Glycine max
  Peptide Sequence Number=SeqID_157215
atgactcttgaagatttctttaccttgtctgagatgaaagatgggctcacagcaccttctcgggtgcaggagctggtctctgtgatgcaaaaggagaaagatagtgaggttaaaaatgctgctgatgtgacaaggcagtgggctgctgttgcaagcactattgctgctacagagaataaagattgccttgatctttttattcaattagatggactttgcttcattaatagatggttaaaggatgcccaagattttggggttgatgcaaacgacagcttcgttgaagaatcaatcactgcaatgttacgtgcagttgaaaagctgcatatagacagtgagaagtcaatgtcttcaggaattcgcatcactgtaagtaatcttcttggccatcatagtgctagggttcaggatagagcaagaacgttgtttgacagctggaagggagttggaaatggtgatactgaatctcatgatgtggaacttgctaag

SEQ ID NO: 40438 - DNA, 270 bp, Glycine max
  Peptide Sequence Number=SeqID_157216
atgaggaaggctaggtgtttagttctgacaagtaagaaatttgatgggaaagtagtgttggacttggatgtgagaactttctttgatgctcttaacggtcttctttatcatggaaatgacaccttatttgagtcaactggcctttatggggagatttccacagaagaaacaaacttcttgctgttgggaaaagactttgcacatttgatcctccctacaccgtacaatgataggagacttgtgcacagaaccatccttcaatggtcatag

SEQ ID NO: 40439 - DNA, 330 bp, Glycine max
  Peptide Sequence Number=SeqID_157217
atgagattgtacattaactcaaacaaagaagaaatagggaaggttgacctcagtgaaggcttgtgggtcgtgagggaacgcgttgaggacggtgatcgtgtcgtaggaaaccccgcattgaaacgcgcagcacctgttcgacaaaaggacgatgacggagataatgagataaacggaaaggaatgcggaagaggccatgcatgggagggttcggagagagaaatgtcctcaaaacattattattgcaagcttcataagttggagagttacgtcacagtattgctattagcaatggagcgagcacgtggagagcgtgaaaggttattgtaa

SEQ ID NO: 40440 - DNA, 2100 bp, Glycine max
  Peptide Sequence Number=SeqID_157218
atggcggacgctgaaaccttcgctttccaggctgagatcaaccagcttctaagtctcatcatcaacacattctacagcaacaaggagattttcttgcgtgaactcatcagcaatgcttctgatgctttggataagattcgattcgagagcttaaccgacaagagcaagctcgatgctcagccagagctcttcattcgtcttgtgcctgacaaggataacaagactctttccattattgacagcggcattggaatgaccaaagcagatttggtgaacaacttgggtaccattgcgaggtccgggaccaaggagttcatggaggcgttgcaggccggtgctgatgtcagcatgatagggcagttcggtgtggggttctactctgcttaccttgttgcagagaaggtcattgttaccaccaagcacaatgatgatgaacagtacatttgggagtctcaggctggtggctctttcactgttactagggacactgatggcgagcaactcggaaggggaaccaagatcaccctcttcctcaaggaagatcagttggagtacttggaggagaggagaatcaaggatcttgtgaagaagcactctgaattcattagttatcctatttacctttggactgagaagacaaccgagaaagagatcagcgatgatgaagatgatgaacccaagaaggaggaagaaggagacattgaggatgttgacgaggagaaggagaaggattccaagaaaaagaagaagatcaaggaggtgtctcatgagtggcaactcatcaacaagcagaaaccaatttggctgcgaaagccagaagagatcaccaaggatgaatacgcttctttctacaagagcctcaccaatgactgggaagagcacttggctgtgaagcatttctctgtggagggccagcttgagttcaaggccatcctctttgtcccgaagagggcaccctttgatttgtttgacaccaggaagaagatgaacaacatcaagctttatgtcaggagggtgtttataatggacaattgtgaggagctcattcctgagtaccttggatttgtgaaaggtgttgttgactccgatgacttgccgctcaacatctctcgtgagatgctgcaacaaaacaagatcctgaaggtgatcaggaagaatctcgtgaagaagtgcattgagatgttcaatgaaattgcggagaacaaggaagattacaacaagttctatgatgctttttcgaagaatttgaagttgggtatccacgaggatagtcagaacaggtccaagttggctgatttgctcagataccactcgacaaagagcggagatgaaatgacaagcttgaaggactacgttacacggatgaaggagggtcagaaggacatttactacatcacaggagagagcaagaaggcagtggagaactctcccttcttggagagactcaagaagaagggctatgaagttcttttcatggtggatgcaattgatgagtatgctgttggacaactcaaggagtacgatggcaagaaattggtttcagctacaaaggaagggttgaagctagatgatgagactgaggaagagaaaaagaagaaagaggagaagaagaagtcatttgatgaactctgcaaggtcatcaaggacattctgggagacaaagtggagaaggttgttgtctctgacagaattgttgattccccttgctgtttggtgactggtgaatatggatggagtgcaaacatggagaggatcatgaaggcacaggctctgagagacagcagcatgagtggctacatgtctagcaagaagacgatggagatcaaccctgacaatggtatcatggaggagttgaggaagagggctgaagctgataagaatgacaagtctgttaaggaccttgtgttgcttctctttgagactgcccttttgacttcaggtttcagccttgatgatcccaacacatttgcttcgaggatacacaggatgttgaagctgggacttagcatcgatgaggatgacaatggcggagatgatgttgatatgcccccgttggaagaggacggtgctgaggagagcaagatggaggaagtggactaa

SEQ ID NO: 40441 - DNA, 465 bp, Glycine max
  Peptide Sequence Number=SeqID_157219
atgaaagatggttggggtctggcaactgatggaaaagtcttgtttggaagtgatggtagttcaacattgtatcaaattgatcctcaaacatttaaagctttatcaaaacaagttgtccactataagggtcatcaagtacacaatctcaatgaattggaatacataaatggtgaagtttgggcaaatgtttttatgactgactgcattgtaagaatctctcccagtgatggcaatgttcttggatggattctcctccaaaatttaaggaaagaacttatcaaagctgggaacaatgatattgatgttttgaatgggatagcttgggatggtgagcagaagcggatatttgtgactggaaaactgtggccaaagctgtatgaaatcaaggtttctccagtaaacaaaccaattgaagaagggatcattgagcagctttgtttgcgtaaccctttcaaatttccatga

SEQ ID NO: 40442 - DNA, 876 bp, Glycine max
  Peptide Sequence Number=SeqID_157220
atggaagctgttttgacgcctcacgcgacggcacaaaaacaaccgtttgctcctaacaagaacatcagaatgaaaaccccgaagaaaaacggacgaggtaatttcatttgtgctaataaccggtctgagaattttgacacgtatgcaggtctcttgaatcctccttcacgcgccatgtccttctcctactctcacccgctctcagcttcttcactcttcactcatcactgtgctcaacaaccacctctgcttcctctgccccacgttgtttcgccaacttatggtagcggacaaggccttgttgttgttgttaataaaaacaaaaacaggagcagagacatgtctctgacacctaagaaatcgaaaccaacgaagcgagaggaagcgaagaagagatcggtgacacaatctgataaccgctggggacctgatcccaaagaccttcccaaagtggtgctagggatgggaaacaaccaccacgacgtcgtttcgggggcggttttcaatctggctccgccacccagtagtttgccgctgccaaagttctctttgagatccaaactcggttgcaacgccgaaaccgccgctggtggcgttgatgacggagcaaccaacaatctccggcgacttctgcgcctccgggaaggagtaggaatcggagaaggcaaagaaggagcaggaccaagagggcgtgtcgacggcgaagtcatcagcagcgagcttggcgaaggcgttgagggtgaagagggaaaggaaggtcaagaggcgggagaagagggtggaggcggcggaggagggagcgagggaggcggctacggtggaggaggaggtgcggtggtcgaggactttgaggaagctggtgtcgcagagccatga

SEQ ID NO: 40443 - DNA, 165 bp, Glycine max
  Peptide Sequence Number=SeqID_157221
atggtggagagcttcattgagaatgagaggtcaagactcaattcctttcccttacaaggaatctggtttgaccgtgactggaaaaagattgaagcatttgttggatcaaagagtgttatacagggaagtcaacagagccatggcaagaaaaggggtattcactaa

SEQ ID NO: 40444 - DNA, 459 bp, Glycine max
  Peptide Sequence Number=SeqID_157222
atgcagcaaggagactacacctccgctccatctccatattatcaattccctcatctccaaaaccccaatcccaatcccgatccacacccaaacaacccctacgcttctgcacctcccttcacccccaattacgctccttccgattacaccccttacccttcttcctaccctcaaaatcccgatcctattccacccactgctccttccttccctccctcttcctccaaccctaatttaccccctcctttcaatcctcccttcgattctaaccctccctaccaacaaccgcaaccacaacaaccctatttcccaccctatgatcaccatcaaacgcctcccaattacgcccctcccaacaccaattccactccctcagtatacaactctgctccctacagctacactggagtctcctccgttcctccgattccgacgtacgaacctgcatacgacgctccg

SEQ ID NO: 40445 - DNA, 972 bp, Glycine max
  Peptide Sequence Number=SeqID_157223
atggcggactcgcgctccaaatccaccttagaacgtcttgaggaagccattgcacagcttgcctccagccagctgaatgttaccgagaggatcgaagaactcctcctacgtgtagccaacctcgagcatgcatctaaaccttcaacctcaccatcttcttcctcgcccaaccccgcaccaaacacaacctataacccaccaaaaatgaaactcgatgttccaaaatttgacggcaccgacccctctgggtgggtattcaaaatcacccaattttttgcctatcactctacgccggaaccagagcgccttaccatcgcctctttcgctatggaaggccccgctcttgcgtggttccagtggatgacccgcaaccaccagctcccgacgtgggcggcgtttttgcaggccattgagatgtgcttcgcccatggtggttcgatcattcagctcaaagctcttccctaccctaaccccattcacccagacatctccgccctgcttatcgactttgcaaccttatttcaaaaacccaacaccctccctcctacacgccccaccaaccacacaatccttcttgaacctcactctaccccggtcaacgtctgcccataccgctacccttattttcaaaagcatgaaattgagacccaagttgcccaaatgcttcaatccggcataatccaccccagtacgagcccattttcctccccagtgctcttggccttgaagtttgattataaccttgaggacgaggttattttggaagcgcttagggattttaggatcagcaatatagaagaggaaactaaggaacaaactaaggagcaggaagcatatgtagagcaacaaaggggtgcagaaaaggagaaggacaaaggccaaagagggaaattcacaaacccccgtaccttagagacttcgtcatttcacgatcattcctccaaggcatatgccatcagaccattaggataa

SEQ ID NO: 40446 - DNA, 975 bp, Glycine max
  Peptide Sequence Number=SeqID_157224
atgcagagaatcgattcatctacctttgcattttggtcaaagagccctgttgacattgagccaagacggatcagattgcaatctaatagttacactactaacacacttttggatatagtgactgctgcaaccatacaggctaagatgataaatgctttccgaaaaattggcggaagatactggctctgtatttttaacgtcaccatgggacaagattttgttttaaagttgctttcccagtttgagttaccatatgaacaagaagtcaagaatagaaaaatacagatggctcaggcagtttcaagattgcccgtggtagtagtgcaatgccatcatggccatcttagctacagtggtgccttgtggccaatcatgaacatcacaggtgctatgcagttcaaggaaatgggtggaagcaggtggcctgctgaagcagtgaaaccaaatgaacagcctacagaaagaaagaaaggttttggtgattggatgaatcttattaaacctgccaatgaagagaaggatcattgggtaccagatgaagccgtctcaaaatgtacagcatgtggtactgattttggggcttttgttcgcaggcatcactgtaggaactgtggtgatattttctgtgacaaatgtacatatggtagaattgctctgactgctgatgagaatgctcagcctgtacgagtttgtgaccggtgcatggcggaagtgtctcagcggctgactagtgcaaaagagtcatcaagtaaacctgcattgcagagtcatgaggatcttgcaaggaaacttcaggaggagctggagagaaatcgaaagacatcaggttccaagtctgatggatctgcaagacggatgaaggaagttgcatgtcccatttgcactgtccatctgcaggttcaggtgcctagctcgggttcagagacaattgagtgtggagtttgccagcacccatttcttgtgagcgctcattga

SEQ ID NO: 40447 - DNA, 2385 bp, Glycine max
  Peptide Sequence Number=SeqID_157225
atggatccatttggtggcgaggatgacaagagggggctggctccggttgagaggggcactaccgaaatggcttcagcaatgaacagtgaaacacgaggtgtatgcgggatgaatccgacaaatctaactttggcgtcgaggacgaagtttgaccaagacctgatctctgacttcgaattggacatctcggcatcacatttggttaaccattcgtcaaccgccgccacattcgagtctccgatgaggcaaaggggaatagaaggtggtttcttgccaaaggttatttcgtatggcgcgaaggtactatttgattacgtgattcatcacctcagtctggccatctgtctgagggtggtaggcagtgctcatcttgagcgtggtgccattgagtttgaacaattcctgccaaaatttgctgatgaagaggagatcgcgatcagagacgaggcttctgggcatgccgccaagatgaattcctttggaaaagcggtccaccacgaccagcactgctgtgtggccctgggacgaaggaaggcctatgatgaaggggcagaggaggcctgggctcctacgatggtcgatcttagtctgttggcacacgaggcaggtggaaatgaacaagtagacatcttgtttcatagaggaccggacgaaatgttcaccaacatgtgccagggtcttagcaatacctatgtggccccctgtaggagtgttgtggaattcattgaggatcgtggatatggcctggagatccctaggggtcgtcttgtattcggcggcgaaggtccaagaatgaaggggagcctcggtccgacgagagagggcgtctgccgctgcattggacttttcggcacgatattggatggtataatcgtagccgagaagtcgagccaagaatcgttgttgctccagagcttcaagcaaaacggtttgttgaagaaagctattgggtggttcttctgggatagaacgacacccattcccacgcttgaggcatctgtttccacacaaaatggaatggagaagtcaggcaagctgaggaccgaggcctggcatagggcctgcttgaggagcggtgatagaggaatagccctgtatgaatcgcccgtagaatccggacaacccgaggaagctgccaagagcccaagtggaggtgggaacaggccaattttgaatagcttcgagttttgccggcacaagtgccacgccctggcaagacacgatatggccgagaatctgttgatagccttgcataaggtcgagcttggagaaccagctggcaccgccgagcttgtcgaggagctcgcagacattgaccggggtagagtgaggttcaagaaggattgtgtggttggttgcaatgtcggtgagcagggtagagatgtctgggtgaatgggggttggggaaatgggtgtaaggaagagttgtatgtggaagaaggcactagcggcattggtctggaccagtcatcaaagttgtggaggagagattgcctccaggtgctgagtcgtatcacctttgagctgaatgatcgaaccaccatggatgaacttcatggtgtggccttgaatttggatggtggtgtcagggcacacatggtggcattcgagcttgttatcgatcccaacaaggacacgcagggctggggtgggtttagtggtcaagttcaggtgccggaggagcctcgcctgcataaaattgtgtgtgctcccaccgtcaatgaggatgacaacgggatgcttttcttcatctgcaatgagaagatagaagcgagaggcacatcggtgcccatgggtgtacttcttgtcgcagttgaagcagagacgatgctcctaccggtgagccattttggcgggtgtcaattgcttcaagggggcggtgttgatcagcaagtttttcctcatggaggcgagccaatcccgcggcctgtaccaggcttcaaactgatgcaggtaatcgctaaccgagccccgttgtgtgagtttgaagaggattcctgttgggtcctcgtatggggagtgggcgaagcgcgtctcaatggcctgcaaaaacgccacccacgtcgggagctggtggttgcgggtcatccactagaaccacgtaagagcggggccttccatagcgaaggaggcgatggtaaggcgctttggtttcagcgtagagtgataggcaaaaaattgggtggttttgaacacccacccagaggggaagaagatggtgaggctgaagggttagatgcatgctcaaggttggctacatgtaggaggagttcttcgatcctctcggcaacattcagctggctagaggcaagctttgcaatggcttcctcaagacgttctaaggtggatttggagcgagagtcctccattagagaggaggaatga

SEQ ID NO: 40448 - DNA, 210 bp, Glycine max
  Peptide Sequence Number=SeqID_157226
atggacaagagaggcatctccacagaggagtcgcggcccctaacgccaccgggagtagggcctagtggcgtgaggccgccacaaggtcacggtgatggcgactgtagcatggcagcgcaacgcaacctcatcaaaggaacaacaatagtccatgcgatcctccttagtagccaaggtgcccacgtcgacggccaaggcgaccctcactag

SEQ ID NO: 40449 - DNA, 303 bp, Glycine max
  Peptide Sequence Number=SeqID_157227
atgcttatggacctgacaaagaatcacatgctaggcaaagttattgcatatgaaattgatcaaattatatcagcagagataccttcacagcaagatgatccagaactgtattcattagtaaaaaaacatatggttcatggtccatgtggaagtctgaatcctggatctctatgcatgaaaaaaggcaagtgtagtcgtttttatcctaaaatgttccagccgcatactcttttagatgctgatggttttccagtctatcgtagaagaaacaacgggggattattgaaggcttttttcttttaa

SEQ ID NO: 40450 - DNA, 522 bp, Glycine max
  Peptide Sequence Number=SeqID_157228
atggtttggttgttaaagctaatgtgcacagttactcctgcttctggcagtagtgaagagacacacaacacattaaaatttgtacactggagtaagcatgttgaaattaaagcttctcaaaataaggagctgcaacagttgaagcgtggcatggttgagaatcccaatatggccacatcttcacaagaagatatgattactttgaagcttcagcttgaagttgggcaatccaaattgaagtcaagattgcaagaggaggaacaagctaaaacaacattgatgggaagaattcaacgactaaccaaattaatcttagtttctacaaagaatgcaatgtcatcaagcattgtagaaaggcctaatcatagacgaatgcattcttttggggaagatggggttggtttttcagaagggtacactagtaattggggttacaacacccaaaaagaaagagaggaagctgatgctatccccataattcatgttcttgagctctctgacttcagcaagaagttgaaatag

SEQ ID NO: 40451 - DNA, 414 bp, Glycine max
  Peptide Sequence Number=SeqID_157229
atggatccgaacgaaggaaacaagataggaggaatgaattcagaacaaaaaggccaaaatactaaaaactacataagctatggaaaaactattatttcaaaacttacaaaacttgcaaaacgtggaaagaaaaagatcacatcagaacctgttgttgaggatgcttcagaccaaacaacagaatctattagtgagaatgcttctaactctcaaaagcatactattcatgttattgatgactcttcaaacccttcaaaccatcatgtggaagcagctgcaaagtatttttctcctccaagctcccctcatcgaggaacatatcaatatgatgtagaagaggggttaggagaggactttctaaaagcaacttattattttgatgattataacacacaaggttgttctattatgtaa

SEQ ID NO: 40452 - DNA, 357 bp, Glycine max
  Peptide Sequence Number=SeqID_157230
atgccaaaaatacccatattgatcacaaataggaggtgtacgtgtattgttcaagaggatacgatgaagttgggtggttattcgtcgttgaaaaagaagagatacaaaaatatcatttttgtttgcgacattgcttcaaacaacaacatcaaaccaatatcaacaacattcaaaacaatacaatcattcattcagaaaagcaacaacgacaacaatgaaagagtagcaacacaatgcacaaaaaataagtatgataaggccaacaacaaaggattaggagccaccaacaagaaaaaccacaaacggaggaccaacacccgtgaaggaagaagaagaagcaccaatggagtgaaatga

SEQ ID NO: 40453 - DNA, 630 bp, Glycine max
  Peptide Sequence Number=SeqID_157231
atgcactgtgagctgccccatgccaacaaattgaaattgggcttagtcaaaaacaaattcccaaagccttggaaagagaagagaatcaaccctgatgagcagagagttggtttggagggaattgccagggatatggaggaggtcgtgtgcattctcttgggtagctcttggatgagaaagttcagtctctatataaggggtgaggtaatcaatgaagggcaagtcatagggtatttggatcaatttggcactggacttcctattaaggtgatctgtctctcgataattttggttcctttcatccatgatgttgtttatatgagtttagtgtacctgccctgttggcttttcatccaacagtttcaattgtttggagtaatatcctttggcaaaggtaaacatgacaagctattgactgagtcttctaggaagattgatgcaattagaaatagactcactgttcttgacatgaagcttgattccaagcctagttatgttgagacttttgcaattgggcttgcctcgggagctaccctgaaagggattggtgcaattgcgcctcatattattgcctcacttttccaaatatggaactctgtttccactgccactaaatcttccccccaatga

SEQ ID NO: 40454 - DNA, 147 bp, Glycine max
  Peptide Sequence Number=SeqID_157232
atgctgaagaaaggagcacaactaagggatggtgaaacccctaatgttgtaccatcacatgcaaatgttatgacacgttctccagacaagataaagagcatcgatggctcaaaagaaactcttaaaactcagtgtgaggatcagtga

SEQ ID NO: 40455 - DNA, 198 bp, Glycine max
  Peptide Sequence Number=SeqID_157233
atgaaatctatgattgagtgcactggctacatgataggcattatacccggagaaatgaagagttttgacaatagtgcacgctatagggtcccctccttcgtcctctgttcccaaaccatccaacggtcatggtatttatctgaccaacttcttccacccatggcacctatcactaaaaaaggcttcacttgctcctaa

SEQ ID NO: 40456 - DNA, 555 bp, Glycine max
  Peptide Sequence Number=SeqID_157234
atggaaggagagagaggtgtcagtcccaattttgagctccaagtttcattcacaaacacccctcaagcgatccatgaaatgggttttgttcaatttgaagaaaaccaggttcttagtttcttggcaccctctgctcaatcccaatcttgtcagctctctcaatctctaaacgccggcagcagcggtagcaatactgctgtggccgctaccaccacattcaccgtcactgccaccacctccggatccggagcaacaattggtttcagccataatgaccttgtctccagaacttcttggaataataatgaacaggtgcgaacactggatcccaaagctgtcaatgacgaaaattgcaccggaaatactagtgatggtggcaacaacacatggtggagaagtgcaggctcagagaagaacaagatgaaagtgaggaggaagctgagagagccacggttttgtttccaaacaagaagtgatgtagatgtgcttgatgatggttacaaatggaggaagtatggtcagaaagttgtgaagaatagccttcacccaaggtaa

SEQ ID NO: 40457 - DNA, 318 bp, Glycine max
  Peptide Sequence Number=SeqID_157235
atgagcaagcaattcagtttgtttaattcaatgagaactgtttatcaaattgagcccacatccaagcattatgcttccttcatcagtgttttgggttactggggtcttctgcaagaagcactagaaactatcaataacatgcctttccagccttctgctcttgtttggcgtgctttgcttgatggttgtagattgcataagaatgcgttgattggaaaatgggctgctcagaatattctgtccctagaacctaaagatccttcaacatttatacttgtttcaaatttgtattctgcttctaggatgggaccgctctga

SEQ ID NO: 40458 - DNA, 408 bp, Glycine max
  Peptide Sequence Number=SeqID_157236
atggtcactacaagtagagactacattacaaaaggaaacaaggcagtcacatcttctcagacaagaaaaaggacaatcacatcatcgaataacataagcttaacctacctaagtaaggttggaggtcgcagttgcttgtcgttgtccacggttggactcccccaacttacgaatgatgaaatcaacccgaccgatggaaccatcccgacgttggatcgaaagccctgcgaaagccttgctgggaaggttgaagtcgtcagaaggaacgaagaggctgtggaacaaaatcaagcaggggtgaggtttaaagaaaaacctagaggcactgaggtttcagcgcgaaagggcaagaggtgcttcaaccaacaggtgttgacactagggttagaagctacaaccaaggtttaa

SEQ ID NO: 40459 - DNA, 222 bp, Glycine max
  Peptide Sequence Number=SeqID_157237
atggagacacattccacgatgttggataccacaacgattaaaagttgttgtcgaatgcataagagaacccaagtgacatatgctagagtgaagcaagcacatatagtgataacatttgtccttgggcctacttgtttacaaattaagtgggatgaggtggaggtaagtacgagggtaatgcctataatttgcaccagtgcagattataaatacatcatgtaa

SEQ ID NO: 40460 - DNA, 684 bp, Glycine max
  Peptide Sequence Number=SeqID_157238
atgacaagaactattggagttcccatgacaaccattgaagccaggcttgaatctgtgccagagatgggatatgatgccctctccaatgtaccccgtggagaaatttgtttgagaggaaataccttgttcttcggttaccacaagcgtgaagatcttaccaaagaagttatggttgatggctggtttcatacaggtgacattggagaatggcaatcaaatagggccatgaaaattattgatcggaagaagaatctctttaaattgtctcaaggagaatatattgctgtggagaatattgaaaacaagtatttgcaatgccctcttatagcatcgatttgggtgtatggaaacaactttgagtcattcttggtggctgttgtggtccctgaaagaaaagccattgaggattgggcaaaagagcacaatttgactgatgattttaaatctttatgtaataatcttaaagcaagaaaacacattttggatgagctcaacaacactggtcagaaacaccaacttagaggatttgagttgctaaaagccattcatctggaaccaaatcccttcgacatagaaaaagatttaataactccaacattcaaattgaagagaccacaattgctcaagtactacaaggatcatattgatcaactatacaaggaagcaaagggagaaatggtgtaa

SEQ ID NO: 40461 - DNA, 411 bp, Glycine max
  Peptide Sequence Number=SeqID_157239
atgatgctttcaagggttgttattattgagaacaatggtcgtagtgtatgtagtgaaagcaaggtggaacaggtgtacaattttgttcgattgacagagctatattatgtaggaagccatggcatggatattaaaggaccaacaacaacctccaaatacaacaaagatagcaaagctgagccaatcctttgtcaacctgccagtgattttcttcccttgatagatgaggtgtatcaacaattagttgaaaagacaaaatcaactcccggagctctggttgagaacaacaagttctatctttcagtccatttttgttgcgttgatgaaaaggtgctagagattcgtcccactattaaatgggacaaagggaaagccttggaatttttattagagtcactaggtgagttttag

SEQ ID NO: 40462 - DNA, 351 bp, Glycine max
  Peptide Sequence Number=SeqID_157240
atgaagaccacagagctcattgaaaatcttaaggtgcatgaacaaaaacttcaacaggataaaggactcaagaaggacaaatctcccgttcttaaggaatgtccaattcttgaaaagtcccaagacaataagagacagttcaagtccaatgataagaaaggcctcatgagcacttggaaggatctggacttgtctaataaggacaaagaaaaggaagctaagatatgtttgatggtgggcacaacctctgaagaatctgaattagaacaaaaggatgaggtagatctcgatgaccctgagtctcttaagcaagcctatcatgagcttttttcaaactcatccattctttaa

SEQ ID NO: 40463 - DNA, 1272 bp, Glycine max
  Peptide Sequence Number=SeqID_157241
atggcttcccgcaaaagaaaggttccagcctcagcatcccaggcctgctatgatagatcaagattcacatcccaagaggcctgggatcgctactctgatatagtgattggcaggaagatcctgcctgagagaaatgtcatgatttatcatacagaatttgatgagttcaaggctgagttagaaagaaggaattggcacaaggagctgaccaatttcgtggatgagagcatcgatgttgccattgttaaggagttctacactaacctttatgatcctgaggataaatcacctaagcagatgagggtgagaagccacttaattaagtttgatgaagacgccctcaacacctttctgaagacccacgtgatcatagaggaaggggggaaccttcctgcttactccagattctctcgtttgaggccagatccacaggaactggcagcccgactatgcatccctgggaggggatttgagcttaatgttgatgggctgccattgaagatcttgcggaagaatctgaccacgctcgctcagacatggagcgttttatcattctccaacctgacccctacttctcacacgtatgacatcacactggacagggccagcctcaacccagccattaatttggcttatgtgaagaaaagttgttggaaccttgatggcctctcggtcacttttcagggaccccaaaagaccaagggcaagaggtctgaggctccaccatcttctgctctccctaccctagctccttttacttctactgcagctctttttgccccagcttcatccactcctttgccagttccttctccaatttctacaagaccttcctttttcaacttcgatactttatttgcaatgctgcagagccttcataaaggccagatcatcatcatgcagttcctacatagctcaggcctacaacctatcatgagcatagacgagttcattagccaggtggcttggccaggagtccagccttctccttcgggagggggtgaggcctccgcagcccaagagcctgtgccagaggaggatgagcacatccctcctgagtcatttgtttatgagactgatccagctagtgctcaggaggaggtagcatcaccagagccccttccgcagtcatctccagctacagttcttgatgatatcccagagccatctgcaccagcactagtgcctgaccagtctatttctcaggacccactatctgcactggtgttggaccttaacgagcatgcagaggatcatttgctagatgattga

SEQ ID NO: 40464 - DNA, 276 bp, Glycine max
  Peptide Sequence Number=SeqID_157242
atgtcaactagctggaaaggagattattattgttatcttgccgaatataagtcaggcaatgagaagaaggaagctgttgatcagtctatgaaagcatatgagtctgctaccattgcagcagaggctgatttacctcccacacatcccatccgattgggtctagctttaaatttctcagttttctattatgagatcttgaactcccctgaaagtggttgctcacaaactactaaagacccatcaaagaagaaaggtaaagacaacatcacgatgtaa

SEQ ID NO: 40465 - DNA, 222 bp, Glycine max
  Peptide Sequence Number=SeqID_157243
atggcttatcaccttcagttgcccgactcatccaagattaacctggtgtttcatgtatcaatgttgaaacttcatcagggtccaccaccttctacttcggaggatccaatgctgagtctattgaccgaaaatctccccttcatcgagccccttacaattctggattggcaatgggacaccttatcctcacccccgtccaagaaggtcctggtacaatgttag

SEQ ID NO: 40466 - DNA, 237 bp, Glycine max
  Peptide Sequence Number=SeqID_157244
gactcgcaccagaagatactacctaggaggattgggatgctttacgcgtttggtacaaccttgacggcaaggttgagcttccaggggagggtgttgatagtaacgcgacccaaaggagtgacagactcaaaagagcacagaggaaaccagcttacctccaggcttacgcatgatcccagccaggggacaactaggataaggataggaattgcaaattctgttatagctgtcggataa

SEQ ID NO: 40467 - DNA, 336 bp, Glycine max
  Peptide Sequence Number=SeqID_157245
atgaagaaagtagtgctaaaggtggagttgcacgatgatagagtcaagcaaaaggctatgacaacagcctctgccctttcaggggttaaatcaatttctgttgacctaaaagacagtcaaatgatcttatcaggggacactgatcctgtgagtgtagtgtccaagctaagaaagtgttgtcatactgaaattgtttcagttgaaccagcaaaggaggagaaggagacgaagaaggtggagccagcaaaactatctcttcctctccatcaagcctatcccctaatttactatgtcacaagttataaagagaatcctagtgactgtgtcatctgctaa

SEQ ID NO: 40468 - DNA, 342 bp, Glycine max
  Peptide Sequence Number=SeqID_157246
atgcatattcctcccatccttttcgtaaagaatcaatgcattccttggttagttaaatacctatggttattgtcagatgaattgctaggctctgatattcctaccgatgaggaacgtgcagaaagcatcaaccgtcgcataagcaacttgatcgttgctgagatattcaccataccatgcgctcacacttgtgtctctctgctgccacacttaataaccgaggcacttcgctacaatctattccaccaaagcctacgtgaggctctctggcatgtaagcagtgtgcgcgagtgggaagatgaggtaatggcaaccaacgcagagctaaagcatgtccgatag

SEQ ID NO: 40469 - DNA, 162 bp, Glycine max
  Peptide Sequence Number=SeqID_157247
atgcttctcctcagtcatcgagctccaccaagcagccatggctcgctcagcgagccagattggctaagcgaggctcatccgcttagtgaggaagcttgtccgctaagcgagaacaaaaccctagagaatgttgagccagagagcagcacgcttagcacgtag

SEQ ID NO: 40470 - DNA, 621 bp, Glycine max
  Peptide Sequence Number=SeqID_157248
atggcagcggaatggagaaggaagagagagaggagatgccacttcaaggaaaagatgagtctagaagaagctcaccaccataggaggccatggataagagcttggaggaagaaggagatgaatgaagggagaggaagagaagaacacgaaattttatgctctaaaagagctctgaaatctgaaaaatctatcatgaggttcatgaaaatcctaggaccttcttttgcaactctagcccaatcctcttggaccctcttgctcatggctctagtgactgcacaccttggtcatgttcaccctgatgttggtcagctccgaattttgctaagtacaattggtagaatagagctttacactattttggttccactaggccataaagtagtgttaaaggtggacttacatggggatagaatcaagcaaaaagctatgaagacagcatctggcctttctggggttgaatcagtttatgttgacatcaaagatatgaaaatgatcgtgttgggggacatcgatccagtgagtgcagtgtccaagctacgaaagtgttgtcacactgaattagtttcagtaggaccagcaaaagaggataaggagaaagaaaaggacaagccagcaaaa

SEQ ID NO: 40471 - DNA, 255 bp, Glycine max
  Peptide Sequence Number=SeqID_157249
atgggaagccgctcctgcgattgccgcatcgctgttcccgtgagccatcaggttctggccttgtttctaaatagtgcaattttgtggcatcggttaatgggaaagaaggttcttgcggtctcaaatgatgttcatattaaagacttttacctacagttaggaaatgtgtcataccctaatttcgtccggggacctttgcttgataacatgcaacttttgtttggtccttgtgaggtgcttggcacccatcattag

SEQ ID NO: 40472 - DNA, 345 bp, Glycine max
  Peptide Sequence Number=SeqID_157250
atgtcaaaagcaacattattggcatcaacccctcagtcaccaaccttaaccccttctttgtcagtggcggccttgcctttgtcatgtagctggactcctccaccatcagcgaccccgacagcttcctcggcctttgaaaggttgtgcatttgggatttcaagtatgtgaggttttttgggtctacccaaggtagcaccgaggttcacaatgttaaatggttcatggctacggaggcaacgaggtcgatgagggttacacggcggccccgtgattcgggcatggctgaagggatgggaaagcgagagaatgtggtggtgtcgtggttagggtttgtgagtgtgtaa

SEQ ID NO: 40473 - DNA, 264 bp, Glycine max
  Peptide Sequence Number=SeqID_157251
atggagatggaagcttcgagtctcggttgcaggcggatgcagtggcggtgggagagagagagcgagtggcattggtctttttgcttacatgatcgacatctggggtatagaaaaattcgtgacattccccggtttggtttcttataccatagtaataaagaaagagagaattttgatacaaaatctgagacattattgttcttaaaccaggttgttgtggagcttgattcctttaagctttcagcaactttactccctctttga

SEQ ID NO: 40474 - DNA, 735 bp, Glycine max
  Peptide Sequence Number=SeqID_157252
atgtggaactttgcatctagtttaattgctggaagtgtgggtctgaaaaatgattctccaaaaccaactcactctgcttcagaattttctgatgacgagacttccatggttagcagagaggaaaggctagaatgcccaatatgctgggaatcctttaacattgttgaaaatgtgccttatgtcttatggtgtggtcacaccctttgtaaaaattgcatccttggattacaatgggctgtggtgaatttcccaacactgccaattcggcttccactttttatctcctgcccgtggtgcaaccttttgtctctccgtttagtttaccagggaaatctgaaattccctcacaagaactactttcttctatggatggttgagagcatgaacggtgatagagtgaagtcacattctactgtttgcggggatcatcaaccagtgtggccaattatagacagtttaaccaacggaagccaagtaagccatgacagccttcaaggagggcaagtttgccatccagagtcttcaagttccaatcattatcatggtgataccactctggttgagcttggctgggtgggaggagggatatcagtttttggcataatctattttgaagaccatcaaggccgtggagtgaacaagagctattttcctggccatatgtgcaagcactgtactctttatttgattttagtgatcttctcgtggttggctactgggaaaggtatcgtataa

SEQ ID NO: 40475 - DNA, 165 bp, Glycine max
  Peptide Sequence Number=SeqID_157253
atgatgaccaaagggaaagtgaagaaggaacagagtagtaacctcgagtcagcgtcacgactcgcgagctccgagcctcacctttccgacgacggaggacatcgacatgatcggagaagcctggacagcgagacatgtaggagaggcaataggagaattaagtga

SEQ ID NO: 40476 - DNA, 573 bp, Glycine max
  Peptide Sequence Number=SeqID_157254
atgagcataacatcgtcaacaacgacacgtagggattatatacaaatattggtcttctaccatgaacagtgggcaccacactacccagactttgcccactttagctatgacagagccatctacgaaggatctacgagtccacccaccatcaattttttggcctgtgaacaaaaatggatattcgacctccacttcactcctccactagatcaacaatcatgcggcagacccctactaacatctagaatgcatgtcgggactcttgaactcacccaaggcctgcttggtacccctgatccattgagacttccacatattgcagcaatacatcttccttcatgtggtttccatatgacggttttaagaaggctcgaccctccattgcaatggactgtcgtcacacttgacgttggcgttggtgacaagtacgttgtccaaccatggtaccaatttcttgcaaacggtgatttcaatcatggagacgagctctcattctactataggcctcacaacaaaatttgggaaattgttattagaagaaaaagaaattggggcgacaacaatagtgactga

SEQ ID NO: 40477 - DNA, 333 bp, Glycine max
  Peptide Sequence Number=SeqID_157255
atggacaagtggtgtttacagtttcagaccaaatttcgagaagatccagcggttaatgaaggctgggaagtgcttttactgagggtgttacaagctcaacttaagaaactaaaggttgttatgtttgagtccttcttggtgcacttcattttgaacactcttccgacggaatatggaccgtttaagatttcctataaagacaaatggtctatcaatgaattaatagccatgtgttttcaggaagaagaaagacttgtaatggagatgggtgagagtacattgctgacaactgcttgtgggaagaacaaagcaactaagtctcaagctaattag

SEQ ID NO: 40478 - DNA, 293 bp, Glycine max
  Peptide Sequence Number=SeqID_157256
atggacatagactatgctataagaaaagatgaatcatctgcaattactgatgaaagtagcccagctgctgttgcgctatatgaacggtgcgagcaatccaatcggctcaacgtgatgttcattaagaccaaaatcccgactaggatacgtaattctatcgaccaacatgaaaaggtccaagacttgcttaaggccattgatgaccagttcatcacttcatataaggctttagcaagcacccttatcatgaagttctcctctctccgactcactagtgtgaaacgtgtgtgcag

SEQ ID NO: 40479 - DNA, 459 bp, Glycine max
  Peptide Sequence Number=SeqID_157257
atgcctcctgagcctaaggttggtccttcagctgctcgtgtcaacacaaaggagagttgtgttgatccctcagggaatgatccagacacagttgactcagacaaatgcgggttgcacatcgaagaaaatcctccccgtctggattttaattcaaaacgggatgtgtacctaggagcctacctgaatggtgcacattggcaaatggttgtcatttttcctaaggaaaatcttgtcgtttggttttgttcattgcataatagaccagacaactacctgaaaggaataattaacagtgcttcaaaaggactggacaatactccacaacctaaatccaaggttggtgctaggtggattgttgttaaatatttcaatgatgctagatcactagaaccagagagattgaagacgtttcgcattcagtgggcaaagtattatttgaaagttagaaatgaaacttag

SEQ ID NO: 40480 - DNA, 198 bp, Glycine max
  Peptide Sequence Number=SeqID_157258
atggtttctgtatttattgactcaaaggaagggccaaaggtagcaaagacctgtacctataataacccggttatgggtgagcatgaggtaaaaatatattattggtgtagttggagaacggtggaggtaggaactaggaaggttggaacattgctttcaggaaaaaaatgggattgcgaagttggtcaagatttatga

SEQ ID NO: 40481 - DNA, 1161 bp, Glycine max
  Peptide Sequence Number=SeqID_157259
atggcgttttggaaggagcagctcagggcagaccaccagtggatcaatcacagttgggttcccccaatcaaagaccacaataatagggacaggatcagtgagctgccggactccattctgctccatatattgaattttatgaacacagaaagtgctgttcaaacttgtgtcttgtctaaaagatggaaggacctttgcaaacgactcatcagtctcgcgtactgtcctgatccttatctcctaaagaaacgcggggttggaaggtttatgaaatttgcaacctgggttttgtctagacgagacgacgcctattccctacttaatcttactcttcacctttgttggactgagcctgaactcctcgataaggtcaccaagtatgctctgcttcatgatgtccggcagttgacaatggagctatattcaggctttagacctgaccttgagtccctccctttaatcttttgctgtcattctttgacatctcttaagctttgcattaatggaatgaactatcccctcataatacttccaaaatctctgcacttgcctgcattaaaaagcttgcatcttcaaggtttcaattttactgcaactggcaatgactctgctgagcctttttcaaactgctacgtgttaaatactttggtccttagattttgttctttgcataatgatgcaagggttctctgcatatctaattctaccctttccattttgacaatattagaaggacaaacttatcaaattgtgctttctactccaaatcttagttcttttactatcaggggttctagtagtctccaactcttctctacatgcaatctttctttccttggagaagtaaatattgatgtgtcttgggatggacattgggctgagaaaagttcaatcataagttcaaacatcgtaagatggctggtagtgcttgcctatgtaaagaaattgtcattttctcggtatgcctttcaaataatactacatgatttctcaaatcccatttcaatgagacctgaacctccaagctttgttagattggagtcactgaaagtgatcaagcttttgtctgcaaacgtatctgatgagaaagtaaacacagtagtggagtacttgcttcgggactctccaatggccagagttgaaatcttgggggaatattaa

SEQ ID NO: 40482 - DNA, 324 bp, Glycine max
  Peptide Sequence Number=SeqID_157260
atggaactaggcagtgaagtaggtcaagaatccagccagtgggaacaagaaaacgaatatttctcacaagaacaaatagattctcttccagatgttattgatgaggaggttactagcatcatcacaatggaagatgtcatatatggagaaaacttctacagtttagcggggtggggagacatactagatgaaactgatgaatatgttcacgttcaaaagaagcggggtgattacgccacaaaaataccttgcgatttggtgacaagcaacatattcagggattccttcctaagacaagatatggcaattctaaagggatcctga

SEQ ID NO: 40483 - DNA, 618 bp, Glycine max
  Peptide Sequence Number=SeqID_157261
atggtatcagaaggtgcacccactgaagcattcgacccttctccttctcttgcaattggagaatacgacctcttaatcgttggtcctgggattcttggtcgtttggtcgctcacaattggcgccaggaatatcctggctgcaaagtttttggacaaacagcaaccactaatcatcatcaagagttaactgaaattggtatcaatccgtctttgaagtggaccaaagcctcctccttcaaatttccctatgtcatttgctgtgctcccccttaccaatccccggactaccttggtgatcttaggctggctgcatcatgctggaatggtgaaggtgctttgctgtttacatcaagctctgctccttatgattgtaatgataatggattgtgtcatgaggataatccagtggtgccaatgggtaggagccccaggactgatgtccttctaaaagctgaaaagatagtgctggagtttggtggttctgttttaagactatctggactttatatatcctcttcagaattcagtttactaggattccaactgttcattcatcttggtggttatttctattatcatatttgtcagtttatgtctattgtctgcttccaaccttga

SEQ ID NO: 40484 - DNA, 309 bp, Glycine max
  Peptide Sequence Number=SeqID_157262
atgaaagaagatgaattcctatgttgtcagcttggtttctgggtgtttctgattatatgtctggtgcttgtgtcactggcaggcattgcatcaggcctagctctaggactactgtccttcagccaagtggatcttgaggtactcattaaggccggtcgaccaaaagacacaaaacatgcagaaaggattcaaccttttgtaaagaatggacattttgtcctgtgtacacttcttctaggaaaatcactggccatggagatgtcctctcatcttttagagaacctatataagagaacttctacaaaatag

SEQ ID NO: 40485 - DNA, 1284 bp, Glycine max
  Peptide Sequence Number=SeqID_157263
atgtccctctgctacacttccaatttcatctcactgaaccataaaaaaagcctctccttaaccttctcttcagagtcttctcctcacttcattaacctatttccagttaagcctaagaaacctcaccaccccattaagttcaccgcagaaaggttcaaactttttgcctctctgacgccatctccaccagttgagaccaccccatcaagttataggtgcaagagccccaaagatgtcaacgtcttggtggtgggttcaactgggtacattggaaagttcgtggtgagagagttggttaagagaggatttgatgttacagccattgccagagagaggagtgggattaagggcagtgttgataaggatcagactttgaatcagttgagaggggccaatgtgtgtttctcagatgtgaccaatttggatgcttttgaggaatctctgaacagtttggggaagtcatttgatgttgtggtttcatgtcttgctagtagaaatggaggtgtaaaggactcttggaagattgattatgaggcaacaaggaatagccttgttgctggaagaaaacgtggtgcttcacattttgtgctgctttcagcaatatgtgtgcagaagccgctcctcgagtttcagcgtgccaagttgaagtttgaggctgagttgatgaagttagctgaggaggatgatggattcacttatagcatagtgaggccaactgcatttttcaagagtttggggggtcaggttgagttggtgaaggatgggaagccttatgttatgtttggagatgggaaactgtgtgcttgtaagcctatgagtgagtctgatctggcttcttttattgtgaattgtgtgctgagtgaggataagattaaccaggtgttgccaattggagggcctgggaaggcattgactccattggaacaaggagagatgttgtttcggcttttggggaaggagcctaagttcttgaaagttccgatcgaaataatggattttgccattggggttcttgactttctggttaaggtctttccttcactggaagatgctgctgagtttgggaagattggaagatactatgcagcggaaagtatgttgcttctggatcccgagactggagagtacagtgctgagaagacacctagctatggtaatgatacattggaagagttttttgcgagggttctcagggagggcatggctggtcaggagctagctagagtcattgtaatgtttacaagttcaggcactgttgaaagaaattcaaatctctggaaatga

SEQ ID NO: 40486 - DNA, 447 bp, Glycine max
  Peptide Sequence Number=SeqID_157264
atggctccattaactgcttctcaagtacaaggtaaatatccatgttggcagcgcacagagcaattttttttttctttctgtggtatattcctgagatattttgtggctgcattcagtgtttctggcctttatgctcttgtttctgctcttgcatctatctctgtcatccagaagccaggattcaaactgaagttcctcctccactttatcttctgggatgcactgatattggggataacagcctcagcaacaggagcagcaggaagtgtggcatatattggtttaaagggcaacagccatgtgggttggattaaagtttgcaacatctacgacaagttctgtaggcatctagctggctccatagcagtggctttgtttggcagcattgtgactgtccttctcatctggctttcagctttcaccattcacagtcgagttcccaaatag

SEQ ID NO: 40487 - DNA, 741 bp, Glycine max
  Peptide Sequence Number=SeqID_157265
atgggaaactgcttgttaggaggcatttcagatcctgaattagtaatcaaagtcacaacatctaatggcggcatcatggaattctatgctccaattactgtgagtttcatcactagtgaattcccggggcatggcatattcccaagccatgacctattctgcaaaccacttagccaatttgatgagttggtggcaggacagtcatactacttactaccacttaacaacaaacctgaacacccttctgcctccggccacatcggcggtgacaacagcgctattcggcaaggccatgttcgttctcatagcgttcctacaacaccctaccctccgccatatagaatgtccttggactaccaacaccaccaaggaatgaagtttctcaacaaaacctccatagaacctttctcttgtaggactagtactagtaaaagcagcataattactagtagcagtagtagtaaaagcagcaaaattactagtagtagtaaaagcagcaggttctggaaagtgaagcttgtgataactcctcaacaattgatggaaattttgtcacaagaggctagaaccaaggagttgatagagagtgttaggattgtagccaaatgtggggttgctgcaggtggcattttaccagcatcagctgcaccaagcatattatctgatcagtggagcctttccagcagtggtaggagtgcttgtgattcctctaaggttgatgcattagtggttgacatttag

SEQ ID NO: 40488 - DNA, 357 bp, Glycine max
  Peptide Sequence Number=SeqID_157266
atgagttcatattttgaggaaagagcaccttgttgtggaactcacttttggattttactaagcatgtgttcggcatttgtgttatttgctgctatcacatcaggtctttctctaggactcttgtccttcagccaagttgatcttgaggttcttgttaaagctgggcagcctaaaatccagaagaatgcagcgaaaattatgtccattgtcaagaatgagcatttacttttatgcaccctcctcatagctaaatcaatggcactggagggggtttctgtttttttggagaaaatgttcccagagtggctttctgtattaatagcagctaccattttgggtttgaccgcagaggtataa

SEQ ID NO: 40489 - DNA, 480 bp, Glycine max
  Peptide Sequence Number=SeqID_157267
atggagggttcagaagcggatcgaaccgcattgctggtgcacccagcaaatttcaaaaatggcaaaaatgcccttcagcttttttacgaaccttcttccgttgacactcgcggaagaaatgttccgcgggcatccacggaagaaccttcttccgtcaactgcggaagaaggttcttccgtggaactacgcggaagaacttcttccgccagagtcaacgaagaaggttcttccgtgggttaccacggaagaagtcacgcacttcttcctctctccatttctctaactctggccatgcaattggcgttggtctcattgcattctctgtagaaatgatgaacaaggccaaaggaaaatgcaaggaggtcgccgaaaaaggttctgccggcaagcgcaagggcgccttcgacgatgacaagatcggtggcgtccaaaagagaaacaagcgaggtgtccttcagttatttttgacgacgaattaa

SEQ ID NO: 40490 - DNA, 1293 bp, Glycine max
  Peptide Sequence Number=SeqID_157268
ttgttggattggctttttggcaaggggcatactgcacttctaggacgagcagagctgaagactttagtccatttacatgctattgaggcagggaaaggtggagagttgtcacttcatgaaactagaataattgctggagctttggacttgacacagaagactgctaaagatgctatgactcctataagtgaaacattttctcttgacataaactccaaacttgacatgcatacaatgggcttaataatgagcataggtcacagccgaataccagtctactctggaaaacaaacaaacattgttggcattatcttggtcaagaatctaatcttctgtcatcatgaagatgaaatgccaattaagtttatgactatcaggagagttcctagggttggtgaagattggccactatatgatatcctgaatcaattcaagaagggtcaaagccacatggctgttgtcctcaagtgtgggggtaacatcagaactgctgcaactggacattgcccttcatttgaaccgggagatcatttccgcatatcaactgatgcatcaaattggcattcacaagaaacagaatattatagtgcaacactgaagagtgtcatgcatcgagagggtgactcagatcttctgcaaagaagatcagaacaacctgatgcaagttcatcctttgagaatttggagtctctttcaacagaagtcgaggaagtgattgggataatcacattggaagatgttatggaagagttacttcagtatcagaatcaaactagaacatgcaagaagagtgtcatcagggtcctccagaagggcttcaagtactcgtcaacaacggagaagttcagatgcatctcgatcttcattcaccaactgagctttttctttgcggctgaggtgcaacacatggttatcatcgtgattatccgtatgaacattatggattgtcaatccgtatgtttcttacgaattgtcaatccgtatgaattatacagattatcaatccgtatgaatcatatgacttatcaatccattgtcaattcatatgaattatatggattgtcaatcagtataatccatacggattgtcaattccctaatgcacaaaaaccgcaacattacaaggagaaaagtactcacggcgatgatgatggcgataacgacagtgatggcaaaaataggaggagaaaccaccaacaagtgaagacgaacaaagggttgaaggagggagatcgtgacgcaagaagggagagcgaaaacagaagcagcgtaggaggagggcgatgggtgtag

SEQ ID NO: 40491 - DNA, 1773 bp, Glycine max
  Peptide Sequence Number=SeqID_157269
atgtcatcatcaaccacaagcagcagcagcagcaacaacaacatgagcgacgtcgatcgtttgttcgcatcttttaagtgcggtttaacacctccaaaatctgctacgagggaaagaaaacgaagcaagaggagactggagcaggtgagttcaaaccacgagactccatcggaatctccgggtccaagatcgcctgaagaggaactgagaacccccttatcacgcatcagaaaaaccaacattgaatcttctattgagaaacttaaatcagcagtaaccagagcacaaagcattggttgtgggaaacagttctctccaattgtattttatggatctccctgtggcatccctcccaaaaagccaacccgtatgttatggcgaatgttacgtgagatatgccccaatgtctctcagcaaaatatattgagcataaggaaggaagtttggatgacattcccaaggcaggatgaagcaatgaagtttgccaaaggacaagaagatgttcatgttttcagctatcaagaccactttaatggccaaagaaggtacaataatatgaatcccaaattccgtcatcattatgaagtcattcaagcgggtttaccatgtcacctttattttgatttggagtttaataagaaagtcaacacaggaaagaatggagaagaaatggttgatctcttgatatcagtggttctagaagccttccatgaaaaatatgcaattcaaggagaccacgattgggtagtagaacttgattcttcaaatgaagggatcagtgttgatttgttcaagattagaaggcagctgtcattggcactctttgttgatcaaaacattggaactactgaaatggagattgtatgtcctgtcttgtttacaccgaaatgcttaggaccatccatcctcattgatggaggaggattcaatcccaagaccttgtgccaaggtgataatgagagacatcagtgttatcaaatagtggctattgtggcgctaccacactatagcatagtgggttttagagataacgcaatcatgatggcatcacgtagcggactccgtgaaaatcgcaatcgcgtgcgccttacacgtcgcggaacctcattgcatcgcgacttttgcgtcacactggtttccaacaagaggaaaccgggtcatgtgcagattgcggattcgggtcagggtgaagaagacatattcatggcttccttgatctgcaatatggatgttgattgcaaaacgtatctggtctgcaaaacagacttagattgtgtgaaaactctgcattttgatacagaggagaatagtaatgttagtaattccacccaaattcctccagaatttacattgggtactagcacaagtgatgtttcaactacatacttcatgggaaagtcaccattcccatttctggacaaatttatactgtctgttgcctctgtcgggaatataccagtgatatatgtggttgatctacgaatggcagtgtattatcagaaatgtcatgatcctgactgcagaggttatcgatctccctcacgtcaaatcccagttcatgtgttctccaatccttcagatgtaattggttcctttgggttgttagatgatgaacagccagtagatgataagttgagacatcaacttgatgacaacaaggagcaaaatcttttacaattcaaagacactgttgaggacaactccaatgattcatggtggctagaagccataagagttgtcgaggatatggaaaataagcaaacaaagacagag

SEQ ID NO: 40492 - DNA, 174 bp, Glycine max
  Peptide Sequence Number=SeqID_157270
atggtgttttttcccccaacaaaacttgtcacaagaaaggcctttgtcctagagcatgattgtgctgaagatgaggtaattgatgaagatgaggagtggtggcaggctgtagaaagtactgcatcccaggttgaacttacctgctccagtcaacaagaactctgcgcaatctaa

SEQ ID NO: 40493 - DNA, 276 bp, Glycine max
  Peptide Sequence Number=SeqID_157271
atgaaggtgctgccaccggaggctttgaaatatgtctttaataaaaataaatataaacgatacatgaaggtggaacgcagtagtcgtaggcgttgcctatggaagattaacgtgcaaaacggcgtccctactcttgctgacccatggtaccagtacttagcggacaatgatttaatgtccggagatgaggtggtattttactacgcgttcaagaaacatggatgggacatcctgtataggaagcagctgatatgggatgacgacgaatccgattga

SEQ ID NO: 40494 - DNA, 981 bp, Glycine max
  Peptide Sequence Number=SeqID_157272
atggaacaagtcattgttggtattaactccatggaaatgatctccgaaatggacttatctggtccttcagaaattgactttgggatagaagaaattgatgaggaagatactgaggatttagatgacagcgatgaagatgaagacgaagatgagaatgaagattatgattcagaatgggtggctgtgttttcagatgatgagcaagatgatgatgaaacacttgcagactgggcaaaattggagtctatgcaatcttctcatccaatgtactttgccaaaaagttggctgagatcgcatcagatgatcctgttgattggatggagcagcctccagcttgtgtggctattcaaggggttataagacctgcttttgttgaagaacattctacaatacagaagcatctatctgccaatcaatccagtgatactgacaaaagtagatctatagaaagtaaaggggaaaatattggtgtgattaatggtcatgtgcttaattcaggatcttctggagataatgcagcacagcaggttgaaaacaacgagaatagtgttatcccctcttgtgagacttcattttacaaattggagatgattaagattcaagtgttttctgcacaagggcaacctactgcccttgaattagaagactacatgaatgcccaacctgatattattgcgcactctgcttccaaaatcatatctcgtttgaaagctgatggagaaaagaccttggaagcccttaagtctctgtgttggagatgcaagggtattcaagtagaggaggcacaacttatctgtctagactcccttgggtttgacgtaagagtttgttctggaactcagattcaaacactgagatttacattcaagaaaagggccacatccgagtacagtgctgagagacaactcaacgatatactatttccaagaattcacccaaagcagcaaaaaatgaagcaaacacatcaaaatgaatgctga

SEQ ID NO: 40495 - DNA, 360 bp, Glycine max
  Peptide Sequence Number=SeqID_157273
atgatgatttttggtgaccaagagcagttcttcgtgttaggaaactgtaggagaaaatctcatgtcaaaaggattcccggtttagaagttatgcatcaaggtggttatgaaaacacaaatttgacgattcagttcaagggtgatccaagaagaagcttcccaaaaaagaagcacttttgcagcatgagtagctgtctctttcttgttaagctccttcagtttaaggaatgtttagcaaaacctgatggtataaagaccaaccgatctcaattggttgattcaaaaaagttgtgcgtaattgaaggactcggtcttggtggagctgatggacggagacggaatagacaaactaatgtttaa

SEQ ID NO: 40496 - DNA, 246 bp, Glycine max
  Peptide Sequence Number=SeqID_157274
atgggtgcatgtcttgaatcaatggtaagaagtaaaataaacacaggcactccgttcacaagaagagacaaacttgtaaagaatagaatcagggcatcatcagagcatctaggatcagctcaggatccggtaaagaaaaatgagaagccatcctatcatccatttgaagaagtttctgtgtcttcatcagagaatagtgaagatgctacacttaccacagcagaaacaagtagaacaattattgag

SEQ ID NO: 40497 - DNA, 735 bp, Glycine max
  Peptide Sequence Number=SeqID_157275
atgcttgcactgacagattctcctctacttattgctaaaacatttgaagcaactaaaataccaacaagcacacgaggcactgtggtatgtgctgcaaaaggtccaagaccaagatatccccgagtttggaagacccataaaaaaattgggaccatttccaaggctgccaagcttgttaagtctattaaggaactgtctaatgtcaaagaggaagtttatggagctcttgattcctatgttgcttgggaattagagttccctttaattacagtgaaaaaggcactcaagaccctagaattcgaacaagactggaagcgggtaatacagataacaaaatggatgctaagcaaaggtcaaggaaagacaatgggaagctatttcacattacttaatgctttagtagaggatgaccgtcttgacgaagctgaagagctttggacaaagttattaatgcagtacatggaaagcttgcctcgtagattttttgataaaatgatatctatctaccataagaggggcatgcatgagaagatgtttgagatatttgcagacatggaggagctttgtcttcgacctaatattgttgttgtctcgatgattggagatgccttcaaagagcggggtatgctagacaaatacctgaagctacatgcaaaatatccaccaccacaatgggaatacagatacatcagaggaaagcgtgtaaaagtcaaagtggaagttcagtctagtcag

SEQ ID NO: 40498 - DNA, 276 bp, Glycine max
  Peptide Sequence Number=SeqID_157276
atggaacctgaacgaatttcagacataaacaacaattataggtctgaagagacttcagacatgattgatgatcagcaacttggacaggaagcagatgtaatatccatggaacttgaacaaatttcagatgattcatatgacagtattgaacctattttagatttattgttaatcatagttggaatcattatttccatgcccatctccaacaagttgttaggagacaagagtgaagacactaggaataggactagaactaagagaacatgtttttaa

SEQ ID NO: 40499 - DNA, 486 bp, Glycine max
  Peptide Sequence Number=SeqID_157277
atggaagcctccaaactcagtagcagtgatcaaaacgttcgatgccatcactgcgcaggacccctttccaaagacatggaaaccagtcactggaccgtttcgcctctcattagggatagcttctccatgattggttctgccgttggcggcgttgcaagtgcattttatggattcaatcttgttatgccgattgtccaaagaaggatcaaaggacccatgtggttgcattttctcataggtttcatggtttttcctcatattgaatactccggagattctaaaccttttcactgttatactgacataaacctttctgcaattcaggcaccacctgtgatagtattctcttcagcctgtgccggactggcgggtggggctgttcctgctgcagcacaacttgtttcctcatcttatcatgcagcttactcttctcctacctcacctccgccatcaaaggatgaaaatattcaaaggtcgagaaaatga

SEQ ID NO: 40500 - DNA, 411 bp, Glycine max
  Peptide Sequence Number=SeqID_157278
atgacatttttaatggtattagtttcatatgtcaagaagctgaatattccaagcggtgtggtgggtgcctgtcgtcttgacctagcatatgaacatttcaaggaaaaacctcacttgttccagtttgttccaaatgagaagcaggtcaaggcagcgaataaactgctgaagacaatatcagagcacggtgagaagaaaaaggttgatggggtgcctgtgtttagtgcccagaacttagatatagctatagcaactacagatggtattaaatggtatactccctacttttttgataaaaacatgcttgataatattcttgaagaagctgttgatcagcatttccataccttaatccaaactcggcacatgcaccggcggcgggatgtggttgatgacaacttggctgcagaa

SEQ ID NO: 40501 - DNA, 978 bp, Glycine max
  Peptide Sequence Number=SeqID_157279
ggatggactacagaattagaggttcaggaattgctagatgaaatgggccatcctagtataccactaagtgttatatcaaaagctgcagagctccagtttcagtatactgttgataaagtatttctgggtaataggcctttgaaactgaaaatttcaacttgtggcattttcacccctgtccttagttcagtggctcctcatccaaatagatttttgtgtcatccacaaagcatgactcttctgtcactgcttgaaagaagcctttcttccagacgttggccatcaaatgagcttgggtgttacatgggatacccaaccaacctagacaatctttattggttgactaaatgcacaagagatcatgggaaaaacaggaaacaaggatccctaaatatcctttcttcttctgaaactggatgtcttgagttgcagagcacttttaaagttggatgtcttgagttaagtgaagcttctctactgagagctacagagtcaagcagctcccttgagaactctaaagtggaagatgataggaaaaatgctgaatgcatagactcttctaagtgcagtttggatggtaataccgaagcaatcaaacaatctagtccaagactaagtctaccatttggtaattggtttcatcacctatggccgaaacagtgtcgcaaaaaagtaggctcatctagaaaaggtgtaaataaggaagaaatgaaaccagcaccctttcttccgaaaattacaatggttggtctctctactgaggaagcaggccaaatgagcaaagctaatttgaagaagacaatggacgatttgacaagagagttggagaagacagagctagatattatgacagatggtggcagtaaagagtgcaaagtagaagatagagatccactatttgtggcaaatgtgggtgattactattctagtttgggaaaaccaggatctggtcgctggataagaggaggatccaactaa

SEQ ID NO: 40502 - DNA, 1047 bp, Glycine max
  Peptide Sequence Number=SeqID_157280
tctgcttagctcaattctccatagctacaacaacaacaagctccttgtcaatggaaggaaacaatttgccccacaacatgccaacatggagttcaagaaaactcgtcacttcccaaagccctgcttcattttcccttgaaccaaatgagaagcagaagctcaagaataacactcaagaatgcaagtcgccaaatactaatgataaggccaaggacccagaagaagggcatagtgagaatattggtaaggttgatggtgtagaggaaattacggggcgtgagaggctgaagaggctccgggaagaggtgaccatggacaaggttaacattccagaaaattggggtcaggagccaaagttgaaggactggatggactatactatgtttgatgcattctttcctcatactttgattgtgactgctcgtgatgctcttattgctaatgctcgtgaagcaaagtcaccaagtaagcttcagagtgatgctctaagagaagctatctcaggaatcatggctgattccaaggaaaagaacaggaaatttgtggagaccattgaactccaaattgggttgaaaaattatgatccccagaaggacaagcgtttcagtggctctgttaagttgcctcatattcctcgccccaagatgaagatttgtatgcttggagatgcccagcacgttgaggaggctgagaagataggattggactacatggatgttgaggccttgaagaagcttaacaaaaacaaaaagttggtgaaaaaactagccaaaaaatatcatgcctttttagcctctgaagcagtcatcaagcagattcctcgtctcttgggacctgggaagttccctacacttgtgactcaccaagaatctctcgagtcaaaggttaatgagaccaaggccatggtcaagttccagcttaagaaggttctctgcatgggagtagctgtggggaatgttagcatggaggaaaagcaaatcttccaaaatgtacaactgagtgttaacttccttgtctctttgctgaaaaagaattggcagaacgtgg

SEQ ID NO: 40503 - DNA, 354 bp, Glycine max
  Peptide Sequence Number=SeqID_157281
atggcaaggactaagggtaaggaacctttagaaggacttggaggaccaatggcaagggctagaacaaagaagaccaaggaagctcttcaccaagtgttaaccatgctatataaatttaggcccaagttacaagtggagaagcttcagattgtcaagctttgttggcctgaaaagaaagaagcaacacccaacaggaaattttggagagatgctaccttactgcaagatgaaaatatagttgtgtttgaactaattccatcacgacgtccgacaatgccttccaagattattttgatgatgccaaagaatcaagaatcaaacaagtttcaaaaatcaagatcaggactcaagtaa

SEQ ID NO: 40504 - DNA, 273 bp, Glycine max
  Peptide Sequence Number=SeqID_157282
atgttgattgatgttgaaaatgcattggcatgtgcatgttgtgtatgttcgtggggggcactgtgcaatgaccttccagggtctttggcactagcttttggccacgttcatacgtcgtatggagtgtatgtcatgagggtagagtgcactgaccttgtcggatggcctagacgtggagggggcttgtcacctggtagggaacagttttgggctcccaggctgatcacctatgggaagggggctattacgtgcacaaccgggtggtcccgatga

SEQ ID NO: 40505 - DNA, 381 bp, Glycine max
  Peptide Sequence Number=SeqID_157283
atgcaagagatgccactttacaccaaattcatgaaggacatcctcaccaagaaagggaagtacattgacaatgaaagcattatggtgggagacaactgtagtgtagtgatacagaggaagctgcccaagaaattcaaagacctcgagaacaagaattggaaatctgaagatagactctaccaggatgacgctccagctcgtagaccgatcaatcacaagaccatacggggtagtggaagatgtcctggtcaaagtccgtcactttactttcccagtggattttgtcatcatggacatagaaaaagatgcaaagattcctcttatcctaggcagacccttcatgttgactaccaactacgtggtagatatggggaatggtaa

SEQ ID NO: 40506 - DNA, 576 bp, Glycine max
  Peptide Sequence Number=SeqID_157284
atggggacgaggggttgcattaattacaataccgtcctttccataagacaacttggctaccctatgaggggggtaccattagaggaaggcctcacaccttttattgcgcaaggtttcaatagcaccaacgtcggggtgcttcggagggtctgcaaggcatgggaaatggtgcaaaagaaagacgaagaactttggggaagtagcaatgggcccatcggtggttaccataagtggttgaaagcctacgcacaaggtctgggttggctcccgaatttgagagccactaaagaggtggaggttgaagctccggaagaaggcgaagaggtacaagccctcagaatgaagctcgagcaagcccaagcggtcaaggaaaagttcaagtcagcagtcgctaggatccgaaaggagaatgccgaactaagagacatcaacatagccaccaccaaggccttggtgcaaaagaccaagagggctcgcaagaaagaacatggccggaacaagtttcgaggagaggaaagggaccagtcgcgagtagatggcatgattctgaaagacgaattgaaagacttgcctaag

SEQ ID NO: 40507 - DNA, 312 bp, Glycine max
  Peptide Sequence Number=SeqID_157285
aaataagggtagagcaacaacttaaaaggaagtatacttcaaaatcttatggccctcacttttatccaaagaaagaccaaggtcaaggcatcttaggggtggcaccttctaagcccaaagataataaggggaagacattagaaaagcaaccccctaaggctagggccaagacatttatagtagccaagatgaggatactacttcaccttcctctagtgaaagtgaagaaccaaaaagggaagaatctagtaaagaaatctacccccaagaagaaaggacaacctttaatggttaaagaggagtgtaaaggag

SEQ ID NO: 40508 - DNA, 204 bp, Glycine max
  Peptide Sequence Number=SeqID_157286
atggagttcaaagttcaagcgtttatgggcgggcgcgagtccatgggaaacaagatatacctctcaggtccattaatggtttcgtcaagcaacatggatcagatgctcaaagatcatgacagaaagatccaagagttttcaagacgagcgagaatcgacaagtcaagagcaagaggtgagaaagttcgtgctctgcggaagtag

SEQ ID NO: 40509 - DNA, 564 bp, Glycine max
  Peptide Sequence Number=SeqID_157287
atgacagtgatgatcaaagtatttgtactacaaaaagaggtaaagctttttgggagaaacaagatcaacttcttaaggactagttcacgtgagacaaaagtccggcaagcaacgaagggagttctaagagaactgaacaaatcggagaggctatgtatttgccggcggcacccagtggtggctaagacgttgcaggaattgcttgctgagggaaatattgacaacaatggtaataatgatgatgtcaacaacaatgataataaaaatacgagtggtgatttcaatgatgtgacggcgacaacaatagtagtggtgttggtggcgacaactggtgcgggtggttgtagcaatgtcggtggtggtagtggcggtggtggggtggtggtggtggttccactggtattggtgatagttgtggtagcagtgatggaggtggttgcaaaaatattagtggtggcggtgatggaggtggtgacagtcagttatggcgatggtgacaatgaggaaggtggtattggcagtgatgatgatgacaatagtggtgatataatggtgttgatgatg

SEQ ID NO: 40510 - DNA, 1402 bp, Glycine max
  Peptide Sequence Number=SeqID_157288
atgtctacctctacctttctcatttctctgcttgttttcatcacaaaccttacccttcttcttcttctaacctcagtttcatgcacagagttcatctacaacaccaacttcaactccaccaacacccttctacatggcaacgccaccatagaatcttccatcctcacccttaccaacagttccaccttctctgtgggtcgtgctttctacccttttaagatccccacaaaaccttccaactcttcaacccctttaccattctcagcctcattcattttctccattgcaccattcaaagaccttctccctggccatggctttgtcttcatactgacaccttctgcaggcaccactggggtgaactctgctcagcatcttggcctctttaactataccaacaatggtgatcccaacaaccatgtctttggggttgagtttgatgtgtttgataaccaagaattcaatgatatcaatgacaaccatgtgggggtggacataaactctctttcttcttttgcttcccatgatgctggattttggggtggcagtgacaacgacgagttcgaggatttgaagcttaatgatggcgagaactatcaggtgtggattgaatatttggattctagagtcaatgtcacaatggctcctgcaggccaaaaaaggcctcagaggcccttgattagtgaaattgtggatctttctgaagttcttttggatgaaatgtttgttggattttgtggggcaacagggcagcttgtggagagtcacaagattttggcttggagctttagtaactcaaatttttccattggtgatgctttggtcactacaaatttgccttcatttgttctttccaaagagtctattttgaggtcaacaggttttattgtagggatcattgtaggtgttttgtttgtccttagtgctgctgttgtgatatttgtgttttttctcagaagaaaaaggagtaaaagaaaggatgaagaaattgaagattgggaactagagtattggcctcaccgtgttagttatgaagatatttattctgctactaaaggattttcagaccaacatgtaattggatttggagggaatggtaaagtctacaaagggcttctgcaaggagtgcaagttgcagtgaaaagaattccatgtgacagtgaacatggaatgagagagtttttgtctgagatttcaagtttaggcaggttgaagcataggaatgtggttccaatgagagataaaagaatatttgatgatgatgagaacacaatttttgggtgggagaagagaatcaaggtgctgaaggatgtagcacatggagtattgtatttgcatgagggttgggaggttaaggtgttgcacagagacatcaagtcaagcaatgtgttacttgataagg

SEQ ID NO: 40511 - DNA, 426 bp, Glycine max
  Peptide Sequence Number=SeqID_157289
atgacggcggattgtctgccggtgctgttctgttcgcagcacggcgatgaagtggccgccgctcacgccggctggcgtgggttatgccatggcgtgctggagcaaaccgtggcggcgttcagcgccgcgccgagccagatcagcgcctggctggggccggcgatcggcccgcagcagtttgaggtcgggccggaggtgcgcgctgcctttatcgcggaagacgccgaagccgcggcggcgtttacgccgcacggcgataagtttttggctaatatctacttgctggcccgccaacgtttgttgcgggcaggcgtgcaggccatctacggcggcgaccgctgcacggttaacgaaaagagtcattttttctcctatcgacgcgatggaataaccggacgtatggcaagtttaatctggctgatataa

SEQ ID NO: 40512 - DNA, 950 bp, Glycine max
  Peptide Sequence Number=SeqID_157290
tgtgtgcatcccaagtgagcgtgagacacttttgaagtttaagaataatctcatagatccttccaataggctttggtcttggaatcataataataccaactgttgccactggtatggagtcctctgccacaacgtcacttcccatcttcttcagcttcacctccacacttcaccttctgctttctatcatgactatgattaccagtatctcttcgatgaggaagcttataggagatggagctttggtggagagataagtccttgtttggctgatttaaagcatttgaattacttggacttgagcggcaatagatttcttggagaaggtatgtcaattccttctttccttgggacaatgtcctccttgactcacctagacctctcttatactggattctatgggaagattcctcctcagattgggaatctctcaaatttggtgtatcttgacctgagttcagatgttgccaacggaacagtaccctctcagatcgggaatctctctaagcttcgatatcttgacttgagcgccaattatttacttggaggaggtatgtcaattccttctttcctcgggacaatgacttccttgactcacctcaacctctctcatactggattcatggggaagattcctcctcagattgggaatctctcaaatttggtgtatcttgacctgagttctgtttctgccaacggaacagtaccctctcagatcgggaatctctctaagcttcgatatcttgacttgagctacaatgattttgaaggtatggcaattccttctttcctttgtgcaatgacctccttgactcacctcgacctctctcatactggattcatggggaagattccatctcagattgggaatctctccaatttggtctatcttgacctcggaaattatttttccgaacctctgtttgctgaaaatgtagaatgggtatcaa

SEQ ID NO: 40513 - DNA, 2285 bp, Glycine max
  Peptide Sequence Number=SeqID_157291
agagacagagaattctaggctgtgacgacgacgacgaagaagatgcagagacgaagtcctccgaagcacaggcacgacgggacttcgccgctgcctctcggcatggattggagccctgcgcctcgaaaatgggggatctcaaccatttccatagtttccttcgtgtattgcctagttcggctggcatctatggaggggagtctcagaaagtcccacatacccctgccttaatggagtgtggtgatctctaccatttctgtagtttccttcgtgtattgcctagtccagcaagtatctatggaggggagtgttggaaggggatctctatggttttcatagtttcctttgtgtatcacttagtccagcagccatcaatggagagtagtggacagttctacagggttcaagttggtgtacagtcaccggaagggattacaaaggtccatggagtcttgagaaggttcaatgattttctaaagttgtttgctgatgagtttcccaggaaaaatatccctccagcaccacccaagggactcttgcggttgaaaagccgagctttgttagaagaggagtggatcaccaaactattatctgacattgatatatcacgatgtgctgccgtggcgtcatttcttgaactagaagcagctgctagatcttcattccaagatgcaagccagcagaattctgaaacagaccccgattccaataacacagtttattctgtgcaatcacctctccagtcgagtttatcattattcgctggcagttcatctgttgcctcagattatggtagtgatactgcatatgagccatctgacctaggaacaccaagaattggacgggacgataattctgaagttggcacagatgatctaacattagatgaagatatgacgaatccaatagaaaagcttgtgaaatatggcatatcaaatattgacgaaggtttgtttatgggtcagactattctagagcaattggaaggccttcctaggcataaagcaaatgccagacatgtgaactatgctgcagaaaaggtaaaaaataatggtaatgtatatgattcctcacttttagctaataataccatggagcttttctctgagcctgggcatgctaaggttgttgctcatgttcgtaagctttcaagtgagagtgttggaagtgatggaagctcaatacgaggtagtgacatgtctaattttgggattccaaattcatctggtgatggctctcatgaccttcctggatctgctttggtttcaagagagacagatattatgggccacacaaagttgaagtctactggtgatactcaattagtccttccactagatcaacgcaataaattgaacaggattctttcaaccatgcagcgaaggctaggcactgcaaaaactgatatggaggaccttatagttagattaaatcaagaaatagctgcaaaggattttcttgcaacaaaggtcaaggatttggaagtagaacttgaaactaccaaacagaaaaataaggagaacttgcagcaggctattctaattgagagagaaaggtttactcaaatgcagtggaatatggaggaacttagacgacaatcattggaaatggagataaaactaaagtctgaattggatttgacaaaggaatcaattgttcagcagaatgatgtactgttggagaatttagatgctactaaggagcagctggaaattttgtcaaaacagtatggagagctagaagccaaatccaaagcagatgttaaagttctggttaaagaggtcaaatctctccgtaattcccaaacaaagttaaagaaagaacttagtgagtctataaaggaacacagtgaaactgaggcagaagtggctcggagaatactgctggagaaatgcagggttcttttcaaccagcttcaagagtgcaatgtcagtcttccttacgaatacgaaggtaggacaattgtgaattcatcatcatcaactgatgcttttaatcaattaacgacatctgatgaccaaatggacatcctactagcagaggtagaaaacttagagaaggactacggaagtgcagcttgcaatgtagataaaacgaatgacataaaagatggtgtaatctgtgatgatgaagtgagaaagatcatagcagatttgttcatcgataatgttagattgagaaaacagacaaaccgcgtcacaaggcatgccctcaaattggatatgacagcaagtgatgattccccttcagtggaaactgtaacaagtattgagaaatatatgtga

SEQ ID NO: 40514 - DNA, 276 bp, Glycine max
  Peptide Sequence Number=SeqID_157292
atggctctggcccccccagaaggaggccttctttgccctccacctaagctgcgcaggaaaagcccaaagccaatcccaggaaacagtagtccgcatcttcacagacatgtctatttcaccgagtctctctccgagacagtgcccagatcgttacgcctttcgtgcggtcgcccgggcctggtcactgcgaccccctttgtgaggaggcaccccttctcccgaagttacggggctattttgccgagttccttagagagagttgtctcgcgcctctag

SEQ ID NO: 40515 - DNA, 156 bp, Glycine max
  Peptide Sequence Number=SeqID_157293
atgaccaaaatgatacatttcgaaaacataaaagggaggttgtggcaaagacaaaagaaggggctggacaactatctttttgggtcgatgatgagaggtgaagtgacagacgaaggaaaaaagactttatccagtgtgattgagaataattggtaa

SEQ ID NO: 40516 - DNA, 507 bp, Glycine max
  Peptide Sequence Number=SeqID_157294
atggaattccgttacaactcaaagttgggagaggggaaagggaacgggtgtaaggaatgggggagagaagcagccatggccactgcaagaactgtgaaggacgtttctcctcatgagttcgtcaaagcttactcttctcacctcaagcgatctggcaagatggagctgccagagtggactgatattgtgaaaactgcaagatttaaggagttggctccttatgatcctgactggtactatgtcagagctgcttccatggcaagaaagatctacttgagaggaggacttggtgttggtgcctttcagaggatttatggtgggagcaagaggaatggtagccgccctcctcatttctgcaagagcagtggtgctgttgctcgtcacattcttcaacagttgcagaacatgagcatcattgaactggacaccaagggtggcaggaaaatcacttccagtggccggcgggatcttgatcaagtggctggacgcattgtggttgcaccttga

SEQ ID NO: 40517 - DNA, 99 bp, Glycine max
  Peptide Sequence Number=SeqID_157295
atgtgttgtgttttggataaagatatccctttctggaccttacatgtgtcagttcattatgttctttggaggtatgaagacgtgataaagggagagtaa

SEQ ID NO: 40518 - DNA, 359 bp, Glycine max
  Peptide Sequence Number=SeqID_157296
atgggcagggtgaggttgaagtcaaagagtgctgctttctcaaattcttctgctagggagggtctggccaagaccagtggtgctatccctcccaggagggacagcatctggggctttgaaattgggagtttcagtttcaaggttggggctttggggagtgaaatttggagaatggggagttttggtgtgggggaacgggaactggtgcagactggaaccagaggttttgtggaagccataatcattctgagaggattggatggaagagaagaagaggatttgagagctagactatctaaattctttgccacacaaattgatgaggttgtgtggcagtggctgcctaatggaatctggaa

SEQ ID NO: 40519 - DNA, 493 bp, Glycine max
  Peptide Sequence Number=SeqID_157297
tgaggctacagagtactcagtgatcacagttggttcaagtcactgtggcaaatatcacattcgtcaggagcaagatcctataaatgtgttcagatatggtgcccaagcagtgcaacacagtcaaacgatgattgcaccaggcaataatggacctacgagtggaacagctaatattgatgatgctgacagtggcaaagcggccaaacaagcattagaattgatgggcaagtgggaaatgattgatgtctgtgatgcactagaacttttgtcgcttgtttttgaaagtgaagagtggttcttccatagattgaaagttggacgcccaattcctatccccaacttaggactacagataacccaacttggtcatgttaaggatttggcaaaagcttttatccatgttcttggtaatgagaaggccaacaaagaagtattcaacatctcaagagagaagtatgtcatgtttaacggattagcaagagcatgtgctaag

SEQ ID NO: 40520 - DNA, 684 bp, Glycine max
  Peptide Sequence Number=SeqID_157298
atgggcgccctcgccgtgcagtatttgaagggagacggcggatggtgtggcgagggaggtgtagggacggtggtggggcagttcgtgaagctgctgttcgaggcaatgggggagcagaacaaggggtgtggcggtggcggcggaggaggggaggcggtgccagtggcagcgtttcaaaagctgtgtccgaggatctgcaagctgctcaacagtcccgtatccgagccgtattggagttgtattgaagttgtgtctaaccttaggaagccgtatcccaacctatcgatgtcggatacgggtgcgacaccgatacttttccttttttcacgtatccgggcttcacagatgatcattctgtacaagaagtgtgacaaaagaaagatacctggtatattatcctttatgaagaaggaaaatttgactgcatctcatcttacatataggattctgatagcaactagaggtgaaactcgggacttaatagggatggaacagttgcttgaggatatgaagtctcatggtttgcaacctgatgctcatttcgtgacagacttgatctctaatgtaaatgatatagtcaaggatgcatgggtttggttttgtgttctgctaatctattcgcctgcatataatgtgaaaaaccgaagctataagaagaagtttctgtgcaaacgggccttttga

SEQ ID NO: 40521 - DNA, 330 bp, Glycine max
  Peptide Sequence Number=SeqID_157299
atgctttctttcaaagggagtccatactggatggcacccgaggttgtaatgaatacaaatggctatagtcttcctgttgatatatggagtttgggatgcacaattcttgaaatggcaacatcaaagcctccttggaatcagtatgaaggggtagctgcaatatttaaaattggtaacaacagagatatgcctgaaattcctgagatatgcctcggatcttgggttcttgagctctcgtctgaacagcctcagaatctgcttccccaaattgccacccacacccctcactgcttctcccttccccacacccctccctattgttgccagtaa

SEQ ID NO: 40522 - DNA, 147 bp, Glycine max
  Peptide Sequence Number=SeqID_157300
atggtccaaaatggtagtgttgggttaggaatagagcaaaatggagtgctggtccagaggtgtagaccttgtgaaggccacgtgatggtgcaagggaaatgggaacttatgctattcactgaaccccgcacgaccactggaaccagg

SEQ ID NO: 40523 - DNA, 990 bp, Glycine max
  Peptide Sequence Number=SeqID_157301
atgaacgacattcaagtgtggaacaacgccgcgttcgacggcaacgaagaagactccttcttaccgatgaagacttcttggtcttcctccgagtgcaccaaagaaaacctgagcccgcccgcacccgataatttatccttcaagaaaagcaccaccgccacaaagaaaaaccccaagggtttcggtttcggttccgatgataacaaaaacatcgacgacgagatcgaagagatcgagcttgagataaagcgccttaccacgcgcctcgacgcgctccgtctcgagaaggcgaagcgggggaagcgcgtggtgatgggcagagtcgtccccgcgaagttcatggagccgcgcccaagcgccgtcgtttcaagaaaacccgaagaaacgccgaagacaaaagttagggttagtagtagtagtaacaataataataatgcgtggcggcgagggatgagtcttggaccgaatgagattgcggcggcgacgccggccaccaccttgcagagtcgccggaaatcgtgcttctggaagattcctgagatcggcgaggaatcgagggcaaaaaccaccgttgggagagtgaagaagaaggagggaaattcggtgattcaggttcaggggaagaggctatttgagaaggagaaagtgaaatcggtgtgtgagagtggcaagaaggggttgttgaagcaggggaggatggtggcgagtaggtataatagtgatgtgaggaagagatcgttgccggaaggagggactgagattagggttaagaagaggtgggagattccaaagaacggcgaggaagaggcggaggccgtggcggtcatgcttccaaagattaagatggtgaagtgtttgaatgagagtcccagagattccggtgcagcaaaaagagttgctgagttgggggggaggaggtcctatttcaacactgatgagaaagatgtttgtcagattctgaattttgctgaagaagaagaagggcaatga

SEQ ID NO: 40524 - DNA, 1169 bp, Glycine max
  Peptide Sequence Number=SeqID_157302
tgagtacaaagagcacgtacgcggaagcacagagttacaatgaagacatgaagcttaccttgaacccaacaccgacaatggcagcgagactggcaatgaaatgtaccttaggtcaccacgagttccccaatccttgcagcagaaaccagaaaaggtccttagcgcaatggagaacaacaaccttagatgttaacggagaagaagagagcatgagaggatacacagagaagaaaagagcgcgacaggaggaagtaattgaagatgacaaaataagccaacaaagtacggagctaattctctcccttccaagagagaaaggttggagaacaccatatgtgtatctattccaagggttttggtgccaaccacatgaaatacaagccataatcacttttcaaaagcactttcaagccaaggacagtgatgttcttgtggccactgtgccaaaatcaggcaccacatggttgaaggcccttacctttgccactgtgagccgccacaacttttcttccttcaacaagaaccaccctcttctcaatttcaatccccatgaccttgtacccttttttgagtacacagtttatgataagcatgacaaggttcctgacttgtccaacatgcatgagccaagactctttggaactcatgttccatttgcttcattgtccaaatcaatcaaagagtccaattgcaaggtaatctacatctgcaggaacccttttgacactttcatctcttcttggttttttgccaacaaaatcaagccagggtcactacccacattggcacttgatgaggcttttgaaatgtactgtaaaggggtggttggttttggcccattttggactcacatgcttggttattggaaggagagcatagagaaaccaaacaaggttctgttcttgatgtatgaggacctcaaaggggacatcaattttcacctgaaaagggtagctgagttcttgggttgtcctttcaccttggaggaagaaaatagaggtgtgattgagaacataatcaagttgtgtagctttcagaaaatgaaggaattagagggtgaaataggggattgggttaattatctttcgccttcgatggcgcagaaattaaccaaagtcatggaagacaagttaggtgggtctggtttgacatttagaatgaactcttaa

SEQ ID NO: 40525 - DNA, 1959 bp, Glycine max
  Peptide Sequence Number=SeqID_157303
atggctccgaccacgatccggaaggcgattggggtggtgaaggaccagacaagcatcgggatagcgaaggtttcgagcaacatggcgccggagatggaggtcgcgattgtgaaggcgacgagccatgacgacgaccccgcgagcgagaagtacataagggagatcttgaacctcatgtcccactcgcgtggctacgtccacgcgtgtgtcaccgccgtgtccaagcgtttggggaagacgcgcgactggattgtggcgctcaaggcgctgatgctcgtgcacaggctcatgaacgagggcccgccgctgttccaggaggaaatcctcttcgccacccgcaggggaaccaggctcctcaacatgtctgatttcagagatgaggctcactccagctcctgggatcactccgcttttgtgaggacctatgctatgtatctagatcagaggcttgacttgatgctctttgatagaaaaagcaccgccgcctcctatggtggcggtgcgggtagtgttggcggtggcggcagtgatgatagatttggcggaagagacaatttccagtcaccgccgtatgagtacggcggtggtggtgaatttagaggggaaggcggctatgggaatgggatgaggaagacgagatcgtatggggacatgagtgaatcggtggggagaggggaagagaagagggttgtgagtgtgactccgctgagggatatgacgccagagagggttttcgggaagatgggacatttgcagaagttgttggatcggtttttggcttgtaggcctactgggttggctaagaatagcaggatggttttgattgcgctgtatcctgtggttaaggagagttttcagttgtatgctgatatatgtgaggttttggctgtgttgcttgataagttctttgatatggactatgctgattgtgtgaaggcttttgatgcttattctagtgcggctaaacaaattgatgagttggttgcattttacaattggtgtaaggataccggtgtggcgaggtcctcggagtaccctgaggttcagaggattaccaataagttgcttgagacattggaggagtttgtgagggatagggccaagaggccaaagagtccggagaggaaagaggaggttccgccggtggagaaggtagaggaggagccggccccggatatgaatgaaatcaaggcactgccaccaccagagaattatatcccacctcctccgcctgagccagagcctaagccgcagccacaggttacggaggatttggtgaatctgagagacgatgcagttactgcagatgatcagggaaataaattggctttggcactctttgctggtgcacctgctaataatgtaaatggatcatgggaagccttcccatcaaatggacagccagaagtgacttcagcctggcaaaccccagctgcagagcccgggaaagctgattgggaattggcattggtagagactgctagcaatttgtcaaagcagaaggcaactttaggtggtgggtttgatcctctattgttgactggcatgtatgatcaaggaatggtgaggcagcatgtcagcactacccaactgagtggagggagtgcaagcagtgtggcattgccaggacctgggaagactacaacccctgtgttggctctccccgccccggatggatccgtgcagccagttaatcaggatccatttgccgcatcgctgagtgttccaccaccgtcctatgtccaaatggctgatatggagaagaagcagcacttgcttgtgcaggagcagcaggtgtggcatcagtatgctagggatgggatgcaaggtcaatctagcttggccaaactgaatggcgctggatactatgccggaggtcctatgcccatgatgccttatggaatgcccccagtcaatggaatggggcctccaaccgggtattatcacactccttactga

SEQ ID NO: 40526 - DNA, 681 bp, Glycine max
  Peptide Sequence Number=SeqID_157304
atggaagttgacttagttcttgctctccccactcaaaattccgttgaggaattcaagcttaacaagtcgaaacagatagtgagtttacagttatggagagccagttgcggttcagaaagcgaaaaacgtgtcaaacacaataagcgcagcttcgaagagtcctttggacattttttgaaacctttgcctttactagtttggagtggacagccaaatgaagaagatgaccgcagtgaaaaggtgcaaagaaacattcacataccaaacaagaatggtgatgaagaaaaccatttggtggggtggccaccagttaaatcatggaggaggaaagaactccatcagcagcatcctgcgagaggccgaattaggaacgataggattcaagctaatgaaaatcaaagtagaggaccaaactctttatatgtcaaggttaacatggaaggggtagccataggaaggaaaatcaatttgaggcttttcaattcttatcagacactcacaagcagcttgatcagcatgtttgctaaataccaaaaatttgaggaagttggagaaagttacacgctcacctttcaaaacgaacaaggggaatggctgcaagtaggacatgttccatggcaatcctttataggtactgtgcggcgtttagtgatactgaggaatggaagtgaaactatttga

SEQ ID NO: 40527 - DNA, 375 bp, Glycine max
  Peptide Sequence Number=SeqID_157305
atggaaaacaagaattcccgtcatttacttgaagaaattagatctaaactacttgaaaatctttccaagctgcaacatgctcctagtgtccaatttcaggaaaggcctcctgattctgatcttggagagttcatgaggcttcttattgtcatcataggcacaatgatggctatgttcctagtttctactcagcctatggattataccagccagtatcctaatcagaatcagtctcaaacctctgcttcttctccagattttgtttcaactagtgtaaatagaatcaatcctagatgtccagtaattagagctgctaatatacacacaacaacagttggagtagcctatgctgcaggattaactattgggatttag

SEQ ID NO: 40528 - DNA, 930 bp, Glycine max
  Peptide Sequence Number=SeqID_157306
atgagtgaacgagcctccggtgagagtgcgtgcacggttttagttgcactcatagcgcactggctccataccaaccacggtatgccaacaagagcacaatttgagagactcatcacacaaggttcatctgaatggagaaggctatgcaacagtgatgactactcaaagctcttcccagataagcatttcgatctagagacagtcatagaagccaatctcagacctcttgttgttctccctcagaaatcttacacgggttttttctcccctgagaagttccagtgcttgaaaggagccatgtcctttgatgaaatttggaacgagataaagagcaaggtgggtgataaggagtcaagagtttacatagtgagttggaacgaccatttctttgtgttgaaggtagaagcggatgcttactacatcattgactctttgggggagagactttatgaggggtgtcaacaagcattcatactcaagtttgatgattcgagtgtgatgtatgggaaaatagacaaagcgaaagaggtcccaattagtggtgcaagccgtgagaaaatttgccgtggaaaagagtgttgtaaagagttcatcaaacggtttcttgctgcaataccactttggcaactagagaaggaggagaaggaggagaagaaatggagtgtttcaagtccctatcttcaccggcaattgcagattgatttccattatagctcttcatcatcctcatctgcttcagctgattctttgtggtctctcttagaaagtggtagatatgctgggccagagaaaaattgcatctccacatcaaattggtgcaaggaatgttttctgctggttgaccttgagcaattgttaccaccagaaaatgctaattcacaagaaatccagtttttagcggctgtgccgctgtttgctgacaacttctga

SEQ ID NO: 40529 - DNA, 396 bp, Glycine max
  Peptide Sequence Number=SeqID_157307
atgccccgcccaggtcccaaaccttacgattgcgtcaaaagagcttggcacagtgaaatacaccaacccatcagaggaactctcattcaagaaattttcagggttgtcaacgagatacatgggtcttctactaagaagaacaaagagtaccaagagaagctacccgttgttgtgctcagggcagaggaaattatttactctaaagccaattccgaggctgaatacatggaccttacaacacttttggaaagaacaaatgatgctattgatacaataattcgacgtgatgagcatacagaaactggagagtatttgcgcccttgcatcgaagaattagaaggaactttaaaagaaaagtatagaaaaagcacttttcttgcttggttttctgattag

SEQ ID NO: 40530 - DNA, 880 bp, Glycine max
  Peptide Sequence Number=SeqID_157308
atgccgccgatgaagtgctgggtcacgaggttgtcggggaagcccaacaaacaacaacacgccgtgaagctgacccaattgaagctcgaattaggcctcttcggagccaggctcggcgccgcaaacgacaggatcgcatttgaaattacggggattgccaccaagaaagaaacgacacctctcccactcgttcccttttccaaacgacgatacactcacagtcacaccacatgctcccgcagattcctcagttccaaatcaccctctctcgcatgggaagcacgcgacctatgcggttttcatctcctcctcaaagaccactccctcgatgtttgcgacatcgcatttcatgtcttatatggagagggaaatgcgggagaatcgaaagcgaaaatgacggcggtcggaaaagcggaaatgagcgttgcggtggcagaattggtggtgaggaaggagaagaagacgcagttcacttctcatcatgactttcaaagaaggcttccaatcaaattaaaggtcaatggtttatgcatagaagctacccttttggtctctatgagattattgaagttgagggattctaatggtgactcagcaggaccctttggaaaaaactgggtccagtcagagaagaaacgagggattataaaggaagtgaagtacttggcaagcttgggaaagaaaaacaaaggcaagtttgatgaatcggaacaaacgagtcctcatgactcggatagatcccccgtgtttgactcggatgactcgtacgattccaccacaagcagtggcagcagtagcaacagcggtggaatccccaacgcacggtcaacactctcaaacgggtctgagagctttacaacctcggagacagcaaagactc

SEQ ID NO: 40531 - DNA, 108 bp, Glycine max
  Peptide Sequence Number=SeqID_157309
atggcagatccgagtagaggttatgatcgagtcatcgaggtattgctgtgggtagcaaatgccaaagggaagaatcagtggtcgaatgtagcattagcatttcaataa

SEQ ID NO: 40532 - DNA, 2451 bp, Glycine max
  Peptide Sequence Number=SeqID_157310
atggaaatacattggcctttcttccatattacgggtacccttttccttttgtgcaaagtttgtttagccggaattcaatattctggaagtgtctcacccggaataataaatggttctcaaatgaattggattgacagagatggcaagttccttgtctcaaaagagggacaatttgcctttgcctttgtcgccactgcaaatgactccaccaagtttcttcttgcaatcgtccacgtggccactgaaagggtaatttggaccgccaatagagcagttcctgttgctaactcagacaattttgtgtttgatgaaaagggcaacgctttcttagagaaagatggaaccttggtttggtccacaaacacaagtaacaaaggggtttcttcaatggaattgcttgacacagggaacttggttttgcttgggagtgataatagtacagtgatttggcagagtttcaaccatccaacagatactttgttgccaactcaggagttcactgagggaatgaaactcatcagtgatcctagcacgaacaacctgacccattttcttgagatcaagtctggtaatgttgttctcaccgcaggttttcgaaccttgcagccttattggactatgcagaaggacaaccgcaaagtcattaataaggacggtgatgcggtggcttcagcaaacattagtggaaactcatggaggttctatggcaaaagcaaatcactgttgtggcaattcattttctctacagaccaaggcacaaatgcgacttggattgctgttttggggagtgatggcttcattactttctcaaacctcaacggtggagagtcaaatgctgcttctcaaagaataccccaagattcttgtgctacaccggaaccttgtgatgcatacaccatatgcacaggtaaccaaaggtgtagttgcccttctgttattcctagttgcaaacctggttttgactctccttgtggtggtgactcagaaaagtccattcagttggttaaagctgatgatggactcgattactttgcgcttcaattccttcaacctttttcgataaccgatttggctggttgccaatcttcttgccgtggaaattgttcatgccttgctttgttcttccacataagttcaggggactgtttccttttgaacagtgtaggaagctttcagaaacctgattctgattctggttatgtttcttacatcaaggtctcgacggttggaggtgctggcacgggttctgggggcagtggaggtggcaataagcacaccatagttgttgtggtcattgtcataataaccttgcttgtcatttgtggtctggtctttgggggagttagataccacagaagaaagcaaaggttgcccgagtctcctagagatggttcagaagaggacaatttcttggagaatttaactggtatgccaatccgttacagctacaaggaccttgaaactgccactaataacttctctgtcaagcttgggcaagggggttttgggtcagtgtataaaggagctctaccagatgggactcaattagcagtgaagaagttggaaggtattggacaagggaagaaagaattcagggccgaagttagcatcattggaagcattcatcatcttcatttggttaggcttaggggattctgtgctgatggaactcataggctccttgcttatgagtacttgtctaatggctccttggataaatggatattcaagaaaaacaaaggtgagtttctgttggattgggatactaggttcaatatagctctgggaacagcaaaaggacttgcttaccttcatgaagattgcgactctaagattgttcattgtgacatcaagccggaaaacgtgcttctggatgaccacttcatggccaaggtttcggatttcggactggctaagctcatgaaccgagaacaaagccatgttttcacaacactgaggggcaccaggggctatcttgcaccggagtggataacaaactatgctatatcagagaaaagtgatgtctatagctatggcatggtgctactagagatcattgggggaaggaaaaactatgatcctagagagagttcagagaaatcccatttcccaacttatgcatttaagatgatggaagaagggaagctgagagatatttttgactcggagttggaaattgatgagaatgatgataggtttcaatgtgctatcaaagttgcattgtggtgcattcaggaagacatgtcaatgaggccatctatgaccagggttgtccaaatgttggagggtatttgtattgttcctaagccaccaactagttcttccttgggttctcgcctttatgccactatgttcaaatcctccagtgaagaaggggccacctcttctgctccctcagactgtaacagtgatgcttatctctccgcggttcgcctttcaggacctagataa

SEQ ID NO: 40533 - DNA, 216 bp, Glycine max
  Peptide Sequence Number=SeqID_157311
atggaggaatttcttaattgtgaaacggaagggttgatgcggttagtttgtggttgtgggagagaaaagaagagagaagcaactgtggaaaaagtcaacaaagacaactgggcaaagtactcttcatttgaccatgagtctatctgtctaagtctaactcaaggttcttggagccgtgaaacgcatttaagggacttgtcttcctcccttttttaa

SEQ ID NO: 40534 - DNA, 935 bp, Glycine max
  Peptide Sequence Number=SeqID_157312
atggtgaaagtgagaacatattacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcaatcggtgcgggccttttcgctattacgccagctggcgaaagggggatgtgctgcaaggcgattaagttgggtaacgccagggttttcccagtcacgacgttgaattcgaacggccagggtctgcccgacgggctgaccgtcgccgccgacggctcggtctgggtcgcactctggggcggcggtgcggtgcacgggtacgcgcccgacggcacacagatcgctcgtatcgacctgcccgttcctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40535 - DNA, 270 bp, Glycine max
  Peptide Sequence Number=SeqID_157313
atgacgtgcgaccattctttggtcctcgtgaggtgcttggcacccatcattaggcaatttatgaaattccaggacatgccgaaaaaccaaaaaaatattgatgcacaatcccacccaggcccacttgggccctctggaatattcctccagaaggcggttgcttctggaggaagcaaccctgctcgcctgggcgagctgggcggcaaccacctcccctattttgctataaataggggaggaagtgaagaagaaaggggttcagccccttag

SEQ ID NO: 40536 - DNA, 174 bp, Glycine max
  Peptide Sequence Number=SeqID_157314
atgggtagtgccagacagttgtttcaacgtttgcaaggaccaatggaggaggatactctgaagtctcattttgataaaattatcaagattgggcagaagcaacgttaccacaggaatcagttgaaacttgaatttagtgatgcttccagttttacagatgtcactttaagataa

SEQ ID NO: 40537 - DNA, 1596 bp, Glycine max
  Peptide Sequence Number=SeqID_157315
atgacaccacctgactggtatgctgtttttacatatcactcccatctttctttcttcaagtggcttagcttgatgatggatccaagcaaccttttgccagctgatggacttgaagaagtccaccaaaatggtgttcatgacgaactgtctaattctggaaaggatgatattgcctccaatgtagaccctggtgttaccaaaattatagaaactgccgctacaaatggaaattttgaaaatttcatccagtatgatagcactgcaactgattactcgtccaaggaaggatcaaacgataacatagatgttaacaatgtcaccatttccaaggaagaggaagcaaaaatcatagatcggacagggcaattaaaagtaggcaaaggtcctgccaagaataagaatgcaaagccaccaagccccagaggcagtcatgtaagttcagttaaaaagaacaaagatggaaaagatgaagaggtagcatctgctgtttcaaatggtacttttgctttagactctcacccaagacagccaattaaaaacagatcattgagtgacaagcaggctcgattgtccaagcaccctggaaagtctaatgcagcaacttctgaagaatcaatggagaagtctagaccacgattattgaagaaagagccccttgataatcttcaaggagaaacagaatcttcttcgtatcctttttttttcctgtttgttactgagagtggcacagtgtatttatggtttatccttaatccacttgtaagtcctaccgcagaagatgccaaacctcgcagggtgggagcacttccaaaatatggattcagtttcaagtgtgatgagcgagctgagagaagaaaagagttctacactaagcttgaggaaaagattcatgctaaggaagtggaggagagtaacctgcaagcaaaaaccaaggagacccaagaagctgagattaagatgcttcgaaaaagtctaggatttaaagcaactccaatgccaagcttctaccaggagcctcctcctcctagggtggagttaaaaaagttatttgctttcattgatctccatgttgaaaccttagatgtgatgccaactacaagagctaaatctcccaagcttggtcgcaagaagagttcaacgaattcagagccagaaggaaaccttagcaacaatgctcgacaaggtcgtttaagtctggatgagaaagtgtctcagactaaccccactaaaggaattagtcctgttcatcaaaagaagccacaacgaaagtctcttcctccgcaactgacttctgaaaagaccaggtcatccaattctgcgtctgtgaggacctcatctaaggcagtgaatggtggtaaaaactccttatcaagtgtaacaactgaagttaccaccttatccaatccaagagaggaagagaaagttgaaatagctgcagccactgaagagaacaatgtcttattgaatgagacaagtaaagctcttcctctgaatatagagccagatgaaacagaatctcctgtgaatggtgatttagtcattcaagagaaaccacagctcaacatggcgcaagaacccatagcagcggagcactaa

SEQ ID NO: 40538 - DNA, 1120 bp, Glycine max
  Peptide Sequence Number=SeqID_157316
cgtgaggaagagatttctttcccaactcaagagttgtttgctctgtcaatgctaatgccagcccgagttgatttagatgaggcaagggttggaaggactaaactgttaaatgatcaatcctccaatcccacatggaatgagacctttcacatatattgtgcccatttgatctcctatgttatattcactgtcaaacaaaaagatccaattgatgcaactctaattggaagagcttatgtcccagttgagcaagttttgcgtgccctagtggacagatggttccagattttagacgagaatcttagatggttttgtgccatggatctccttgtcaagtggaaaaccttggacccaatgaagcctagaacaagaatcacccttggggaactgcccaagatgaaagctgaggaaggtgttaaggttcttatgcttgtttgggatgacagaacctctgtgctagatttcaagaaaaatggcttgatggcagctcatgatcaagaaactgctgattacttcaaaaacaaaaaggtgaattgtgttttgtgtccacggaacccggatgatgggaaaagcatagtgcaaggtggcattgatctttgtgatgggagatatgatattcaggaacatcctctattttcaactttggatacagtgcataaagatgatttccatcagccaaatttctctggtgcttccatcaagaaagggtctgttgcttgggatgttttgctcaattttcaacaaaggtgggagaagcaggttgggaatcagctcctattctcttcaagcaagcttgatgagtactttgtccctcgatccacggtggcaacaacaaatgaaaatgagacatggaatgttcagttgttcagatccattgatggtggtgctgcttctggcttcccccaagatcccgaagacgcggctgaattaggccttgttagtgggaaagataacatcactgatagaagcattcatgatgcttatataaatgctattcgacgtgccaaaaactttatctacactgaaaaccatttcgtgacagatctctgctcggacttccataaatgcatatctgtggatatgttccaccttggttctgtcagattctcgcttgcatggg

SEQ ID NO: 40539 - DNA, 196 bp, Glycine max
  Peptide Sequence Number=SeqID_157317
acgaagctggtcgtccatgagggctttagaatatggagatagatatccattgttttgtgtaggctctgtcaaaagattaggaaaaattgtattggtaactgctcggaaccattgggctggagatgtgaaattattcatggttttgcttctgtatctgcaagagaaaaatgttatagccgagggtagagcttgttaa

SEQ ID NO: 40540 - DNA, 579 bp, Glycine max
  Peptide Sequence Number=SeqID_157318
atggtacaagcaaagaagttcagaggagtcaggcaacgccagtggggctcctgggtgtcagaaattcgccaccctttactgaagagaagggtgtggctagggacatttgagacagctgaggcagcagcaagggcatatgaccaagcagccattttgatgaatggtcagaatgcaaagaccaatttccccacctcaaagaaccaagctgaagctgatcatgacaacaacaacactttcttatctccaaaagctctttcagaactactcagcacaaagctgagaaagtactgcaaagaccctgctccttccctcacttgcctgaggctagatgctgataattcccacattggagtgtggcaaaaaggggcaggaccacattctggctccaactgggtcatgagggtagagcttggaaagaaacaaattataaccgagggtgagtcaacggggtcaccccaaagtactaatattggtgctgttgaaaataatgaagtagaagtagaagtagaagtagaagaagaagaagaagaggatagagtggctttgcagatgattgaagaactactcaattggaactag

SEQ ID NO: 40541 - DNA, 3615 bp, Glycine max
  Peptide Sequence Number=SeqID_157319
atggacttagaaggaagtgaaaagggttcagtggttactcagattagcattggtggatttggcagtgaggtcaaagcaagtgatctcctgaattacttggaggataaaattggacttgtgtacaggtgtaggttgaagacttcttggacccctccagagtcatatccagaatttaaaatcattgatactgcaaagattagaagaacggaagactacaagaaggtggagccccatgcctttgtgcattttgcatctccggaatctgtgactgcagccctgaatgcttcaggttgttgtgatctatttttgaagaatcaaccgttaaaggtcagctgtgggcccaaaaatccatacttcctgaaccaaaggaggagaactacaactccttttaagatgtctgatgtacttgttgaaattgggactttggttagtccaggggagtttttcgtttcttggagaggacctgataaaggtgtaaaatttcttgtggatccctttgatggcatgtgcaggttttgtttcagtagagatactgcattctcattcaaagggatagacaaaaaagcagttataaagtgtgattttcaggtgggattcctggttagagacattaatgagatcaggagatataatgatacatcatatctcgttgttttattacacctagcttcttcgccttgggtttggtacagaactgccgatgatgacattgaagaatcagtaccatttgatttgctggatgatgatgatccttggatcagaaccactgattttactcctagtggggcaattggtcgatgcaatttttatagaatttcaatcccacctcgccatggtgcgaaattgatgaaggccatgctttatctaaaaggtcaaagagtgcaaatacaagaacttccactcaaacagacacttaggacacagaatgaacctgattttggcatgccaatgtcagatgctttcttctatgtacattttcagaaggacattgcttttgacataatgtttttggtcaatgctattgtacataaaggcatattcaatcagcacaggttgtcggataggttttttgaattgctgagaaatcaacctaaggagcttaatgtggctgccctgaagcatttatgttcgtacaagcgcccagtatttgatgcaactaagaggctaaaaatagtccaagaatggttgctcagaaatccaaaactgtatcagatctctaaacagttggatgatattgttgaggttagaagattggttgttactccatcaaaagcctattgtataccacctgaagttgaattgtccaacagggttctcagaaaattcagagaagtttcagattgtttcttgagagtcacctttatggatgaaggcatgcagacaattaatgtgaatgctcttaactattatgttgctcctatagtgaaggaaatcacatcaaactctttctctcaaaagacaaaaatatataaaagggtgaaaactatcttggaagagggattttacttttgtggccgaaaatattcatttttagccttttcatccaatcaacttagagatagatctgcttggttttttgctgaggacaaaataagatgtgatgatatacgaaattggatgggcaagtttaatcagaggaatgttgcaaaatgtgctgctaggatgggacaatgcttctcatctacttatgcaacagttgaagttgctgcaaatgaagttaactccatgctacccgatgttgagaggaacaattacattttctctgatggtattggtgttatcactcatgatcttgcaagggaagttgcagaaaagttgaaattggacaatgtaccctctgcttaccagatcagatatgctggttttaaaggggtcgtggcctcttggccggctaaaggggatggggtcagactttctttgaggcctagtatgaacaagtttcaatctactcataatatcttggagatctgtgcgtggaccaggtttcagcctggttttcttaatcggcagattataacattgctttcggcactgggtgtgcctgatgaaatattttggcaaatgcaggaggcaatgcttttgaagttaaatcaaatgcttgtggatgcagatatcgcttttgatgttctgaccaaatcatgtgctgagcatgggaatgctgcagcaataatgttaagttgtggcttcagtcccctaacagaacctcatcttagaggtatgttaacttctacacgtgctgcgcagctttggggacttagagaaaagtccaggatttttgtatcatctgggcgatggttgatgggtgtcttagatgagttgggtgtgcttgaacaagggcagtgctttgttcaagtgtctacaccttctcttgaaaattgtttctcaaagcatgggtcaagattttcagagacaaagaacctgcatgtagttaaaggttttgtggttatagccaaaaatccttgccttcatccaggagatgtaagagttttggaggcagttgatgcccccgatttacatcatttaaacgattgtcttgttttccctcaaaagggtgacagaccccatacaaatgaagcttctggaagtgaccttgatggggatctatattttgtcacatgggatgaaaatctcattccaccaagtaagaggagctggatacctatggagtatgcccctcaagaaagcaaacttctgacacgtcaagtgatgacccgagacatcatagaattttttgtcagaaacatggtaaatgaacatttgggtgcaatctgcaatgcacatgtggtacatgctgattccagtgactatggtgccttggatgaaaaatgcatacacttggccgagctagcagccactgctgtcgattttccaaagaccgggaagcttgtcactatgcctcctcatctgaagccaaaattgtaccctgatttcatggggaaagagcggcaccagtcttacaggtcaaataaaatcctgggtagactttaccggcatatcaaagatgcttatgatgaagatattgaagctccgtatttgaactttgtgactggcgatataccatatgataaagatcttgaggttccaggatctgctgattttattgctgatgcgtgggagcaaaaatgctcatatgatggccagttgagtgggctaattggtcaatacaaagtgaaaagagaagaggaagttgttactggacagatttggtccatgccaaaatacaacagtaggaagcaaggggagcttaaggagaggctgaagcactcttacagtgccctgaaaaaagaatttagatacactttcgagaagttgaattcggatgttggagaattaagcgaggaagaaaaaaatttgttgtatgagcagaaagcttcggcctggtatcaagtgacatatcatcctgaatgggtgaaaaaatcccttgatctgcaagataaatcctcagagaaccaagaggctgatagtttgggaagtacggtgatgttgagttttccttggattgcagttgattacctagctcgcacaaagataaggcaacgacatcagaggagtggaaattttgactcaactaagccagttgattatctggcaaagtatctatctgaaaggttataa

SEQ ID NO: 40542 - DNA, 267 bp, Glycine max
  Peptide Sequence Number=SeqID_157320
atgggtcttacaatgtcacaagcgatcatctctacattgcgtacatgtcacgcttttccaccattcaacgtcaccttcccaactttgactctagacatcaaactgaaggtggccttcgtgggtcccatcctcctcaacgacgccatcacgtgcagagatttagacgtggttaggaatttgattaaacgacagtgttccatgctcacagatttgtcacccacccaagtcaagactctttggaaattgcctcaaggcggcaaagactaa

SEQ ID NO: 40543 - DNA, 1572 bp, Glycine max
  Peptide Sequence Number=SeqID_157321
atgggtgaaactaaggacgaagcatacgaggaagagcttctcgattacgaggaggaagacgacaaggcccccgactccgccggagctaaagtcaacggcgaagctaccaagaagggctatgttggaattcacagttcgggatttagggacttccttctgaagccagagcttcttcgggctattgtggactcgggatttgagcatccatctgaaggcaaactatctatttatctgaatcttttatttaatttgcagttgttgctcttggccgtggttgctgtttgtgatgattttgaggattttagatttgtaatgcagattgatcctgttcctggccaagtttctgcacttgttctttgtcatacaagagaattagcataccagatatgccatgagttcgagaggtttagcacctacttgccagatctcaaggttgctgtcttttatggtggggtcaacatcaaagttcacaaggatctgctgaaaaatgagtgccctcatattgttgttggaacaccgggaagaatactggcattgaccagggataaggacctttctttaaagaatgttagacatttcatattggatgaatgcgacaagatgctggaatcattggatatgaggaaagatgttcaagacattttcaagatgactccccatgataagcaagttatgatgttctcagcaacactcagcaaggaaattcgcccagtctgcaagaaatttatgcaagatctggtagggtggagtgtgaggtgggctggtggctggagagattgggctagaaagaagctttggatgggatgcttaagtattggtcctgtttgtggctggcgtgagtgtcaagtgtcatggcacttgcttggcgtgactaaaaaaaagtttctgcaaggagacaaaacagatggacaagaactgtcgttcaagggatctgcatccatcattcatttcgttgtggattccattagcttgaggaaggaccctaatatgatttactgtgaaatttgttcctttcagcctatggaaatttatgttgatgatgaggccaagttgacacttcacgggcttgtgcagcactacatcaaattgaaagaggaggaaaagaatcggaagttgaatgatcttcttgatgcactggactttaatcaagttgtgatcttcgtgaaaagtgttagcagagcagctgagctggacaaactacttgtggagtgcaactttccatctatatgcattcactctggcatgtcccaggaagaaaggttaaagcgctataaaggtttcaaggaggggcatacaaggattcttgttgcaacagatttggttggaagagggattgatattgaacgtgtcaacattgttataaactatgacatgcctgattccgcagacacatacttgcacagggttggtcgagctggaagatttggcaccaaaggccttgcaatcacatttgtttcttgttctactgatgtcgatgttctcaacaatgttcagtctaggtttgaggtggatataaagcagcttcctgagcagattgatacctctacctatagacatataattgaattttaa

SEQ ID NO: 40544 - DNA, 264 bp, Glycine max
  Peptide Sequence Number=SeqID_157322
atgtgtttcaaggccctattgctaccaaatatcgctttgtcattgcaaaggttttacagaaaggaggttgatttgacgttgaacggaggagctgttctatgctctcaatgcaaaggcagtggggtgaactctgttgatattttcaatggacagtttaaagccggtgacacgtgctggctttgcggaggcaggaaggagatgttatgcgggaattgcaatggaacaggctttgttggtggcttcttgagcacttatgatcagtag

SEQ ID NO: 40545 - DNA, 381 bp, Glycine max
  Peptide Sequence Number=SeqID_157323
atgaagttctggaagatcctgaagagccagatcgagcagaccctgcccgagtggcgtgaccagttcttgtcctacaaagacttaaagaaacagttgaaggttatgtgtcccaaagatgctctaactccaccctgtttggatgctgacgagcttaaccacttccttggcctcttggagcttgagatagataagtttaacggtttctttgtggacaaggaagaagaatacatcatcaaatggaaggagttgcaagacagggttgctagagccattgattcaaacgcggagttgatgtcactagggagggaaatagtggattttcacggggagatggttttgttagagaactataccgcactcaactacacaggcatgttctaa

SEQ ID NO: 40546 - DNA, 303 bp, Glycine max
  Peptide Sequence Number=SeqID_157324
atgaagaacgatggaaaaccttcgcgaaatcgcccagggaaacatctcgaaagcgttacggaagtgcctcggctagaattttcttcatggaaacaatttttctcactaattttaagtgtttctcaaataccaggaaggggaaaagagggaggtggttgctgcccagctcgcccaggcgagctgggttgcttccaccagaaggcatcgccttctgttggaacaccctggaagctccaagtgggcttggttgctattttcacacccctgtttactcaatacacccccctttgccctttttgctga

SEQ ID NO: 40547 - DNA, 531 bp, Glycine max
  Peptide Sequence Number=SeqID_157325
atggtgattgcaatgttgaatgtggcgatgccaatagtggtgacaatcagtagtggcgatggaggtggtagaaatatcagtggtctcgatggtgatggtggttgcgacgacgttggcgatgattgtgggggcaatgatggaggtgatattgttggtagtgaaggtggtggtgacaatgacagtgacgacggtgatgatgacattgatggtggtagtggtagcggtgctagtggtgacatcaacattgatggtgatggtagccatgctagtggtgatgatgatgtcggtgatggtgaaggtggcaccgacaatggtggcagtgacaacgacgatgatgatggtggtagcaattgtatatggtggtggtcgtcgcggttgcgacatgttgatggtgattgtggtgacaatgatggggataatattattggtaatgatgatggtggtgataatgatgggagtaatattattggtagtgatgatggtggtgacaatggtaatgatgacattgatggtggtagtgttagttgctag

SEQ ID NO: 40548 - DNA, 180 bp, Glycine max
  Peptide Sequence Number=SeqID_157326
atggagaaatgggagtctgaaattgaatatagctggcaagaaatggcgacagaaattgtagcaggaggtagagaaaagacgagcaataatgcaaacgaattggacccaagaagaacaaaaactcgatgttacggctacgtggtgcaagacactgatgggctttcatcatcatcgaattag

SEQ ID NO: 40549 - DNA, 204 bp, Glycine max
  Peptide Sequence Number=SeqID_157327
atgaacggaaatggcagcaacaaccttgcaggcacggaggaagaaggaatgcacaaaatgaagaaagatgaagaaaggcggaaaggtgagattgttggtgagtttttagtgatttggcttaagaggatggactgcagtttatgtttagggagatgggtgtgcatagtaaggcttagatgtgaaaagaaggaattacaggagtaa

SEQ ID NO: 40550 - DNA, 1305 bp, Glycine max
  Peptide Sequence Number=SeqID_157328
atgggtagaaggggaatccaactgtttgatgagaaaatagatgtttttttctctgtcagcaatttggggtttgaatccaaagatggctaccatcaattcggaggtttgtttgccagtgttggtcaaatgggaatgggggttggcgtgcaacctaacgacccttctgattctcgtgacaatggtggcatgaaacttcccttaaacgaattgttcctcaagcatgttcaacctcaggggaaggaagaggttgttgaggaaggagctaaggggaagaagaatagaaagggtggtggtgtttcactcaagcttaagatcaggaacccttcactgaggaggttgtttagtggggcagttgccggtgccgtgtctcggactgctgtggcgcctttggagactataaggactctcttgatggtggggagtagtggccattccaccactgaggtgttcaacaatattatgaaaactgatggctggaagggattgtttaggggtaattttgttaatgtcattcgggttgcgcctagcaaggccattgagccaggatggaattgtggatttaagcaggttttgctggagtctcttgtagatttagagatgattgagcataggtgtaatatgatcacccttgtgatcctcttctactcacaacatcttcaggcagctatgctatttgcttttgatacagtaaacaagaacctatccccaaagcctggagagcagtccaaaatcccaattcctgcatctttgattgcaggtgcctgtgctggaatcagttcaactatatgtacatatcctcttgaattagtcaagactagattaactgtccagagcgatatttatcatggtctgcttcatgcattcgtgaaaataattcgagaagagggtcctgctcaactttatagaggcctcgcagctagtcttattggagttgtcccgtatgctgctaccaattactatgcctacgacactttaaggaaagcataccagaaaatttttaaagaagagaaggtcggcaacattgaaacccttttgattggttcggtagctggtgctttttcaagtagtgcaacttttccacttgaggtggctcgcaagcagatgcaacttggagctctcagtggaaggcaggtttacaagaatgtgtttcatgcccttgcatgcatatttgaacaagaaggcatacatggtttatatagagggctagcacctagttgcatgaagttggtaccagccgctggaatctctttcatgtgttacgaagcattgaagaggatattgctagaaaacgacgaggaggattag

SEQ ID NO: 40551 - DNA, 255 bp, Glycine max
  Peptide Sequence Number=SeqID_157329
atgggccagggagagcttcatcgccgcgatgaactccttcgtctttggcttctcggcgaactccgccacaaagtcctccaccacgacggcactggcggcagtgctggcaacagcggtggagatggcgaggcgcttctccttgcggttgatcttgatggaccagtcgcggggcttcgggccgaagatgacacctccgcgggggcggaggggagtgcggttggaattacatcaaagggtttgatggaagccaagtag

SEQ ID NO: 40552 - DNA, 1185 bp, Glycine max
  Peptide Sequence Number=SeqID_157330
atgaggaaccaggatgatgttgtgaacagtattagggcgatgctggagaaggcagaggcacccgtaactgatgagtgttgcatctacagagtcccctttgatatccgcaagctcaacgaagatgcctacacccccaaggtcgtttccataggcccttttcaccacaaaggcaatcctcgccttcaaaacatggagaaacacaaactcatctattgcaacgcatttcttaaacgttccaacacaggcttggagacctggatccgctacatacaggacgtagagccccgattccgtagctgttactcagacgcccttgagttcaccaaggaggagctgctgaaaatcatccttgtggattctggttttatatttgagcttttttggttgacctattatgaagaaaactcagggaacaatggatcgattcttttaaaaccctggttgactactaatgtaagattggatctgttgttgcttgagaaccaacttcctttttttgttctcgaccatcttttcggtctctcgatgcagtcttacacctctacatctggccgcggcggtaaaaagaatatccctccatttattgcttttacatttgactatttttccttttacaatagatccgaattgaacttccatggtgttatgataaaacacttcacggatctcttaagaacttttcacctgcaacatcctcagcaaaatcgcatcgagaagacagttgtacatcttcccagtgctgctgagttgtcggaagcaggggtgaggtttaaggctaacaccacaagcaaatgctgcttgctggacttgaaattttcaggaggtgttcttgaaatcccgcagttgaaagtgcaagattggactgaacttatatttcgcaatatggtggctttggagcagtgtcattatccctaccattcctttgttacagactatgttgctgttttggacttccttgtaaataccagtagagatgtggatgtacttgttcgaaagggagtactcgttaactggctaggggatagcgattctgtggctgacattttgttctgtcttgcaagtaatacaacaatagagtatatgcctcccctcagcccgaaaggccagaggatggccaggggccccaaaaaaggatttatggctcgatctgtgggggtagtcagccccatcaggtccttaatataa

SEQ ID NO: 40553 - DNA, 318 bp, Glycine max
  Peptide Sequence Number=SeqID_157331
atgggtctcaatttcttgaatgcaatgcactttcttgggcaagtcacaattcccatcctgatgataaaggactctacaacaagccttaattttccttacttctatgttcttgggcatgcagccacaggagaaaatgttgaagacccttttattgctgtggaagaaattgataaagaagttgatactcaatttgctaaagacattgaagaccaagttgacataatgttattcctgaaacccaagctgccacaaatgttggacaaggtagtgttaagaaagattttgccgaacgaaacacccatcggtaaaaggcactaa

SEQ ID NO: 40554 - DNA, 438 bp, Glycine max
  Peptide Sequence Number=SeqID_157332
atgacatcaatcaagcccatcatccaccaaaacccctccactacatctcccatttacatcaaacccagtaccatcaaaagatctgttctccgatcaagtcaaatatacttgtccaggtcggaaaggggagtggagcaaagaccggagaggtgcggcgacggaaacggcaggaaagccatgtacctgccggcggaaaagccttcggagaccactatgcagcggcacgtgacgtggttctcgtgtccgttcgtaggctgcgaacggaataagctccaccgacggtttcggccactgaaatcggtgatttgcatgaagaaccacttcaagcgaaggcactgcccgaagatgtacacgtgcgagcggaactcggccggagtgagatcggacaatttggtgatgccgtggacggtggaggggtcgagcttagagggggtgtaa

SEQ ID NO: 40555 - DNA, 219 bp, Glycine max
  Peptide Sequence Number=SeqID_157333
atggctgtggtcggaagtgatgttgaagctttgtggcattttggattgactatgaccctcatggttgaccacaaccctcatgaattgaccacggttgtggtgaatttaccatgtgtagaagcaaagcttcatgatgatgacaaaggtgatgacaaaaagctcaaaggacaatcaaagaatgagttcaagatgttcaagatagaatcaagaacactttaa

SEQ ID NO: 40556 - DNA, 408 bp, Glycine max
  Peptide Sequence Number=SeqID_157334
atgtcagagaacaacccgtttagtggtagcgcccatgaagatcctatgcagtacctgaggaagttcatcaagttgatcaacacggctagacaaaaccatccccttgtcgatgccatcagaatcattaaagacatatgctctaacccctacaacaacttaagacaaccaagaaaccttccttcacaacttgaatcaaatcctaagagggaggatgttaaatttgtgatgactagaagcaagagaattcaaggagacattaaggagaaagaagactttcctccaaaaactgtaaatgggatccttgctgaaaaggaccaagtacttgagaaggttgaagatcctactattgggaacgcattgccaaagaaggaaggggataaaaagaaggagatactgacatctccttag

SEQ ID NO: 40557 - DNA, 221 bp, Glycine max
  Peptide Sequence Number=SeqID_157335
gtggccttattggtgcttgtgtgcttagcgcaactctggctcgcttagcgcgcattagtgaatttcgacttagtgcgcgtcttttcgctcagtggatggactcaagcggtgcgcttagcgggattagcccttgcttagcaaacatgaataactcatccttcttccatattcttcctcgcgctcagccaaaggagtgttgcgctcagcagatggctcgctaa

SEQ ID NO: 40558 - DNA, 366 bp, Glycine max
  Peptide Sequence Number=SeqID_157336
atgactcactggcaacgtaggtgtgattcaacctctctaaccaactcagagctagcctgttgcctgatgacgttgaaaagacatgacgcatcatcaaggggggtgatggtcatctcaccaactggaaggtggaaggtggaaggaggaggacctttagtcctgacctatgtgtctttggctctgtctactggtgttgtcattaagccaagggagttgggaaagttgttgaaaattgaagaagaaggggaaaaggttgtggaagaggggaaagagttgggcacaagggttgggagaagagggaagagggcaaaaaggttgggggaagaaggaaaagagatgtatgagaggggaagggagaagggataa

SEQ ID NO: 40559 - DNA, 483 bp, Glycine max
  Peptide Sequence Number=SeqID_157337
atggagggttggaactgcatgcagtgtttggagatgaatcgtgatggatttgtcttaggagaaggtgctggtgttttgcttttggaagaattagagcatgctaagaaaagaggtgcaaatatatatgcagagttccttggtggaagtttcacctttgatgcttatcatgttactcaaccacatcctaatgatggtaaaatttcatatattggatatggatttcttggtggatttgttgctacatcgatggatctggattttgttgttctaagattaagttgttggtggttgatttggatctttaatggtggatttggtgacggtgtaagggttaggtcgggtgcttgcacaaaggatggatgcgtggagtgcgtcggtggggcttggtcatccagagatttagttatggggaagatggcgacgtgcgacgcaacaacaatggtggttgcagatctaatctatgaaaaggtcatggacacatga

SEQ ID NO: 40560 - DNA, 291 bp, Glycine max
  Peptide Sequence Number=SeqID_157338
atgaatgtaaacttcaacaagctaagagtgaattcaacgaaatctatgatcggtcacctactaggggcagctggtggtgtggaagccgtagcaacaatacaggcaataaagacagggtgggttcatcccaatatcaatttagaaaacccagatgaaggagtggataccaatgttcttgtcggctctaagaaagagacactagatatcaaggcggccatgtctaattcattcggctttggtggccaaaattcctctatcatatttgcccctttcaaatgcaatagattttag

SEQ ID NO: 40561 - DNA, 366 bp, Glycine max
  Peptide Sequence Number=SeqID_157339
atgcacccaccttcatcattcgcaatcatgcctaaacctcatcctccccaatgtaatcgtgcctccaccttcccgatctcaaatcccataacatgttcttctccctcccccatgattgtctttgatttcttcatcaatgacccatcatttgaatctcgtaatgatgtccaagagcatattcatcgtattcaaggccatatctacctttgcaagggactcaagttgatgaacgggttgtcgacagtgacattgactgattctaggggtgatgataagtcggtctgcttggcgtcgagattgaattgggacaacgatgacgagacagttctgctcgatgctgaagatggtggtaagggagaagcatga

SEQ ID NO: 40562 - DNA, 1200 bp, Glycine max
  misc_feature (39)..(39): n is a, c, g, or t
  Peptide Sequence Number=SeqID_157340
atgaaagtgatgagaacatctctcaagaatgaaaaacanaggagaaaaagcatgatcctcatctttgaagatgtacacactttaatcttgaaaaagatttcaaattctgaaacctgcaattcttctctctctcgaaaatcctctcccccaaattttcctctagccatatctcactcaattcttgtccaaatcactccctacaaagcccaaaacttcatcttttttcactttctttcatttgaaccgattgaaatctcgaaaaatctcttcaaatggcggaaccatcgaagaagcgaaagggcacttcgagtcggagtcaatgacattccgggtcacaggaaacgccaattccttcctccattccctctggatcattgttttcatgagaggaacaacgtatatgaaatcaatgaaggtaccctaatgtctaaattttatgggattaagatggtcattgaccaatccctattttatgatttaaccaaattgcctaatgaaggtgtgccttttgagggtacaatgattgatgattggaaattcgatttttctgtgcatgatgctcgtcggttggtttgtaccaaccaagcggatatgatcggaaggcttcttgtcggttcattggcttttgaaagccgcatcctccattaccttattgttcgcatcttgcttccgagatcttcaaaccttgctcaggtttttgaagaagatctcattgtattgtgggcctttcataaaggtttacaaattgattgggcacatcttgttagatatcgcatgcataaggcattgcgattgaatgccccattgccttatcctcatcttgtcacccttttccttcaacacttcaacattcctcttgattctaaaccttatgttccaatcaagagatctttccttataggcgctttagtcatagcatcttttggctatcaaaaggagcatgatggctcttgggtgaagaaaggtactcgacatgttggtgaagaaggacatgatggagaggattcgtctctcctttcaaagataatggataggtttgattgtcttcaaacctttgttggtgaaaggtttgacactttggaattacaagtggatatgcacttcaataaaatggagccaagaatcacaaaggttgaagaagatgtgtcttacattcgttcaagcttcgatcttccaccaccgccgccaccatcatcttag

SEQ ID NO: 40563 - DNA, 807 bp, Glycine max
  Peptide Sequence Number=SeqID_157341
atgagctacagtggctcctcaatgagttctggtagtggatcttctagaaggacatttgagtttggaaggacccatgtggtcagacctaaagggaaacaccaggcaactatagtttggctacatggccttggtgataatggctcaagctggtcccaactcttggaaactcttcctcttccaaatgtaagaataagcatactttgtaattttttcagtagctactgcacagctgatgtttcaccacatgctaaacagtctaatttgattgaggcatctctaccagggtttgatgctggggagatttcagaagaagctcctagtgatttggaggggttagatgcttctgcagcacacgttgccaatcttttgtcaacagagcctccaaatatcaaacttggtattgggggcttcagtatgggtgctgcaactgcactatactcagctacatgccatgttttggggcactatggtaatggaaacatttaccctatcaacttaagtgctattgtttctttaagtggctggcttccttgttcaaggaccttgaaaaaccaaattgaacgatcacgtgatggcataaggcgtgcagcatcgttgcccttatttctctgccatggaagaggtgatgatgtggttgcatatgaacatggggagaggtctgcagtgaccttaagttcatcaggattccagaatcttatatttaggagctacaatgggttgggtcactatacagtccctgaagagactgatgaagtttgcaggtggctaactgcaaatttgggactggaggggtttcggttgaactag

SEQ ID NO: 40564 - DNA, 111 bp, Glycine max
  Peptide Sequence Number=SeqID_157342
atgtgtcttaacatcagggttttggctaaaacggatgctgtaaagacaccttctacatcggttttggccaaaaccgatgtggaccagcaacaaagaggttggtgtaagtga

SEQ ID NO: 40565 - DNA, 1569 bp, Glycine max
  Peptide Sequence Number=SeqID_157343
ccgaagctctggcagggttccttcaaagaaaagcatcagccgaagcccggtcagagcacctagtagaagcaatcgccgcagtttttctaggagtcctagccctgttcataggacaaggactcctcgtgggaggagtgtgtcaaggagtgtatcacctgatgcttcaccaaagcgtatcagaaggggaagaggtttcagtgaaagatactcttatgcaagaagatattctacttacagaaggttttcccctaggcgtttcaggagcccaccaccacgtggaagaactcccccaaggtatcgaagcaggaggagcaggacgccatctgtttcacgcagtccacgatatcgagcccgacgatatagccgaagtaggagcccgaggcatgcatcttcttctcggagcaggagtccatcaaaatcccggtctaggtccaggtcatccgtggagtctccgccaagagcaagtagagacagcaggtccaggtcatcgtccagaagccctgatggaaagcaaggcttggtctcatatggcgatggttctccatactaacgtgaaaggtgaaatatgtggtgcggagggctttggccttggttgtgaagttgttgcggtatttgttggaatcggagactcggatgctgttgctctacttatgcttggttggaaagtgctgaaccataattggggcgaaaaccagtctcttgtagctcactcagacatgattttggttttgattctccccgaggcccgagttataaccacttatagcatgagttctcagccgatctccctaatcccgttccctgccaatgagaagggacaaatatatagattgaatgtgccagaacacccaagatttacgttcaagctttttaaatacttcccttcaaaagaccacaagtttggtgtggttgaaagctgtaagcctaaaaatatgtcagtatcatcagtatcccgtgttgttgacactattactgaatgtctatccctggttcaatcagactcaattgaagttcaggagaaagctcttcaaacgttggcttccatcaccaaggttagtccccaaaacagaaccatgctagctcaaacagataatgccatcccaacattagcctcgctaacaaactcttcctcccctgtcatccagacactttccttgttaaccctcttcaacctatccctcaatcctgatttgaagcaatctcttgctgacatggaaaccattcactacctcaattccctcatcacctcaacaagttcccttgattcctccaaattggcctcctcgctgatttgcagcttggccatgcatgacaaaaacaaggccaaatttggggtggcaggcacagttcagttgctagtgaaagccattgaaggttctcatgatgcacaccaccttttgagttctttggctgagcttgttcattttcatggaaattgcactttggccgtgagagctggggcagtgccagtgctacttcgagttgcgaagggcactgataatgaggacttggctggaacttctcttgctgttcttagtctccttgcgaggtttgatgaagggttgaatg

SEQ ID NO: 40566 - DNA, 300 bp, Glycine max
  Peptide Sequence Number=SeqID_157344
atgatgttcactaagaccaaaatctcggctaggatatgtggttcagtcgaccagcatgaaaaggttcgagacttgtttaaggctatcgatgaacaattcatcacttcagataaggcaaataagcacattgatcatgaagttctcctctctctgacttaccagtgtgaaagaagaaaggcttgtaatggagatgggagagagtgcaatgctacaactgcttatgggaagaacaaagcaactaagtctcaagctaatcaaaaagggaatggtaaaataccacctcaagctgatattaagaag

SEQ ID NO: 40567 - DNA, 270 bp, Glycine max
  Peptide Sequence Number=SeqID_157345
atggatgtgaaaacaacctttcttaatggtaatttagaggaggtaaatgtgaaacaacctgaaggtttctcctctagcagtggtgcgcatttggtttgcaagcttaagaaatctatatatggtttaaaacaagcctttcgtcagtggtgccttaagtttcatgggataatttcttcatttggttttgatgaaaaccccatggatcaatacatataccacaggatgatattttacttacagccaatgaccggggtttgctacatgaggtga

SEQ ID NO: 40568 - DNA, 1956 bp, Glycine max
  Peptide Sequence Number=SeqID_157346
atggaagcagctaggctcggctcttttacaagccacgcctttatatataagctagcctatgagccttctttcatcatctcgaatgaatcctttccgtggttatcgactcgggcaaagacgatgaccaagaagaagaatcccctggtgtttatggatgtgtccatcgatggggatcctgttgaaaggatggtttttgagcttttctatgatgttgctcccaagactgcagaaaactttcgtgcattatgtacaggagaaaaaggtatcagtccaaatactggaaaatcactgcactacaagggttctttcttccatcagatcataaaaggttccattgtgcagttgtccgggttgccagccttgttccatttgcatgtttcctgtgacaatggaactgctggagaaagcatatatggttcgaagttcccagatgagtcacctaagctaaagcatgatgctaccggacttttatcaatggcaattgcagaccgtgacacacttggttctcattttattatcactttgaaagctgatcatcatcttgataggaagcatgtagtctttgggaagcttgtccaagggcctaacgtattgaagaaaattgaagaagtgggtgatgaagaagggcatccaactgtaacagttaaaatcattaattgtggtgaatatagcgaggatggaaagaaggtaaataaatcaaaaatgggaaagaataaaaaatcttcaaaagacagaaggaaaaggagaaaatactactcatccaaatcaggaagctcttcagattctgatacagaatcttcggaaactgatagtgattctgagtcagatatgtcctcatcgtcttacataagttcttccagtgatgacaggcgaaggaagagaaagagatctaagaaagataaatatagacgggaaaaaagaagagataaacgtcgtgacaagaagcgaaggaaaaaggacaagagatcaaagcgtaaatcaaaaagggaatccggtagtgactcagatagtgagagtaacagtgacagtagctctgaaggtgaaggtattggtgctcaacataaagggctgaagcttaaagatcattctcagaaaaatgctgaaacaaggtctgccttggttgctgagaaagatttgcctcctgcgcatcatgaaaaggaggaagtgggtatgctagaaaatgaggaaaaattctcaaaggaaaacggagagcaacgcagcaatggcattggaggagctgactatggatctgacagaagtgaagagaggcagcctgacgttatggatgatcattcaggcaaaactaggtctactttcttctttagtcacacctcagttatttcttatgcttaccatttcttccagatctggaggagtgcgagattgagcaagagcccaagtgttactccaaaaaggagattgagcaagagcccaagtgttactccaaaaaggagattgagcaaaagtccaagtgttagaagccctcctccatcacagaggagtttgagcagaagtcccgccagaagcatcagcaggagtccaagcagaagcatcagtagaagcccagtgagaggcaggaatgggagaagtgtcagtagaagccctgtgagaggcaggaatgggagaagtgtcagtagaagccctgtgagagtcaggaatgggagaagtgtcagtagaagctcagtaagagtcaggaatgggagaagtgtcagtagaagcccagtaagagtcaggaatgggagaagtgtcagtagaagcccagtgagaggcaggaattggagaagtgtcagtagaagcccagtgagaggcaggaatggtagaagtgtcagtagaagccctgcgagaactcgttctcttagaagtgtcagcaagagccctgtaagatcccattctcgaagtcaccggagcaggagttctcctagagcaccatcaggaaaaattatcagcaaaagccct

SEQ ID NO: 40569 - DNA, 3828 bp, Glycine max
  Peptide Sequence Number=SeqID_157347
atggccaaagctacacgatccaaaaccaatgttgatcgttgggaagatgccttcgtgaagctttctgcgtctattacttcaaagttcgacgagcttcttaaccgtatgaatcagttggagacctcgcataccaatcctcaggttacaccagcgtttgcaagtccgtcagtcgccgcaaccacaaattttgcttatcggctgaagctggaggttcctcactttgatggatcaaatcctgaaggatggatattcaagattatgcaattcttcgaatatcatgtgacaccagaccatgatcggcttacgatcacttcgttctacatggaaggtcctgctttagcatggtttcaatggatgtatcgcagtggccaattgtcttcttggtcagcttttctatatgctatccacgcacggttttcgtcttcagcttacgaagatcctactggagtactttgtaaattgacgcagcgttcaactgtttcggcgcatctctcagagttcgaagctttcgctaataaagttatcggccttccggcgccgtttatgcttagttattttgtatctggactgagtcttgcgattcgatgggaggtgcaagtcatgcagcctcattccttggctcaagcagtttcgttagcaagactccatgaggagaagttgctagatagtcgtcggccgagggttcaatcttcacctactatgacctctatctcccctccttcacgactcaaacctcctcctaggattaatccttcagaatcgtccttgcttccgtccttgaccaaagcatgctcctccaccattcctttcaaacgattgactccgacggaattagctcttcgtcgagaacaaggtctatgtttcaactatgacgagaaatactctcgtggtcataaatgcacttcttccttgttcttgtttgttacggaggaggatgagtatgctcaagaaatcgatcccgagcctttgtcgccaactcttcctccttcttcgcaagaaccgtcaccggcccagattagcctgcatgcgctctcagactacacaactcttactatgaaattcatttatgatggcaagttgattaaacttatgggggatcgcgatacgtctattgatcagatttcaccatcccagttgcatcgtttggtagacacaggtaacactagcacttattttcacattcagatggaacctcacaccacaacattgttacccttggctcaccctataccaacaatccagaagatcctcaccaaatactcttccttgtttcaaccattgttgaccttacctccatctcgacccatagaccacaccatcacacttttcccaaactcagcccctattaacgttagaccctaccgctatccttactatcaaaagaaagagatagaaaatcaagtagcttccatgctcagtcaaggccgcatacaacatagttcgagtcctttctcatctccagttttgttagtgaagaagcacgacgaaacttggcgtttttgtgttgattatagggcactcaatgcgattacagttcacgatcacttccttatacctacggtggatgaattattggatgaacttggaggcacagtctggttttctaagctggacttgatgcaagggtatcaccagattctgatgaaagaatttgatacgagcaaaaccgccttccgcactcaccatggacactatgagtttcgggtgatgcctttcgggctttgtaatgccccttcatcatttcaggcaatgatgaaccgcttgtttcaaccctatctgcgaaaatatatcatcgtcttcttcgatgatatattgatatacagtcaaaatctggaggaacatttgaatcatttagaaactacatttcaagtgttaatggatggtaagtttactctcaagttcactaaatgttcattcgcgcagaagcatatagattacctagggcacattgtttccggcaatggtgtacaacccataccagaaaaggttcaagccatccaaaggtggccgcaaccgcgcacaactcgagctttacgggggttccttggcctcgtgggattttattgcaggttcataaggggttacactgctatggtcgcatccctcttgcaactcttaaccaaggcagacttcatgtggtcaccagaagctgagcatgcatttcaaactcttaaggatgcagttactatggccccagtacttgcactccctgattttgctaagccctttacggtagaaacagatgcttcgggttcggatatgggtgcagtactctctcaagaaggacacccaattgccttctttagcaaacaattttgtcccaagttgctccgatcctccatgtatgttcgcgagctcgccgccatcaccgctgccgtcaagaaatggaggcagtacctgttaggtcatcattttgttatattaacagatcatcgaagcctaaagaagcttatgaatcaggccattcaaacacctgaacaacataggttcttagcacgcttgctaggatttaattatgttatccagtatagagcaggaaaaagcaatgacttgtgcaaagagttgcagacacataatgagtttgtaactttgaaggaaaagatatgcactgatacgatagcataccttgatcattcgttgactcctcatttcatcttagatcagggtcgcatttggcttccctcagattgttcattcatcaagaccttactggcggagtttcatcaatcaccaactgggggtcatatgggttttcgtaagaccttgaatcgcgtcactgagaactttatttggaacaccatggttgttgacactcgaaagtttgttgcaagctgtttggattgtcaacttgtaaaatatgaacctgcaaagcccagaggcttactatgtccattatcggtgtcgtcgcaaccgtgggaagacctttcaatggacttcatagtaaggctgccagcctaccgcggcaacacatgcatcttcgtggttgtggatcgcttctccaaggggttacatctcgacatacttcctcctcaccacacatcacaaggtgtggctcagctgttcatagagatagtgggcaaaattcacggcatgcccagaagcattacatccgatagagaccagtttttcatcagcaaattctggcaggcactattttccctaagtggcactaagctcagaatgagttctgcgtatcatcctcagatgaatgggcagactgaagttgccaacagagtcattgagcagtacttacgagtgttcatccaccgacggccgagtacgtgggggcatttcctgttgtgggttgagtggtcatacaatacgtccactcactcagccacaggattgacaccgttcgaggtaacctttggctgcaaacctctgagctttccgcagtacctgacgggcacatcaaaggttgatgcagtagatgaattactcagccaaagggaggccgtatttgccttactccgacaaaagcaacagaaagcccagaatcgtatgagagcgatcatcgacggacaccgtcgggaccatgagttccagtccacagtgtcgggtacagcccagtccaagctttcaaagtgtttttatgggccttttcgaattagtgtgaggatgggtccagtcacttacaagcttgcgctaccagagcactctcgcattcatccagtgtttcattgttccattttaaagcccttcatcagacctcgagatacggtgcaggttatggaccttccaccagtggcggttgataatcaaccagttccaataccattggctatcctggctcacaaaactattctgtcagataccgggccaaagtag

SEQ ID NO: 40570 - DNA, 369 bp, Glycine max
  Peptide Sequence Number=SeqID_157348
atggagcaagttgccgacgagaagggggaaagagagaaaaggaaagaagggagagggaaagtttacgaaaagaaaagggaaatgaaagcagtggccaatgctggttgttactatatttcttatttattttctattttctcttcgcaatggctgctgctaaatgatggtgatgtacggtggtcaagtgttggtgcatatgggttagttgggattggcagcgaagtgtgtagcaggacgaagacggtatcgccagtagcaccagcgagacaggtgctgactgggcaaccagccagtagcaccagcgagacctacatgcaccttctgcacgcgctacagacaccttcttcacgtcttgatccagctacatag

SEQ ID NO: 40571 - DNA, 1437 bp, Glycine max
  Peptide Sequence Number=SeqID_157349
atgagaaagagagaaaggatcctcgacgcaactacgccggacataaggatgggcagcaacctcgctttattcgggcaaactagagggacagatccgacatctcaaccttctactttacaagattcccgaaagatgcggcaaaagaggacttatgggtccagttcaaaaagtggggggataagcagaggtggtagaaggtacgggttcgtgcggttcagaagggtgactgatgaacgcagattggaaaggcagttgggtaacatcatggttaatggattgaagttgtatgtgaacattccaaaatatgggagaccgatgacgacaaaggcagagtacagaaaagaaaccaaaatgcagggggatgagaacaaacatgaaacggaagcagctcaaaaaagacaaccacagcctcgcatacctttggtgtcatacgcgatgatggtggctaccaacaccaggaactcagggcaaatatggactcaacagaacgtgctctacagacctgatgagtcacaatcaacggtccaactcgaaatcccaaagggggagaagaactggtgcagagatgcctgggtgggtcggctgaagaacttggcgatgtttgatagacttgaagatgaaatatcatgggacgtaggagcaaatgttagctcaaaataccaaggggacgaaatggtgctgctactcggcctcaccgatatcagagcagaacagttggcccaggaagacgatcggaatgggtcatccttgttccattcattggagaagtggaactcggggatgcgaacaagacacagattggtatgggttcaatgttggggcattccgctgatagcatggaacatggcgcaaatccaaaagatggtggcaaccataggagacatggtggaggtggatgatgacgccaaagagagttggaggttggatagggcaagggtgcttatcagaatcccgtggaggcccacaatccaatatacagtgaatgtgcatgtcagcggggaggtatacgaagtatacatagtggaagaaaatgggaacagtgccgtaaaatgtaactgtagattcaagggtggcttggggtcttcggaggaaattgattctgacgacagtgacatgggaactctgctttcgaagctggacggtgcaccggaaattgaagttgtgccaactcgggggaacaagttgttaaccatcggtccaaatgaaacggcgagaccactaggtaacgaccatggtcagaggccacactgtcacatccaacaagaaccaagggcggagaacttgtatggaaacgaggatgagcatgctgagcggtccacggtggcggcagaggtcagctcccgagttgacgtctcatgcagagcgcaaaacgagcatggcgctaggcaaagagttgattccaatagcacaatgttttcaccaaaaaggaatagatga

SEQ ID NO: 40572 - DNA, 1401 bp, Glycine max
  Peptide Sequence Number=SeqID_157350
atggatttggtgtctggttacaagggcgtttttgggctcgtttttgggaatgagaattcttcaaatgaagatagctatgttgaacgcttacttgaccggataagcaatggtaaactggcagaggacagaagaaatgctattactgagcttcaggctattgtatcagaaagtcaagctgcccagttagcatttggggcaatgggctttcctgtattgctaagcgtcttaagggaagaacatgatgatgttgagatggttcgtggtgccctagaaactcttgttagtgcattgactcctatcaaccatgcaaaagggtcaagcaatgaagttcaaccagctttgatgaacactgatttgctttccagagaagcagaaagtatctctcttcttctaagtttgctgcacataactattaaaccatctagcttggaaagcacacttgctaagttcctcttcaggttacaggaagctatattgaccatccctcgtggtataactcggctaatggacatgcttatggatcgtgaggtaataaggaatgaagcattgttacttcttactcacctgacctgtgaagctgaggagattcaaaaaatcgttgtctttgaaggcgcatttgagaagattttcagtatcatcaaagaggagggaggttcagatggcggtgtggttgtacaggactgtcttgaattgttgaacaatttgcttcgaaagaatgcatccaatcaggtactgctaagagagactataggacttgattcattgatatcaattttgaagctgagaggaagtggttatacttttactcaacaaaaggtaggttctgatgctgatcctgggaaagatctgaataaacagacaaacaagagaactctgattcagaaaaagctattggattatttgttaatgttaagtgttgaaagccaatgggcacctgttgctgttcgctgtgcgaagctcttggaagctgtcctcaaactaaggctgaggatcctttttgtgtgcatattttcatactcaaacatttcaagttggtatcaaagcgggacgatcccattctgcacttctgtctctgtctatcgccggcgccactgcacctatctccaacaatacccagatctaggtcgtctctttcagcgcatccctaccccagaggtttcaaagtcaaaaaccttgacacgcgccacttctccacacatcattctcaagcgtgtgcatcccatgcacccgtctctggtcaccggaacttcgatgcgacacctgggttttggtcaccggcctctccccactctatttcagccctcagatcgtcattttggtgttgtttggatagtggatctgtacacctccatccttttgcctatatttgtttcctcaggttttgtgctacgcgtctattag

SEQ ID NO: 40573 - DNA, 831 bp, Glycine max
  Peptide Sequence Number=SeqID_157351
gatgtaggcaatttcccttttggacctgatttgagggctttgatggcgagacaaaacatggtagtagggaaccatcaacaagtctcttataggagagtttgggagaggactagacaagaaaaaaaaaacactactgaggtggaaagcagggcgatagacttggatgtaggtgattgtggcgttccagctcaaaagaccagagaagatgaagttttagagtccaatgtgcctctatccttggaacatattaggttgttgtcgtcaaacattcaagtagatacccagacaaagtttataaggaagtggaaaagaattgctagagagaatactgaaagaggaaatcgggaaagcttaaagcaaggagggaaacgaatagtggagatgatttggagtgattcagctatggaaactgaaggagggaagcgcgctaaggaagctcgtgcaacaataaggtctctatctgatctttgtaatggaaaccaagaagaagttagtagaggtgcaaggttatggctgaagaaggccgaggagtgtaaagatgtagtggctcactcttggattttgggtgatgatgttatgcatcacttgactagagtgggctcaaaccttaattcttggggaaaagctgcctttgacttattcatgacgtctattcctcaagatactgacttagttgcacaactggttggagggaggataataaatgatttaagaaatgtgttgaatggtgatttcacaaaggaagaggcgtttgaagctctgaaccaaatgcatcctttgaaggcccctagtctagatgggacccctgctgttttctaccataagttttag

SEQ ID NO: 40574 - DNA, 1686 bp, Glycine max
  Peptide Sequence Number=SeqID_157352
atgaagatgtgctttagttatgctgctaaacttaatgctttgttaggcattgaggagccacaagtggaacctgctctgaactctatacttagaatcattttgaggacttctagcatgcaagagtttattgcagctgattttgtttttaaaagcttttgtgagaaaaatgctgatggacaatcaatgctggcatctacgctaattccacagccatattccatgaattatgcaccccttgaggaggatgtcaatatgtcttttggaagcatgctattacatggtcttactttgggtgaaaatgatggtgatcttgaggtttgtggcagggctgctagtgttctatctcatgtattgaaagacaatctccactgcaaggacagggcacctgtcccatccctaggagctccagagccactaatgcatcgaatggtcaaatatttggcccttgcctcttccatgaaaagcaaagatggaaagtctagatcgtcagaaaactcatatattcaagaatatatcttaaaattactggttacctggctagctgattgcccggctgcagtgcattgtttcctagatgctcgcccccaccttacttatcttcttgagctggtgtcaaatttgtcagaaacagtgtgcgtaagggatttggcagcagttgtcttgggtgaatgtgtgatctataataaatcctctgatagtgcaaaggatgcatttgccattgttgatatgatgagtcagaaaatcgggcttagttcatactttttgatgtttgatgagatgcagaaaagttttgcttttgctaatatagagtcatctctaaaccttaaatcattcactagatcttcagcagctagcatggaagatattgcagattcagacaacaatgacctgtctgaacagaaaaatatggatcatcctattctgtcttcaatattggattcttattttgtgaatcttgtcaaaggactggaggcagatatcagggaacaaattgtggaggcctttagtcatccaaaagtccaggtggcagtggtgccagcagaattagagcagaagatgggggaaagtgatggggagtacataaggcggctgaaagcttttcttgagaagcaatgctctgaaatacaggacctcctttctaggaatgcttctttggctgaagacctggctaggacaggtgggggtagtaattcacaatctgagcaaagagtgagtgggagctcagataaagtccagataaacgcactcagtagagatctccaagaaacgtctaaaagattggagatgctgaaggcggaaaaagcagaagttgaatctgaggcaagaaagaaccggactttagctgaaaagatggaagctgatctaaggagtctttctggtgcctacaatagtcttgagcaatctaacatagaacaggagaagcaggtgaaagcattgaaaagtggagcaccctccacattcctagatttggaggcaataaaagctgaagcaagggaggaagctcagaaggagagtgaaggtgaactgaatgatctgcttgtatgcctagggcaagaacagagcaaggtggatagacttagtgctagattgctcgagttaggagaggatgttgataaactgcttgaaggcgttggagatgatgttgggaatgttgaagatgatgaggatgatgaaggcactgaataa

SEQ ID NO: 40575 - DNA, 1788 bp, Glycine max
  Peptide Sequence Number=SeqID_157353
atgcagaatggaacgtgtgaagcttatcgagtgagccgtgagcatgatcaaggggttagaaggctaagatacccttcagttagttgtttagcttctgttaggctcgaagcgaatcaacaacaaccacagtctccgccgtcgtcgtccgcaggacacacgccacagactcaaaccgccttccaccgtatgaagcttgatgtcccgaggtttgatggatctgatccaaccggttggaccttcaaaattacgcaattctttgagtttcatgctacgccggatcacgagaggttaaccattgcctccttctacatggagggaccagcactcgcgtggttccaatggatgcatcgaaatgctcagttatcttcgtggtcagcttttctccatgctcttcattcacgatttgcaacatccacgtacgaagatcctacgggattactctgcaaattgcaacaacgttcgtcggatagtagggttaccggcttcgttcgtcttgagttgcttcatctcaggattgaatccaacgattcgcagagaagtacaagtcttacaatcgatatcgctggcttaggcaatatcctatgcacgattacaggaagaaaaacttctcgatgcccaccggccgccgctgtatcgtccactagtctccacaggatctcttaccacacgttcatcatcaagcaactctacacaaaccttgctaccaacaccgttatggaggatgaggataccatgattgaagcagagtcattacgcgactatacaccaactcaggagttgctaccagaattgccgccggcgcagctaagcttacatgcattatccggccacttggcaccagagacgttacgacttaaaggctttattaatgaccaacctatcaacatcttgatagatggaggcagtactcataatttcctccataatcgtgtggtattgagcttaggattaaaatccaatgaaatagcgccgcttagggtcacgatggggaatggcgaggagattcactgtaatcagttgtgtacgacggtacaggttcacatacaacaacattctttcactattgacttccatgtattaccattatgtggagttgatgtggtcttgggggtgcaatggttgaagactctcggcccagtcttaacagactacggcgctttaacaatgaagttcatcactgggggtaagctcattgaactccatggagatcgtgagaagggaatcgaacaagtgtcgccatctcaactacgcaggttcgtatacacaaaccctactatgaccttcttccatattcgtgtcgaaacagcaaccacacataactcttccccaaaccatcccttatcggcaatcaatagattgatttccaaatacgcttccctctttcaacctcctacgaccctgccaccatcgcgatccacatatcataccatcaatctattgcctaactcaaccccggtgaatgttagaccatatagatatccttactttcagaagaaggagatcgaagagcaggtagctactatgctcgcgaaaaggttcatacaacctagctcgagttcgttttcatccccagtcttgctggtaagaaagaaagatggatcatggagattttgtgtcgattatagggctcttaatgccatcacggtctgcgatcgcttccccatacccacagtggatgaattgctcgatgagctgggtggagcacggtggttctctaagcttgatctcatgcagggataccatcaaatattgatgaacacgtctgacatctgcaaaatagcattttga

SEQ ID NO: 40576 - DNA, 685 bp, Glycine max
  Peptide Sequence Number=SeqID_157354
gcctatctacaaccgaaaaagcaaagtccaggtggaagaggtgcgtgaggctttgcccaatcagcaaaccgtcgattaccccagcttcaagctcgtcatcgtcggtgacggtggcacaggaaagacaaccttcgtgaaaaggcatctcactggtgaattcgagaagaaatatgaaccgaccattggtgtggaggttcatccgttggattttttcactaactgcggaaagattcgattctattgttgggatactgctgggcaagagaatatccatgggcaatgtgcgattatcatgtttgatgttactgcccgtctaacatacaagaatgtccctacctggcaccgtgatctttgcagggtctgtgaaaacatcccaattgttctttgcggtaacaaggttgatgtcaagaacaggcaagtgaaggcaaagcaggttactttccacaggaagaagaatttgcagtactacgagatatctgctaagagcaactacaattttgaaaagccatttttgtacttggccaggaaacttgcaggcgatactaacttgcactttgtagaatctcctgcattggctccaccagaagttcaaattgatttagctgcgcaacaacagcacgaggctgagcttcttgcagctgctagtcagccccttcctgacgacgatgatgatcaatttgagtag

SEQ ID NO: 40577 - DNA, 1245 bp, Glycine max
  Peptide Sequence Number=SeqID_157355
atgacgaaccacgatgatattaaggccatactggagggggcagaggcaccagtaactgacaagtgttgcatctacagagtcccctttcatatccgcaagttcaacgatgatgcatacacaccaaaggttgtttctattggcccttttcatcataaaagccatcctcgcctccaaaatatggaaagacacaaactactttattgcaaagcatttctggaacgaacccaaacaagtttggacagttggatccgctacatagaagaggtggagcccgattttcgtcgctgttactcagacacccttgaattcagcaagaaggaactggtggatatcatccttgtagattccggttttataattgagctcttttgtagaatcatttctggtacatggtcacgcgacgacaggtttcttgcaacacctttgttgttcaccaatatagtccaagacttgtgtttactcgaaaaccaacttcctttttttgttcttgagggtctcttcaatctgtcatttgcctctacatctagcggcatttcatttcttgagcttacccttttctattttgacaattacaatagatccaacttggtttttaataataatactaacattagacacttcacggatcttattagaacttttcacttgcaacatcctctaaacagacgaccctctaggactgatacatacgtgaaacattttcctagtgctactgagttattagaagcaggggtgagctttaaggtaaacatccacagtaaatgcttactagacttgagattttcagaaggggttcttcaaatcccgcagttggaagtggaagattccactgaaattttgttacgcaatatgatagctttggagttgtgtcactatccatacgaatcctacattacagactacgctaaagttttggatctccttataaacaccagcagagatgtggatgtgctggttcgaaagaatgtgctcgttaactggcaagaggataatgcttctgtggctaacttgtttaatggtcttttgaaaaatgttattagaggaaatgacaattcccattaccttactatctgccaagaccttaatgctttttgtaagaacccttggaataattccaagtccactctgaggcaggattattgtaaaagtccttggcaaactgctgctaccattgctggaattgttctccttattctctctataattcaaacagtttgttctgtcttgcaagtaatacaacaatag

SEQ ID NO: 40578 - DNA, 453 bp, Glycine max
  Peptide Sequence Number=SeqID_157356
atgcttttggacaagaatgatattcaagaaacccattatgaggttctccatgtcaaggaacatgcaaattatgaagaaattcgggctagttaccgaagtgttgtactcagcttacatcctgataagctattgaagacttccaagacatccagcagtaatcaaacaaccagagagatttctcaaagtacagaaggcgtgggagattctgtgaaggatgtcttggctgctgacattgctgaagatttgagcttaaggaaggatgtcttggctgctgatgttgccgaagatttgagcttacaggatatgatgattgaagatgatggagaagcattggaactggtgggaagtgggatatctgtactcaatgctgataccttacctggatcagtgattcttccatgtggatcttgttcgttaaaagctcgtctgctaatcaatatggatgccaattga

SEQ ID NO: 40579 - DNA, 843 bp, Glycine max
  Peptide Sequence Number=SeqID_157357
atgacggaggtgtggcaattttggatctgggctggtggcgcgacacaacagagtggaagttgtaaggaaaggtgtcgcaaagattttggatctggccataggggggtcgtgcaatggtgttggaggacggggatagggtggcgcgggattttggtgaagagaagtctaaggggtgtaaaggctttgcccaatcagcaaaccgtggattaccctagtttcaaactcgttatcgtcggtgatggtggcacaggaaagacaacctttgtgaaaaggcatctcaccggagaattcgagaagaaatatgagccaaccatcggtgtggaggttcacccattggattttttcacaaactgtggaaagattcgattctactgctgggatactgctggacaggagaagtttggtggcctcagagatggatactatatccatgggcaatgtgctattataatgtttgatgttactgcccggctaacatacaaaaatgttcccacctggcaccgtgatctttgcagggtctgtgaaaacatcccaattgttctttgcggtaacaaggttgatgtcaagaacaggcaagtgaaagcaaagcaggttactttccacaggaagaagaatttgcagtactatgagatttcagctaagagcaactacaatttcgagaagcctttcctctatttggccaggaaacttgcaggtgatcctaatttgcactttgtggaatctcctgcattggctccaccagaagttcaaattgatttagctgcacagcaacagcacgaggctgagcttcttgcagctgctagtcagcccctccctgacgatgatgatgaatcttttgagtag

SEQ ID NO: 40580 - DNA, 204 bp, Glycine max
  Peptide Sequence Number=SeqID_157358
atggagtctggaagggacgaagatttattgaagaaagagatggttgtggtgtgtggcagcaaaatgcccaacatgtgtgacgtgaaagaacgcagaagaaaaggccacatagcttcgtgcaaggtactggtaatgggattactaccggaatgtggtaagcaggaagagccgatcatctttaaggatgatgtcgattccccttag

SEQ ID NO: 40581 - DNA, 1563 bp, Glycine max
  Peptide Sequence Number=SeqID_157359
atggcagttgcgcgggatattaaggggaggcgagaacgcgtaattgcagttatcagcaattggacaactatggctggtcaggcgtatgaggcaatgagcaatgcaggatatttggactcaaatatggttgtgattttgaatgatagccgtcactctttacttccaaaaattgaggagggcccaaagacatttgtcaatgccctatctagtaccctgagcaagctccagtccagtaaatctttccggagatttagagaagctgctaagggtgttacgaaacgaattggtagaggtatgcatgaattggcagctaaagtggatgaatatgctcgtggtatgatgggtcctctaggttctactctttttgaagagcttgggttgtactacataggcccagtggatggacacaatattgaagatctcatatgtgttctgcaagaagtagcttccctggattcaatgggacctgtcttggtacatgtgataactgacgaaaatcagggagatgaaaacagtcagaaaagtgatatatcagatgggcagcaggatgaaggttctgttaaatctgattcgttagataatcctgttcggcctcaaacatatggcaattgctttgtggagactttggttgtagaagcagagaaagacaaagatattgttgttgttcatgctggattaacgatggagccatcacttgaactgtttcaggaaaaatttccagataggttttttgatgtgggaatggctgaacaacatgcagtcacatttgcttctggtttggcatgtggtggattgaagccattttgtgtcatagcttcctcctttctacaaagagcctatgaccaggtggtgcatgatgttgatcaacagagaattccagtgcgttttgttattacaagtgcaggattggtaggttctgatggtccccttcaatgtggagcatttgatataaactttatgtcatgcttaccaaacatgattgtcatggccccatctgatgaggttgaactcatgcacatggtggctactgctactcgcatcaatagtcagcctatctgctttcggtatccaaggggtgccctggttgggagagggtacactataagcgatggaatccccatcaagataggaagaggaagagttcttgttgaaggcaaagatgttgctttcctaggatatggatcgatggttcagaactgcctaaaggctcattcactcctcgccaagcttggcattgaggtaactgttgctgatgcaaggttctgcaagccccttgacatcaagcttctgaggcagctttgtaaacaccactcttttctagttactgttgaggaaggatctattggaggatttggttcccaggttgctcagtttattgcggttaatggactactcgatggaagaattcagtggcgaccaattgttttaccagacagatatattgagcatgcatcaccaaatgaacagcttgatcaagcagggttgagtggacatcacattgctgccacggcattgagtttactaggccgtacccgtgaagctctcctatttatgtgttcctga

SEQ ID NO: 40582 - DNA, 2085 bp, Glycine max
  Peptide Sequence Number=SeqID_157360
atgggagcaccatttaagggaataattcaagatttcaagggaagagctcaatgctataaacaagattggatttgtgcactctgttctggcgttagcatattggctccaactttctacatattctttgcttctgctcttcctgtcattgcttttggagaacagcttaatagggatacagatggaaccttgagcacagtggaaacattggcatctactgctatttgtggagttattcactcaatattaggtggccaacctttgttgattttaggagttgctgaaccaactgtcataatgtacacttacctctacagtttttgccaaaaaacacctgaactgggtggcaagctctttctgccttgggctggttgggtttgtgtttggacgggagtctttttgattctgcttgcaattttcaatgcttgcacaattatcacaaggtttacaagaattgcaggggagttgtttggcatgctcataactgttcttttctttcaagaggctataaagggattgataggcgagttcaacatgccaaagaatgaaaatccttcctcagtggaatttcaattccagtggctgtatacaaatggattactcgcaatcattttctgttttggactactcgtcactgcccttaaaagcagaagagctagaacgtggcgatatggaacagggtggctacgaggatttatagcagattatggggttccaatgatggtagtgttatggactgcactgtcttatactgtaccaggcaaagttccagatggtgttcctagaaggctcatttctccccttccctgggatgctgcatctctctatcactggacagtagtgaaggttagggtgttggggttcaacattgtgataacaagcagtgatcattttagtttaggcaagtcaaaatatctatctaatagttactgcaaactgcaggacatggggaaggtaccagtggtttatatatttggggcaattattccagctctgatgatagcaggcttatactttttcgatcacagcgtagcttcgcagatggcgcaacagaaagaatttaaccttcaaaagccatctgcctaccactatgatgttttgctgcttggaataatgactttgatttgcgggatccttggccttcctccttcaaatggagtccttccacagtcccccatgcatacaaagagtttagcagttcttaggaggcggatgatccgaaagaaggtggtgaagagcgccaaggaatgtattaagcaacgaaggaccaactctgaattatatggaaagatgcaagaggtgattgtagaaatggatacagaccctacggttaaagaattggagaatttgaaggaggctgtaatgcaatctgatagcaaggatggagcaaaggaaaaatttgatcctgagaaacacatagatgaatatctaccagtgcgggttaatgagcaaagaatgaccaacttattgcagtctctcctggttgctgtatcaatcttagccatgtcagttatcaaaaggataccaacctcagttctatggggatattttgcttacatggcaattgatagtctcccagggaatcagttctgggaaaggatattgcttctcttcgtcacctcaagccggcgttacaaaattttggaaggttctcatgcctcttttgtggagacagtaccattcaagaccatagctgcatttacagccttacagttagtatattttgcgttatgtttcggggtgacttggatacctataggtggaatattgttccccgtaccattcttccttctcataattataagagaacacttgcttccaaagatgttcaagcctaaccatcttcaagaactagatgcttctggttatgaggaaattattggtgctccacatggttcactgagggataaggagccagatactgatactgatggaagctcggaagacttttacgatgcagagatattggatgagatgacaaccaacaggggagagttgaaacttagaactgtaagcagcttcaatgatagaaaccacagcttcagtgaagacagacacactcaggtttatcctggaaatgctgtctga

SEQ ID NO: 40583 - DNA, 162 bp, Glycine max
  Peptide Sequence Number=SeqID_157361
atggtgtttgagagcgtgaaaagaagcgaaggttttatagtggaaggaagggaaataatcttcatacctccaccaatgtcaattgcgtttagaccgccttctgttaaacatcaaatagaaattcattgggcaataaaacgcaaatacatttggatattgtaa

SEQ ID NO: 40584 - DNA, 309 bp, Glycine max
  Peptide Sequence Number=SeqID_157362
atgacaagaagctacaaaaatagaacttctagccaggtcaacaagtgttgcttttcaattccagactcagggcctttcgtgatcaaagaagtaagaccccatgaagttgtggaattggtggaccctacggcaggcacccctaagaaaagacggatcgtcaatggacaacacttaaaaatttataaaggaggccagttagaaaggtaccaactcactaagcctcacattagtcttagtgagaacaaacaatctagagaagaaaagcaaaagtttaggaatgaactcgctaagcacgaccctacacgctaa

SEQ ID NO: 40585 - DNA, 879 bp, Glycine max
  Peptide Sequence Number=SeqID_157363
atgggccccaaatcagcagctgccaaatctgccatgatgtcatcccctacttcggcctcaatagtctctctgacctcagagggcttatcccccccatcagtagaaggctggacacctggccaagcaacttactggatgaaggcctttgggttggcagtgacgggttcatcgccaggtggggcgtctggtgttgcggctctggctcgggcacgacagggccctgggaaggtgatggacaagtcaatgtggttccaacagtttttctttatgaaggccaagttaatcacagggcttagtgactcaaaggtcaaggcgatctacgtgatttgtcatgaaataaagctgcccagatccttctacaacaccttccgtggtgccccattggtgttcaagatgaatcctcctccagtacgctggatattcttctccgtcaacaaggatgacggggcatcaaagaaatcattaatggtctctccgtcaaatgataacatgcccccgcaccttgcaatagtttggagcatcatcctctgggtcatagatgttggagtagaattctttgaccaaagcaacgtctatctacttttctgggagcctagtgagtacccggtgccactgcctctgttggagctctccgtaaaattcatcaaacatgcttgcggagagctctatgttcctttccatgggaggaatcctagttggattcccctccttgagtgggcattgatcgtcgtttccgtgaggccatatgaaaaaatgaaaataagactagtctcgtttagcatgagctatgcactaagcgagtttatccttcttcatgagcacgctactgctcgcttagcacgcttggccatattcttctgttgcaatgaactcacttag

SEQ ID NO: 40586 - DNA, 303 bp, Glycine max
  Peptide Sequence Number=SeqID_157364
atggctcacaagctcggagtcattgacaatggtggctcacgagaggtggctctggctcacaatggcttagttagcaaatttggaagagtggtggctcaactctggctcatagtggctcaggtagctgatttacgagaaaggtcaagacttgtgagagtggtggctctagctcacgacggctcaagttcagtgagagacgaagatagcagaaaggtcgagagaatgagggacgaaaagtggcagtgcctcaatggtagcacaactgcgcaaaaagaagagaagagagtgacacctatagggtga

SEQ ID NO: 40587 - DNA, 282 bp, Glycine max
  Peptide Sequence Number=SeqID_157365
atgagttggaagaagagtggaaatggcatctcattcgttcttgaccagctcatgaagaagaggaagaatgagcatgaatgctttaagaccacaaagaaatgtaggatgctcttcgaatcaactatgaagattgaaggcattgaggatgttagacttgggaaaattgccttcttaatcgggcattatgagaacttcaacatgaaggaaggagagaccgtagatgagatgtttagaagatttcaaactatcttgaacgatggtctagggaaagttgcactttga

SEQ ID NO: 40588 - DNA, 4272 bp, Glycine max
  Peptide Sequence Number=SeqID_157366
atggaaagtggtgaactgagagtggcaagtgcacgcatagggagctccagcgtgtggaggagcagtggtggcgttgatgtgttttcagggtcttcaagaagggatgatgatgaacaagagcttaaatgggctgcaattgagaaactccccacttatctacgtatgactaggggcattctcaccgaggctgaaggccaacctacagagattgatataaacaaactctgtccacttcagaggaagaacttggtggagaggctcgtcaagattgcagaacaagacaatgagaagttcttgttcaagttaagggatcgcattgatagtgttggacttgaaattccggcgattgaagtccgttttgagcacttgaatgttgaggcagaagctcatgtgggaagcagggcactacctacaatctttaacttctgcattaatttgttggaggggttcctcaattctcttcaccttattccaagtcgaaagaagccattcacagttcttgatgatgtcagtggaatcatcaagcctaaaagaatgtcactgcttttaggccctccaagctctggaaagaccacattgttgttggcactagctggaagacttggtaaagatctaaaagtaagggcatatgagatttgcttttgtttcaacaacttcactgatgaattagaatcagaatcatttaaggcttatgattcattcaattctattgctgatgaattgcagttttcggggcgagtttcgtataatggtcatgggatggaggaatttgtacctcagagaacatcagcttacataagtcaaactgatctacacataggagaaatgacagtaagagaaacattggccttctctgcaaggtgtcaagggattggaacccgtaatgagatgctggcggaattgtcaagaagagagaaggctgcaaacattaagccagatcctgatcttgatatttatatgaaggcagcagcactagaaggccaagaaaccaatgttgttacagattatataatgaagattttgggactagaaatttgtgctgataccatggtaggggatgacatgattcgaggtatttctggcggacaaaagaagagagtcacaactggtgagatgctagttggaccagcaagagcacttctcatggatgaaatatcaactggtttagacagttctaccacattccaaatggttaattctttaagacaatctatccacattctgaatggaacagctgtgatctctcttctccagccagcaccagaaacttacgagttatttgatgatataattctcctctcagatgggcaaattgtgtatcagggtccaagggaaaatgttctcgagttctttgaatacatggggttcaaatgtccagagaggaaaggagtagcagattttttacaagaagtaacatcaagaaaagaccaagaacagtattgggcaaataaagatgagccatactccttcgtcactgttaaagagtttgctgaagcatttcagtcgtttcacgttggtcgaaaactcggtgatgaacttgccactccatttgacatgtccaaaggccaccctgctgtgttgacaaaaaacaagtatggtgtttgcaagaaagaacttctgaaagcctgtgtgtccagagaattcttacttatgaaaaggaattcgtttgtctatattttcaagatgtggcaactgattttaacggggttcataacaatgacattgttcctgagaactgagatgcaccgggatacagaaactgatggtgggatctatatgggagcactgttcttcgtactaattgtgattatgtttaatggatactccgaattatccatgtccatcatgaaactcccagttttctataagcaaagggaccttctcttttttccttgttgggcatactctctgcctacatggatccttaagattcctatcaccttagtggaagttggtatttgggttgtgatgacttactatgttataggatttgatcctagtattgagaggttcatcaagcaatactttctacttgtttgtatcaaccaaatggcatcaggactttttcgatttatgggggcagttgggaggaacatcattgttgcaaacacagttgggtcatttgctttacttgcagttatggtcatgggtggatttatcctatctagagttgatgtgaagaagtggtggttgtggggttactggttctcgcccatgatgtatggacaaaatgctctagctgtgaatgagttccttggaaagagttggtcacatgttccacctaattcaacagaaccattaggagtaaaggtcttgaagtcacgtgggatcttccctgaagcatactggtattggattggagttggagcttccattggatacatgttactgttcaacttccttttccccttagctttacattatcttgacccatttggtaaaccccaagctctaatatccgaagaggccttagctgagagaaatgctggcagaaacgaacacatcattgaattatcatctagaatcaaaggctcttctgatagagggaatgaaagtcgtagaaatatgtcctccagaacactgtcagcaagagtgggtagcattggtgcaagtgaacacaacaagaaacgagggatggttcttcctttcacacccctttccatcacttttgatgaaatcagatattcggtggagatgccacaggaaatgaagagccaaggcattcttgaagatcgacttgaactgttgaagggtgttaatggagtctttaggccaggagttcttacagctctaatgggtgtaagtggggctggtaaaacaactctaatggatgtgttatctggaagaaaaacagcaggttatgttcaagggcaaatcactatatctgggtaccctaaaaagcaagaaacgtttgcgcgcatagcaggatactgtgagcagactgatatccactctccccatgttacagtctatgagtctttggtttattctgcatggcttcggttaccccctgaggttgattctgtcaccagacagttttttattggttgtgcacttgtgcctcataagaactgtgctcgtgctcatgctcatatgttcattgaggaagttatggagctggtagagctgacttcattaagagaagccttggtgggattgcctggagtgaatggcctctccacggagcagcgcaagaggttaacaattgcagttgaacttgttgccaatccatctattatattcatggatgaacctacctctggccttgatgccagagctgctgctatagtaatgagaacagtgaggaatacagttgataccggacgaactgtggtctgcacaatccaccagcctagcattgatatatttgatgcttttgatgagcgtggaggtgaggaaatatatgtgggacctttaggccagtgttgttctcaactgatcaattactttgagggaattaatggggtgccaaaaattaaaaagggctataatcctgctacttggatgttggaggttacttcagaagcacaagaagcagctcttggacttaacttcgctgaaatatacaagaattctgacctatataggcaaagaaaacaagatctatttaatgcaatgggatccatgtatgctgcagtcctcttcattgggatacaaaatgctacatctgtgcaaccagttgtagccattgagagaacagtcttctatagagaaagagctgctggaatgtactcagctttaccatatgcatttggacaggttgctattgagatcccatacatattcatacaaaccctcgtgtatggagtcatagtgtatgctatgattgggtttgattggacgttcagcaagttcttttggtatctcttcttcatgttctttacctttttatacttcacgttttatggcatgatggctgtgggtcttaccccggatcacaacgtagctactatagtttcctttgggttctacatgatatggaacctcttctcaggattcgtcattccacgaaccagaatgccagtgtggtggagatggtacttttggatttgtcctgtgtcttggaccttatatggattggttacttcacaatttggtgacataaaggaacgtatagatactggagagactgtggaagagtttgttaggagttattttgggtatagagatgactttgtaggagtagctgcagctgtgcttgttgggtttacactgctttttggatttacctttgccttctcaatcaaggcattcaatttccaaaagagatga

SEQ ID NO: 40589 - DNA, 276 bp, Glycine max
  Peptide Sequence Number=SeqID_157367
aggacttattcaacagtcaacagtcagagttcagacccagacagtgagctttcagtaattaacaatcaaataatcgccatcgaagtcttcttcgcagacaacgtgttgagagcactatatgtgtgtgaagaacgtacaattacaacaatttcgacggtttggtttgtgttacacgtgccaagggaagctcaggtggtggcggttcaactttggctttccgtcatgcaactacccaataaaaaggttcacacacgcgcgcctacacgtcacaattaa

SEQ ID NO: 40590 - DNA, 138 bp, Glycine max
  Peptide Sequence Number=SeqID_157368
atggggtggttcgtgaagcaagggaagacgcgtgcagctcaccgagttgttgttgaagaagctggaaccttgtttactgggctgcaaacggttggcggcattgtctgtggagtttctcatactcctttctgcatttaa

SEQ ID NO: 40591 - DNA, 738 bp, Glycine max
  Peptide Sequence Number=SeqID_157369
atgcgaacaaatcaatctggaaaaaggttttatcaagtcaagattaagggcctagatgtcaccagccttaaggagttggggcgattgatgggacctctccaaatgcaagcctttcgcaaggcgtacggaaagattttagatttgaccatagcggagatattcacggaagccgttgtatcactcacccaatactatgaccagcctttgagatgcttcatgtttggagacttccaattagtaccgactgttgaagaatttgaggagattctaggatgtgctcttgggggaagaaaaccgtatcttttctccaggtttcttccctccttgagcaagattacggttgtggtcagggattcggcaagcgagttggatcgtgtaaagcaaactcaaaacgacgtagtgggcctaccacggaagtacttagaaggcaaggcaagggatatggcgaatcaagaggagtgggtcccgttcatggacgtattagcattgctaatctttggggttgtcctctttccaaacgtggacggtttggtggacctaggcgcaattgatgctttccttgcatatcaccatagcaaagaaagcccggtggtagctatcttggcgaacttatttgatacatttgaccaaaggtgcgagaagagtagcgcacggatcatctgctgcttgcccgctctttgtgtatggttggtttcgcacctattccaacaagacataagacacccctgtcccctctga

SEQ ID NO: 40592 - DNA, 435 bp, Glycine max
  Peptide Sequence Number=SeqID_157370
atgagtcatcattcatctagtgttaatggtgagggtactagtcataaggaccctctatctaaaatcttagaagatttgagttccctcaagttatggaaagaaaaactagaaagaaaagaaaaaggaaaagaaaggtcttttccaaagaaagaccaaggtgaaggcatcttaggggtggcaccttctaagcccaaagatgataaggggaagacaacagaaaagcaactccctaaggctagtatgcaagagaagactagctctataaagtactttaaatgtcttggaagaggacacattacttctcaatgtccaactaagaaaaccatgattatgaaaggccaagacatttatagtagccaagatgaggctactacttcaccttcctctagtgaaagtgaagaagcaaaaggggaagaatctaatgaagaaatctaa

SEQ ID NO: 40593 - DNA, 654 bp, Glycine max
  Peptide Sequence Number=SeqID_157371
atggcacatgaagtggaagatgactcacaccaaaaatctggagagatgacatctgaggtagcaagcgaaattgcagataggattgattcccttgaagagcgatacaatcctagatgtagtccagatgcaatcacatatgcaatcccagggactcgaactgcctctgctacctatgtcagcataaaaggaagttgtgtcgatccctcagagcaggatccagacacgagtaaatcagacaaatatgggttgtatgttgataacaatcctccccatttggttgcccttagaagagtttatgaagggctgacaaccgtccataatgtccctttgggcaatgatcgagtgaaggttagtgttgaggaagttcgagatgctgatgcttgcatccttgtacccactcaaaaggataaactaagagctaagggaccggcgaaacctgtagataggccaaaacctgatgatgatcccctatatcagatgacattgatgatcctggagcttttcctcaagcctatgcaagtgtcgttggattcaactgtgtttggggtgtataatgataatgtcctcttgtacataaagcatgaagatctttctgaaatagcacacagtgatcaatgtctcaacatctctattatacaaatatggattttgtaa

SEQ ID NO: 40594 - DNA, 915 bp, Glycine max
  Peptide Sequence Number=SeqID_157372
atggggacatcctctttgctagtgtctgatttgtactgtactctatatcatatgatgcctcacgatcttaaacatgctatctcatacctgccacctaaagaactcaagttagtctataatgcctttatggaacttgactgggagtcgattgctcctggattacttcatgatatagttgaggacacaaatgttacttttgagaggataaaggaggaatttggtgctacagtgaggcacattgtggaaggagagaccaaggtacttattattcttgaatcttcatcgaaaagaattacttcaaatctaaaatcttcaataacattgtggaaggatagactaagctatcatcaaccgtctccttatgctgagaattcagagaatactacctatcatgaaccatcttcttatgcttggaattcatcaaatactgcctactatcaaccctctacttatgctaggagttcaaaaaacacttgccatcaacataagaggcaacccacatatatagttgataattttagctcattggataaggtccatgagtccaaaattgatgatttaaacaaggaagcaattcctaaagcaaaggatgtcgtgagaattgatttggtgggaggctatgctatgcaaaaggtgacattagaaagaagttattttcgtgagagtgcaattgaatatacagatgatgaagatgtcagctggaaagttcagagagtagcagctaaatgtttagtagcattgattgtttctcgtcctaagatcttatcaaagctgtatgatgaggcttgtccaaaactaatagatagattcaaagagagggggaaaaatgtcaagtgggaagcttcaaacacttccattagtagtttagggagttatttcaatgatttgcttcaaacacttccattagcagtttag

SEQ ID NO: 40595 - DNA, 286 bp, Glycine max
  Peptide Sequence Number=SeqID_157373
tgtttcgaagaagcctttgtatccagggtgcaagaagtctttgacgttattgtcagtggtgttaagtcttgttaatgtcaaggctagatatgagtggagtaacaaaagcttcacttcattgcttcagtatcagaaaattcatgcatgtcctaatgattgcatattgtacatacatgagtttgaagaaatgcataaatgccccaagtgtagggtatcatggtacaaagtgaatgatgatgacgagtgtagcaatgacgaaagcataaagaaagaccccccaatgaag

SEQ ID NO: 40596 - DNA, 162 bp, Glycine max
  Peptide Sequence Number=SeqID_157374
atggttcttcaagagatcgaaaaaggggaaaagaatgaggggtcgatggagtcgatcttggcattgcccgtgaataaagctataaaacacaaggcaacaatgggaatgtataattcattgcagaggtcagtaagttggagcattggcttgtcacgaagctga

SEQ ID NO: 40597 - DNA, 423 bp, Glycine max
  Peptide Sequence Number=SeqID_157375
atgggtaaagtagaggaggtgcaagagaaggtgaaggccgacatggaggccatggccacaatgatggaggccatgatgagcatgaagaagataatggaagccaatgcggttgcagttgccgctaccagcgctgttactaaggtgaacctgatgcccccatctgatctcaaccaaatgaatcatccaacctcagatatggtgggcaaagatttgggaagtacggacgaccccatgatgtgcaaattcaaaacaagcacgtcttcccaccatatggcttgccacccaactatacatcacccattgtggcgtacactcccaataaggatgtcaataactccactcctatactcattgagagccaacaacccaaaactgatcatgcacccatgggtgaggcacataaaatgccccaccacaatctag

SEQ ID NO: 40598 - DNA, 126 bp, Glycine max
  Peptide Sequence Number=SeqID_157376
atggtgagacagtgtaaagagcggccaagaagcgagatatccaagaggttgccagtccacacgggaggacagttcactaaagatgcttcttccacttctaactcctactcgcggaagggaatataa

SEQ ID NO: 40599 - DNA, 534 bp, Glycine max
  Peptide Sequence Number=SeqID_157377
atggaggctatgaaagaccaaatgaccaccatgatgaaggccatgatgagtgtgagaaaaatgatggaggtcaatgcggctgcagtcactgccacaagtgccgccattgaggtggacctgactcacccatctggtatcaatcaagtaaatcgtccagtcctggatatggtagatcaaggaggtgaagctttgggaagtatgggtggcccccattttgtgcagtctagtcatgcacacgtccctcaacccatgggggagacacatgaagtaccccgagaccacactctagccgaattcgagcctcacgtcggatatgccattaaggggcaagcatttggtggcgtacccctgccaaacgctttagggggccctcagtatcgcccacaaccacaactacaacccttacattttacgatgggaagactgcctcctgccatggtggaaagggaaaaatttgatcatatagaagaaaggattaggaccattgaaggaggtggagattacccttttgtcaacatggcgaaactgtgccta

SEQ ID NO: 40600 - DNA, 192 bp, Glycine max
  Peptide Sequence Number=SeqID_157378
atgacggcaatgaatcttggccttaggtatcccttgtatcgaaagtcttcctggcggtgggtccaggcaacatgtcccgcagatggagcggcggtgcaagtaccgcaagtagctaaagcatgtgatgacatgtcagtgattgaacgtgatgacgtaatactccgtttgtcgcgtcatcacttaacggaatga

SEQ ID NO: 40601 - DNA, 2826 bp, Glycine max
  Peptide Sequence Number=SeqID_157379
atgtctcagaccaactgggaagctgacaagatgttagatgtttacatccatgattatcttgttaagagggacttgaaggcttctgctcaggcctttcaagctgaaggaaaagtatcctcggaccctgttgctattgatgccccgggaggttttctgttcgagtggtggtcggttttctgggatatatttattgcaaggacgaatgagaagcactcagaggttgctgcttcgtatattgagacacaattaataaaggcaagggagcaacaacagcagcagaaccagcagcagccacaaccccagcagtcacagcatcaacaacagcagcagcaacaacacatgcagatgcaacagctcctgttgcagagagcacagcaacagcagcagcaacaacaacaacaacagcagcagcagcagcagcaacaacaacaacagcagcagcagcagcaacaacaacaacaacaacagccacaatcgcagcaacaacagtcacaaccgcaacaacagcaaagtagggatagggctcatcttttaaatggtagtgcaaatgggttagtcggaaaccctggaactgcaaatgcactagcaacaaaaatgtatgaggaaagattaaaacttccccttcaaagggaccctttggatgatgcagcaatgaagcaaagatttggtgaaaacatgggccaactcttggacccaaatcatgcatcgatattaaagtcagctgcagctcctggccagccttcagggcaagttttgcatggtgctgctggtgggatgtctccacaagttcaagcacgtactcaacaattaccagggtctactctggatattaagggtgagattagtcctgttttaaatcccagagctgctggtcctgaaggatcattgatgggaatgcctggatcaaatcaaggtagcaataatttgactttgaaagggtggcctctcacaggtttggagcaactgcgctctggtctactccagcaacaaaaacctttcatgcaggctcctcaaccttttcatcaactccaaatgttgacaccacagcatcagcaacagcttatgctggcgcaacaaaatctggcatcaccatctgccagtgaagaaagtagaagattgagaatgctattgaataataggaatattggtctaaataaggacagtctttcaaatcctgttggtgacgtggtatcaaatgtcggatcccctcttcaaggtggtggccctccttttcctcgtggagatacagatatgctaatgaagttgaagctggctcagttacagcaacagcaacaacagtcaagtactaatgcacagcagcagcagcttcaacaacatgtcctttcaaaccagcaatctcagacttctaatcatagcatgcatcagcaagataaagtagggggaggtggtggcagtgtcactgtggatggtagcatgtcaaactcatttagaggaaatgaccaggtttcaaaaaaccagattgtgagaaagagaaagcagcctggatcctcatcaggtcctgccaatagttcaggaacggcaaatacaacaggtccatcaccaagttcagcaccctcaactccgtcgactcatacgcctggagatgtgatatcaatgcctgccttgccgcatagtggtagttcttcaaagcctctaatgatgtttagcacagatggtactggaacccttacgtcaccttctaaccagttgtgggatgataaggatcttgaattgcaggctgatgtggatcgctttgtggaggatggatctctagatgaaaatgtcgagtcttttttgtcccatgatgacacagaccctagagatactgttggccgttgtatggatgtaagcaaaggcttcacattttctgatgtaaattctgtacgggcaagcacaagcaaagttgcctgttgccatttctcatctgatgggaagttactagcaagtggtggccatgacaaaagggttgttttatggtacacagattctctaaaacaaaaggctactcttgaagagcattcatctttgattactgatgtccgtttcagtccaagcatgcctcgtcttgcaacatcttcattcgacaaaactgtcagggtttgggatgttgacaatgaaactgttttgtatattttaacgggtttgatttgtgtttctgttgtagaagttcctagatgtggtttcactgttttatattactattgctatgtggctcatatgcctggttattcacttcgtactttcacgggacattcaacatctgttatgtcactagattttcatccaaataaagatgacctcatctgctcttgtgatggtgatggtgagatacggtattggagcataaacaatggcagttgtgctagagtgtccaagggtggcaccacacagatgagatttcagcctcgtctcgggaggtaccttgctgcagcggcagagaatattgtgtctatatttgatgtggagacacaagcgtgtcgatattcactaaagggacacacaaaaccagtggattgtgtttgttgggatccttctggggagttgctggcatctgtgagtgaggactctgtcagggtttggactcttggatcagggagtgaaggggaatgtgttcatgaacttagctgtaatggcaataagtttcatgcatctgttttccacccaacgtacccttcattgctgtcattggagctgtggaatatgagcgagaacaagacaatgactctgtctgctcatgatggtctcattacttccttggcggtttcaactgtaaatggtttggttgcttcagccagtcatgacaagttcctcaagctctggaagtga

SEQ ID NO: 40602 - DNA, 153 bp, Glycine max
  Peptide Sequence Number=SeqID_157380
atggcatgcacaggttctgtggggtcacttgatctcagtggcgtgttacttttccatgctagcaggatttatttggaagtgccaaagcaacacttgatgatgcaagtaaacagttatggaatgagtattttagatggtgttaggtttagttag

SEQ ID NO: 40603 - DNA, 225 bp, Glycine max
  Peptide Sequence Number=SeqID_157381
atggacaagatcaagtacaaccctgaaatgcaaaatggggcagtggatggatgggaagtgatttcagagaaaatcccgaggatggttcagagggacaacctgtttgatatgtttgtgatgacaactgtgaagaaaaagcctgacttaagaagaattcaaggggaacttgggaacatgctgggtatgcaactccaagagaaaactctggagggaagagctacctga

SEQ ID NO: 40604 - DNA, 198 bp, Glycine max
  Peptide Sequence Number=SeqID_157382
atggcaacatcattggcgcgtcctctttgcatgcgacacgtggcagtgacgctactgtcactggcgacaccagttagtatcgccacctgcaatggcgctttggccatgcaaggtggagttgctgcttttcagctttatggcagtagcttttcagctatggcagtttgggagaaggcgcaattacggttagtgatttag

SEQ ID NO: 40605 - DNA, 951 bp, Glycine max
  Peptide Sequence Number=SeqID_157383
atggagagtgagagtgagattatgatgattccatgttttgattttggcaaggcattagaagaagggagtgaggagtggaaagaaatgagcaagaaagtgagagaagcatgtgagagtcacggttgcttcctcttggtttgtgatcatgagataattcccaagggtgtacatgaacagtttttcagtaacatggaagcattgtttgatttgcctgaagaaacaaagatgaagcacattagtccaaagccttatagcagctacaatgggaagagccctgtcattcccctcagtgaaacctttggaatcgatgatgttccactctctgcttcggctgaggccttcacttacctcatgtggcctcaaggaaacccatctttctgtgagacactaaagatcatgagcttaaagatgctagaattaagttccctcgttttgaaaatgatagtggggggttatggcattcaacaacattacgtagatgttgaaaagatgaagagctctagcaattcacgattgataaagtacaaagttccggaaaataataatgactccaagactgccctgttgcctcacactgacaaaaatgccttaaccatattgtgccaaaacgaagtccaagggctccaagtattatccaaaacaggcaattggattgaattgaagataccccaaaatggctttgtggtcattgttggtgatatactaaaggcgtggagcaatgggaggcttcatgcagctacacacagagtggtgatgaatggaaacaaagagagatattcatttggcctttttgcaatgccaatggaagagatggacattgaggtgccccttgagttggtggatgagaaaattcatccccttcgttatcatccattcaaatatggagagtacacctcttacttcgtttcaaatctcaaagaaaatgctcttgaagtgtttgcaggtctttga

SEQ ID NO: 40606 - DNA, 977 bp, Glycine max
  Peptide Sequence Number=SeqID_157384
aacaatccgcagctggagagagagggaatatggaaagtgagagtgaggtgacgatgatcccatgttttgatttttgcaaggcattagaagaaggcagtgaggaatggaaagagatgagcaagaaagtgagagaagcatgtgagagtcatggctacttcctcttgatgtgtgatgagatcatccctgagagtgtacgtgaagagatgtttgatggtatgaaagaattgtttgatttgcctgaagaaacaaagcagcaacacatatgtcaaaagccttataggggctacattggcaagaactctatcattcccctctgtgaaagctttggggtcgatgatgctcctttctcagctacggctgaggccttatcaaacctcatgtggcctcaaggaaacccacatttctgtgagacactgaagacgatgagcttaaagatgttagaattaagtttcatcgtcatgaaaatgattgtggagggttatgaccttccccaacattacatattggatgttaaaaacatgaagagttctagctattcacgattgatcaagtacaaagttcctgaaagcaacaatgacttagagactgccctgccgcctcacactgacaatagtgccataaccattttatgccaacataaagtccaggggctccaggtgttatccaaaataggaaaatggattgaattggagataccccaagatggctttgtggtcattgttggtgatatactaaaggcatggagcaatgggaggcttcatgcagtcacacacagagtggcattgagcggaggcaacgagaggtactcgtttgggctttttgcaatgccaaaggaagagatggacattgaggtgccccctgagttagtcgatgaccaaattcatccccttcgttatcgcccattcaattatggagagtacttcaactactttgtttcaaatcccagagaagctcttgaagtgtttgcatgtctttga

SEQ ID NO: 40607 - DNA, 2862 bp, Glycine max
  Peptide Sequence Number=SeqID_157385
atgatcaatccaagtgaggatgatggggcctcatgtgatcgatttacacattatgctggctatactaggttatcaagaattgagtttcctagatttaatggggataatgtgaaagaatggctataccaatgtgaaacttacttcttgatggatgaaacccctccagaagttaaaaccaagttagccatcatgcatttggaaggcaaagcccttaaatggcatcatgcatctaggaaaattctttggtctcaacacctccctagttgggaagaatatgttcaattcttgactgaaagatttgggaatgcttgtgatgatcccatggttaagctaatgaatttgagagagaagggtaccattagtgagtaccatgagcaatttgacgccatcatgacacgattgtatttaccagtaaactactccttaagttgtttcttgggagggttgaaaactgagggggctgcaacacagtttgaggaggcacaaatctttgtcaatgccttgataggggttccaaattttaaaaccatgcgtgtcacatggagatacaataaaaagcctctgcacatacttattgataatggcagcactcataacttctgggatgtccatgtagctgcaagaattaggtgcaagattgaagatcttaaacttctagtagtcacagtggcagatggcacaaaagtgcaaatatcttcagttgtacgaaattttacttgggtaattcagcataccactttcacttcagatgtcatgctgattcccctaggatgttgtgatatagtgttgggtattgaatggttgatcacattatgggaaatcacttggaatttcaccgagttgaatatggaatttatggttcagggtagaagacatgtaataagagggatggaaggtggagtattgcaggcattaacaactcatgccactaaggtggacattcccactactattgaacagattctatgccaatatgcagatgtatttgtgacacctacacaactaccaccaagtagaggtgagcatgatcacataatccctctcttgcaatctgctgaacaagtcaacaaaagaccttatagggacttgaacaagaatactatcaagggtcgatttccaattcctttagtagaagacctcatggatgagtttcatgaatctactatcttttccaagattgatcttagggcagggcaccaccaagttaaaatgcatactgctgatatttacaagacaacattcagaactcacaatggtcattttgaatacttggtcatgccatttggcctcaccaatgcccctgctacatttcaaaacctgatgaacactatcttccaagagttcttgaggaagtttgtgctagtctttttttatgacatcctcatctatagtcaatccttggatgagcacttacaacacttacacaaggtggagtacttagggcatgtcatatctactgaagaggtttcaacaaaccctgccaaaatagtggcagtccaaaattggcctatgcctgctactcttaagcaacttagagggtttctaggcttggcagtagccaaaatagcctttcaacaactcaaagagtccctcacctctgcacctgccttggctatgcctaatttcacacagatttttgtcattgaagttgatgcttctggtcaaggcataggtgttgtgttaatgcagcaacatcatcccattgcctttatcagtaggatgctgaatcagcagcagcaagccctctccacttacgaaaaagagctactggcagtagtgtttgctgtccaaaagtggcgacactatctcttaagtaggccatttgttattagaactgaccacaggagcctcaaatatatgctggaacacatattgactactacatttcagcagaaatggttggtcaaactcatgaagtttaaattctccattgagtataagcaaggcaaggagaatgttgcagttgatgccttgtcaagcacttgggtttctgatgcttcattggcaaccatcattgcagcattgaaagaaaataacagctctcataagcattacacttggcttaatggtcaattgaggaggaagggtagattggtggtaggaaaagatctccaacttagacaagaattactacattggtttcataattctgcaccaggaggtcactcaggcagaactacaacttgtaaaagaatccagggattcaatcttcctcaggaaattctggcaggaattaatggcattctagggtgtatgtgtgttgattctcctcaacaatggcctaagtggttacctttggcaaagtggtggtacagtaccactttccactcagctattcagactacaccatatgaagtagtatatggtcagccccctcctattcatctaccttatttgcctggtgaatcaaaggtggctgataagcacaggtccgacaggcaattttctattggagacttggtttatgtcaaattgcaggcctataagcaagtgcccattgctgcgagagctaataagaagctagcacctaaatactttgggccatatcccgtgattagtagaattggagttgttgcctatgaattgaagttgcttgatcatacaaaaattcacaatgtctttcatgtttcacaacttaagaagcatattggtcaatttattcattctctaacactgcctgattttattcctgaagctacagggcctaaagaaccagcagcaatactggatcgaatgacagccaaaagaaggggacaagctgtcacaaaagtcttaattcaatggaaacatcaacttccatatgatgcaacttgggagttctattatgacttgaagaggaggtttccacagttcgattcttga

SEQ ID NO: 40608 - DNA, 1062 bp, Glycine max
  Peptide Sequence Number=SeqID_157386
atggggttttgtatatcaggatcttcagactctatgataaggctttgggatcttggtcagcaacgctgtgtgcattcttatgcagttcatacagattctatttgggctcttgcaagcacttcaacatttagtcatgtttatagtggtggtagagactcttctttatacttgacagacttgcaaacaagagagagtgttttgctttcaaccggggaaaatcctattcttcaattggctttgcatgacgatagcatttgggttgcatcaacagactcttcagtgcacagatggcctgctgaaggacgcaaccctcaaaagattttccatagaggcaatttgtccttttccagagcaagggtgtcactagaaggatctacccttgttcctgtatataaacaaccaactttaactattcctggcatcccttcaattgtacaacatgaagttttgaataataggaggcatgtcctgacaaaggatacttctggttcagtaaagttgtgggaaattacgaaaggtgttgtagttaaagattttggaaaggtttcatttgaggagaagaaagaagagttgtttgagatggttagcaatattccagcatggttcacagtggatactagacttggatgtttgtctgtacatttggacactcctcaatgtttttctggtgagatgtattctgcagatcttaacattgtaggcaagcctgaagatgataaggttaacttggctcaagaaacactgaaagggctcttggctaattggttgataaaaagaaagcaaagaatgggaactccagcccctccatatgataatgcggagttactatctggaagtgttacacattcaagaactgagcttgatggaagttctgagactgagataatggtttatcctccattcgaattctcagatgtttcccctccttccattattaccgagggaacccatggaggtccgtggagaaaaaaaatgtctgatttagatggaactgaggatgaaaaagacttcccctggtggtgtttggactctgtattgaataatcggttacctagcttctag

SEQ ID NO: 40609 - DNA, 821 bp, Glycine max
  Peptide Sequence Number=SeqID_157387
atgcatcgtgttggtagtgtggggaacacaaacaattcaactcgccctcggaaggagaagagattaacgtatgtgttgaatgattctgatgacaaaaggcactgtgcaggcataaattgtttgtctgttcttaagtctactacatttgatggatctggttatctcttcactggaagtcgtgatgggaagttaaatcggtgggcactagctgatgacatgccatcatgctctgctacctttgaatctcatgtggactgggttaatgatgttgttcttgttggtgataatgttcttgtttcgtgttcttcagatacaacccttaagacatggaatgctttgtccacaggaacatgtactaggacactccgtcaacactcagattatgttacttgccttgctgtggcagaaaaaaatagcaatgtggttgcctctggtggccttggcggggagatttttatatgggatattgaagctgcactagcttcagctacaaaatgcaatgatccaatggatgatgatgataattcaaatgatatcaatgtttctggaaactcattaccaatgacaagcttacataccatcagctcaagtaacagtatgtctatgcacactactcaatctcaaggatacaatccaattattgccaaaggccataaggaatctgtttatgcattggcaatgaatgaaggtggaacacttcttgtctccggtggtacagaaaaggttttgcgtatttgggatccgagatctggatcaaagactttgaagctaaaagggcatacagataacatcagggctttacttctggattctactggcag

SEQ ID NO: 40610 - DNA, 582 bp, Glycine max
  Peptide Sequence Number=SeqID_157388
atggtttgtcatgctgaaaataccattgaagtggatgagtgtagaactttgattgacgcattgagtggcaacttggatgaactgaatcagcagaagatgaatgttgtgaagcaattatatattctacaagagagaatcaataaggagggtgctgattctgcagcacagaagttggtttctttactgacgtctttgaaggatcttaaaaagcaggaaaattactttcagtccaatcgtgatactaaacactcagaacttcaagatgatatcagtgaattagagaggaaaataacaaatgactgtgataccgagaaccttcctgatgaactatatcattcttttagtgaattaattgaaaaagtcaatttgatgaaaaagtttcaagaggcctttagtagcactgatggacgtataaaacttgttcattcgatggaaggaattgtcaagggaaatcaacagaagctagaaagggttcatgtaggacttcaagatgaagagaaaatttgtaatgatctaaagtataggtatgctgcagcaaccggtgagcagaagcgctgctattctctgttgaaagcttttcag

SEQ ID NO: 40611 - DNA, 1029 bp, Glycine max
  Peptide Sequence Number=SeqID_157389
atggtcccaaggttgtgccaagctcatttaactaaaaatttcacatttttacatgtgatatacattcacaaggattcagaagtatgtttagtggtagttggggaggctccttgttcatatggagaggtataccatgctgactggaatggcacggaggttgctgtgaagaaatttttggatcaggatttttcaggcgctgcattatcagaattcaaaagagaagtgcggataatgcgtaggctacgtcatccaaatattgttctttttatgggtgctgttactcgtcctcccaatctgtcaatcatttcagagtatctaccaagaggaagcttgtaccgaattcttcatcgccctaattgtcagattgatgagaaacgaagaataaaaatggctctggatgtggctaggggcatgaattgcttacacaccagcacacctacaattgttcatcgagatctaaagtctccaaatcttttggttgataagaactggaatgttaagcctaaagctgaaaacgaaacccaggtatgtgattttgggttgtcacggttgaagcacaacacttttttgtcatccaagtcaactgctggaacgccggaatggatggctcctgaagttctccgcaatgagccctcaaatgagaaatgcgatgtttatagttttggagtcatcttatgggagcttgccactctaaggttgccgtggagtggaatgaatcctatgcaagttgttggtgccgttggtttccaaaaccgtagacttgatattcctaaggaagtcgatcctatagttgcaagaataatctgggagtgttggcaacatttccagtttatgacatttttctggcccccctccccgtttcagggatccaaatttgcggccctcgtttgcgcaactcacagtggctctaaagcctctacagcgtctggttatcccatcttatcaagatcagttagctccacctatgccgcaggagatttctgtaaattccaccccctgaaatgtctcgcttcaagtgtgaataattag

SEQ ID NO: 40612 - DNA, 180 bp, Glycine max
  Peptide Sequence Number=SeqID_157390
atggtcaaaaaagaattgttacctcaaagaatgcatagcaaaatacaagatgcaagatcaaactgcaaccatagtagtagaagatgcattgttgaggtagttcattttttcaagcgcgaacaacatatagatgatgagttttataaagaattaagaaaaattctaaaaagcaagtattaa

SEQ ID NO: 40613 - DNA, 273 bp, Glycine max
  Peptide Sequence Number=SeqID_157391
atgtcagaatacactgtttcaaaggcacgaaagaacttcttccgtgagagtgcacaaaagaaccttcttctgcagttgaaattaacaactgcggaagaaccttcttccgtgcattcttgcggaagaacttcttctaggaaccttcttccgtgcatttttgcagaagaagttcttccacaggaatgcacggaagaaggttcttccgtagttaatgttacaatttcggaagaaccttcttccgcagttgaaaataacaactgccgaagaagataa

SEQ ID NO: 40614 - DNA, 1084 bp, Glycine max
  Peptide Sequence Number=SeqID_157392
atgagtgagagagtgaagaaagaaaagcaaacgggggagaaaagggagaggatgaagaacatcttcaagaagctgcacataggtagcagccacgatcctcatcgatccaatgaggcttcaccgtctgtgccgtcgccgtcgtgcgttgccgatcagtcccagagctccgccgccactccggcgagtccttcgtcggcgtcggcgtcggcgtccacggtggtggtgactcccggaggaggaggcggcggcgcgagtccggtgatgaatcggcaggactttttctcgtcggaggaggagtttcaggttcagctagccctagctatcagcgcttcgaattcggagttccgtgaggatcctgagaaggatcagatccacgcggcgacgcttttgagcttgggaggccatcgaatcgattcggcgcggaacaaggatgatgtggcggaggcgctgtcgaggcagtactgggaatataatgtgcttgactatgaggagaaagtggtagatggtttttatgatgtatatgggccctataatgattcagtaatgcaaggaaagatgccatctcgaacagatcttgaagcaaaccctggaggttctgagttggtcattgttaatcgaacaattgatccttctctggaggaactgatacaaattgcacaatgcattgcattagactgccctgtctctagtttggtacaaaggcttgctgaacttgttacaagtcatatgggtggtcctgtaaaggatgctagtattatgttagcaagatggacagaaacaagagcagagttaaagacatctcttcacacaattgtattgcctcttgggtccttaaatattgggctctctaggcatcgtgctttgcttttcaaggtattagctgacaacattaatatgccttgtagactggtaaaaggtagtcattacactggtgtcgaggatgatgctgtcaacattataaagttggaggatgaaagggagtttttggttgatctcatggctgctccagggacacttatcccagctgatattttaagcaccaaggatagtgcctttaagccttacaatcccaagatttggccaa

SEQ ID NO: 40615 - DNA, 915 bp, Glycine max
  Peptide Sequence Number=SeqID_157393
atggctcagcctcacaatggcaacaccaatagcactgcgaaccagcaattggtccttcatgactttctgggtatgaagcccgccgccgattccccccaaaccgccgatgttaggtttccggagccgtccgcctccgcctcctccgccggaggacgcggccccttctccgccacctccgacatcgcttccgagaaacagataggaaatcatctcgagggagttccattctatggcccgaggagtgatttttctggcactgagataagcaacagattagtgggaaacaagagaagtaattctgattccacttttatgggttcctccagagatgccttgcaaatggtccctgattcctttcaaaactcacatttgatgaaggttctccgcagtgcggctgaaggagaaaggtcacaaaggcccaatgacgatgaagtgttacttggtatgcagtcaatgaagccatcctcttctcagatatttcagcctcccaccagcactaagattgatgccaataaatgggaacgatctattctcatgaatgttggcccttccatgcagcatccactgcgtggggcgcaattggcaccttttgtgcaccaaatggcttcaagcaagattagggattccaacgctggcccttcattcatctctcagtcagctgctgatgaaggatctagaacgggaatcaagggccctggaattttaagttctataaacgcagctgctacagccactgagaaaactattccatctgctgtgatgcttggtggcagcaggccaaagcctggaactaatataatagaatcatccacacctccaagcagtcaacatgggttaacttctgcctgccgccagatgactattttttatggaggccaagctcatgtttttgatgatgtccaccctcataagtga

SEQ ID NO: 40616 - DNA, 321 bp, Glycine max
  Peptide Sequence Number=SeqID_157394
atggatgtgaacacaatgttaatgtctaatgatcgattttcatgtgttggaccgattgagttgttatgcaccgttggtagaacactagatgaaattttaaacttacttgaacgcactatgactcctactcatgatgcgattttgtattacaacggaaggtggaacatgccacaccaaaacaactttgtaggttacacattcacaggaaaaattccccaaaaatttgatattacaaaaggatgtgccatagatgaactgaaggatttgatgaagcaagtagcacctaaagggattcctcctcataggattcatgaatcctaa

SEQ ID NO: 40617 - DNA, 243 bp, Glycine max
  Peptide Sequence Number=SeqID_157395
atggaagaaaagaaagatggagaagatagcacttttaataaaggtgaagctgaggttaccatggctcatgcaaagagactagtgcagagtggggtgcttcctcctgatattggaattattactccatatgctgcccaagttgttcttggcttcgtggagaatggtgccgccaatgtcgcagtcgtgattaaagagcatgaggcggtcaactatcaacttgagtccaatgagttggagaggtag

SEQ ID NO: 40618 - DNA, 865 bp, Glycine max
  Peptide Sequence Number=SeqID_157396
gaagagtgggaaagagaatctgttcaggtgcacctacgtgcttccggatggtgtcacgtacacaaaggggtttgttaagtatccagatcaggcgcagcgatatcttgcattgagggagggtggccttcattcttcatcaccagtgcaagcgcaggaggatgtgaatttcacggaaattgccgagcacccagagaacaggaagagagttgatttgacaaaaaatgaatttgacttgacaaatgaacggtttcttgtgccagagatgatcttccgtcctgctgatttggttgggtgttctcttatctgtaaaatgctgagaaaaaggtttgcaggaatgaaccaggctgggctagcagaatgcattgtacgtgctgttaatgcgtgccatccacatctccgccctgttctctatgaaagcatcattttaactggtggaagcaccttatttcctcagtttgccgagagactagagaaggagcttcggcctctagttcctgatgactatcgtgtgaagataacgactcaagaagatcccatactaggtgtttggcgtggaggttcactgttggcatcaagtccggattttgaagctatgtgtgtgaccaagtctgagtatgaggagcttgttgatgagattcataaagatgtcacttttttttatctctttcattttccaattcctacatcttcctcgcaagcaaatgccacattggagagaagatcagaagaccatggactgctagtgcaggaagtgtgtaaatggagaatattgattgaacccactgtacgtcattgcactgttcagcgaatgttctgtcctcatctttccaacggattcttacacgggaccaaggcatactggtaa

SEQ ID NO: 40619 - DNA, 102 bp, Glycine max
  Peptide Sequence Number=SeqID_157397
atggcttcacaatatgaggttcctgcggctacagcgctccacttatgcaaattccaaagtcacggattggaggcttctgtgcttctagaacaaatctcataa

SEQ ID NO: 40620 - DNA, 666 bp, Glycine max
  Peptide Sequence Number=SeqID_157398
atgcttgaagacaagtcgatgtgcgagtttctgcttagaatcaaagccatttccgactcacttgcctctgttggaagtccaatttctcttcaggaacacactgatgctttacttgaaggtcttccacaagattatcattcagtaatctcagttattgaaagtaaattccaacctcttcctattgaagaagttgaactttggtcattgatggaagttttaacagagacggcggttgtggtggtggtggcggcggttgtggccatggaggaggacgctttgcaaattttcaatgtcaattatcaactgaatctttcattcacactacatgatccttcaaatcaaggaaatgttcagaccaagtcctttggtcaaaatcagtattttcaaggaaactctaataactctggtcagaataactatggacaaaacaatggtttcagatcatcaaattcatggaatcaaggaactaatcagaatgcgtcaatgctgaacaaccaaagtcaacaacctccaagtgcaatgattgcaaactccaattttcagcttggtccagaccaaatctatattggcaatggacatggcttgcctattaattccactggttcttccacttttacctctcctattagtcctaaagtgtctttatccttgaatcagcttctacat

SEQ ID NO: 40621 - DNA, 1848 bp, Glycine max
  Peptide Sequence Number=SeqID_157399
atggctgttgggtcgcttggagacaacataggattgaaagaagagttcatcaccaatgtgtgtggtttggccttccaagctaacatgtcaccggagaatctctaccatttccatgagattgagattttttccgaaatttatcatgttttcagcttttcagggtcttggaacccccatgaatggcttgttaataacaaaccttttggggaaacaaagatagatcatgccctgtttccttcacttagaagtattggcaatgatgaagctgctttggtgaatgaaggcttcgcaaagagattcgacctcatattgaaaactagctccattaaatctgaggtgaataaggctatggttgatggaaagcaagtagtgtttacagggcactcttctggtgctgcaatagcaattcttgctaccttttgggccttggaagagtaccttaacccaaccaaaccccaaaacctcaagcatcccttttgtgttacttttgggtctcccttaattggcaatcatatattctctcactcttcaaggagagaaaattggtctcactatttcatacactttgttttgaggtatgacatagtgccaaggattttgcttgctcccttctcttctgttggccaaacttttagctctattcttcaaatcttggaccccaacttcgaaacttccacccaagacccaacaaggaattgtgtaatctctcaattttactcaactgtgatgacaaacgcagcaactgttacaagccatgctgctggcattctcatgggcagcacaaacatgttattggagacagtgacgaattttgttgacttaagcccttataggccctttggaacatatgttttctgcaatggaaatggacagctgattgtggtgaaaaactcagatgctgttttgcaactcttgttccacactgctcagttaagcaattttgcagaactagaagaagttgccaataatagcatattgcaacacctgaactatgtggctgagttgcaggaaagcttgggaatgcagaatgtagtgtacttggagcaacttgagcaacttcccttgtcagctgatggttcaaatagcgatgttgcaacagccttggatggccttggactgagcccaagagcaagactttgccttcgagcagcagcaaatttggcgacaagaaaacttgacaacgaagataaaatcaaacaaaagaaagtttttattgagcaaaaaatgaaagaccttaaaaaatacagagaaatgtgggagcatcaaaacgttggtttctacgatggcttcagggagcacaagaaaaaagaggacttcaaggcaaatgtgacaaggctagagttggcaagtgtgtgggacgagatcatggaaaagctaagaagttaccaactcccagatgagtttgaaggcaacaaagaatgggtagatcttggatcaaggtttcgacaactaatggagcctctagatattgccaattattaccgtcatgcaaggcattacgaggatggttcttcttcttacatgcttaggggaaggcctaaacgatataggtacacccaaaaatggttggaacatgctgagagaaggccacaggaacctagctccacatcttgtttctgggctgaggtggaggatcttcgctacaaaaccagttatagtaatagctcatcatttgaagatgttaaggaaagggttgagcaattggaggctcaattacaagcatggagcgaaaagggggagttggctaatgatgtcttcttggagggttctaccttggtcaagtggtggaaaactctacctctacaacacaagcaacaatcatgcattagaaatctaataaatgagtga

SEQ ID NO: 40622 - DNA, 729 bp, Glycine max
  Peptide Sequence Number=SeqID_157400
atggtcggaaaaacaatgtccatggcggcgacttcccgcgaaaagctggcgagtctcgtgaacgccgccaagctggccatcgacatcccttcgaagctagaatcgctgcgccaactccgccacgaacttccccccgaagaccccgttctcctcaccgagttcctcccctcgctcttcctcttccactccgatcgcttcggccccgttcgcaaattcctcaccgagattgattctggaagctatccttccctcactcttcctcttccgctccaatgcctcggccccgtttgcaaattcgtcactgaggacacctttttcccgttggtctctaagttattcttagtgatgcttggggagattggattgaagaacacagagttcttgtccaacattgtgcctgtgcttattgatttattggatgacgacacgccggcggttgttcgccaagttctactgtgcggaactgacttgtttcgcgccactcttgagaaaattgtggttcagggtctatactctagtgatttagatggtgcccttgaatctgcttgggcatggatgcttaaattcaaagacaaagtgtactcaatagcttttcaacatggaagtggtggcgcaaagctgctggcactgaagtttgttgaggcagttattcgtctttacacacctgatcccaatggttcctcagagcccacttctcatcaaggtattacattgagattggttgggtaa

SEQ ID NO: 40623 - DNA, 1024 bp, Glycine max
  Peptide Sequence Number=SeqID_157401
gtccaatcgtggtggtgagaatgatgatgatgagccagcgtttgatcccgcttggcctcatttgcagctggtgtatgagttgctgcttaagtttataacctcaaattgtctcgatgctaaggtggctaagaagtacattgaccattcgtttattttaaggttgttggagttgtttgattcggaggatcctagggagagggactgcttgaagacgattctgcatagggtttatggcaagttcatggtgcataggccctacataaggaaatcaattaacaacttgttctataactttgtgtttgagaccgagaggcacaatgggattgcggagttgttggagatttttgggagcataattagcgggtttgctttgcctttgaaggaggagcacaagatcttcttgtggagggttttgattcccttgcacaagcccaagtctattggggtgtacttccagcagttgtcttattgcgttacacagtttatagagaaagagcccaagttggcaagcattgtgataagggggatgttgaagtattggccgataacgaacagtcagaaagaggtgatgttcctgggtgaactggaggaaattttggaaacaattaacatggtagagtttcagagggtcatggtcccgttgttttggcggattggatgctgcattaacagtttgcacttccaggtagctgaaagagcccttttcttatggaacaacgaccatattgtcaacttgattgctcacaaccgacaagtgatcctgccaatcatatttccagccttagagaagaattctcagggccactggagccagtcagtgctcaacctaacttataacgtgagaaaaatgtttgtagagatggatgagaagctgttcctggcttctcattctcaattcaaggaagaagaagtaatgctaaacatggcggcagagaagcggaaggaagcgtggaaacaactcgagcatgcagccagtctccagcctgcgattggaaataccccagttttagtatctccaatttga

SEQ ID NO: 40624 - DNA, 135 bp, Glycine max
  Peptide Sequence Number=SeqID_157402
atgagtcaaaaacaagctcaccatcataggaagtcatggataagagctttaaggaaccttcgtgctagtgttgggaattttgttcttgctagaaaggtggaagcagctaagaagccaaagaaaaacttgaagtaa

SEQ ID NO: 40625 - DNA, 1032 bp, Glycine max
  Peptide Sequence Number=SeqID_157403
atgactaggtgtatgcttaaagggaaaggactaccaaattgctactggggagaagttgtcaccacaacaacttatgttttgaatagatgtcccaccaagagacttcaatctataacacctgaagaagcttggaccggagacaagcctacagtaaatcatttaaggatctttgggtctcttagctatagacacatcccagacgaaaggaggaagaagttggatgataaaagtgaagctcttatcctagttggatatcatccaactggtgcatacaaactttatagccccttgaagcagcaggtggtgattagcagagatgtcgtggttagtagagatgccgtggtagacgaaattgcagcctggaagtgggaaaatgattataaaattcacaactcatatattcttgaggacagtccaagagccaaggatgttaaccctgctagctcaatgcaaccttctataagaagttcaatctctgatgttggtgaaatggtacagttcgcttttatggttgtcacagaacttgtacattggaagcaggccttgaacatcagagaatggaaggctgctatgaaagaagagttggatgccatagagaaaaatagaacccaggagctggttgatttgccacataataaacatccaattgatcttgatgtcaaaactgcctttttgaatggtccattagaagaagaagtatacatcttgcagccaccaggatttgaaataaaagggaaggaacacaaagcccctcgagcttggaacagggtgattggcaatttccttggcaaacaaggatttgtgaaatgcacagtagagtttggtgtgtatgtaaaggaaactcagcacaagaacttgctatttgtatgcctgtatgtggatgatttgatcattacaggagacgaggatgaagaaatagagcaattcaaagaaaagatgaagtcagagtttgacatgatagatcttggaatcttgcattattttcttggttttgaatttatgcatacacagaagggaatcttcctacactaa

SEQ ID NO: 40626 - DNA, 363 bp, Glycine max
  Peptide Sequence Number=SeqID_157404
atgttggaggagcaggccgcgccgcattattgctggggcacccagcaaacagtgaagtggcgaaactgcccttcagcaattattcttccggaagaaggttcttccggaaaagttccggaaataatttttccggaaagtttctggaagaatcttcttccggaagatcaatttgtgtcttccggaaatactcacagacaatttccggaagaacgtcatccggaatgtttccggaagaagcttcttccggaagaattccgttgtcttccggaagaagcttcttccggaagaagcttcttccggaagttagtttttttttataatgcgtatgtaatgacgattttgcccttgtgtaaatttctttaa

SEQ ID NO: 40627 - DNA, 1158 bp, Glycine max
  Peptide Sequence Number=SeqID_157405
atggcgcgccctactcatcatgtcattgacatcacggggagttcccgaccttccacttcgtcttcttccacgccccatgataggcttgccaatgatgtggattttggtgccttgaattctaggactagaaggcgaggggatactacgcgtagtaggcagcataggagtcctttgaattcgggtttgtggatatgtgttgagttagtgatcacagtgagccagattgttgcatcggttgttgttctgtctttgtcaaagcatgagcacccgcatgccccgttgattgcttggattgttgggtatgcgtccggttgtgttgctaccctccctttgctatattggcggtattatcataatcgtggtgttcgggagcaagagtcgtctcaggcctctccgaggagtaatgatccttcaggtacacttctttccgattcaacgaccaatggaggggaagatgctccggcatcttccagaactagaagcaatcaagagtcgtggttgatgaatgcaagattgaagctacttgtggaatacttcaaaattgctgtagattgcttttttgctatatggtttgttgttggaaatgtatggatttttggaggacattcatctgctgatcaagcacctaacttatacaggttatgtgtagtgtttcttacttttagctgcatcggttatgctatgcccttcattctctgtgcaacaatttgctgctgcctgccttgtataatttccatccttggagttagagaggatatggcacaaacccgaggtgcatcctctgaatcaattaatgctctgccgacttataagttcaaaatgaagagaaataaaagcaaaggggaaagcaactcagctgttggtgaaggtggagttgtggctgcaggaactgaaaaggaacgtatgatctctggagaagatgcagcttgctgcatctgcctggctaagtatgaaaataacgatgagctgagagaattgccttgttctcacctatttcataaagattgtgtcgacaagtggttgaagataaatgctttatgccccctttgcaagagtgaggttagtgagaacgtaagaggatcagtctctggggtagatgccaaccaacatgagggtgaaagcagggttgagaatggcctcaccaacacctcatcgtaa

SEQ ID NO: 40628 - DNA, 426 bp, Glycine max
  Peptide Sequence Number=SeqID_157406
atgggaacaaatcaaactggaaaaagattctatcaagtcaagattaagggcctagatgtcaccagccttaaggagttgggattgagagctgttgaaggctttggcgactatccattcgaggacatggcggatctttgcttggtaccggacgtcgtcatccccccaaaattcatggtacctgattttgacaagtacaaagggacgatttgttctaagaaccatctcaagatgtattatcgcaagatgggggcacattctagggatgaaaagttgttaatgcactttttccaagatagcttggctggagccgcggtcatttggtacactaatctggaagcttcccacatccgtacttggaaggatctgattactgccttccttaggcaatatcagtacaattccgatatggctcccaatctcacttag

SEQ ID NO: 40629 - DNA, 544 bp, Glycine max
  Peptide Sequence Number=SeqID_157407
atggatgctattcttggattccaagaacttgatgaaatcgagttgcatcgagagaacaagcgactagactgcaaggctcgagttcttttgcatcaatgtgtttttgcaaacgtgttccaaaaaatttcacaagctgcaacctcgaagcaagcatgggatattttgcaacaagtatatggcaatactgggagaacaaagaaggtcaagctacaatctctcagaagacaatatgagttgttatcaatgatagagcaggaaaccatcatagattattttaatcgaattcaggtggtgacaaactcaatgcgagcctgtgatgaagcaatggctgattcaaagattgtggagaaggtgctcagaacattaacacccaactttgatcacattgtagtagtcattgaagaatcgaaagatattgagaatatgaatgtggaagaattgcaaaactccctggaggcacacgagcaaacggtgctcgaaagaaagaataataataaagttgcagagcaggcacttcaagccagaaccaaccacaagtctagag

SEQ ID NO: 40630 - DNA, 156 bp, Glycine max
  Peptide Sequence Number=SeqID_157408
atggcattcacagcagccataacaacacgcctgcagcagtgctctcaacaacaacaacaatgttgcttccttttcatgggtccctgtctatgcacaagctctggaaatgagtttttatatacaacaacatacaactggatgctgaattgtaagtga

SEQ ID NO: 40631 - DNA, 184 bp, Glycine max
  Peptide Sequence Number=SeqID_157409
tttgagtatcccagtcagtgacatagtgagccctggttatgagatgagtgtagcaaatgaagggatgccaataacaaaggagcctggtcataggggtgatttgaggatcaaatttgatgtgaagtttccaacaaggttgacccatgagcaacgagcaggactcaaacgagcactgggaagttga

SEQ ID NO: 40632 - DNA, 3372 bp, Glycine max
  Peptide Sequence Number=SeqID_157410
atgtccaacaatctggtttcagagccgataccaagtatgcagatggctcaactggagccccttatgaacaaggttgattcatcagggagacaggtggaaatggggctcttgggtcctgtatccagtgatgttattgtgtcacagtcgcagggaacctcgaatgagcatgttggattgttgagagctgtacctggtgaagcaagtaatccaggaatgcatcaaattctgtccgctaacaaacactccatgctaatggatatacttccaaacagctcagggccacagcagcagccaacaactcccaagcgcaaggcaccgatggaattattgtccagtagctcctttaacaagcgggttgcacagatgggaagtagaccttggttgcagcaagtacctaatgtatcaaataaaggttctctgcagatgcaatccccatcacatgcctctaggacacaacatttggcagcttctagtaagagaaaaacgcagttggataacactcccagtaaatctgggacacctcggtccatgagttctaaaagtcaaaatacacagatgaagcagtcctccaaggttcaaactgaatcatctgatagtgttaggtccaagatgagagagtctttagcttctgctctggccttggtttgtcagcaaggtaaacttcagctcccaaacaataatacaccaaatgatgctgccaatagtcagggtaaattagagaacagctctcaatgtgctggatcagcacctgcttccattgatgcttcactggagcaaaggaaggatatttctcaatcagttaattcttcttttgctgatgctgattcagttggcaatgtggtgggagagcacatgcaaagtacagcttatgaagattttccagaaaaatacaaggactacgaagcaggacccacaaacacatcaaacaatgaaagcatactgagttctatgcatgtcttgaaccgtgataagcaagatttccagtcaagttactttttgactactgatgctgtttctttcagtgacggtttctttatgaaagatgatcttttacagggaaatggtctttcatgggtattatctgatatggtcgatgtgggaaatcaaagggaaagtcaaattaatatagagcagagatcagaacctgaggaatcaggtggaggttgtagggtggaggtccctttgcctaaacttttggcatcaagaatagaggcagaactcttcaaactgtttggaggtgtgaataagaagtacaaagaaaaagggaggtctcttttattcaatttaaaagatcacaataatcctgaacttagagaaagggtcatgtttggtaaaattcctccagaacaattatgttctatgacagctgaggaacttgcttcaaaggagctctctcagtggcggatagccaaggctgaggagcttgctcaaatggtggttttacctgattcagatgttgattttagacgtttggtcaagaagacacataaaggtgaatttcaagtggaagttgaacatgaagacaatgtccctgtggaggaggtttcaggtggcacaacctctgtggctcaaagccaaacaataaaaaaggatgtggaagatgcttctccttccaaacctgatgtgaacactgatggtgagaagggaaatttacagaaggatgatacattttccattaccatttcttccaacgacggggctgatcccatgcaagggcttatgactgatgatgcattaaaggaccctgactttcttccacctattgtatctcttgatgaattcatggaatctcttcattctgagccaccatttgaaaatttaccagtagaatctgggaaagtgacacctacctcagacaaggatgattctggggttggatctaaatctaaatctgctgatttaacaccaaatgagcaagctgatgtcaacgctgataataagtctgagaagtttcagagcacgcgtgtgaattcagatgctgaaaaggagaaaaagattaatgctgaatctggggccatttcttctgatgcgggatactgtgggagtcaagctgacatgaagtcaactgatggtcataccaaggaaaggtcaactgatgatgtgaagtctgcttctagcgatgctgagttgagaggcaatcagtttcatctggaagagagatatggtaataataataggtactcaaaggatgcagttctcactaagggtgaatgcctctgggagggaatgcttcaaccaaatatctctagcactcattcagtcgtaagcatctttaagagtggtgagaaaactgctgctgaagactggcctgggtttcttgagatcaagggaagggtgcgatgtgatgcatttgagaaatttctgcaagaccttcgacagtccagaagtcgggcaatcatggtttcacatttcgtttccaaagagtcggatgatcaatcaactctcagtgaggtggctgactcgtacgttttggacgagagagtagggtttgctgagcctgcccctggagttgaactttacttttgtccacctcataataaaacagttgaaatgctctgcaacataattccaaaggaacaaattgaggaagttaattctattgataatggcctaattggtattattgtatggagaaaaactaatttaacttcgtctatatcacccaccactgaatcacatcacaaacatagctctaaaagacaatacttcagtaggagacagcaagatataaatatgaatgccaattctacccttaaagcagtgccctctatgggtgttaagatgactgagaatgatgatgatgacgtgcctcccggatttgggccaccagtggcccaagtggaggatgacctgtcagagtttagtttctgttcaaatccatcacacttgggtcaaaaaccaatggggtcatcaaatgtggtcccattacacccggttaacccagctccaccatgccctgcagaacaaatgagggaacttgtacacaaatatgggcaaaacaaaccaaatgtaccttcgataaactggcaggataaatttgggggaacaattcaaccctggaatgatgatgatgatgacatacctgaatggcagccccaaaactcccagaatcagtttcctccccaacagacaatgcacaactttcatcttagacctcacattttgaatcaatcatttccgggttcacagcaacagccaatcatgacaccacaatatctgcaacccccaatgaatgtgacccatggccaacgaaattttgaccctcagggggttccttctccacagggtagcaacctacagccaagaggtggaccaccctatgcgcaaggcactacctggcctcaacatgcgtctagcagtacaggatattag

SEQ ID NO: 40633 - DNA, 267 bp, Glycine max
  Peptide Sequence Number=SeqID_157411
atggtttgcctaggaccattgtgtcagatagagatacctaagttccttagccacttttggaaaaccttatgggctaagctaggaactaaacttcttttctctaccacttgtcatccacaaactggtgggcaaacagaggtagtgaataggtctttgatggaagcttgcttgtggggcttctatggaggctggatctttgagcttcaatggggtcctttaatggtgattttccaccatggagatgcagcggaagacaaaggaaaagag

SEQ ID NO: 40634 - DNA, 234 bp, Glycine max
  Peptide Sequence Number=SeqID_157412
atgagctcaaaaatctaccctgaggttcatgagaaccctagggccttcttcaacaactctagcctaatcctcttggagcctcttgctcatggctctagtgattggtcccttcctagggaggattgcatcaatctaggtgatgctcttttgcctcctctatcttttgttcggtctattcactttaattccttgttcttcatcatcttctccatgtatctccttcattgtgttgtg

SEQ ID NO: 40635 - DNA, 528 bp, Glycine max
  Peptide Sequence Number=SeqID_157413
atgggtttggattactacaatgtgctgaaggttaacagaaatgcttcggaggatgatctgaagaaagcgtacagaaagttggccatgaaatggcaccctgacaagaaccccaccaacaaaaaagaagcagaagcaactttcaaacagatctctgaggcttacgaagcaagaaaccttttcccatcgttagaattgcgtcaatatgattgtgcaaggcacatcggtgattttatactcatggtactgagcgacccacaaaagagggtggtttatgatcagtatggagaggaagggctgaaagataggccaccaccagaaacgcagaggatatatttgcagaattctttggaagtagcccttttggatttggatcatcagggccaggaaggtccaagaggttcccatctgatggaggggcaacaacatttggtggattcagtgcaactgacaataattttcgaacgtatagtacaggaacaggacgggggaacatgccaaagaagccaccaccagtggagaccaaactag

SEQ ID NO: 40636 - DNA, 534 bp, Glycine max
  Peptide Sequence Number=SeqID_157414
atggcctccaagaagcgtaggagcattggggcaaggccaactgctcagtatgatactagacggttccattcacttgattcttggaaccattatacagataacattttgggaaggagtattttgccaaaaagaaaggttgagatataccacacagagtttgatgacttcaagacagagttggagaggcataatcttcacaaacgcctcaccaacttggctgatgggactattgatgttgctttggtgaaagaattttatgctaacctctacaactctgaggatccttcaccaaagcaagccagagttagaggccacttggtgaagatagatgccgacagccttaacacatttctagagactcctgtagtcctagaggagggggagacattgcccacctactctcgatactgcaggttaccaatagaccatagagagattgagactgctctttgcataccaggaagggggttcattttgaatgctgagggccattcgagaaggattctcaggaaggatctgactacattggcccag

SEQ ID NO: 40637 - DNA, 297 bp, Glycine max
  Peptide Sequence Number=SeqID_157415
atgaagaatttccacagaatcgcttacggaagcgtttcggaagcgcctcggcttagattttcttcacggaaacgatttttccaagcaaattcgaaagagagagaagtgccaaaggggctgaacattttgaaacagctcccccctcccctatttatagaaaaaaaaggaggttttcggaaattttacggaagtattacggaagccgcggaagccccgaaaaccatttttcaaaaacgtggaggagcttgccgcccagttgcttcctccttaagcaacccaacttccaaaatgttctag

SEQ ID NO: 40638 - DNA, 390 bp, Glycine max
  Peptide Sequence Number=SeqID_157416
atggccccgaggaagcttctcgtgaagaggtccaggaaggacaccactggagagggctccagcactgccccgcatgttgacatggacttcgatcggcattggttccagagctgcgagtacagccaggggaggagtcaggcctctggctttgatgaggaggctatcacccaactgctatgcataccagggcaagatttcgctcagaccgccgcagggagacgggtgagtgtgcatatggctcagctgatctctaacgccatttatcaatttgcaggtattgcacccatgagacaccctgtggacccggagaagtccaacagggccctggggtttcccgctctaattacgagcctctgtcagttctacggaatgcccgtcgcctccagcaag

SEQ ID NO: 40639 - DNA, 270 bp, Glycine max
  Peptide Sequence Number=SeqID_157417
atgagaagtgccaagaaggctgaaccttttttcttcttcactcctccccctatttatagcaaaataggggaggagcttgccacccagctcgcccaggcgagcaaggttgcttcctccagaagcaacagccttctggaggaaggatctggaaggcccaactttcgaagaagttacgaaaactcacggattgcgaaaaatacctcgtttcgatttccgtcacatcacggaattttcacggatcgcgtaagcctgcttccttttgatttttga

SEQ ID NO: 40640 - DNA, 226 bp, Glycine max
  Peptide Sequence Number=SeqID_157418
cgatgcggatgaggcgccactcgatgtttccatttgcctgcatgcctttggtattgtggggtgtggttcgttagtggtgtcaagtcttgcgaacgtgagggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 40641 - DNA, 216 bp, Glycine max
  Peptide Sequence Number=SeqID_157419
gctcatcttggtggtgaagctccttcttccatggcttattccttagtggatggcgcctcctctcacctcttctcctttgtcttccactgcatctccatgggtggaggatatgcgaacagcgctaggcaatcaattcgctgggctccagtctcgatggcgaacagcgctaggcaatcaattcgtggggctccagacttgatggtgaaggacagatga

SEQ ID NO: 40642 - DNA, 258 bp, Glycine max
  Peptide Sequence Number=SeqID_157420
atgaacacattgccgagatcatcattttcatttcgaagacaaggatcttctggtcgaatatggcaagatcagatacaatttgtggagccaaaagccaatggcagtgctagtattgctacatctttggggaagaacaaaagcattaaggaggaaaatgtgtcacacttggaagaaaccataatgggaagaaggttgcatgataatagtaaacgtgccacacgttcatcatcttcatctaaaattcataacaagctataa

SEQ ID NO: 40643 - DNA, 1038 bp, Glycine max
  Peptide Sequence Number=SeqID_157421
atgggaaggcctccttgttgtgacaaatccaatgtgaaaaggggtctttggactcctgaggaagatgctaaaatacttgcctatgtagccaatcatggaactggaaattggacattggttccaaagaaagcagggcttaacaggtgtggtaaaagctgcaggctaagatggaccaactacctaaggcctgacctcaagcatgatggttttactccccaagaagaagatctaattattaaccttcatggagccataggaagcagatggtccttaattgcaaaaagactacctgggagaacagacaatgatgtcaagaactattggaacacaaagctaaggaagaagcttatgaagatgggaatcgatccagtgacacataagccggtctcacaagtcctctctgacttaggaagcattagtggcctcccaaacaccactaaccaaatggcttttatcaacaaggacttgatgatgagcaacatgccaccaacaaaaactgaaccatcagattccaacaagtcaatggtggagcacacacaagagggtcaagttcactcttgggaacaccacattccttaccaagtcatcatcaactcagaaaatgttcaaccacaagtgttaagtgaagctgcatcctcaacctcatcctcgtcttcctctaatctcacacaattaggatcaccacagtcctactcttgccaaactcctcaggctcaaatttcccctccttgttcctcctttgattggagtgagtttcttcacagtgactcatttaattggtcattgaatcccccctcaggtctaatgcaaagtgaagctgaactttccgacaataccaaaagcaatggccatgacatgcaaggagctgcaagtgagggttctggttctggttctggtgctgttgcttgtggtgctagcatggaatatcaaattaacaagcagtgtgaagctcattcatttgtggatggtattttggacagggatagtgagataagagcagcattccctcagcttttggatgcttcttttgactactaa

SEQ ID NO: 40644 - DNA, 1086 bp, Glycine max
  Peptide Sequence Number=SeqID_157422
atgtctttgaatgagtatgaaattgggtcaaggccaaacgattcatctcctaaaggagttgattctgtgtttgttgatcaccaacaacagaaacaaagagtgcacccttataattattttcgtagcaattcttctttgaaggttgccaagaatcaaggcaaaccaaaagattctacattgaaatcagatggctctagagttgagttagactctgtttcgacaggagaagtgtctacaggtcaagcagatgaaattggagagtacagaaagctgtccctggaccattgtgggattctgccaaatacctgtttgccttgcctcacttccaatgcacttgctgttgaaaaaagaaggccaatgagtcctgatacacctagttcgcggagaaagtcgctttctaaactctccttcaaatggagagaagggtcttcagatatgactttactttcccctaaggcatttaaacaaaaacatttggcaggttcatcgattccattttgtccaatagagaagcaaacccctggttcttggtcacaaattgagccaagttccttcagagtcagaggcaaaaactactttagggataagaagaaagattttgctccgggcagtgctgctttttatcctcttggtgctgacctctttttgtcttctcgaaaaattgatcatattgctcgctttatacaaattccttcaataaacgtacctggggacgtcccttctattcttattgtaaatattcagataccattgtatcctgccactatcttccaaagtgaaaatgatggtgaaggaatgaatgtggttttgtactttaaattatctgaaaaatactctaaagaccttccagaccaattccgggaaagcattagtaaattgatcaatgacgaagtggagagagttaaaggcttccctctagatacaattgcaccctttagggagagattaaaaattttaggcagagtggcaaatttggagaatttatctttaagcacaactgaaaagaagcttatgaatgcttacaacgaaaagccagttctctcacgtcctcagcatgaatttttcttggtatattgcgtattctag

SEQ ID NO: 40645 - DNA, 279 bp, Glycine max
  Peptide Sequence Number=SeqID_157423
atgcgtctaccggggaaggagagtctgctgatgaaatctcccataaccataaatgagattttggatgttagcatttcgtttctaaatgaccatttagagcaaacactgggttcgacaaaaataaaagaaatccactcaaagtgtatcaatctcgcacagggtaaggtttatggtgagtcaggattttggctcaaggcttgtagaatggctagacatgatacatgtcagggtttggtttggttcaaggataaaaagggatgccccacattatttccatga

SEQ ID NO: 40646 - DNA, 204 bp, Glycine max
  Peptide Sequence Number=SeqID_157424
atggtcatggacatggctgacacatttggagaagattttggtattcatttcaaccaatggtcatccaatatcagagcaggatttaatcatatatttttctattttataatcactcccgattgctggaatggtgaaggagttgcattaatgcagaaatttccacagaatcatcagtgtcaagattgtagttcttcagcactttaa

SEQ ID NO: 40647 - DNA, 441 bp, Glycine max
  Peptide Sequence Number=SeqID_157425
atgatcagtgaagttgtcatcatcaaaaacggggagattgtagaagcaaagcttcatgatgaatcaagattgattcaaagatgttttgatgataacaaagatgatgacaaaggtgatgacaaaaagctcaaaggtcaatcaaagaatgagttcaagatgttcaagatagaatcaagaacacttcaagattcaagaggaaagttgaagaacacttcaagattcaagagaaaagttgaattcaataatcaagaatcaagcttcaagaatcaagatcaatattcaagactcaagattcaagaatcaagagaagacttaatcaagataagtatgaaaaggttttttcaaaaactgagtagcacatggatttttctcaaaacatgtttaccaaagagtttttactctctggtaatcgattacgagattgttgtaatcgattactag

SEQ ID NO: 40648 - DNA, 449 bp, Glycine max
  Peptide Sequence Number=SeqID_157426
gtatgccacccaccaggcaccctctagacccggataagtctaacagggccctggggtttccgacattgatcacgggcctctaccagtcattcagggttcccgtcactcctagtaaggtgatccgaccaccgatcacccgggccttcattgagaagtattgcacgcctaggcagacgcagggtgatgcaccgcaggctgcagacgcatcgccaccacctcatcaggctgatcccgctgggtcattaggcatggagcgttatctacaacacttggttcgccagcagggggccaaccaccaggggcagaacagtttagggctaaggtcgcatggccccgaggcccaggcaggggaggcgcctgcagaagctcccggcgatgcaaaggaggcccgcaaggatgaggagatgacggacttgctcggtttcttgggaggaagcagagccacatga

SEQ ID NO: 40649 - DNA, 447 bp, Glycine max
  Peptide Sequence Number=SeqID_157427
atgcagtctagaattgagacccgcctcaatgacttgatagagatatcacgagacgggaaggcgttctatgaggaggcctcggatcgaatagagagctcggagctttccgatctctttatgggcattgcaggcgtgaaaggcgagctggtcgaagagatcagtagaattgtctccagaagtggtggtcgtcctgcagagcgaggcacattggtgggtgcaatgcatcagtattatgggaagatgctcgcggcgtttggcgagacccagtaccaatacttgaaagagttggagaagtctgaagagcgtcttgttcagacgttcaacgaagttctcaatgatccggagctatcacaggacgtgaagagggaggttgcgcggatgattcccaaggtcagtgaatgccattccgtcatgttgaatcggctgcaatcgatgcatcgacactaa

SEQ ID NO: 40650 - DNA, 1155 bp, Glycine max
  Peptide Sequence Number=SeqID_157428
atgctggagcaggtcctcgcgattgttgcgtggcgtgttgacggcgcggctgaggcggcaggccagctattgctggcggcttgctgcgcctctcacagcgcgcaccatcgtcttgcggtgaattcatcgcgatggagtgatttatgtatgaacgacgtcgacggctacagatacgcatccagcaccaacttgaagggctgcgagcgatatggatacgggtcaagtatcggagtgaaaggcttcaagcgatacgggtacatgctcgacgcagaagtgatcgttccatggaggctgcgttcctgcgagcagcgaatccagctcaagatattcagtgagagtcgtggtttggtgtgtggctcattaggtggccgtgcagcgcgactccttgagaggtcggtcgtcaacagaataggggggcgtcatcaggagaggaggtggtcccagcatcgagacgcaaggcgtcttgcagcggcctcattgtctgcacggccagaacgcatttctagccttctaatcaagtcatcggcccaagcgtcacggcttccgtggggatctctttccgaaactggcccctgggaattctcctgtcccgaacttagcgcgccagtggacaacttctcgttccacatcaacataatttttatccctgctcatggcactttcctcgaatgcaccgaggtcactgtacgcctgttggtcgaatgggctcattcatgtgcccgtaatgttatgaatgacttcaaacgtgatgcatccaataccaacaagccggctgtggcggagccggatgcagggaagcagaagcaacagcaacaggagcaggaacgccaagacaaggagtccaaagagcgtaacgccaatgaaggcggggctcataagtcgaataagttgagagataggagcacggatgcagagactttgatggtgcgggtggcctatcagcttaggtgcccgtctgagacgacgttgctgccatgcaagaggtgccggagaccaagccccggcggctacctatgtgccaattgcctatgcgacgacctcgccgttctgattgagaacacgggggctgcaagtagatggctttcctcagtaaagattgctatccaggatgaagggactgtccttcgatatgcgaggaaggctgcatctaaatag

SEQ ID NO: 40651 - DNA, 336 bp, Glycine max
  Peptide Sequence Number=SeqID_157429
gcggcacgttctgggaatgcagcagcaacggccgcacaggaggctgctgacgcggcggcggctaaagcgaagactgcgcggacgaagattcgaaccttcgaccaaaagattaaaagtccgcccatccttgcttacaaatcaattacttgcccccagatattttatggaggactgcctatcttcgtcgcgaatttcgtcttggtcccgagccattttacggaggccaacgacgcaaaacgcatctgggcgtatccggccctcaagcttgtcggcgctggcttctgctcgtcgcgactgcgtatgcaggctcacgtcaacggctttgcaatcgactga

SEQ ID NO: 40652 - DNA, 591 bp, Glycine max
  Peptide Sequence Number=SeqID_157430
atgcaggtccgcaactacaccgcccgcgaatacgccgaggccatgcgtgcgtggccgcgcttctggacgtcggttcggccgttgaccgccaacgcgcagcaggccagcgccacactggaacgggatctttccaaattccgggcgctctacccggctttgcgcccggccaccatcacctacgcagtcggtgtactgcgcaccggtggcaccacgctgggcgacaaggtgctgatcggtgccgagatggcgctgggcgatgagcgcgtggacgtgagcgaactgcccgaaaagatgcgcgagcggctacggatcttctacgacagccgtccgggggcgaacaacgcgcagaacaacctgcacgagtacgtgcatacccagcagcgcgagaccaccggcagcctggcccagtacgcggtgcgcgagggtgttgccgagtacgtggccgaacgactgagtgggcgtcggccggcgcttccgctgtacagctacggacccgcgcatgaggcggacatccgcacgcgtttcattgcagagatggacgggggtaacctcgacaactggctctacaacagcgcccgcaatccattcggg

SEQ ID NO: 40653 - DNA, 244 bp, Glycine max
  Peptide Sequence Number=SeqID_157431
atgcaggccggggctgcctggatcgatgtagcgctcctgcacgagtgcgacctggcgttcaacgtcgggctcggcgcgtaccgcgtcatagtggcccagaagcggccgatgtcgtcggtgacgacctggggcggggcggccagtgccgcgcagggcagcagcagggcggcaatgaggcagaggggcagtgcatccgtggctccggggaaaggatcacagatgggatgcgacgacggctcggaag

SEQ ID NO: 40654 - DNA, 357 bp, Glycine max
  Peptide Sequence Number=SeqID_157432
atgaggtctttcaatggtgattttccaccatggagatgcagcggaagacaaaggagaagaggtgaggggaggcgccatccactagggaatatgccatggaagaaggagcttcaccacaaagaatgtgccttggataagaagcttgaagaggatgttttaatggaggaaaataaagagagaaggggggagcatgaaattgaaggaataaaagagggagagaagtggaactttgaagtgtatctcataagactttcattcattaaagttacaacaagtgttactcatgcttctatttatagactaagtagcttccttgagaagctagagcttagctacacacacccctctaataactaa

SEQ ID NO: 40655 - DNA, 210 bp, Glycine max
  Peptide Sequence Number=SeqID_157433
gcaatcatgaaacacagctccaaactcgaaagtggaggacacatgaacgaaaacgcaattcatggagctccgaaaaaggcgctaggcaataacattcatggggctccgaaaaagggtggttggcaggaccaaacggtctaccgggaagctgggtgtttcggtcatttcctctttgttcaggtggggtgggatatcgccagtcgagaatga

SEQ ID NO: 40656 - DNA, 177 bp, Glycine max
  Peptide Sequence Number=SeqID_157434
atgtgggtgcaagccattggtctattttctcaagcgacctatgctcctgagtttggacttccaagaccgttcaatcagagattactcgtcttgcacgttggtggggagagaagtgagttatcaagaataggatgttggacaaatggcctcagttaccttaagaaaaaggggggttga

SEQ ID NO: 40657 - DNA, 345 bp, Glycine max
  Peptide Sequence Number=SeqID_157435
atgggtccagaactgacccggctcgcacgtgattggtctcgagcgtggctcatccacccattttatcacggcgaagtcggccatgaacccagatttcaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 40658 - DNA, 403 bp, Glycine max
  Peptide Sequence Number=SeqID_157436
gagagaaattgagaggaggaattggtataaggagctcactaacttctttggagggagcattgacgtggcattagtgaaggaattctatgccaacctttatgaccttgaagataaatcaccaaagcagacaccagtggtcatcgaggaaagggagagcttgccctcttactccaggttctgcaggttgaggccagatcttcaagagcttgcagcccgtctatgcatccctggtaggggatttgagctgaatgcagacgggctgcctctgaagattttgaggaaaaatcttactactctggctcagacctggagtgttctatctttttctaacttagccccgacatctcatacttcagatattactttggatagggctaagttaatctatgggcttgtaatgtag

SEQ ID NO: 40659 - DNA, 180 bp, Glycine max
  Peptide Sequence Number=SeqID_157437
atggctcagagctctgagaagaaggatccaaaagaactagagttgctggagctggagggagaggagagggattcaaaggtcagagaatcagatgtgactccttgggccttgcataaagcagtaataagggctggaaaacctagccttgaggagtcatgttgtgcgatgagagaaatctga

SEQ ID NO: 40660 - DNA, 273 bp, Glycine max
  Peptide Sequence Number=SeqID_157438
atgcgaggtaattcttcagcaaggaatttagctcccctagatttagagattgaagctacttgctggagaaataacgcagaaaggaggagaaaagctttgcaagaaaggacagtacaaccaagtgccgagggaactcattcatctgaatcatcttcagcatttccagtagacttgagggaatccgaagttggtgcatctgaagctcacatcatggtggacgagccaccacagagggttactcttaagtactattccagctctactgtgccgtaa

SEQ ID NO: 40661 - DNA, 318 bp, Glycine max
  Peptide Sequence Number=SeqID_157439
atgactcaaatggtaacatggagatatttaaggctagactggtgggaaaagggttttacgcagaagaagggtattaactttaaagaaactttttcccctgtatcgacaaaggattcctttagaatcattatagccctcccagctcacttcaatttggagttgcaccaaatgaatttgtcgcaacctacccttcggcgggaaggcgacgcggggctcacgggtgcatcttccaagggaggaaggcgcgcagagtcgccaccaacgtttattcaaggaaaacgtcggaaaaactggaaaggtgtggtctacgaactttaa

SEQ ID NO: 40662 - DNA, 363 bp, Glycine max
  Peptide Sequence Number=SeqID_157440
ttaggtggcacacggagatacccaagtggttatccgtataaacactcgttcgctatccgtcagactcagagtccggtgacgtgcgaagatacccaagcggtattcatacaaacgatttctgttaaccctgacccgggaagtcaggtggcaggggggtaccgtatggttatccgcacctttcgtcaaccaggggcaaacgagcccgctgacacacagagactaacgtcgtcttctgcaccttttgtcatccagggacagcgagtcaggtggcaggcgaagataccttatggtcgtttgcacctttcatcaaccaaggcgaacgagttcgacggtatcaggatgatgttggttgtccgattctga

SEQ ID NO: 40663 - DNA, 402 bp, Glycine max
  Peptide Sequence Number=SeqID_157441
atgtggagccctttaaaagcgaggacgtgtagtcctctgaaggcgagggcgtgcagccctctgaaggcgaggacatgtagccatctgaaggcgaggaggtgcagtcctttcaaggtgagcatttgtagtcctctgaaagtgaggacgtgtagtcctcagaaggcgagggcgtgtagccctttgaaggtgagggcgtgtagccctttgaaggcgaggacacgtagtcctctgaaggcgagggcgtgtagccctctaaaggcgaggacgtgtagtcctctgaaggtgaggacgtgtagtcctctgaaggcgagggcgtgcagccctctgaaggcgaggatgtgtagtcctctgaaggcgagggcctgtaaccctctgaaggcgaggacgtgtagttctctgaag

SEQ ID NO: 40664 - DNA, 756 bp, Glycine max
  Peptide Sequence Number=SeqID_157442
atgggtgttaaacattttgaggtggtcaagcgaaagtcgcatgccaacaaaaaatggtccctggacgaaattaggaggtcaatctatggcttgaaacaagcttttaggcaatggtacctgaaatttgatgaaatagtggcctccatgggatttaaggagaataaggtagatcaatgcatatacctcaaagtcagtgggagcaaatttatcttccttgtgctatatctggaggatttattgttggcttctaatgaccttggcatgctgtataagacaaagcatatgctaacgacatcttttgacatgaaggatcttgatatagatcacgtcattgacctgggttatttcaaaaggcttacattgataaagtcagagagattcaatatgcaaaattgtaaacgtggaaatgttccagttgtcaaaggtgataaattcgacaaggaccaatgtcctaagattgagattgagcaagagactaaggagtatatgcttgtgtataggagagttgacaacttggaggttgtgggaggatgtgatgcaatcctccctaggaaaggaccagttaccggagccatgagcaagaggctccaagaggattgggctagagttgataaagaaggccttagggttctcatgaaccttaggctaagctctagcttctcaaggaagcttctcaaggagcttctcaaggaagttttctcaaagaagcttctcaaggaagttttcttaagaaagcttctcaaggaagctacctag

SEQ ID NO: 40665 - DNA, 516 bp, Glycine max
  Peptide Sequence Number=SeqID_157443
atgagaaataaaagggaaccgacaaaagaggaagtcatgatattgcacgagattagaaggcctaactctctaaaaacagtccccagtggagtcgccaactgtcgcaacctacccttcggcgggagggcgacgcggggctcacagtgcatcatccaagggaggaaggggcgcggagtcgccaccaacgtttattcgaggaaaacgtcggaaaaaccggaaagggaaaaagagaggtgtttgctgcccagaggcttcttgaggaagatttctaagcgcaccccaattactaagttcagcccccttttcatactttacggaaaagttacggaagccttatggaagtgtttcggatttgattttcatctttttttatcttccctttcaccaatgttaagtgaaatatgtttacccaaggttttcggaaattttacggaagcattacgaaagccacagaagtcccggaaaccatttttcaacaacgtggaggagcttgccgcccagttgcttcctccttaa

SEQ ID NO: 40666 - DNA, 774 bp, Glycine max
  Peptide Sequence Number=SeqID_157444
atggaaaaatcatccaagaaacgcaagggttcattttcctccaccaccactgtaggccaacgccgccatggtgcttctggtgactctccagcaccaccaaatccttccctttcctcaccatgcccactaactctattttcctccaatgatcaacgtcaaaggcattactcctccttttcaaatcgtgtcattcttgatcctaaatttctagattttgatttctttgagggagaaacctttgactgttatcaaggaaccttagttgatgattggaaatccatttattctagtcatgatactcgaaaaacagtctgtgttgaaaatgatgatatgactggtcgtttgcttgctggttcttttacctttgagtgttgcatcatgcattatattttatgtcaagtcttgcttcctcgttctgcaaatcttgctcaagcctttgaggaagatttaatcctgttatgggccctgcaaattggtcgtcaaattgactgggcccatcttgttcgctaccgtatgcataaggcattatgggcaaatgcacctctcccttatccccaccttgttactctaattttacggcacttcaacattcctctggttaatgaaccttttgttaaggttaaacgttcctttgccattggagccattgttgttgcatcctttgggtataggaaggatctgattggtcaatgggtttgtaaacaagaccttccacctaatgcttcgaatgaacgcactccatctccaccaccaagggtccctcctcttcattga

SEQ ID NO: 40667 - DNA, 318 bp, Glycine max
  Peptide Sequence Number=SeqID_157445
atggaattaatagttattagaaataaggctagattagtggctaaaggatataaccaagaaggaatagattatgaagaaacttatgctccaggggctagattagaagccattagaatgcactatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagttcaaggttgtgagttgtatcatggcccaaatggaggaggactaa

SEQ ID NO: 40668 - DNA, 162 bp, Glycine max
  Peptide Sequence Number=SeqID_157446
atggtagtaggcatacttaacaagacttatcaaggtaatccttgtggcatctaccctaacttatcttccttcactggaagtggcatcatccaaaactctgtaacctatatcaagcgatccgctcctagtaaggatcacatcaacaagtattcctcctcatga

SEQ ID NO: 40669 - DNA, 264 bp, Glycine max
  Peptide Sequence Number=SeqID_157447
atggcggctcgtggtggccaccggtggtcgtgggtgatggagaaaaaggtattagggtttgggtgggcgtctgcagaggaggagagtcaaaaaatcatgtttttcatgctgaaaaacctcgtctcgctaagcgggagtccactattcgctcttagtgcgacaattcgctctaagcgcaactcccgttgcgctaagcgcaacaattcttgctcagtgcaattccctctcgggttagaattgcaattagtgcgcttctcgcactaa

SEQ ID NO: 40670 - DNA, 720 bp, Glycine max
  Peptide Sequence Number=SeqID_157448
atgacattgaccatcccagagcttttcttgaggccttatcaggttagatgggatgccaccgtgttcagggtctttaatccagatttccccctctacataaagcacgaagacctctctgaaatcgcacacggtgatcaatgtctcagcatatcagtgttacagttgtggattttgcatctcactaaaacatgtatgcgagtggggaattctaatatctatggattcctcgagccacagtccattcagaggtctgggcaatcgcagtttgagtctgaaagttacataaagagttggatgcagagttcacaacgcgatgtctatcttggagcctacctaaatgggttccactacagaggacactggcagatggtggtcatcctgcccaaggaacacctagttgtctggttttgttcattacataacaggccagacaactaccttaaggggattattaatagtgctttaaaaggtcttgataatgctccacagcctaaatcaaaggcttctgctaggtggactgccatcaagtgtaatagacagaaaggaagtactgagtgcggctactatgtgatgcactggatgtccaccatcattttaggaacttttaggaataattgggaagcgtattttaacgatcctagaccattggagccagagagattaaaggcattgcggatccagtgggcacagttttatctccgagttagagatcaagcctag

SEQ ID NO: 40671 - DNA, 904 bp, Glycine max
  Peptide Sequence Number=SeqID_157449
gaaaggtaaaaagctggcacctaaccttaatgccgcattcgtaaatataggttacgacaaagatgcgtttctgcattatcaggacctggggccacaatatcttacttatagaaaatttttaaaggacaccatttctaaaaagcaaagttcttcaagcttaaaaaatttcgagatacaacccgaaatagacaaaaacggaactgtggataaagtcattgcaaaggatgacattgtcctgctgcagattaccaaagagcctatctccacaaaaggcccaaggatctctacccaggtatctttaacaggacgttttttggttttaattcctttcgacaacaaagtttctatctccaaaaagattaaaagctttgaggaaaaagaaagactaagaactcttatcgagagtatcaaacctgaaggttttggtgtgatcataagaacagttgccgaaggaaaaaaagtggcagacctgcataacgatatgaatcagctgattcagaaatgggaaagtacttttaaaaatatccagaaaaataaagttccatctaaggtcttaagcgaagaagataaggcttcagctattttaagggacaattttaatcaggatttcgtaagtatcatttgtgatgatgaacaaatggtggaagaaatgaaaaattatgtagaagtaattgcccctgaaagaaaaaatattgttcagttttatgattctcacattcctcttctggaatattacaatgttgaaaaacagcttaaacaaagctttggaaaacacgtcaacattccaagttctaaaggagcttaccttgttattgaacatacggaagctttacacgtagtcgacgtgaactccgggaataacattacaaccggaaatgcagccaataaagaacacgctctcaac

SEQ ID NO: 40672 - DNA, 184 bp, Glycine max
  Peptide Sequence Number=SeqID_157450
tcattttgctaagcgcaagcctcgtgctaagcgcatctttggtcatgcgctaagccaaaagtctctagtgcttagcgctcaacccttgcatctcaggctgatttggtccgctatgttggccaaggctgagctaagcccatttcaattcaatttgaattgggctaagcgatggcctactcgctaa

SEQ ID NO: 40673 - DNA, 435 bp, Glycine max
  Peptide Sequence Number=SeqID_157451
atggggatgaggggtttcattaattacaatctcgtcttcgccataagacaacttggctaccctatgagaggagcaccattagaggaaggcctcacaccctttattgcgcgaggtttcaataactccaacacagggatgcttcagagggtccacaaggcatgggaaagggtgcaaaagaaggacaaggaacttaggggaagtagcaacgggcccatcgatggttaccgtaggaggttgaaagcccatgcacaagagcttgggagagcccaaacagccaaagaaaagtacaagtcagcagctgttaggatccgaaaagagaacaccgaactgagagacgtcaacatagccaccatcagggccttggagcaagagaccaagagggcccgcaaggaagaacatggctggaacaagttccgaggggctctgtgggggtag

SEQ ID NO: 40674 - DNA, 135 bp, Glycine max
  Peptide Sequence Number=SeqID_157452
atggctctggtgatgggtcctctccttaggaggattgcatcacttctctctgggtccaatacgcaaacacactatggtgaatctagtgaggcacttatataccccttgttgcatgcggctatcagactcgcttaa

SEQ ID NO: 40675 - DNA, 252 bp, Glycine max
  Peptide Sequence Number=SeqID_157453
atgtgttttctaaaagccgctctagttacggctgttacagagattatgttgaaagtgtgcatagaagaggtgaaggtgaatgttggaaataaacctcacaaccacttcactaagcttggttgggcaaatattgcagaaaagttcaataagcttattgggaaggacacaggtcttgcctgggatggggagaagaaaaccattgctgctagtgatgaatggtgggaagccaatattcagattcttgatctatga

SEQ ID NO: 40676 - DNA, 198 bp, Glycine max
  Peptide Sequence Number=SeqID_157454
atggcaccgtttgcatctcacaagatgctctttgtgttcctgtgggagcacgatcagagggtttctggtgttgggcggcgtgccggtgaggctaccgtcgagctacggccgatggtgttctatctgacggagttcgacatcggcgttattctcaacactgaatgtgccacctgggcgttggtttactgcaccgtttaa

SEQ ID NO: 40677 - DNA, 963 bp, Glycine max
  Peptide Sequence Number=SeqID_157455
atggacaaaatcagccctgctcttgtggccttcatggtccaccagtacctcaaagacaatcattttgctcaaacgtcttctactttcctaaacgaggcttcctccctcttcactgattcttcaaccaaccagttgtcaaagactatgctgggcttggtgcaaatattggatgagtatatgtgtttgaaaaagcaaaaggagatgttgcatcaacaacgggtcatggtgatgcaagagaaataccgacttcaaatgtttgttcaaggcctgcaaaatgttataaatacttttcaaaagccactctcactgaatttcttagggatgagcacaaattctgcagtggttcctcaatggaggctttgtaatgaaactccttcaggtgtttcttctattgcaagtattggttctgccatgcaaaacacatttgggaacttctcaacacccatgattaatgcgtctgacaagaagagaaaagatactgaaacagtaaatgggcctgcagttggaaagcaacctcgtggtagaccacctgggaggaaaaatcaagtccaaggtcaaaacacactgcctcaatcaagtaatgttgtcaacaatcaagtagtttcttggcaatcttcttcttcaactctaccaccatctgggatctgtgcacccagcggatcacaggttcaaggatccaattttgccaaaggctcattcaatcaccctctgttttgcgttccaaaccattcacaaattctagagacacctcctagaacacaatcctctcactgtgatacatatgtatcccctactaattttcttgttgcatcatgcaatcgagaggctagttcctcttactgcactatgatttcaaccgatagagttatgtttgaccctgtaaaacaaatggcttataaagagagcagtcattgcagttctcctatcaaagcagatacaggaaaagcaagtaagaaggatgat

SEQ ID NO: 40678 - DNA, 444 bp, Glycine max
  Peptide Sequence Number=SeqID_157456
atggccaaatatttgttatgttgttgggatcatcagcaggttcaaggaaagtgtgctgatgtggatctaatcggattcaccgattcagattggaagaaggatcctgatgagaagaaaaatactgcaggctatgtctttatgtactgtagagctcctatatcttggagctcaagaaagcaagatatagtggccttgtccacttgtgaggctgaatatgttgcaggagctcttggtgcttgccaagcagtttggttaaagtctctactggaggagttgcagctaagggaaaacaaaccaatgaagatcatgatggataaccaatcagcaataaacttggccaagcatccagtggcacattgtagaacaaagcacattgagacttgctttcatttcctgcgtgatcaagtcaataaaggaaaggtggatgtggagttttgcagataa

SEQ ID NO: 40679 - DNA, 847 bp, Glycine max
  Peptide Sequence Number=SeqID_157457
aagactacacgtcctcaccatcagagtactatacgtactcgccttcagaggacttcacgtcctcatcttcagaggactacacgtcctcgacttcagagggctacacgtcctcgccttcagaggacttcatgtcctcaccttcagaggactacatgtactcgccttcagagggccacacgtcgtcgccttcagaggactacacatcctgaccttcagaggactacacacctcgccatcagaggactacacgtcctcaccttcagagggctacacgtcctctccttcagagagctacacggcctcgccttcagaggactacacgtcctcaccttaagaggactacacgttccaactttcagaggactacacatcctcaacttcagaggactacacatccacgacttcagagggctacacgtcctcacctttagtggactgcatgccctcaccttcaaaggactgcacatcctcacctttagaggactacacgtcctcaccttcagaggactacacgttcccactttcagaggactacacgtcctaaacttcaaagggtttgacgccctctcatttagtaggatacacgctctctccctcagagtactacacatcctcaccttcagagggctacacgccctcgcctttagaggactacacatcctcgccataacagggtcgcgtaccatcaccttcagagggatgcacgccctcgccttcagacgactacacctccttgtctttagagggctgctcgccctcgccttcagaggactacacctcctccctatcagagggtcacataccctcaccttaagaggacaacacatcctcgccatcagagagtcgc

SEQ ID NO: 40680 - DNA, 636 bp, Glycine max
  Peptide Sequence Number=SeqID_157458
gtgaactctagaggtggtggcggtgtgtctattgcccgctaccggccatcccaatgctacttgtggtgtcttgccctgcgcccgtctgggggcgcagtacttcttgatgaaagctcgattagtagggggcctgatgcccttgctgggggtccactgggtgtctttgtgggtgcgatccctgcaaacaatagatgggggagattggcattgcagtcgctgggcagaatgttgctaagtagcaatgtcatctatatctgtgtaagagtggtcatgttggtgcgcatggtccgcacttgtctctttgcagtggtacgggtgaaatcttgccccggtatgcatagtagctgtgtgatagcctccctctctggttgtgcttgcacagttggtcgccctccaatatcagggggtggcccaggaaccgtgtggatgtggagcacactgaaaatgaggacacatagccctctaaaggtgagggcgtgcagccctctcaaggcgaggatgtgtagtcctctggaggtgagggcgtgcagccctctgatggcgaggaggtgtagtcctctcaaggtgagggcgtgcagccctctgttggcgaggaggtgtagtcctctaaaggtgagggcgtgtagccctacgaag

SEQ ID NO: 40681 - DNA, 1518 bp, Glycine max
  Peptide Sequence Number=SeqID_157459
atgagtctccgccaccgtcagtctccggcttcggtgacctcctccgcccccggccgcggcgaagaaccgttcaacatcatccccgtgcacaacctcctagcggaccacccttccctccgcttccccgaggtgcgcgcggcggcggcggcgctgcgcgccgtcggagacctccggcgaccgccgttcggccaatggcggccgaacatggacctcctcgactggctcgcgctcttctttggcttccagcgcgacaacgttcgcaaccagcgcgagcacctcgtcctccacctcgccaacgctcagatgcgcctcacgccgccgccggacaacatcgacacgctcgacgctggcgtgctccgccgcttccgcaagaagctcctgaaaaactacacctcgtggtgctcctacctaggaaaaaagtccaacatatggatctccgatcgccgcggcggcgccggtgacgatctccgccgcgagctcctctacgtctccctctacctcctgatctggggagaggccgcgaatctccgcttcatgcctgagtgcatctgctacatcttccacaacatggcgaacgagttgaaccgaattttggaagatttcatcgacgagaacaccgggcaaccggttatgccctcggtttccggtgagaacgcgtttttgaacctggtagtgaagcctatatatgagactattaagcgtgaggttgatagtagtaggaatggaactgctcctcatagtgcttggaggaactatgatgatattaatgagtatttttggagtaggaggtgttttgagaagctcaagtggccacttgatattgggagtaacttttttgtgactgctggtgggggtgggaagcatgtggggaagactgggtttgtggagcagaggtcgttttggaacttgtttagaagttttgataggctctgggtgatgctgatactgtttcttcaggctgcgattatcgtggcttgggaggggaagacctacccttggcaggctttggaggataggactgtccaggttagggttttgaccatttttttcacctggagtggcttgaggtttctgcagagtttgcttgatgtggggatgcagtataggttggtgtcgagggagacaattgggcttggcatgaggatggtgatgaagtgtgttgtggctgctggatggattgttgtgtttggggtgttttatgctaggatatggacgcagaggaaccaggataggaggtggtcgccggcagcgaataatagggtgtggaactttctggtggttgtgtttgtgttcatcattcctgagcttctggctgtggccctttttgtgattccttggattaggaatttcattgagaacacgaattggaggattttctacatgttgtcgtggtggtttcagagcaggagttttgtggggcgtggcttgagggaagggcttgtggacaatgtgttgtattcacattctgggttgtggtgctggccacaaaattttgtttcagttactttttgcaggtga

SEQ ID NO: 40682 - DNA, 168 bp, Glycine max
  Peptide Sequence Number=SeqID_157460
gtattagcaaagattttggcagctatattgagaagggaaattcactatgttattgcatacgcacaaccaacattcatccatcaaagacaaattcctgatggtgtcttggcaaataaactaatggaggaagcaaagaggatcgagctaggatcattaatgagtgaatag

SEQ ID NO: 40683 - DNA, 558 bp, Glycine max
  Peptide Sequence Number=SeqID_157461
atgaaatttcaaagattacccggacctgtcggccaaggctatagactcgttgaatacatcagtgtagcgcgcgtgcggcccagaacatctaagggcatcacagacctgctgaggtctcgttcgttaacggaattaaccagacaaatcgctccaccaactaagaacggccatgcaccaccacccatagaatcaagaaagagctctcagtctgtcaatccttactatgtctggacctgcacggaggcacgacccggcccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 40684 - DNA, 243 bp, Glycine max
  Peptide Sequence Number=SeqID_157462
atgctgattgaaagagttagggttaggattgacattataattcaagggctgaccattcttgctccagttgactctccaaacactgatggaatagatccagatgctatatgtgagctaaatctctgttcaaatattaggcgactcatgtttaagaaagaatttgacaccagctatgtgggattccattctggatcagagcttctctctcgtcagaatttatgtaatgcgtaccttgacttctaa

SEQ ID NO: 40685 - DNA, 191 bp, Glycine max
  Peptide Sequence Number=SeqID_157463
atgtggaagaggataaggagggtggaattggtgttgtggatacgctgttggctccggaacgatgagctcttgaagctgaagcggaggtttgggaatggagggacgtcgcaaggaggaagaggttgtgcaggggtttctgaaaaacgtggtatttataggccaggacgcattgtaatcgattacaagtactg

SEQ ID NO: 40686 - DNA, 342 bp, Glycine max
  Peptide Sequence Number=SeqID_157464
atggggttgaaccaagatcatgcttttaagaaaagatttcctacatctactgtccaatcttttgaatttgggatgaccggccctctcgatgagtcaaactcttgctttctcacaagggtggacccttgggtactagtgcctattgcctttagagggctacatgccctctccttcagagggctgcacgccctcgccttcagagggctgcacgccctcacctttagagggctacacaccctcgccttcaaagggatgcacgccctcgcttcagagggctgcacgcctcgccttcaaagggctgctcgccctcgccttcaaagggcttcacatcctcgcctttag

SEQ ID NO: 40687 - DNA, 566 bp, Glycine max
  Peptide Sequence Number=SeqID_157465
gtgaaggagacatcctcaccacttgtgtttttgcagtctttcatcttgttcttctctttgttgtaaaggaggtttccagactatggaaagctaaatcctctgctggatcttcccttggaaacaggtctgattctaaagtccttggtagtacaggactaagttgttgtgctatcacgagggattcggataacacaagttccccgagagttcgatacttggttcttaccgttttatactacttgtgcgatccagtgcacttgtcggccgtgaacagttacatgccttcaagctttcccgatttagtgttcgtcgacgaaaggattgaagtgggtctgaggaaaggcaaatttgattgtcttgctttgacaaataaaaagcctagggcaaatgaagagaaggagaaggaggaaggaacccatgttgtggctgccattcctacatggccaaatttcccacctgttcaacaatgtcattactcagccgatatcagcccttctcattacccaccacccaatcatccacaaaggccatcactaagtcaaccacaaagcctgcctgccacataa

SEQ ID NO: 40688 - DNA, 159 bp, Glycine max
  Peptide Sequence Number=SeqID_157466
atgtatgtgcatctttgttgtcctatgagtcagaggacaggagaagagttggtcgataccacaccaagtccaaggccaaaggtacgagcaagtactgggcctgtgatcgacaagtcgtcgtcctacgtttggcttaagacgttaaagaggtgctactag

SEQ ID NO: 40689 - DNA, 261 bp, Glycine max
  Peptide Sequence Number=SeqID_157467
atggagttcctggagctcaagcaggggaacatgactgtggttgaatatgcagccaagtttgagctagggcacatctcctcaagttgtattgataaagggacgacctgtttcaactatagacaaaagggacatattcagagagattgcccatatcccaagaaggagcataatggtgggggccagaatgaccaaactattcgaaggccatgggaagagtctttacccttagtagtgctgaagcttcaaaatccaaaggtctaa

SEQ ID NO: 40690 - DNA, 252 bp, Glycine max
  Peptide Sequence Number=SeqID_157468
atgtcaggatttacacgcaattctcctcaaatttcagccagcccgcatcaattagaccttgcaccttacgcttcagagccctacaatgctcaatggaacgccccagggcttctccgtgacaagcacacattgcgttcgagtcatattctcggagaaatggaggttgatgaaccttggctagggttatggctaccattgaattatcaagtggtcttcgtcattggaagtgcggtagacaggctttgtggttga

SEQ ID NO: 40691 - DNA, 282 bp, Glycine max
  Peptide Sequence Number=SeqID_157469
atggggtttccagctctgagtacgagcctttgtcaattctatggagtgcccgtcgcccccatcaaggtcatcaagccccctattaaccgagtttacatcaagaagtactgcggcccccaggcaggcacagggcgagacaccacagcagcctggggatggccggcatcaggcaatagacgcactgccgccacctccagagcccctcagctcatctacaaaggttggagcgttgcctacaacccgtgggcaaccaagtccaatgccaaagggttaatgctgtga

SEQ ID NO: 40692 - DNA, 427 bp, Glycine max
  Peptide Sequence Number=SeqID_157470
atgacagaaccatcgaagaagcgaaagggggttgcgacttcatccgcagtcactggaacacaaagccacggaacatccaaggtgcagacatctcaaattccttcctccatatcatctcctacgttgttttccatagaagaacatcgtatccggtacaattctcttttctcttctcattccattatcgaccctaagttcgtagacttagctttctttgatgatgaagtgtctgattgctttcaagcatttcaaaattctagtttaattcagtttatctccatgaaacttcctttttaccctgaattggttaaagacttttattctaacttggagattcaagaagattccttgatttccgaagtttatgggattaagatgatcatagaccagtcccttttctttgatctcactcaattatcaagtgatg

SEQ ID NO: 40693 - DNA, 495 bp, Glycine max
  Peptide Sequence Number=SeqID_157471
atgggttctgtcttgatccctactgtaaacaaaccaacggagggtccgtgtcgccttcttaaaaacgtgcgttggggcattttgctacccctagacgtcgtatctaagaaggggacaaattccccggacccccgcattcctagattgcatctgtgtcatatgcattccatcatgcattcatccattccacccatgagatatcggagttttgatttgcaccagcttttatctcactttagtaagcatgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccatagaagtcattgcatcacttactcaatactacgaccagcctttgaggtgcttcacattcggggacttccaattagtaccaaccattga

SEQ ID NO: 40694 - DNA, 207 bp, Glycine max
  Peptide Sequence Number=SeqID_157472
atgttcatgacacctaagctatgcatttcggctattttggggaaaaatacacgttttcgtgaagaaaaattgagtcgaagtgcttccgtaacgcttccgcaagcgattttgtggaaattcttcatcgttcttcatcgttctttaccgttcttcgttcgttcttcgtcgttcttcagtcttcaaccgttttcttttcttccgctttaa

SEQ ID NO: 40695 - DNA, 360 bp, Glycine max
  Peptide Sequence Number=SeqID_157473
atggcttctagaaagagaaaaagcattgttacaaggcccacatctcagtatgacacaaggagattctcttcattagatgcttggactagatacattgataatgttctgggaagaaacattttacctgagaggaaagtagagatgtatcacactaagctagatgactttaaggctgagctggagaggcataatttctataaatgcctcaccaatttagccgatgggagcatagacctggctttgattgatgctgacagtctcaacacattcttggagacacctgtggtattagctgagggagagactctacccgcatactccagatactacaggttgcctacagacttcagagagatagag

SEQ ID NO: 40696 - DNA, 237 bp, Glycine max
  Peptide Sequence Number=SeqID_157474
atggcttatgcctgcatcggcccatcatcaacatggaggatttcgtggcttaagtggcctggcaagaagtctagccttcttctctggggcaaggtgacgctcctacagcccaggatgatgcaatcctaccccccaagggcattggatagaagactccaagaagattgggccaaagatgcaagagaaggccctagggttctcatgagccttagggtagatttcgggcccatgggctaa

SEQ ID NO: 40697 - DNA, 1188 bp, Glycine max
  Peptide Sequence Number=SeqID_157475
atgttagaagttggcatggatacgatatcaacaagtatttgttctacaccaaaatcacaaggcgacaagagtacaatgcaaaacagtggggttactcttagggctaaatcccaacactttgctactatgcatgatgacaatgcatgtctggtgtccatgccttactttggagtcatcgaagaaatctgggagcttaagcacatgactacactatcgaggtcccctccttttcctaagtcagcaccttcgccgtctaccctaaaacccgtcatgatggagagaccagtgattcatgtagattctgccactgggaaagctgatggtctccatagaaggaaattaaggatgcatttggggatcgtcgctcgagacaaggtagatgttacatttgttaactggaaagaagtttctacagctcaaaaggatttgatttgggaggacattcagtttaagtcagatttgacctcgaaatgggctttggcacaaggcaaggaggaggacgatgacactgtctacgagaagtacagtattagcaaagaaaagtggaaccaattttgtcagagtcgtagagatccttcatgggaggattcccttgaagagcagttagcacagggcaactttgttgcccatggacatcaagattcccttcaatggatacccttgaagagcggtcagcacagggcagctttgtcacccatagatgacaagatgactgatatcattgggcaaccaaagcactctagccgtgttcgtgctgctggagtcggtgccacgattaatcaatacttagcactggcttcagcaagcttccacacctctatgtcaatcaaccctgaagagttgcatcgattaacaaaaaatattacggagcaactaataaaaaaaattagagatgagctggagcagtcgatcaatcaaaaagataagcaaggacctaatggaccaattaaacctataaatagggtggaacctgatgacaatcccctataccatataacattggcatcctgcaactttttctcaagcctatgcacgtgtcgtaggattcaactgtgtttgggggtgtataatgatgatgtccctttgtccataaaacatgaagatctttctgaaatagcacacaatggtcaatgtctcaacatctttgttatacaatgtatattggcaactggtcgttatatgtcctaa

SEQ ID NO: 40698 - DNA, 171 bp, Glycine max
  Peptide Sequence Number=SeqID_157476
atggttctttttgtaggtgaaaagatgaagaataagaaggttgaagcagctggtgtctcgctaagtgaggcatatgcgcctagtgagttacatccactaagcgaggcactcagctcgcttagcgggttgggagaatctggaagagaatctgaaaatcatgcacgcgcttaa

SEQ ID NO: 40699 - DNA, 372 bp, Glycine max
  Peptide Sequence Number=SeqID_157477
atggcttcaactcacaaggtctttgctgtgacaattcttcttcttgctgtgaacatggcttcaccatcatcatcatcatcatcatccaatacgagccttgttgcacggttgaagcttgatggtgagtcatcaaattgctgggactcgttgtttgagctgcaagcatgcactggagaggcaataaggattgtgggccatgattgttggcccgacatgattgcctcactgggcttcaccactgaagagggtgatgttcttcagggctattgtgactctgaaaaagaacaactccattctcctccgtctcccacgtcaccaaccactgttgttcatgattttgatgatgcaaccaccaaagtgctgcttccttaa

SEQ ID NO: 40700 - DNA, 204 bp, Glycine max
  Peptide Sequence Number=SeqID_157478
atgctactgtgctttttttccttgctagcatgtttaaatttggaatgtttcttcaacccacattttggaccgaatgttcccaaaacaggggatgctgagaggaaaaaggagaggtacaagcagctaatggaaaaagtactccctatcgcgcagaagcaaaagccaccatgtatactccgtagggctcgctccttgcaatggtag

SEQ ID NO: 40701 - DNA, 753 bp, Glycine max
  Peptide Sequence Number=SeqID_157479
atgcacttccccattctctttctctttctcctaccttcactcttcaagctttcacattcaaccacaatactagtagatggatcttccgagtggaagagccccacagtttccatcggtgactccatcattttcaagcacaagcaacactacaacctctacattttcaagaacgagaaagccttcaagctctgtaacatcactcaagccactcttctcagcaaccccttcacatggcatccatctcggcctggttttttctactttaccttccacaatgggtcactcaaggcatgccaagattctcaaaagctagccatagaggtagcttcttcagcaatggctccagaacattctccagtggcaacaccagctccttcttctggtggagaggtgccatcttctccttcgtttccgtggccttttcgtcctggacaagaagcttcttcacctggtcctgcaccacaagcacaagcacaagcaggttcgccagtgacaattccgttagtgccggataaaggtggtggcatgcccttcattaacagcaaccctgcagttcctcttcctactggtgaagttgattctgctaccatacgccccttacccatcacttctggccatcaagaacagaccatatgtaaccacaatttcagtggcaacatcaagatttttggagggtccataaccacatcaaccacatttatctacaatatcatgcaacacggcgaaattgtggttgcggtcacaattttgtga

SEQ ID NO: 40702 - DNA, 276 bp, Glycine max
  Peptide Sequence Number=SeqID_157480
atgttaaaagcaagaccttctctctctttcctccagaaatttccagcctcttctccttcttcccctatgttttcttcttgctcctccatcaccaattttagccttcttcaagcttcaaattcttcttcatttccacacaaaatttcaagccaaagctatttttggagcctaggaacctacctctacatcaagggaccttcaattctagttagtaaactggtagagaagattggtagagttagcttagagttaaatgtgaggaaggtagtgttgtag

SEQ ID NO: 40703 - DNA, 644 bp, Glycine max
  Peptide Sequence Number=SeqID_157481
aggcaaggaagaccaagctcagagcagctgatgttccctcttcctttgcactaacaactggaatccctgcatcttctacttcagccccatctccagctttagcagacccatctgcccaaagctcccagacttcagatgccaaattgcaaagcctatttgaaggacagattctcattatgcaaagcttgcaagaactggctcagcaaaagccaattatgagtgtagagcaattcattgagaaggtggccaggtctggagcccgaccttcttttatgggggataatgaaagttttacagcccaggcacctcaaccacatgagctagagccaaaaaacgatcactcatctaaagccgtcatccctggagctgttgattttttgaaaagaagattagaaatgagatccaatgaggctgctcatcctgaaccagtgccagtatcagctgatgcactatttctaggggtggatccatctttatctcagtatgcagcagactcttccactcctgtcttagagatacctgagggccaaaccataccagtcctgactctggacacttctcctccagttattccagtattacatctagcagatgaggaggatgttcaaacacaggacacccaggaccagtcacaggaattgtga

SEQ ID NO: 40704 - DNA, 795 bp, Glycine max
  Peptide Sequence Number=SeqID_157482
atgtctttcattcatcaccacccagggatgggcaacgtcagcctgtcgcaaacgccttcgttgctggcagtctgcattgctgtggcactgacgccagccgccgctttcgctgcatcaacagccgaagataccgttattgttgacggcggatttgaccaaacgcaggatccttccgcaagtcaggagcgggattacagcgtcaaaaccaccaccaccggcacgaagctgttgctggttccccgcgatatcccgcagtccgtcagcgtgattagccagcagcgcatggccgatcagaacctgcagtccattggccaggtgttaaccaacaccacgggcgtaacggcgcaggtgcaggacagcgaccgtaccgtgttttactcgcgcggatttttcgtcagtaattacgcctatgacgacctgccaacctccatcagcgaagtgtggaactttggcgatactgccgccgatacggcgatttatgaccgcatagaagtggtccgcggtgcaaccggcctgatgtccggtacgggcaacccggcagcgtacgtcaacatggtgcgtaagcatgcggacagcaatgaattcaaaggcaatgtttcggcgagctacggcagctgggataaacagcgctacgtgctggatctgcaggcgccgctggtggagtcaggtaagctacggggccggatgatcgcaggttatcaggacaacgacagcttcgtggataactatcactaccgaaagaaattcctctatggcgtgatggatgcggacgtcaccgacagcaccaccctctcg

SEQ ID NO: 40705 - DNA, 474 bp, Glycine max
  Peptide Sequence Number=SeqID_157483
atgggactggcgaaacctccagataggccgaatcatgatgtcgatgatcccctatatctaatgacattgaccatcacacaactttttcttaagtcattgcaggttatgtgggatgttattgtgtttggggtgtttaatgaaaatttccccttgtacataaagcatgaagatctatctgaaatagcacacggtggtcaatgtctcagcaactctgttatacaattgtggattcttgcacattggcaaatggtcgtcattttgcctaaggaaaatgttttcatttggttttgttcattgcataataggtcagacaactacctcaaaggaataattaacaagtcagttctatttttcaatacatttgcattagcactagtcgggaacatcaatattttaattgtacaatatgaatccatgtttgcattgaacaattctttgaaaggtcttgacgatactccacgtgggatcctctag

SEQ ID NO: 40706 - DNA, 261 bp, Glycine max
  Peptide Sequence Number=SeqID_157484
atgtctttttcaagagatttacactctggtaatcgattaccagaggatggattaagagaccgagggtcgcttattgtaaagaaatctgaacacaaaggaagggttgtccttgtgtggtttagaacttttaaagggcttttgcaagatagtgaaactctcaagcgggttgcttggggactggacgtaggcacaatggtgtggccgaaccattataaatctgagtttgcaatctttcttcccttaaactcttctattcaataa

SEQ ID NO: 40707 - DNA, 291 bp, Glycine max
  Peptide Sequence Number=SeqID_157485
tcgcgggtgaccatgacttgtcattcccggattttcacaaattgcctaatgatgggtgccaagcacctcacaaggaccaaagaaaggtcgcatgtcatcaagcaaaggtccccggacgatttcactcctctcagttgacgagagtcgcgggcgaccatgacttgtcgttcccggattttcacaaattgcctaatgatgggtgccaagcacctcacaaggaccaaagaaaggtcgcatgtcatcaagcaaaggtcctcggacgaaagaaaggtcgcatgtcatcaagcaaag

SEQ ID NO: 40708 - DNA, 429 bp, Glycine max
  Peptide Sequence Number=SeqID_157486
atgaccggtagattactggctggatcattaacttttgattgtcgcatcatgcactatattattgttagaattttgcttccccattcttcaaatttggctcaagcctttgaggaggacttgattttgatgtgggttttccttaccggtcgtcagatcgactgggctcacttggttaggtaccgaatgcataaggcattacgggccaatgcacctcttccttatcctcaattggtcactctgtttctccatcattttcaaattcctcttgatgatgaaccttttgttcaagtcaagcgttcctttgctataggtgttggtgcagtcacttcatttggttaccgaatggatacccgtctcatgcagcttaaagaggatatgggttatatttggcagagcttcgatcttccaccaccaccaccaccttcttag

SEQ ID NO: 40709 - DNA, 111 bp, Glycine max
  Peptide Sequence Number=SeqID_157487
ctgaggtgaactctagaggtggtggcgtacttcttgatgaaagcccgactaatgcgggacctaatgaccttgttgggggcaacgggcactccgtagaactaacagaggccc

SEQ ID NO: 40710 - DNA, 219 bp, Glycine max
  Peptide Sequence Number=SeqID_157488
atgaagagaggaggtctgaatagactatgtgagcttagtgctgaacgaagaacagaggaaaaactgagcaaggaagaaaaagaccctaactttttggtagatttcaggtgcttggcacccatcattagacaatttgtgaagttccgggacatgccggaaatcaaagaaaatactgatgcacaatccgtaaggttctgtgacacaccggaaatcaaatga

SEQ ID NO: 40711 - DNA, 303 bp, Glycine max
  Peptide Sequence Number=SeqID_157489
atggacagacagctggattatttggtttttgcccaaacagccccagtgcaaaccttctgttggcacgtgacaacatctttttctactggcgacatcagacagcctcgccggtcgtcgatgccttggccttgtctttttcctagttgcactggcccttgtctatgttctagttgcactggcccttgtctatgtcctagatgcactggcccttgtctttgtcccagatatgctggccccgtttatgtcccaggtgcactagtcccgacgattgtcccagatgcattagtcttgccttcgatttga

SEQ ID NO: 40712 - DNA, 2043 bp, Glycine max
  Peptide Sequence Number=SeqID_157490
atggagcatgttttggagaaaagatttcctcttaattcagaagattacaagttatatgaagaagttggtgaaggcgttagtgcctccgtatacagggctctctgtgttccactcaatgagatagttgccatcaaggttctcgatctagagaagtgcaataatgatttggatggcattcgaagagaggtgcagaccatgaacttgattgatcatccgaatgttttacgggcacattgttcttttactgctggacacaatctatgggttgtgatgccatacatggcaggggggtcttgccttcatataatgaaatctaactatcctgagggttttgaagagcctgttattgctactttattgcatgaagttctcaaagctcttgtctatcttcatgctcatggtcacatacatagagatgtaaagtctgggaatattctgcttgattctaatggtgcggttaaactagctgactttggagtgtcagcatgtatgtttgatgctggagataggcaacgttcaagaaacacttttgttggaacaccttgctggatggctcctgaagttatgcagcaattacatggatatgattttaaagcagatatatggtcatttggtataacggcacttgaacttgctcatggtcatgccccattttccaagtatccacctatgaaagttttgcttatgactttacaaaatgcccctcctggtcttgattatgaaagagacaagagattttcaaaggctttcaaagagttggttgccacctgcttagtaaaagatccaaaaaagcgtccaagttcagaaaagcttttaaaacaccacttctttaaacaagcacgtgccagcaaatatctagctcgcaccattttagaaggccttgctcctttaggagatcgttttagattgctgaaggctaaacaggcagatttattggtgcagaacaaggctctttacgaggataaggatcaattatctcagaaagaatatattcgaggaattagtgcctggaattttaacctggaggatttgaaaagtcaagctgctcttattcaagatgatgacatacctaatgcagaagagtcacaaagggataagaagcaaaaagacagattggacgacttcaaagtttctgcagagaggctatcacctggagcagctaatcattcagatgatgcaccaacgcaggacaaggaggatggattcaacaatcttccggatttggagagctcacttgcttcatttcctagtaaacctcttcaagcacttaaaggatgctttgatatgtgtgaggatgacgtcaacaacagcagtccaagaaatttggatcatgatggaagaattgacaatgaaagttctgggacaagtacttcattacaacaaaatgctaccagtcatcaaaaaaagtttccaagtggttctttactacctgataattttctttttcccaaaaagattgttactgatggggacagggattatctacaaacaaagtattcttcagacaggaatcacagtggtccgttgcaatatcggcagaagagagacaccaacaaccttccattggttgatgacacatcggatggagcatttgtccagtttagggggcggtttaaggtcacgccggcagatctcagtccaatgggtccttcaaacagcacatctggcccacttgttagtcctaccagtccaccaaatccaaatttcctgtctgtagctattcttccatcactgcagtgcatcttgcaacagaacggcctaaggcataaccgtatttccaatgggtttttccaggaagagattattaaattaataaaatatgcagagcaatcttctggcaagaatacagaatcaatggaggcagggatagttgatattttgcaggcaccacctgcaacaactagggagcgagagctgcattttcaggtgattcaactccagcagagcaatggaatcctttttgaggaattgcaaaaacaaaagatgaaaaatgttcagattcatgcaaattattactcattgcctatgcaaggcagattctaa

SEQ ID NO: 40713 - DNA, 816 bp, Glycine max
  Peptide Sequence Number=SeqID_157491
atggcaattcctgtttatctgtggctgaaagacgatggcggcgcggacattaaaggttccgtagacgttaaggaccgtgaaggcagcatcgaagttgtcgctcaggatcacaatatctacattccgaccgacaacaacacgggcaaactgaccggcacccgtatccacacgccgtttatgttcaccaaggaaatcgactcgtccagtccgtatctgtacaaggcagtgaccactggccagaccctgaaatcagcagagttcaagtggtacaaaatcaatgacgccggtcaggaagtcgaatacttcaacaccagactcgagaatgtgaaggtggtgaaagtgaatccattgatgcatgacgttaagaatccttcttacgaaaagcacaatcacctcgaacagcttgaactgcgttacgaaaaaatcacctggacctacaaagatggaaacatcattcattccgatagctggaacgaacgtgccaccgcagtaacgcctgatgcggatggggaaacctgtccgcagcttttagcaaagcccctttgtgctgaggggacagttaaaaagcagcgctgggaaagaggaaaatcaatcagtgtgccgtctgccggaatgcggaaatatcacgactggcgtagatatattctgaccggccgttctccgtcagatgctgcaagacttgcaggagatatgaattatgaaaaattgaagggcaacagtaacctctattctgtccggcttacacagcaggacagggttttattctcggtggcaggaatgtccataacgatcctggaaattggtggccattattag

SEQ ID NO: 40714 - DNA, 331 bp, Glycine max
  Peptide Sequence Number=SeqID_157492
atggagaaagtctttatggagcatcacgcatcaaccttattacgccgccttaacccttactgtgctcgcgcactggaagccgccgcctccctgtgtcagacccgagcccatgcggaaattttgccggagcactggctgctgaagctgctcgaacagggggaaggtgacctgacggtactggcacgccgctatgagtgggatatggatatgctatggcaggatttgcttgcctggctggataaactgccgcgttcagtccgtcagcgtccgcaattgtctgacactcttcagacgctgatgcaggaagcctggctgattgcttctcttaacg

SEQ ID NO: 40715 - DNA, 198 bp, Glycine max
  Peptide Sequence Number=SeqID_157493
atgaccgcctgggtgccatttgagcagcagcgcaatgaactggagacgcgcatcgaagagcaggaagcacgtttcagccatgaaaaggcgctggcacagcaactgatgaccaggcgcaaggacattagccagcaggctgacgttgccgacctgcaacagcagcttgaacaggcgcagcagggcgatgtgctggttcag

SEQ ID NO: 40716 - DNA, 660 bp, Glycine max
  Peptide Sequence Number=SeqID_157494
atgacggttgctgccggcggcgatatcttcgcaaagcgcctgcgcttccagtgccagcgcggtcagttgcgctttcaggcgtacaatttgttctggcaccgtgtcgagactcatccgtacacgtgcggcggcggtatccagcaaatcaaccgccttgtccggcagctggcggcccgtcagatagcggcgggacagcgtgacggctgcgcgtactgcatcatcagtgatatgcacgttgtggtgttcggcgtagcgggctttcaggccgcgcagcatcaggcaggcggtctcgtcgtccggctcgtccacttttaccatctgaaagcggcgctccagcgcggcatcgcgttcgaagtattgcttgtattcagaccaggtagtggcggcgatggtacgcagttcgccacgggcgagtgccggtttgagcaggttggcggcatccgcgccgccggcctggttgccggcgccaatgatagtgtgcgcttcatcgataaacagcagaatcggtaccggggactgctgcaccgcatcaatcacgtttttcaggcgctgttcgaattcgcccttcacgcctgcgcccgcctgcaacaaaccaaggtcgagggtgcgcagaacaaccggcttcaggctttccggaacgttgccttcagcgatacgtaa

SEQ ID NO: 40717 - DNA, 1608 bp, Glycine max
  Peptide Sequence Number=SeqID_157495
atggagatcgttaccgcaccgcatcttgcggtcagaaacgagtggcttgcgttacatcgtgagccgccactacaacccgagctgcccattattgatgcgcatcatcatctctgggatcggcaaaccggacgctatctcacccatgagttcagcgacgatatccagacctcagggcatcgcgttttctcctcggtctacgtgcaatgccgctctatgctgcgtcgccacgggccggaaacgttgaaaccgcttggtgaaattgagtttgccagcgggatagccgcgatgttcgccagcggacattatgcaaacgctcttggatgtgaagccatcatcggcggcctgagcttgctggcgggcgatgcgatgcagcctgccatcgagagcgcgctggctttatcaggcgggcggttgcgcggaatgcgtaatccattggcctggcatccggatccgcgggtcacgtccagcccggttacaccaccggcaggactggccctgagcgaaccgttccgccggggcgctgcctgcctcgcacaaaatggattgtcgcttgatgtgtgggtttaccacacgcaactggatgaaattgccgagctggcgcggcaaataccaacgctacagattgtgctcgatcactgcggcgggcctgtcggcgtagggccttattcagaaagagatcctgacatgtttcagcagtggcgaagcagtatgcgacatctggcggaactgccgaacgtatgcgtaaaaattagcggatttggtatgacggtcaggggatttcccttcgcagcggcagaaacgccgccggattcgcaaatgctggcacaggcatggcaaccgtggtttgagaccatcattgctcttttcggtgcggaacgctgcatgttcgccagcaattttccggtcgacaaaggcatgttcagctacggcgtcttctggaatgcctgcaaacgcctggcgcaacaggcttcccctgatgaacaggcgcaattgttctggcgcactgccgcaacctgctaccggataacctctgtggagaatatcaatgaccacgtcacggccggtggacagatcatcggcgggatcctttttggttttatcgccgataaaattggtcgggtaaaaacggccatgacctgtatcgccatctattcactcttttccggactattagcctttacgcacgatcaacagcatttcgcacttttgcgtttttgcggtgcgctgggtatgggcggaatgtggacgtcaggtgcggcgctgattgctgaaacctggcggccagagcggcgcgcgcgcggcggcgctttgatgcaaatgggcttacccgttggcgctattctggctatcagcctgacggcaatcgtgagctcggttaacggcggcctggagcagggcgcatggcgctatctgtttatgatcggcgcgctgccggtattcattatgagcgtggtggcctggttcacgccggaatcacaggtttggcttgcacgacagcaggggaaagctaagcgcactcaacctgcctcgaaactgggcaaacacaatctgaaaggcctgctgctggctttcgtctttatcttctttattcagtatctattctggggg

SEQ ID NO: 40718 - DNA, 438 bp, Glycine max
  Peptide Sequence Number=SeqID_157496
atggcttctaggaaatgcaagagtattggtttaggacccacaacacaatatgatactaggagattttcctccttaaatacttggaaccgatacacagataatgtcctggggagaaacatttttcctgagaggaaggtggagctctatcacactaagctaaatgattttaagactgaattggagaggtgtaatttccgtaaatgcctcaccaatttggttaatggaagcatagacttggctttggtgaaagagttttgtgcaaacttatatagctctgagggcccttcaccaaagcaatccagagttagaggccacctagtgaagattgatgctggtagcatcaacacattcttagagacacctgtggtattggcagagggtgagactttgcccacatactccagatactataggctgcccacagatacagagagatga

SEQ ID NO: 40719 - DNA, 381 bp, Glycine max
  Peptide Sequence Number=SeqID_157497
atggaagaaaagaaaaccgaaagtgaacaaaatgaagatgaaagccaacaaaacaagaaaagaattgaatgtctcggattcgaaaacttacaggttgaagaacgaagaacgcacgaagaatggacgaagaacggtgaagaaggaggaaaatcttcacgaaattgctcacggaaacgtttcagaagcattacgaaagcatctcggcttggattttcttcacggaaacacgttttttcaccaaaaacagctgaaatgcatagcataggggaaaaatggggaggaggttgccacccagctcctccaagcgagctgggttgtttcctccttaagcaacccagctttcaaaatgttcttgaaggggctagatttcaaaaattttga

SEQ ID NO: 40720 - DNA, 621 bp, Glycine max
  Peptide Sequence Number=SeqID_157498
atggatggcaacccttttggaaacgtgccaccccctccaatacaagtccctgataacttggctatctcttcctcgtcttcgccaactcctacgacgtcgtctccgtctccgacaccctccggaggcgtccggtaccgcgggacgcggtaccggagcggaaagtgggtgtcggagataagggagccacgtaaaacgaagcgcatttggctggggacttacccgacagccgaaatggctgcggcggcttatgatgtcgcggccctcgcgttgaagggtcccgacacgccccttaacttccccaattcgatactctcgtacccgattcctgcgtcattgtccgccacggatattcgcgccgcggccgcggccgccgcgcaggctaggatcgtgagggcgccgcaggagtgtggggaaacggtaaaccctgatgatggcggggggcaagggatgtcggagaggcgtgaggagtacattgatgaggatgagttgttgaacatgccgaatttgctcgatgatatggccaggggaatgcaggttagtccccttaggatcacttcctattcttcagatgattcgcctgggaattctgatggagataacctttggagttataccctttga

SEQ ID NO: 40721 - DNA, 729 bp, Glycine max
  Peptide Sequence Number=SeqID_157499
atggttaggactagaggattaggtcgtgccttaggtcacgttactggcagaggtgtgggtcgaggagatcgtgatgattccggtgatgctccgcagcgtcaaaggcctaccgcatccgcacggaggcagcgagttcctgtgactacggcgcacgatgagccagtggtccctgcaccagatgtagaggctgacatattttcggatgacccgatgacaccagctgatgtagaggacactggggcaaacattcctgcagacacaggcgtgcaggctgcggaggatgagcatgagggatttccgggtggtccgagtgacctatccgtgttgacccagtatgcagatcacgttgcttgcagtgtatggatgggagaggagcatcctgagttgaagttatcctatcacgagaggaaggtgcatagtttaggtaggcctgtccctgccattgagggactagtttttgggacaggactaagtcctctgatcgcgtgttcggtagacaccggcgatcggggactgttgtcctcgtttgtcgagcagtggtaccgggagacgtctagtttccatctccctgtgggagagctcacgatcacgctggacgacgtctcctcgattctacatatgcccgtggatgatgcggttcagatgctagtggacttattgatggtctttgcagaggctgccagagttgagacaaggcagtgtcgtgggccgtacgtacacctgcaatga

SEQ ID NO: 40722 - DNA, 1275 bp, Glycine max
  Peptide Sequence Number=SeqID_157500
gcggatcaccacgccggttttcagcacctgcagcaacgccgactgcatctccgccggcaggtattcgatctgttcgaggtacagcgtgccgccgttggccaattcgaatttactcagctggcccgcctcttcttcgttggcgtcgctgcccagcagttcacgcagcccctgcgcctgcggcagcagctggcagttgagggcgatatacggcccggcggcgcgttcgccggcgttgtggatagcctggctgagccgctctttgccaaccccttcctccccgcgcagcaggattggatgctggcccttggccgcctgctgcccgtaacggatcagccgccgcatctccagcgaggcggagggcatttgctcgaagctgtggctgacgcgccccaactggctgctgacatactggcgcagccgctcgagcgggtgcagcagggcgatgaaactgcagcgatcgccgtcgaaaatcggcttgagcgtcagcaaggcggcgataaactgccgctggctttcgaaggtgacttcgacgtgttgcagcggctgccggtcggcgatagcgcgcttgagcagggcgggcagcgtcagcaactgcgccagcggtttgccttggctctgctgctcgtccagcttcagcagggcggcggcgcgctggttgatgtattgcagatagccgcggtgatcccaagccatcacgccgtcgtccacgccgtccagcaggccgtaaagctgattcagatggcggttggattccgccagcaggccgtcggcgttcagcgagttgccgatttcgcgggcgatggccagcgtcagcgacagatcgccggcggcgcagtcggccaacagacagcccagcgcgatcgaaccgcgctggcggccgctgttgtcgtagaccggcgtagcgcagaacgaccagccgtgcagcgcccggcgcacgtgctccccgccgctcacccgcaccgggtggccttccgttgctgccagcgccggggcgttgcgccacagcatgcagccgctctcgtcgaggatcatcaacagacaacgacgtggctccatgtactcgcaggcgtcttccagcgccgcctggccgagcgtcagcagatcgttcttgcggcggcaaatcgattcgaaggtggcgccctgagcgcggtgcggtgcttgccagacgtcgggctgcatcaggctgcggcagcgcagccaggaggcgtaaaccgcctgtgccgggcgcagcggcggcggcagttcgccgtcgttaatcagccgttgccagcgtga

SEQ ID NO: 40723 - DNA, 435 bp, Glycine max
  Peptide Sequence Number=SeqID_157501
atggctgaagtagatgaggtgcaagagtggataaaggccgacatggaggccatgaaagaacagatggccacaatgatggaggccatgattagcatgaagaagataatggagaacaaacatgttttctcgccatatggtttgccttcgaactatactccacccaatgagaatgtcaataactccactcctatactcattgagagccaacaacctcaaactgatcatgcatatgtctctcaacccatgggggagacacatgaaatatcccatcgcaatctagccaatttcaagcctcacctcagatatgccactgaagggcaagcagttggcgatatacccctacaaaatgtagaagcaagcttcatgatgatgaatcaagttgattcaagtagttttgataatgacaaagatgatgaaaaaaagcccaaagaatga

SEQ ID NO: 40724 - DNA, 216 bp, Glycine max
  misc_feature (210)..(210): n is a, c, g, or t
  Peptide Sequence Number=SeqID_157502
atggcatctaagaaaaggaaggcttcttctacacctacccaggccagatatgacagatccaggaatgtggtagtttattacactaagtttgatgagttcaaggaggaactcgagagaagacactgggatgagaagttgactgattttgctaacaacaacatggacattgctattgtcaaggaattttacgccaacctctatgaccccaanggataa

SEQ ID NO: 40725 - DNA, 444 bp, Glycine max
  Peptide Sequence Number=SeqID_157503
atggataggttgacgaccatgatgagtgcactcctgtcagcccagaactctcaagctgccgccgctgctgtagagcagcctttggtgagcacaaccccgctatctacagtgacttctccacccctctttttgcctccaggttgtacatggggaatgccacctccagtctgtggaagcccccagcccgctgtatctgaagttccacctccttttgctcagcagtcagcaccggttccgcaacccagtacctctttccctcaagctgcaatgacttattcagctccactgattcacactattcaacaagaggttgaaccaattttccaagctgaaaatgttgtagcctttgaccagatggaagaactccaagaaagatttgatggtatgccaagggaaagtcgaagccctccgaggaagagatctgttcgggaaggacgcctgtga

SEQ ID NO: 40726 - DNA, 609 bp, Glycine max
  misc_feature (8)..(8): n is a, c, g, or t
  Peptide Sequence Number=SeqID_157504
atgcgtgncggaattagctacaacccgcttctcgctcgacgacaatttgggtacccgataaagacaaaaccaaacaaccttgccttgactaatgaattctatcttaaccatggagatcactcgaacaaaagggaaagattcgcacaagcttggagcgctatccgcagactccacaggagtcagttgggaaagaaatcagactatgtgcatgaatcttatacccagtgggttattgataggaccaagagctttggcctaccctaccgcttacctagatacctatcgtccaccatcccaccatcatccttgcctatcccctttgacactaaggaagagtttcatgaacaattaaccaaagaaaggcaagaaaaagaaacttggaagaggagatgccaggagctcgagcgagagaatgagactttgaaggggaagatagcccaacagagccgtgagatttttatccagaaccagaggatgattgagaaggacgacctgcttcgtcggaaagacgctttgctccaccaagatgctagaaggaagaggaggtttatggacttgttctcccgtgcacattcagattccgaggacccatctactccgggagtttga

SEQ ID NO: 40727 - DNA, 1092 bp, Glycine max
  Peptide Sequence Number=SeqID_157505
atgagtagcaatgatcaaacttctggtactagtctctacattagggctttaatttgcaacgctgcttctggtgccgctgctggggcaatagcggctacatttgtgagcccattggatgtgatcaagactaggctacaagttcatggccttcctcacgggcagaaaggcagtatcattataacaagcttgcaaaatatagtaaggaatgaaggttttaggggaatgtaccgtggcctttcaccaacaatagtggcattacttccgaattgggcagtttacttcacaagttatgagcaactaaagggtctacttcgttcacgcgatggttgcaacgaactcacaactattggaagtattatagccgctgctggtgctggtgcagcaacagcgatttctacaaatccattgtgggttgttaagacaagacttcaaacacaaggaatgaggcctgatgttgttccttacaagagtgttctttctgctttgacaaggattacacatgaggagggcatacgaggcctatatagtggcattgttccatcattggctggtgtaagtcatgttgcaattcaatttccagcatatgaaaagatcaagtcatacattgcagaaaaagacaacacaactgttgacaagctaactcctgggagtgttgccgttgcatcatcaatttcaaaagtatttgcctctgtaatgacttatccacatgaagtaattcgatcccggctgcaagagcaaggccaagccaaaaatattggggttcaatatgcaggggttattgactgtactaagaaggtgtttcaaaaggaaggcattccaggcttttatcgtggttgcgcaaccaatctatttagaacaactccatctgcagttattacattcactagttatgagatgatacacaggtttttggagcgagttgtacctcaggacaaagggtatctgcatggcctttctaaagccaatgaacttaacaagccccagccaaaagctagtggcagtgacactgatagggggcaaccaccatctcagtctaacacgaaagcttcatcaattcctcatggaaacaaagagcagctaacaagacattga

SEQ ID NO: 40728 - DNA, 492 bp, Glycine max
  Peptide Sequence Number=SeqID_157506
atggacgaagatcaatggatgtatgacagtataatgtctgaagaagttgatatggatgatcaaaatgaacaagaatgtggtatgaatgaacatgttgattgttcggatgcgttcaatacttctcagatgatgttttgcagtaagttcgatcagttgctcatgaaaacggatttgtggcggaagaaagattttgttagaagagatactggaagtaggaaatgtgggtgttccttcaagcttcatgagaaaccattggttggagggcgattgattaaggatgaaaagacaattattgttgatatgacaaagtcaatggtgaaaccaagaaacattttgctaacgttgaaggagcacaatgccaatagttgtacaacaatcaaacaagtatacaatgcaagaagtgcataccgttcttccattggaggaagtgatgttgaaatgcaacatctaatgaagcttcttgaacgagatcaatatatttcattgacatag

SEQ ID NO: 40729 - DNA, 951 bp, Glycine max
  Peptide Sequence Number=SeqID_157507
atggcctctaggaaacgcaagagtatcggttcaagacccacaactcaatatgatacaaggagatttcactccttagatgcatggaaccggtacacggataatgtattggggagaaatatcttgccagagaggaaggtggagctctaccacactgagtttgatgattttaagactgagttggagaggcataatatccataaacgcctcaccaatttggtagatgggagcatagatgtggctttggtgaaagagttctatgcaaacctatatagctctgagggcccttcaccaaagcaagccagggtcagaggccatctagtgaagattgacactgacagcctcaacacattcctagagacacctatggtgttggcagagggtgaggctttgcccacatactccagatactgcaagctgccttcaaatcctagggagattgaggctgccctatgcataccaggtcgagggttcatcttgaacactgagggccatcctgggaggatcctaaggaaggacttgacgaatttagcccaggtgtggagtgttctctcatactctaacctggcccccacatcgcacacctctgacctgacagtagacagagctaggctgatctttggcctagtctctcacatggatatgaacataggagctctcatttctggccagatgacttctatagcccagtctaactcttctagacttgggtttcctgctctgatcactgccctatgtcgagccagaggggttgtctctaacagcctcacttttgagtgcctaagcatggttattaatttggcctacatcaggaagaactgttggaatcctaatgatctgacagtttctatccgaggggctaggagggcgagggcgaggccagcagatcttccttccacatctacaactcctactccagcatccacttcagcagctcctttagtcctagcttag

SEQ ID NO: 40730 - DNA, 397 bp, Glycine max
  Peptide Sequence Number=SeqID_157508
ggaggcggagcctatggaaaaacggctttgctgcgaccctctcacttgcccggttaagtatcctcctggcatcttccaggaaatctccgccccgttagaggtagaggagctagaggaggaggaggaggagaaggatgaggaggaggaggcgaggcaggttgttttgtattttgtggggggtgtggactatggagtgaatgcattggcatcatcatggtggaggagaatgttggggtcgagtatcaacaaccttgagatgattatgcttttggaacagaaggatgaggttagtatttctattgacatggaaattgaagaagaagttataaaccaaaacatggttaatggaccagttggggtcattaaatgtattgtctcaatgacagttcttacatag

SEQ ID NO: 40731 - DNA, 339 bp, Glycine max
  Peptide Sequence Number=SeqID_157509
atgacattctcaaaagctaagttaacaaggattcaaccacactccaaagataggctactaaaattgtgtgtgtacgtaaaggcacctccacgaaagtctagagaaaagcttcaaaggagaaggaaatgggtgcaaagggcacaaaagaataaggaaatcaatgtagagggaaaagggttcaaaggagaaggaaatggagtggatgaagcacttggttcctttgtgctatggtcattggacaacattgttgcagaccttgccagtcatcaaggagttgttaagggatataagaaggcagtccagcaatcatcatcaaaacatttgacagcaacaaattga

SEQ ID NO: 40732 - DNA, 681 bp, Glycine max
  Peptide Sequence Number=SeqID_157510
atgacagatccaggttcatctcaggaagcttgggagagatatacagatattgtggtgcctaggaaactactaccggataggaatgtggtagtttattacactaagtttgatgagttcaaggaggaactcgagagaagacactgggatgagaagttgactgattttgctaacaacaacatggacattgctattgtcaaggaattttacgccaacctctatgaccccaaggataaaccacctaagcaggtgagggtgagaggtcatctagtgaaatttgatgaggataccttgaacacattcctgaagaccgtagtgattctagaagaaggggaaattttgtgttctttttccaggtttgcactcctgaggcctgatcctcaggagttggctgctaagctctatatcttagggaggggattcgagctaaatgctgatgggcagccattgaagatattgaggaagaacatgaccactctagctcagacatggaacgttctttacttttttaacctgattcctacctcccacacatctgatgtcaccttggacagagccaagttgatttatgggccaaggaaggccaggggtaagagatcagaggtccccactacttcagcaccacctgagacaccagctccttcttcttccactgctccagttattcctcctacatccacttag

SEQ ID NO: 40733 - DNA, 669 bp, Glycine max
  Peptide Sequence Number=SeqID_157511
atggaggagaagggatggaaaaatgaaatagaaaattatgaagagaagaaagaattccctaaggagagttctcaagctttaggtgcctgtattcgcgctgaacgcggcttgggatgtgccttcctcgcgcttagcgtgtgcttctcgatgagcgggctgcgcactgagcagacagttctcactaatcctgatatatacaatgatgtcatccccagcgccggctttagtcgtatctctgacctcagagggctcacccccattagtagagggttggactcttggccaagcaacctgctggatgaaggcctatggggtcatcagtggtgggtccatccccaggtggatggcgattgtgttggaggtggggcatctggtgctacgactctggctcggacacagcagggccctgggaaggtgatggatgggtcagcggggttccaacaattcttcttgatgtacgacaagttaatcatagggcttagtgactcaaaggttaaaataggaaagtatgctccatgtctgagcgagtgtaatgaggttcttccacaacagcttccaaggggcctcgtcggcattcaggatgaatcctcctctaggtgtattgggagtacaccagataatcttctctgtcagcaaggacaactggggtgtcaaggaagtcatttatag

SEQ ID NO: 40734 - DNA, 636 bp, Glycine max
  Peptide Sequence Number=SeqID_157512
atggctaggaatgctaagcgagcaacacgcactcaacatgcccatgaaaatggacgaactcgcttagtgcacagcttatggtctcacggaaacaccgagtggtgcctgctcaaggaggggaatccacctaggattcctcccgtttcacttcagaaacaacttggcactgatatcaggacaacatccacctccagaacattttactggagaggaacgtggagctcttcgcgggcatgttcgatgaattttagaggtagtgggcacggagtaatcactagactcttggaaaagcagatcaacatcgctctggcatgggggcatgtcattaggttcaatgcagaaactataaatgacttccttgacaccccagttgtccttgctgacagagaagattatctggtgtactcccaatacctgcacatgtacccagaccaccaggccattacggcaaagttatgcacacctagaggaggattcatcctgaatgccgacgaggccccttggaagctgttgtggaagaacctcattacactcgctcagacatggagcatactttcctattttaaccttgcccatacctctcacacttctaatctcaatgttgacggggcaaggcttatatgtgacttagtatga

SEQ ID NO: 40735 - DNA, 186 bp, Glycine max
  Peptide Sequence Number=SeqID_157513
atgtatataaatctcccgatttatggttctttttggcaaaaaggagctattttgaagaagtgccaaaggattcatcgcgctaagcttagcacaagattagcgctaagctcaaattcacttactcgcgttaagcacgagagtggcgctacgcacatcgtcgagattaagaaaacctttcaagcctga

SEQ ID NO: 40736 - DNA, 192 bp, Glycine max
  Peptide Sequence Number=SeqID_157514
atggatgaatgggatggtaaatcgtcggttaagtggtggctggacagaaatatagaaatgacaataactcaagctacagggctccaaatgagaacaaggttgaagatgaagggaagcaaagaatcactctttccggcgagggcaacacacaaaggttgtgaaagtcctttgatacagccagggtgttcttga

SEQ ID NO: 40737 - DNA, 1050 bp, Glycine max
  Peptide Sequence Number=SeqID_157515
atgggtcctgtggaggttccaaattttacatcatgcaagctttctccagctaaccaaaaacctgaattttattgggaacttgtcacaaactggttttatagaatttacaaacacattttctgcaaacttctcgtttcatcaactaaagctaaaatgggcaattgggcaagcttgtcattactatatgcatgtcatgctgtaagcatgactttgttggaaatttatcatggtaaacccagtggagtgtgtgtttctcaaggaggtcgttttcctcccttcaaatcagagggtagcactcccaaaaagggtcctaaagatttgactctttgccggatctttcgcaaaaagacttgctgcgatgtaacccatacacatcctgcacttctgtctgtaaggaagcttgcttctactggggaagctagccaagagtgcttgcacttatgggaactgttggaatgttccatatgcgatccacgtgttggtactcagcctggacctcctcttatttgtgcatctttatgcgagagaatttatgaggcatgctcaaatgcatacttctctatggatgtgaaaacacagattctagcaccttgtggagtaaatgactttgtatgtggtagggctgctgaatgggtctccaatggtacagatctttgtcttgctgcaggttttcgagtgaaaccatccgaatccgatattgtacatattgcctcagaagaaacttcttgctatggtgataaagcaagtctaggttctgttgccgattcatggaaggcttcacaatttgagttgactcggaaaggtgagagcttgaggatgttggatgatttccagcaatgggtgagggaaatgccatttggtgaaaaagtttcttgggctataggagggatggttctaacagcaggcttggtgtttataagcaaaaggaaaagccataaccaacgccagaaactagcagctataaagcgaaccgcaaggaagcttgaaggcaggatgatggaacaatggccttctaatgctcaagaaaataggagaagagtttctagataa

SEQ ID NO: 40738 - DNA, 255 bp, Glycine max
  Peptide Sequence Number=SeqID_157516
atgcaaaggatactgggctgccttgcagcgacgttctctgcttgtttagcgccgggaaggggcaacgatcggaaacaaaaaatccaatggccaatcgtgtctggccatcgtcttaccttggttgatttccgcattcaacttgtctcgacttctaaccgtgacctaagaaggccctgcccctgttaccacaaaatatgcatgtgtatgtgcatgtatgttccttatgcgataactttcttagtgaaggctagttag

SEQ ID NO: 40739 - DNA, 414 bp, Glycine max
  Peptide Sequence Number=SeqID_157517
atggccccgaggaaacttgcctcaaagagatccaggaaggataaagcagccgaaggaactagttccgctcccgagtatgatagtcaccgctttaggagcgctgaacaccagcagcgcttcgaggccatcaagggatggtcatttctccgggagcgacgcgtccagctcagggacgacgagtataccgatttccaggaagagatagttcgccggcggtgggcatcactggtcacccccatggccaagttcgatccatacatagtcctcgaattttatgccaatgcttggcctacagaggagggcgtgcgagatatgagatgctatcggccagttcctgggataccctttagtgctggaagagggttaggagtgcaagtatggccagaggaggaaccggtccgatgggctcgatga

SEQ ID NO: 40740 - DNA, 432 bp, Glycine max
  Peptide Sequence Number=SeqID_157518
atggcaggtccttactatggtgctagttcattcttgtatggatttccatcccagcacgccgatgttgagaactcagtggagtgtggcggcagttgcaatatctgggtaactattagcaccccgcgttctaagcacttgttgcaggccgagacaagtctagaccaatacgatgtgatgaattgttcgccttcaatatgctgttgttcactgtggatagacctacccaagttatcttgtttttatgcgccggggagtttccgaagtggccctgacaatcattacttcgttcacggatcgacacatgatcttctgcaggaggatggcatgaacattggccagcaacccaccaattcggcggtatgtccgaagagctatcccaccggatacgattccccaatatgggagcctttcggcctccgaagcaagatataa

SEQ ID NO: 40741 - DNA, 276 bp, Glycine max
  Peptide Sequence Number=SeqID_157519
atggctcttcccaaaccagcatctaatatgaccgaaacctcggcccaaccttccccaatgtcgtctaaggaggaaatcgcagcaggactctccacatacatgggctttcccgaacgcctgatgcaagacgtaggattcctcgtctctcttttcgtattccactttctgtactatcgggcctgtggactgttctatgctttggtctaccgtggagaacggcgggataagattcttcgggattatgggttgggattgttaggcagcgagacgaggtag

SEQ ID NO: 40742 - DNA, 600 bp, Glycine max
  Peptide Sequence Number=SeqID_157520
atgaagattggaaaagaagaaactggaacaatacgtggagagcaaccaagggagtggaaaatgaaaaggttagaaaagaagacacctggaacaatacgtggagcaaccaagggagtgagaaatgaaaagcacaatcatgcttcttcaccaaaggcatgctggtcttgctggagggtagcatgggcatgctctgctcttcagttgaaatcctttgaggttcatcatggttgtgctagtggtgaaatgctggttaaactagcggcgagggctttctacgatgatctgacgagtaaaggagagaatcaacccaaatcgggaaggagtgataacagaggaatcgctgtggtgattctcgatgccctcacgaggcgacaatgggtccgagaagaagacttggcaaaagatctcaaattacacacaaaacagcttcgccgaactctccggttttttgaagaggagaagatcattactcgagaatataggagagagaattatgattctcctgtcacttatttgaaccttttgttcggagcacttggtagtgttttgttaggatccaattgcaatggattggacttgagtcccgcattgatactatga

SEQ ID NO: 40743 - DNA, 510 bp, Glycine max
  Peptide Sequence Number=SeqID_157521
atgtatagtgctgctacagctgctacagttgatgttcaactaactggaaaagagggagaagaaaagatatatgatgtggttaggtacagaatacatcgcatgaagaagctgctgaaagatgaattggacaacaagaacacaattgaggaatatatctgtagaaaatgtggaaaaagatataatgctctggatgcattgcgattagtatcttttgaagatgatgacttccattgtgaaagttgtaatggaaaacttgaggtagaaagtgacaaatttgttgctcaagaagggggtgatggagatgaaaatgcaagaagatggcggcatgaaaagttaaaagacatgcttcagaagatggagaagttgtcaccatcactggactcatctcctcatctctggtcaagccctcctttctttgccgccatcggagctgccatgcaccaccaccttatccggccatctcttctaatctttttaacgtcttgtcaaatctactcctctccggtgtga

SEQ ID NO: 40744 - DNA, 393 bp, Glycine max
  Peptide Sequence Number=SeqID_157522
atggctaaagttggagaggagaaggttgagtacattaagtattctgatcctcagaaaggagctgttgctatgcttccaccagctaaaactcttttgcctgaaggcttagcctctcgtcactgttggcactgtcatcatgtcgaaactactctcaagccctcgcctctcatcatcgttgatgttgagtttccttcagcttggatctctgacaatccacctaaaatggcgatgtatagcgggatctgcaagcatggagggcgagaacgcgagcaaggtgaccgagttggtgaacgagatagccaacatctccgagtacatgcctccaatgaagaagcagcattgcaacttggcgtagaggctgaagcttctgatcccaatgttcaaggagattag

SEQ ID NO: 40745 - DNA, 4518 bp, Glycine max
  Peptide Sequence Number=SeqID_157523
atggggcatgtaaagttgcaaacgcaaactggtatcagtgcaacagaagagggatctgggcagtgtgaggctgaatatcctaacaaaactactgtggcatgcatgatcaatgcagaaattggtgctgttttggctgtcatgagaagaaatgttagatggggagttcattatatgtcggatgatgatcaattggagcattcccttgttcagtctctgaaggcattaaggaggcaaattttttcatggcagaatcagtggcatgttataagccctgccttgtatctccagccttttctggatgtcattcaatcggatgaaaccggtgcaccaattactggtgtcgctctatcatctgtttacaagatcttaacattggatgtaattgatcaaaacactgttaatgttggggatgccatgcacttggtagttgatgctgtcacgagttgcaggtttgaggtgactgatcctggatcagaagaagtggtattaatgaagatattacaagttcttctagcatgtgccaaaagtaaagcatctatgatgctgagtaaccaacatatttgcaccatagtaaatacttgtttccgtatagttcatcaagcaggaaccaaaagtgagttgttgcagcggatagcacgttacacaatgcatgaacttgttcggtgtattttttctcaccttcaagatattgacaacacagaacttgcattggtaaatgggaacactgctttaaaagaagaggttggtgggataaataatgagcataattctgcaaacgtattggagaatgggaaattgaattctgcaaatgatggtcgacccttatccacaggcattgcttctagtactgtgagtgacgtggcagcaactgtagtggatgaagacactgctattgctagcattggcaaagagactgatctgaatgaattgcagcttatgaatgaaccatatgggattccctgcatggtggaaatattccactttttgtgttctttgttgaatgttgttgaacatatgggaatgagtcctcgatcaaacacaatagcatttgatgaagatgtgcctctttttgccttaactttgattaattcagccatagaattgggagggccttcctttcacagacaccctagattgctgagcttaattcaggatgaattattccgcaatcttatgcaatttggtttgtcaatgagtcctcttgtactttcaatggtctgtagcattgttctaaatttgtatcaccatcttcgtacagaactcaaattacagctagaagcatttttttcttgtgtaattttgagacttgcacaaagcaaatatggggcttcatatcagcaacaagaagttgccatggaggcccttgtagacttctgcaggcaagaaacattcatggtggagatgtatgctaactttgactgtgacataacttgcagtaatgtctttgaagacattgctaatttgttgtccaaaagtgcttttcctgtgaacagtccattgtcttccctgcatattcttgctttggatggtcttattgccgtcatgcaaggaatggctgaaaggataggcaatggatctttaagttcagaacaatctcctgtgaatcttgaagagtatactccattctggcaggaaaaatgtgaaaatttcagtgatccaaataattgggttccttttgtatgccagagaaagcacttcaagaaaagattgatgattggagccgatcattttaatcgtgatactaagaaaggtcttgagtttcttcaagcaacacatcttttgcctgacaaacttgatccccaaagtgttgcttgcttttttcgatacactgctgggttggataagaatcttattggtgattttctaggaaatcatgatgaattctgtgttcaggttcttcatgaatttgctagaacatttgatttcaaagacatgatgttagacactgccctacgtctatttttggagactttcagactgcctggagaatcacagaagatacagagggtgcttgaagctttctctgagagatattatgaacagtctcaaaatatcctagccaataaggatgctgctcttttgttatcatactcaattataatgcttaatacagatcagcacaattcacaggtcaaaaagaagatgtcagaagaggattttatccgaaataataggcgaataaatggtggcaaagatctacctcgacagttcctgtcagaactttaccattcaatttgtaagaatgagatccggacaactcctgagcaaggttctggtttccctgaaatgaccccaagtcggtggatttatctcatacacaagtcaaaaaaatctgctccattcattgtctctgattccaaagcataccttgattatgatatgttttctatattatctggtccaacaattgctgccatttctgtggtatttgataatgctgagaatgcagaggtataccaaacatgtatggatggattcttggctgttgctaagatatcggcttactatcatcttgaaaatatactggatgatttggttgtgtcactctgtaagtttgtcactgtttttgatccattatctgttccggagtcaatcctagcctttggagatgacacaaaagcaagaatggcaactgagactgttttcactattgcaaataggtatggtgattacattcggacagggtggaggaatattcttgattgcatcttaaaatttcacaagttaggtcttcttcctgctcgtatggccagtgatgcggctgaagagtcagagctttctacagaaactgaggatggggggaagcagaatactaattctttatctttatctcgtcttccatctgttaatactccgaagagaccctcaggattgatgagcaggtttagtcaactattatatcttggtgctgaagagccaagatcagaacctactgaagaacaacttgctgctcagcagtgcacccttcaaacaattcagaagtgtcacattgacagcatattcactgagagtaaatttttgcaagctgaatctctattgcagcttgcaaaagcactcactagtgcaggagtgtggcctaagaaagggaacagcacatctgaggatgaggatacttcagttttctgcctggagttactggtagcaatcactctgaataatagggatagaattgaacttctttggcagggtgtttatgagcatatctccaatattgttcagtcaactgtgatgccttgtgcattggttgagaaggctgtttttggcctcctacgaatttgtcatcgcttacttccctacaaagagaacattactgacgaacttctgaggtctttgcaacttgtcctgaagcttgatgcacgtgttgctgatgcatactatgagcagatcacacaggaagttagtcaccttatgaaggcaaatgcttctcatattagatctcatttaggatggcggacgattacatcactgctttccatcactgctagacacctggaagcagctgaggctgggtttgatgcattgttgttcattatgtcagaccaagcccacttgcttccagctaattatgttctctgtgtagatgctgcgaagcagtttgctgaatctcgtgttggacaggtagaacggtctgtaatggccctcgatcttatggcagggtctgtcagttgtttagagaagtggactaatgatgctaagcaagcaacgaaagaagaggaagtggcaaagatgttgcacaatattggggacatgtggttgaggctcatacatggactaaagaaactatgtctggaacagagagaggaagttagaaaccacgcgttgttatctttgcaaaattgcttgacaggatcagttgggattaatctcccacatagtttgtggttacaatgttttgatcaagtgatcttctctgtgcttgatgacctgcttgaaatttctcagacacactctcaaaaagacttccgcaacatagaaggaacccttgttcttgctttgaagctcttgtgtaaagttttcctccagttaatccaagacctatcacaattgccaggcttcaacaaattatggttggctgtactaagtcggttagaaatttatatgaaggtgaaagttaggggaaggagaagtgagaagcttcaggagcttgtgcctgagcttcttaagaacactttgcttgttatgaaagcaggccgtgtactagtccagagcaatactgtagatggaagtagtttatgggaactgacttggctgcatataaataattttgctccgtcgttgcaatctgaggtgtttcccgagcaagactcagagcatttgcagcacaaacagactgaaaaagttgaaggtttggggcctgaagaaagcaattctgtgtcttcaaatgaaacagcaggttgtctgggttctcttgaagtgattatgcagaacattacagatctcattcacatcttcattgggacgcttgatgttagtgtaagatttttggttgaagatatgttatggcttgagacacattag

SEQ ID NO: 40746 - DNA, 485 bp, Glycine max
  Peptide Sequence Number=SeqID_157524
cggatatgaccgaaaggcttcttgccggttcattggctcttgaaagccgcatccttcactatcttattgctcgcattgcgattaatgctcctttaccatatccacatttagtcacccttttccttcaacatttcaacatccctcttgattttgaaccttatgttccaatcaagagatctttcttaatcagtgctgctgtggttgcgtcctttggttaccgcaaagagcgtaatggctcttgggcaaaaaagggtgctcaaccaaatgatgatgaaggacaaataccagttgaaggagactcttctctccttcaaagtattttggacaggtttgatggactccaaacctatgttggtgagaggtttgatgctttggaacaacaagtggacatgcgatttgatgcaatggactcaaggatcacaaaggttgaagaagaagtcaccatcattcgcgactgccttgatttacttccaccaccatcatca

SEQ ID NO: 40747 - DNA, 300 bp, Glycine max
  Peptide Sequence Number=SeqID_157525
atggttcctcgcatgccatcaggcctgtcgcctctggatgacaaaggtaaaaaagtgcgggaccaaatggttcccgcatgtcatcgggcccgccgcctctggatgacgaaaggtgaaaaagtgcgggaccaaatagttcccgcatgtcatcgggcccgccgcctctggatgacaaaaggtgcagaagacaacgttagtctctgcatgccatcagacacgactgtgtctgaatggcgaaaaggtgagcggaatgaccataatttgtctctgcatgtgatcgggcccgtcgcctctggatga

SEQ ID NO: 40748 - DNA, 168 bp, Glycine max
  Peptide Sequence Number=SeqID_157526
atgggtgttaagccttccgaagcgatcaacaatggtccccggatgaaattaggtttctccttgaaacatcccgaaactttacggattccccgacgatgggtgttaaacacggtcaaacaaaggtcgcatgccaacaaacaatggtccccgaacgaaattagggtatga

SEQ ID NO: 40749 - DNA, 636 bp, Glycine max
  Peptide Sequence Number=SeqID_157527
atggcaatggtttcggtagttttggccttgatcatacactttgaacctcactatggacagactaacatgctggtctacttgggaatttgttcattagttggctcacttacggttgtgagcataaaggccattggaattgcaataaagcttacacttgatggaataagtcaaatagtttatcctcagacttggttttttcttaccgtggccataatctgtgtcattacacagttgaattaccttaataggtgctgttccatggggcaggggcaaaccctcttggcttttgttattatagttgtttttaagaggaaaaccaatcaaagggttggtcttctagttttgatcttcaaacatgatccattgaaagttatacagagaagtataaaacacaatgttgtgaacagccctgtcctctggatgattggtcccggtcaggatatcagcagcatagcctctgagatatgtggattcatcactgttcttacaggaacaatcatattgcacatgactagagaacaggaagaatccaatatgcaaaagaccttgacatggttgataggagaggatatgatgaaggatgttgagaatgaacacctgattcttatacacgattcggattacctagaacgttga

SEQ ID NO: 40750 - DNA, 99 bp, Glycine max
  Peptide Sequence Number=SeqID_157528
atgtatgatactgatttgaatgatcataacatacatgcattaatgaatgtcattacatattatgatgtagcttctaaggagcatgccactcgtggttga

SEQ ID NO: 40751 - DNA, 107 bp, Glycine max
  Peptide Sequence Number=SeqID_157529
atgaaagcagccagactcagaagtgaccccaatatacttagccatatctttacttcccaaaacttgctctacaatgagtttccttcgttcttttgcaagaaacaagg

SEQ ID NO: 40752 - DNA, 1467 bp, Glycine max
  Peptide Sequence Number=SeqID_157530
atgcatgttcttttttctgcgaagagagtagcgttctctgagtcctttctgccacacagaagaaggcttttcacttggttcagtttaagtactttagcttctcttgttctgttgtccctcttccttctcagtaactccctcagggttcctaaagttttagtctttgttccaaaatttggcgctgttggtgcaaactcttctgttggtccttgtcccttgtttcctttcaacaccagccactctttttccaatgagaatgacacttttgacacttcaaagtcaaatgggtcagagagttctgtgaagagaattgaagagggaagtgttgttgaaaatcttcatgtagtgaataatgtgtcagatgaaaacattaagagtgttgcagaagggaggggtttggagaattctagtttttcttctattttgttgtcagagagtaaccatgggaagcaaccaaagcatgaggggggttttgttggggaaaagagtttaaagaatgtaactgttactcataatgagaaaatgcatgttggtttatatgacgagaaatgtgacatttttgatggaaagtgggtaagagatggttcaaagccatattatcctttaggatcttgtcgcctaattgatagagattttaattgtcaccgtaatggaaggcctgatgctgaatatgttaaatggaggtggcagccaaatgggtgcataattccaagtttgaatgcaactgattttctggagaggttgcgtgggcagaggctagtttttgttggggattcactgaacaggaacatgtgggagtcacttgtatgcattctccgtcaaagcatcaataaaaagaaacgggtttttgaaatttctggaagaagggaatttaagaagaaaggtgtctatgcttttagatttgaggactataattgttcggtggattttgttgtttcaccattcattgttcaagagtcaactttcaagggcaaaaatggttcgtttgagacattaagattggatttgatggaccgtactacggccaggggtgggcaatggaactcaggaggacagtgccacaaagaaactgagccaatattcaatgaagcttacttacaaagatatccttcaaaaatgttggctctagaacatgtcatccaacaaatgaaaaccccagtagtatatatgaacataagtaggcttacagattacagaaaagatggacatccttcggtatacagaacggggtataaggcgtcgatgaagcagaacactgctgcactattcgaagattgcagccattggtgcttgcctggggtaccagatacttggaatgaattgctatatgtttctctcttaaaatatggaaaagtcttacccttacacatgcaaagaggctgtttaacccttgaccaacaggtcactaaggcacaactttacccttgtgattatactatttgggttgatagcaagggaaggaaatag

SEQ ID NO: 40753 - DNA, 171 bp, Glycine max
  Peptide Sequence Number=SeqID_157531
atgtacatgataaagataaacaaactatttatccctatagtttcctggaatactttcaataaactgaagagaaagcctgattctagtcatctgcaaattgagtgttatggacaacacaagttgagaaaccaatggctaaagcataagcaaactgtaggaggtggagtgtga

SEQ ID NO: 40754 - DNA, 168 bp, Glycine max
  Peptide Sequence Number=SeqID_157532
atggagatagacataaaagaaaggccaaaggaagtgaaatcctatttctctcattttcaagggaatcaaagtgcaccagagagaagttcctatggagaaaggacaaagaaagaaaaggttgagagcgcgcaagttgaaacgtcaacgtgcaactatggtgaacaataa

SEQ ID NO: 40755 - DNA, 138 bp, Glycine max
  Peptide Sequence Number=SeqID_157533
atgaggttccattgttatgctaacaatgctgcatattacaagcaaagggtagggagggagactaacctgttcgcggagaagaagaagaaaaccttgggcgcgcctcgcggagaagaagcaagttcacgaagaagataa

SEQ ID NO: 40756 - DNA, 243 bp, Glycine max
  Peptide Sequence Number=SeqID_157534
atggaggtgtttggttcgcttgcgggaaacgacaaggagaagacgaagaagaaccgttttcttgaggcttgttgggccacgtcgcgcgtgtccacttggtgggcagcgtccaatcgtgcgtgtcctgttgttcaaccgtgtccggtgacggcggaagcaacagacaccgcgtgtgtccggtgcgaatctgatgcgggacacgccgatgaagtgccgcatctatgcttcttagatctgcactaa

SEQ ID NO: 40757 - DNA, 420 bp, Glycine max
  Peptide Sequence Number=SeqID_157535
atgtcacatccagaaccaatggttgaagaaaatactattgaggtggattcaaatcttgactcttctttgaaccatgaaacctctcaacataccccagttgtagaagaggaacttccatacaaagatcatgccactattttcattcctatttcgattgttgaaacaaatgaaccaataattgatgaaattgttgccaaaacatctctagttatgaatgtagaaaatcatctaggagaaacagatccaacaaatgttgatccaattgcctttattgaggcttggccttcgaattcgatgccatcaaaagcttatgaatttggccacaacaggccattcacacattttgatgaagttgtggcaaagtttcaaagattagatttcgatccaaaccttaaagactcactttcaaatccaaattag

SEQ ID NO: 40758 - DNA, 327 bp, Glycine max
  Peptide Sequence Number=SeqID_157536
atggtggcctcctctcaccataatatctctattgatcaaaatgcttatgctaatactaagaaaagtacaccattgccaacaccaagagtgacgacaacaacaacaaacaagggccttgaactgattcttattccaggacacaaggaagaatgcaagaaggtgtgggaaacccaagaactactcccaacctctctaaacactaaacacttttgctttgcagctacgattactagtcttaaacctttgggtaaaacctatgctttaggtttaattgaagatcaaatcgaaatgaccgaagtagatatagactttagtgctaagtcttaa

SEQ ID NO: 40759 - DNA, 177 bp, Glycine max
  Peptide Sequence Number=SeqID_157537
atggaagaagaaagaaagaggagaaacataactgtgctcttagggaaaacagtgtcacgtgtgattcaattgatagcgaggtttggggcgaatagcttgctaacattcggctctttgttgcggttcttgtgggaactgtggcatcatatggctttgctcaagatatgggaattctga

SEQ ID NO: 40760 - DNA, 1425 bp, Glycine max
  Peptide Sequence Number=SeqID_157538
atgtcgagaataaacaacagccttgtctggatggacgaaccagaagccgaaaacactgcctccgcttcctgggccagaaactccaagcctaacaacaacaacatcatcattaccaccggcacaaccacaaccacaggtttcgtcgaaacctctaacgacttaggttctctctgcgccttcaagcccatgctcgatgttgacgacgaatggtacaacaacatcaccaaccaccaccaccaccaccaagatatggccttcgaccccgacaacctcttactccacccctccgccgtggactcctcctcctcctgctccccctctcacctccagttcttcctccctcccaaccccaaactcaaccccttcgatatgggctttcttgaccctcaagcttcttcttccttaccccttctcgcctccgaaacaacacacttcacaccccctcagaccagcaccaccaccgctttcgccggcttccagagcctccaagagggttcctccaatcctctctttctcaaccgttccaacattctgagacctctcgagtcgctgcccccctccggggcccaacccacccttttccagaagagagccgcgctcaggaagaacatgaacatgagtgacaataagaagaggaaggagaaggatgaggtggtggttgaggatgtgagtttcgacgggtctggcttgaactacgattctgacgacttaactgagagtaattataatgacgctaaggagaagaatggtggtgggggggttagttccaatgccaacagcaccgtcaccggtttggatcagaaagggaagaagaagggaatgcctgctaagaatttgatggccgaacgacgccgccggaagaagctcaatgacagactctacatgctgaggtccgttgttcccaagattagcaaaatggacagggcttcaattcttggggatgcaattgagtatctgaaggagcttctgcaaaggatcaatgatctgcataacgaattggagtcgacgccggtgggttcttcgctcactccagtctcaagtttccatcctttgacgcctactcctcctacgctgccgtgccgaatcaaggaagaactgtgccccagctcattgccaagccccaatggccaacctgctagggttgaggttcggctgcgtgaaggaagggcagttaacatacacatgttttgtggccgcaaacctggtctgttgctctcaaccatgagggctatggataaccttggattagacattcagcaggctgttatcagctgcttcaatggatttgctatggatatttttcgagccgagtataaaaggctaacaatccttctctttcagcaatgcaaagaaggtcaggatgtgcatccggagcaaatcaaagcagtactcttagattcagctggctacaatggcatgatgtaa

SEQ ID NO: 40761 - DNA, 1170 bp, Glycine max
  Peptide Sequence Number=SeqID_157539
atggcggctactgtgtcttctgcgtggtcaaagcccggcgcgtgggctctcgattccgaggaacacgaagccgaactccttcaacagaacaacgacaagccactcgccgacttcccctccctcgccgccgccgctgccaagcccaagaagaagaaggcccagacctactccctcgccgaattcaccgccaaacccgacacctcctttgccgaccaagatcccgtcgtcctccccaccggcccccgccagcgcaccgccgaggagctcgaccgcacccgcctcggtggcggcttccgcaactacggcgaccgccccaacaggaacaactccggcggcggcgacgagtcttccaattcccgctggggttcatctagggtttctgacgagcccaggagaaatggttttggggctagggattccaatcgggagcttcccccttcgcgcgctgacgaaactgataattgggctgcgtcgaagaaaccctctggaggagggtttgagaggagggagagggacaaaggagggtttttcgattcgcagtctcgtgcggatgaatctgatagttgggtttcgaataagagctttgtgccgtcggaggggcggagattcagctccaacggcggcggagagaggagggttgttggattcggctccagcggcggcgcggattccgacaattggaacaataagaagaagagtgagtccaacattggtagcagcgagagtgttggtgttggtgggaggccgaagcttgtgttgcaacctcggacactgtcggtgagcaatgaaggggataatgtggggaagcctaaaggggttaatccgttcggagaggcgaggccgagggagcaggttttggcggagaaagggcaggattggaagaagattgatgagcagcttgagagcgtcaagattaaggagacaagtggtggtggtggtgatgggtttggaaagaggggttttgggtcctccaacggtggtggtggaggacgtgctattttgcctgaaagtcgcactgagaggagttggaggaagccccaatctgatgatgatcgccctaaaagttgtaatgctgttgagctgtttgctcttaaatgcagtgctgagaaagtggaaaatgaacctgatcaaaaaaaggaagtggaagatgaacacgttgaggaaaattga

SEQ ID NO: 40762 - DNA, 345 bp, Glycine max
  Peptide Sequence Number=SeqID_157540
atgccttatattaaatcccaccaccaacaacaaagtcataagctgcgacagctaattccagcagcaacaacaacaacagaaaaagaagaggaagaactaggaattcctcttgttgttgttgttgtccttgtccctctcttcatctttgatgggttccaaggtctcgaaacagaaactctggggaagactgccccggctcagattatcatccctcagacagaaaaaaatggatgtctgagctaccctgagaaagttgtgacaaaacaaattgtttggcctggaacccatgattctgcaaccaataagattggcatcccatgcatcactcggccttttgctcaatga

SEQ ID NO: 40763 - DNA, 4104 bp, Glycine max
  Peptide Sequence Number=SeqID_157541
atggattatgaggctgatggttttggtgccaatggcgagggagagagcaagagagtagtgggtggtgaaggggtttctgaggagagtgtagcgggctctgatcaagtcaagggtttagaaacagaggaggtttttcaggaggcaatggagccacgggagcaggtccatgatcaaggatccgaactcaatttggaggatacggtagttgataaacaatatgatgctgaaaccggtgttgcattgacttctgctttggcggatggaaatactccagatgccgcgcaggagcccgattactttaaggaggctgttttggctgatgctgactctgggaagctggggggagatgatgtaatttctgagcaagacttggaggaaagggatgggcagggaagtgataatgttcatctggatggtgttgattctggagtgcctgtagatggagaaatttttgatgaatcccatggtgtgggggatgataatctggagagtagtgatgggggtggtggaaaggaagaatctgggttaaattctgacagagagatgttagttcaggagaatggtactatggtggatgaaaattctggtttggtgagtgagagggctgaaatcgatgattctgaattcatgactcctagagaaaatggtggtatgatatttgagaatggaagcacaaacaaggtcgatggtgttgctactgaacctattatggaatctgaatccagtgaggttattccagcccaaggtactgatgctggggatttgaaggagtgtggctcagatactgaacttggagatgacaagatagaggtaaagttaaatgcttcagctgatccttctggggagattcaagatgatacatctgaagaagtacacgacaattcggctcacatgactttagaacatcaagatgaagtaactagggatatgaaggatgattctctgggcactaatatgagtcacgaggatagaaatggtgaagaaatgagtactgatggcattcaaaatactgaagtaagagattatggtaatggccatgctgaagctgaaagctcaccaccctttttggaaaattcctctactaatctgacaccgtctattcaggaggctagtgcagctgaaccaaaggaagcaagtaataaggatgatcaatctcagatttttgatgaagagcatagagatcatgacaatacttctgtggttgaggagcctgaaagcatacaggagaagattattcaacagacaggcaccactcctagtgcagctgaaccaaaggaagcaagtaataaggatgatcaatctcagatttttgatgaagagcatagagatcatgacaatacttctgtggttgaggagcctgaaagcatacaggagaagattattcaacagacaggaaccactcctagtgcagctgaaccaaaggaagcaagtaataaggatgatcaatctcagatttttgatgaagagcatagagatcatgacaatacttctgttgttgaggagcctgaaagcatacaggagaagactattcaacagacaggaaccactcctagtgcagctgaaccaaaggaagcaagtaataaggatgatcaatctcagatttttgatgaagagcatagagatcatgacaatacttctgtggttgaggagcctgaaagcatacaggagaagattattcaacagacaggaaccactcaagtgactggagagcaacatgttcaacctgcagcagatatttcttcttcatctaaaaggtctgctggtactgtgcctactcctgtccgtccttcatctgaaaattctcctgctgctgggcccactcctgttcatccaactggccttggtcgtgcagctccattactggaacctgcatctcgggtagtgcagcagccccgtgctaatggtgccgtgtctaatactcagtcccagcaaatggaggactcctcgagtggggaggctgaggagtatgatgagacacgtgagaaacttcagatgatcagggtgaagtttttacggttggctcataggcttgggcaaactccccataatgttgttgtagctcaagttttatatagattaggactggctgagcaactccgaggaaggaatgggggtcgtgttggtgcttttagctttgatcgtgcaagtgcaatggctgagcagcttgaagcagcaggtcaggagccacttgatttctcttgtacaattatggtccttggaaagacaggagttggtaaaagtgctaccatcaattctatttttgatgaggttaagtttaataccagtgcttttcatatgggaaccaagaaggttcaggatgttgtgggaacagtgcagggcattaaggtacgggtcattgatacgccgggacttctaccttcctgggcagaccagcgaagcaatgagaagatcctccactctgttaagcactttattaagaaaactccacctgatattgtgttgtatcttgataggttagatatgcagagcagggattttagtgatatgccactcttgcgcacaataactgaaatttttgggccatccatttggttcaatgccattgtggttctgactcatgctgcatctgctcctcctgaaggccctaatggtactgcttccagctatgactggtttgttactcaacgttctcatgttgtgcagcaagccattcgtcaagcagctggtgacatgcgtctcatgaatcctgtatccttggtggagaaccattctgcttgcagaacaaatagggctggtcagagagtattgccaaatggccaggtttggaaacctcatctgttacttctatcttttgcctccaaaattctggctgaagcaaatgctcttctcaagttacaagatagtccacctgggaagccatatgtagctcgaacaagagcgcctccattaccttttcttttgtcaacccttctccaatcaagaccgcagttaaagttgccagaggagcagtttggtgatgaggacagtcttgatgatgaccttggtgaatcatcagagtctgatgatgaaaatgaacatgatgacttgccgccatttaaacctttaactaaggcccaggtggaagagctgtctaaagctcataagaaagcatattttgatgagttagagtatagagaaaagcttttgatgaagaagcaattgaaggaagagaaaaagcaacgaaaaatgttgaagaaaagggcagaatcagcaaaagatctgccaagtgaccatagtgaaaatgtggaagaagaaagtggcggtgcagcttctgtccctgttcccatgccagatttggccctgcctgcttcttttgattctgataaccccactcaccggtatcgttatcttgattcgtcatcaaatcagtggcttgtaagacctgttttagaaactcatggatgggatcatgatgtgggttatgaagggttgaatgtagaaagattgttcgttgtcaaggaaaagattcctttatctttctccggtcaggttactaaagataaaaaggatgctaatgttcagatggaaatatccagttcagttaagcatgggaaagggaaagcaacttcattaggttttgatttgcaaactgtggggaaggacttggcttatacattacgcagtgagacaagatttactaattttagaagaaataatgcaactgctggtctctcatttactttacttggtgatgccttatcatctgggttgaagattgaagacaaattggttgctagtaagcgattcaagcttgttgtcagtggtggtgcaatgacagggcggggcgacattgcttatggtggcagtttggaggcccaactgagagataaggattatcctcttggtcgtttcttaactacgcttggcctttctgttatggattggcatggagatcttgctgttgggtgcaatgtgcaatctcagatcccagtaggacgacatacaaaccttgttgcccgggcaaatttgaataatcgaggggcagggcaaataagtattcgattaaatagttcagaacagcttcaaattgctttgattggtctcatccctctcctaaagaagctagttggttatcatcaacaaacgcagtttggacaatactga

SEQ ID NO: 40764 - DNA, 1212 bp, Glycine max
  Peptide Sequence Number=SeqID_157542
atggtggctgggtatgcacacaagggcagatttgctgaggctttgagattttatggacacttgaggagattgtctgtggggtataatgagtttagctttgccagtgtcttgattgtttctgtaaagttgaaggattttgaactttgtaggcagatccatgggcaggttttagttattggattttcgtccaatgtagttatatccagcttaattgttgatgcttatgccaagtgtgggaagttggaagacgcgaggagattatttgatggcatgcctgtgagggatgttcgtgcgtggacgacattggtttcgggttatgccacatggggggacatgaaatcgggtgctgagttgtttagtcagatgcctaaaagcaattcctgttcgtggacatctttgattagaggctatgcaagaaatggtatgggttatgaagcaattggggtgtttagacaaatgatcaggcatcaagttagacctgatcaatttacactcagtacttgcctctttgcttgcgccactattgcttcactgaagcatggtagacaaatacatgcttttttggtgctgaataacatcaaacctaataatgttgtcgtttgtgctattgttaacatgtattcaaaatgtggaagcttggaaactgccatgcaagtctttaatttcattggaaataagcaggatgtagtgttgtggaacacgatgatattggcactggctcactatgggtatggtatagaagcaattatgatgctatataatatgctaaaattaggagtgaagccaaatagggccacttttgttggcattctaaatgcttgttgtcattcaggtcttgttcaggaagggcttcagttatttaagtccatgactggtgggcatggtgtcgtccctgaccaagaacactatactcgcttagctaatcttttgggtcaagctagatcttttaataaatcagtgaaggatctgcagatgatggattgtaatccaggtgaccatggttgtaattcttcgatgggtctatgtagaatgcatgggaatatagatcatgagacagaagtagctgcattccttattaaattgcagccagaatcttctgctgcctacgaatttcttgcaagtacatatgcttcacttgggaaatgggaattggttgagaaaataagacatattttggatgagagacaggggaggaaagggtcaggctattag

SEQ ID NO: 40765 - DNA, 231 bp, Glycine max
  Peptide Sequence Number=SeqID_157543
atgatcgaaattaatagtgaaaaaaatcaacggtgcatcaaagggggagagaaaaaagaagataaggcgcaattaatcaacttatggaagactgagcaagccggggcggtgggaggcgatagcggcgacgttcggtggaaggcacgaagtgaagagtgtgataaagaaggcaaaggacttgggggttgcaaaaatggtgttgtgcctgcatcttctttacttctgttttag

SEQ ID NO: 40766 - DNA, 135 bp, Glycine max
  Peptide Sequence Number=SeqID_157544
atggagagagagaggatgagaaatagaagggagcaagacacgtgtagggcgaaagtgtgtgtcaatgtgtatggtccaaagcaacaacagagggaaggaatctttgtccccgcacaaatactaatattattatga

SEQ ID NO: 40767 - DNA, 177 bp, Glycine max
  Peptide Sequence Number=SeqID_157545
atgagaaggagtgatcggatctcaatggtggtggggttgtcgatgtggcgctatgacagaggaagatgcacaatagatctcatgggtcagtgtgtcaaagggtgggggttggctttgggtgctgttggagatggtgaatatgagcagtttggcgacgagggggaaggagagggatga

SEQ ID NO: 40768 - DNA, 255 bp, Glycine max
  Peptide Sequence Number=SeqID_157546
atgatagcacaatcatggtgtagggtagttgcgcccacggagcctcaaaggtggagattgcccgtgggtggaggtcgcatgcaagttgttaatggtgactatggtggggggtggagcttagggtgggtaggaagaaggtggggagtgtgtgagatgacaagggaagaaggagaaggaagagggaggggcaaattggacttattcgtgggaagctcggggccaatagcaactcctaaagggataaatgctccataa

SEQ ID NO: 40769 - DNA, 792 bp, Glycine max
  Peptide Sequence Number=SeqID_157547
atgagaagtggcaacaacatcataaggactgtgaatgtcaccgtcacagtcattgccaccgctgaatctagaatcaaggaagttctaagacacttgaagaggttcaacactgatctcccccttatgttgagctctcgattctcttgtgtttccactcctaacactcagttgaagatagcagtagataagtatgtgttgtaccaaaaggctaactgctacaagggtaaggagttgttgattgaagaagatgaagaggctccaccaaccaaatatgtcaaggttcaccctagcaaactctctaagcatgaacctgaagttatcaagaggaagaaaaagcatacaaatatggatttgtatgctataatacgcttttacagactgaaagctcactatccaggtttggaaccagatgagaagccccctgtagatggaattgatcatcagattgggttgttatcagactctgaatcatacttgcttcactcaagagactcctttcaacatggtctactcatggatcagggagttttatgctgtttgcccggaacttgtcttttgttttgtatcttccctactccagattcatcttcactcatcacgttgaacccatcattgaagatgtttattctgatgttgaaccttaagctgatcttgatgtgtttgcacttgaagcatatgatcctccaccttccagggagtacgttagcgggattgaggctgagttactcagaacaaggaaagaacttgctcaagctctggaagacagacgatatgctgagaagcaagctgtga

SEQ ID NO: 40770 - DNA, 507 bp, Glycine max
  Peptide Sequence Number=SeqID_157548
atgacttcgaagggggctgggaatggacaaaagagcgcagatattgctcgaggattctattcattacctccgtttggccgtcagtctgggggtggtaggccgtactcatgcggaggagggaagagagtcgcgaccttgaaggctgagaattgcgtagccggtaggtgcgtgatgaagtccatggatatatcctcccatactcttgtcggaattgggagaggttgcagtagtccagccggccgtgccagaagaaactggactgaagtcgatgtgaggtctttgcgacgcccatgtggccccctaacggtgttgcgtgatactcgagcaggatggtggggatctcattgtggatgtgatagtcaatgtgagctgaaggattggtcgtcacctgggataatagttcttggaactgagggtcatcgtgtaacgttcgctagagatcctccaggaattccaggagatcgcgataatgcatctgcaacgatattggacgcgcctgctttgtag

SEQ ID NO: 40771 - DNA, 2172 bp, Glycine max
  Peptide Sequence Number=SeqID_157549
atggctgaccacacgaccaggaaaaccaccactgatagactagaagacgcggttgctcgcctgacccacaaccaagcttccctcaatgaaaaatacacagagttatcaggcaaagttgattcaatcctcgaccatctgcgcctccatgacacgaacaccacccactctagtccccgaacttccttctcccaacgaaaccacatcaagctagatatttcgaggtttgacggccgtgactcgatgggttggattttcaaaatcacccagctgtttgactaccagaacacgccggaggaggagaggattacggtagcctccttttaccttgatggcgcagccctaagctggtatcaatggatgttccgcaatggattcatcacatcgtggccagggttcttgcaggctctcgaatccagattagctaatcgggtaattgggttacctccaccgttcatgttaagttgttttatctctgggctgtcacccgagatatgtcgggaagtgctagctcttcagccaatctccctccctcaggcaaccgcactagccaagctacaggaggacaagattctcatgctcatcgcagaaaaccccacgccggaaatagacgaactcagccaggaaatatccacgtctccggcagcagcaactaacgaagtatcggaattaactccggaagatccataccctcatatcagcctacacgctttatcagggttaccctcgtcggaaaccttctgcctctacggcgagctcaaccacgcgcacctcaccatcctcatcgatagtggcagtatgcacaactttctccagccacgcatagctcaattcctccatcttccggtgaagtccacccagcctctacgagtacttgtcaggaatggctccatcctcaactgtgatcagctgtgccccgatacatcattatcacttcagggacaccattttagtgtctcgttccacttgcttccgataagtggggctgacgctgttctgggtatcgaatggcttaagcaatttggtccagtagtcactgactacacctccctagttatgaagttccaccatttgggccaggcaatcgaaatccacgcagatgttacgaatgggccagaacccgtttccacagcccaggtaaagcgtttcattcaaaccgggtcaacatccaccctgtttcacttaagtattttacccacggcccaacccggcccaacatcacatcgtcttccccagagtcatcttccccacctagtctccgccatcgaaaccttactgtaccagtatcagcagctattccagacaccaaccaccctctctcccccacaagctgtcacccaccacataaacctccttccctcatcttccccgatcaacgtacgtccataccaatatccacattttcagaaaacaaaaatagaaaagcaaatctctaacctcttatccgctagcctgatacgcccaagtaccagcccttactcatcaccggtcctcttagtcaaaaagaaagatggcacctggcgtatgtgtgtggactgtcgcgcgcttaacgccgtgaccatacgcgaccgttttccgatacccaccattgacgtgttgttagatgaactgggtcaatcaacatggttctccaagctcgatcttcgacagggattccatcagatactcatgcacgagcctgatattgagaaaacaacgtttagaacgcatcatggacactatgaatatcgtgtcatggccttcgggttaagcaatgcaccttccactttccaggctgccatgaacaacttactgacaccattcttgcgctgctttgccacagtatttttcgacgatatccttgtttatagtaagtctttatcatctcacattcaccatctcgaggcagtcttcaaagcattactacatgggcaattctatctcaaacgtgctaagtgtgttttcgcgcaagatcaagtggagtatctagggcatgatgcgttcgaatggaatgaagattcacaagctgctttcgataacctgaagttaacaatgactcgtgcaccagttctcgctctccctaacttctcagagttgtttgtggtcgaaatagacgcatcacaaactgccatgggagtcgtgctgacacagaaggatcacccagtagcgttcttcagcaaagttttcggaccttga

SEQ ID NO: 40772 - DNA, 729 bp, Glycine max
  Peptide Sequence Number=SeqID_157550
atgggcgtcgcaaagacctcacatcgacttcagtccagtttcttctggcacggcctcaaggaggatgttaagcgctttgtccgggaatgtaaggtttgtcaacaaaccaagtcaagcactcgccgaccggctggactactgcaacctctcccaattccgacaagagtatgggaggatatatccatggacttcatcacgcacctaccggcttctcacggattcacagtcatcttcgtcgtcgtggatcgttattcaaaaggcattcacttaggcgcattacctacgcaattctcagccttcaaggtcgcgactctcttcctggacctcgtatgcaagcatcacggtttccctcgaagcattgtgtccgacagggaccctatatttctcagttcattttggcgcgagctcttttgtctacatggcaccctcctccgcatgagtacggcctaccacccccagactgacggccaaacggaggtaatgaatagaatcctcgagcaatatctgcgctcttttgtccattcccagcctgcaaactggttcagatacctagctctcgtagaatggtcctacaacacgtccattcacacaagcttaggttttacccccttcgaagtcatatacggcaaaaccccaccgacgttaccccactacattccgggactgaccagcaacgaagcagttgacaacctaatccacaactgccaagagatccacaggaaactgtag

SEQ ID NO: 40773 - DNA, 255 bp, Glycine max
  Peptide Sequence Number=SeqID_157551
atgggccccgacggccaaaattcagaagctttccctcactctcacgttgcttttctcttcttcttcctctccattgaagcctccatcaaagctccaaactttgctcaccttttctactccaaatcacaaaaggaagccattttcgaagtcgtgaagcgcacctctatgtggtgggacttcaaatttcaggtttgggtagacttcttctcacatgattttcatgggtattgggtttttgggagatatgatgggtag

SEQ ID NO: 40774 - DNA, 1558 bp, Glycine max
  Peptide Sequence Number=SeqID_157552
agagacattccaggatttgcacaatgcaagatcctcatttgaggaagctcgtttcaatctggttagtgctcttcataatgttgaggccaagaagagatttgattttttggaggctgtcactggagttatggatgctcatcttcggtattatcgacagggatatcagctattacaagagatggagcctttcattatcgaggtattggcttatacacaaaaagcaagagaaagttacaatgaggagcaaattagtctttgtgaaagaatgttggagtacaaaaaacatgttcatcatgaaagtatgttgtccttgaatggtccttatggttctccttgtagagatggtccagtgcatcctttttctaggatatcagataaagtggcagatgctgtaacagaatctgctgaaaatggaaaggttcaaatcattcgacaaggatatctttcaaaacggtcctcaaatttgaggggtgactggaagagaaggtattttgttcttgatagtcgcggaatgctttactactttcgtaaaccatggagtggattaaacagtggcaatcaatcatctttacacagaaactgtgccactgaaaatagtgctggaattttgagtcgcctcctttcttcacattaccatggacttatccctgatgaaaaatctgtagcacgtcatacagtgaacctgctcacatcaacaatcaagattgatgctgaacagtcagatttaaggttctgcttcaggattatttcaccatcaaagagttatacattgcaggcagaaaatgccctggaccagatggattggatggaaaagataactggtgtaattgccaccttattgagtgcacaaacactggtacatcatatatctttcttgtgtgttttgtttatgttactgccaaaagatgaggatactaggctatgccaaaggggtttcattcaagttgtcgccaaaagagtactgggcaatgttgaaggggtcttaggttatgtcaaagggattctaggttgtggccgagagggtactagcccatgccgaaggggtcccaggttctgtcagtcagatgactcagaaagcggtgacagctactctgccaacaagacttatttgttaaaaggttctccagatgatgatcatgcagtgagtggggattctataaaaaatgaaaagccaattgatgttcttagaaaggttagcgggaatgacaaatgtgctgattgtggtaaacctgatccagattgggcatccttaaaccttggcatccttatatgcattgaatgttccggtgttcaccgtaatcttggtgtacatatatcaaaagtaagatcactgacccttgatgtaaaagtatgggattctgcagtgttaaccatgtttcagtgcttggggaatctctttgcaaactcagtttgggaggaactgttgcattcgacaagtacatcacagactgatgacactcctgatggttcatccaagacacacaaaaagttatttcatgcaagaaaaccagcacatgatgatgctatttcactaaaggagaggttcattcatgcaaag

SEQ ID NO: 40775 - DNA, 396 bp, Glycine max
  Peptide Sequence Number=SeqID_157553
atgaattggtgtggatgcagctccagtgcatggaagagagttcagaatcgttacgctcgagatgtttcaagttctacaaaggatgtcgaaagtacacgtgggttttccatgccaatggaagggcttggagaggcatatgatggagacattgcatttgcaagtgcccttgaaaattttggaggagggcataatgatcctctatttgtaactttgggaggacctgtcatgaccaaattttctattgctttgagagaaatcagtacatacaaggaacttcttcggtcccaggcagagcatatgctgaatgaccggttactaaacatgctaaacgtcgatatcctagatgtcaaggaagctagaaggcgttttgagaaagcttcccttgtacatgatcag

SEQ ID NO: 40776 - DNA, 309 bp, Glycine max
  Peptide Sequence Number=SeqID_157554
atggaaagcgtggacgcgaacagcgaagtcgaaaacgacgcggaaatgaagctcttgagagataaattcaggctctccgcaatctccatcatcgaatctcaagagcgcctggctagggatcttcatctatttgcgcagcatgcgaatcgtaaatctgtaaatatggaagatgtgatactttgtggacataggaatgaacatgtatctggcatgttgaggagcttctccaatgatttaaaagccaaggatcctcaatctgaaaggaagcgaaagaaagaacccaaaaagaacgacaaaggaaccgcttag

SEQ ID NO: 40777 - DNA, 2664 bp, Glycine max
  Peptide Sequence Number=SeqID_157555
atggagaacactgctttgtgtgtactatggtttatactactcttgttggggtgtgtcatttcctcagaatctaagtatataaggtacaacacaacatcgaccattgttcctgggaaactcaacgttcacttggtccctcacactcacgatgatgttggatggttgaagaccattgaccagtactatgttggttccaacaactcaattcagggggcgtgcgttcaaaacgtgctcgattccctggtacctgcattgctggcagacaagaatcgcaagttcatatatgttgagcaggcatttttccagcgatggtggagggaacaaagtgatgctgtccagaacatagtcaaggaactggtcaacactggtcaattggagttcataaatggtggtttttgtatgcatgatgaggctgctacccattacattgacatgattgatcagacaactcttggacatcaatttatcaaagaagaatttggagtgactccgagaatagggtggcagattgatccgtttggacattctgctgtgcaggcctacttgttgggggcagaggttggatttgactctctattctttgcacggattgattaccaagacagagctaagagaaaagatgaaaaaactcttgaagttgtgtggcggggctccaagagccttggttcatcagcacagatattttctggtgcgttccctgagaattatgaacctcccagtaatttctactatgaagtaaatgacgattctcccattgttcaggatgatgtcagtttatttgattacaatgtccctgaaagagtaaatgagtttgtggcagctgcaatatcacaggcagcgaggcagttggaatattttaaagggaagagtgccttaggtcccaacactgactctttggctgaagctttggctattgctcaacaccatgacgcagtatctggtacagaaaagcagcatgttgctaatgattatgctaaacgactttcaataggttacacagaggctgagaaagttgttgcagtatcacttgcttgcttgacagagggagcaaccaaaacaggttgtaagaacccacagactaaatttcaacaggcaagtagtgattgtccacttctgaacataagttactgtcctgcatcagaagttgattcctcaaatgggaaaaacttggtaattgttgtttacaatcctctaggatggaaaagagaggatatcataaggattcctgttgtcaatgaaaatgttgttcgggattctagtgggaaaaagatccaatcccagctggtgccgatacttgatgattttcttggtttaagaaactaccacactgtggcatacttgggagtgtctccaactgtaaaacccaaatactggcttgctttttcagcagctgttcctccactcggttttagcacttactatgtatcctatgccaaaaaagaagctactatttcagatagagatacagcttaccaatcatggaataagagtgatacaattacagtgggcctaaaaaacttgaaactagtttattctgtgaaggaagggaaacttactaaatatatcaacagcagaagcaaggtcaaagaacctctagagcaggcatataaattttacactgggtatggaaatgatggaacagaaactgctcaggcttctggagcatatatttttcgccctgatggttcaccttctcccatcaaatccaacgggaagtctcctctcacagtttttcggggaccaattgtgcatgaagtgcatcagaagatcagtccatggatataccaggttggacctatacccattgatgatggagatggcaaagaaatcgcaactgaaatcaaaacaaatctagcaagcaacaaaaccttctatactgattccaatggacgtgatttcattgaacgtgttcgagactatagaaaagactggcacttggaagtaaatcaacctgtagctggaaattattaccctatcaaccttgggatttacctgaaagataaaagcaaagagttttctatattggtagatagagctgtggggggctccagcatcatagatgggcaattggagctaatggttcataggaggttacttcaggatgattcccgaggtgttgcagaggcactgaatgaaacagtttgcatccatgataagtgcaccgggttaactgtgctagggaagtactatttcagaattgatcctgtaggagagggtgccagatggcgtcgatcatttggtcaggagatatactcacccttgcttttagccttcacagagagtgaaggtcactggggagattctcatgtcacaaccttctcaggaatagattcctcatacaacttaccagataacgttgccatagtaactctccaggatctgggtgatggaaaagttctccttcggctggcacacttatacgagattgacgaggacaagtatctttcggttaaggcaactgtagaacttaaaaaggtgtttcccaacaagcagataaacaaaataactgaagtgagcttatcagcaaaccaagaaagagatgaaatggagaggaagagattggtttggcaagttaaagggtcacctccagaacctaaggtgtatggagtcaagttcattgccaataaaagtgcattgcttctcccctttactcttgacatctaa

SEQ ID NO: 40778 - DNA, 129 bp, Glycine max
  Peptide Sequence Number=SeqID_157556
atggagaaggtttatttactactgaaagatggattcgaagaggaagatagcattacttatcttcggtctgctggccatgctccttttcatctcctcagaggtggcagccagagaactgaaagagggtga

SEQ ID NO: 40779 - DNA, 349 bp, Glycine max
  Peptide Sequence Number=SeqID_157557
cctttacggaaatcctcctgggatgccaccaacgccaccaacaccaccaaagccagtgtttgagaagccgccgccgacgccaccaccaaagccagggaagatgccggggaatccagtgccggggaatccagtgccggggaatccagtgccggggaatccagggccgccggagaatccagggaagccggggaatccacggaagctggggaatccagggaagaagagggggaagccattattgaagccaaagcggaagccagggccaccaccaatgccaccaaagccaccaaagtttacgccacggccaccagacaagccagcaccagtgactggggaagccaccaccaat

SEQ ID NO: 40780 - DNA, 192 bp, Glycine max
  Peptide Sequence Number=SeqID_157558
atggttcacatatccaattcttctttaaaaatgttgagctaccagagtatgatgattttagattctgcagttggaggagctttcatgaacaagctagtggaagaaagcattatcatccttgaggttgtggcttcaaactatagccaattaatgtggggtgaaagagaaaacacctcagggccaaggaggtag

SEQ ID NO: 40781 - DNA, 348 bp, Glycine max
  Peptide Sequence Number=SeqID_157559
atggctaattccatgatagaatttcagattctaaagtttttccttgttagcattcaaccttctaaacaacaacatatcaagcaggttcaatggcatgctcccaaggatctccgggatatgttggtagtggagaaattttcagggaccataagtgatttcttaggtggtttctctgtttatgttgggatacaaaatgcatttgttgctaaacttcacgcggttattttggatattgaaattgcccaccagaggggatggcataatttgtggctggaatcagattcacaattggttatagctgctttcgaaaatccaaatattgtgccttgggaaatccgtggcaagtag

SEQ ID NO: 40782 - DNA, 2847 bp, Glycine max
  Peptide Sequence Number=SeqID_157560
atggctgcatcacctggcatcatttttaatacttcgtcaccccatgaaaccaatgcaaaaacaggcttgttaatgtctcaaactactctatctcgtgaaattacagaagacctacattttggcagagaagcaggcaatatagagatgctgaaggattctaccacagaatcattgaattatcacaagagatcatggtctaatgtgcatcggcagccagcatctagctcatatggtttagttgggagcaagattgtcaccaatgctgcctcacgggaaagcagtctattttcaagctcattgtctgacatgtttagccaaaagttgaggttattggggaatggagtgctgtctggtcaacccattactgttggttcccttcctgaggaagaaccatataaatctctcgaagaaattgaggctgaaactattggaaatctccttcctgatgaagatgacctgttttctggagtcaatgatgagttaggatgcagtactcgcactagaatgaatgatgattttgaagattttgacttgttcagcagcagtggaggcatggaattggaaggagatgaacatctaatttctggaaaaagaaccagttgcggggatgaagatcctgattactttggagtttctaaaggaaaaattccttttggtgaacaatcttctagaacactttttgttagaaacatcaatagcaatgtagaagattctgagctaaaggctctctttgagcaatatggagatatccgaaccatatatactgcctgcaagcatcgtggatttgttatgatttcttattatgatataagggcagcacaaaatgcaatgaaagcacttcaaaataggtcattgagatctaggaaacttgatatacattattcaattccaaagatatatcttgatttgatgacatgtcagggcaattctccagagaaggatattggccatggtacactgatgatatccaatcttgattcatctgttttggatgatgaactaaaacagatttttgggttttatggagaaattagagaaatctatgaatatccacaattgaatcatgtcaaatttattgaattttatgatgtccgggctgcagaagcttctcttcgtgcattaaacgggatctgctttgctgggaagcacattaagcttgagcctggtcttcccaagattgcaacatgtatgatgcatcagtcacacaaaggaaaagatgaacctgatgttggtcatagtctgagtgacaacatatccttaagacataaaggagtgtcatctggatttattgcatctggtagcagcttggaaaatggatataatcagggatttcattctgcgacacagctacctgcttttattgataactcaccgtttcatgtgaattctagcattcacaagatcacaagaggggcatctgcgggaaaagtatctggtgtttttgaggccagtaatgcttttgatgctatgaaatttgcatccatttcgaggttccatcctcattctttacctgaatatcgtgaaagtttagctactggcagtccttacaacttttcaagtaccattaacacggcttccaatattggaactggatcgacggaatcatctgaaagcaggcacattcagggaatgagttcaactgggaacctagctgagtttaatgcaggaggaaacggaaaccacccccatcatggactttatcatatgtggaatgggtccaacttgcatcagcaaccttcttcaaatgccatgctttggcaaaaaacaccatcctttgttaatggtgcatgttctccaggtcttccacagatacccagctttcctagaacaccacctcatgttcttagagcatcacatatagaccaccaagtgggatcagcaccagttgttacagcctcaccctgggatagacaacattctttcttgggagagtcacctgatgcttctggttttagattgggttctgttggaagtccaggctttaatggtagctggcagttgcatcctcctgcttctcacaatatgtttcctcatgttggtgggaatggtacagaattgacgtcaaatgctgggcagggctctcctaagcagttgtcacatgttttccctgggaaacttcccatgactttggtttctaaatttgatactaccaatgaacgaatgagaaacctctattctcgtagaagtgaaccaaacactaacaacaatgctgataaaaaacaatatgaacttgacctaggccgcattttacgtggggatgacaaccggacaacactcatgataaaaaatattcccaataagtatacttcaaagatgcttcttgttgccatagatgagcaatgtcgaggaacttatgattttctgtatttgccaattgatttcaaggcaataatcataaatatgtttctaagtcaattctacaaatggttgcagaacaaatgtaatgttggctatgcattcatcaatatgatcgatcctggacaaattattccattccacaaggcttttcatgggaaaaaatgggagaagttcaacagtgaaaaggtagcagtactcgcctatgcccgaattcaaggaaaatctgctcttattgctcatttccagaattcaagcctgatgaatgaagataaacggtgccgtcctattctcttccatacagatggcccaaatgctggtgatccggagcctttccccttgggtaacaatattagagtgaggcctggaaaaattcgcattaatggtaatgaggagaatcgcagccaagggaatccttcatctttggcaagtggagaagagtccgggaatgcaatagaatctacatcgagctcttcaaaaaattctgactga

SEQ ID NO: 40783 - DNA, 402 bp, Glycine max
  Peptide Sequence Number=SeqID_157561
atggtagaagggcgagcaatcttattcatcttaggcttgatagagctatttgcaatgactcttgattggatttttgggacactccagcctattgcacccttacaagatcatctgaactgtaaaaagattgttcaacaggataatagcatgctcattgtcattccttctcttaatgaggttaagtttgcagttttttccataaatggtaaaggagctcatggatcagatggttttggaggctctaattcaaatttagtggtccttataccaaaatttctagaagctaacaagattcaagattattggctcatagccttagcaagcttccatttcaagataatcacaaagattcttgcggataggcttgctatcgttgctccctgcatgatctctagtgagtag

SEQ ID NO: 40784 - DNA, 468 bp, Glycine max
  Peptide Sequence Number=SeqID_157562
atgactttcaactctgttcattcccttgccatgatcgctagcttaaaattcgcacgcaaacccactcttcatcttcgttccactcccttccaatgtgtccccaaggttgtgccgagatttctcgctgcggttgaggctgaggccccgacaaacgagcaaaccagtgtctcaattcgtgaagaaggcaagtcaagactcaacacagatgttgttcaacttagaaatcgggaaggccccggcatggaagagactgaattacgaagagcttgggattcgcaattcaatgattggaagcactacgaaaaaggatatgatgtataccttgtaggaggttgtgtgcgggatcttattctaaagaaaacaccaaaggactttgatattataacttcagctgagcttaaagagatgatagctagcattgggggtgctgacatagttgggatcccctttcactatagtgatgcttag

SEQ ID NO: 40785 - DNA, 1047 bp, Glycine max
  Peptide Sequence Number=SeqID_157563
atggagtccatcagggagatctgttatctcacattctcttttgattggctaaagaggttctcaacaagggcatttgtcagcaagctgactcaaggtacctctaataacttcaaggtgtttcctaagttgtttaaagactatgttgaggtgtcgaggcaacaactaaaccttagcaaatgttggttttatggtccaaagataacttctgctaaagctcgaataatcaagtatatcttggggttccaagaaggctttttctcttctcgagaaactggctacaaggaaaggaaaacacctctccatcatggaaaaactacaattggtgcattcggcgatgaaaatagttatagtggcttggaaaaggtttctgagccagtaaaagagagggatctaggtttaagggaatccaagtggcttgttggcaatggggctacaattcatctttggaatgataattggttaaggaaagcgttggtggacaaattagatatcccaccttctattcactccaagatgcaagctaatgtggcaaatattattcatctagctagctggaaagttccacaatcattagttgatctttttcctaacctcgagcaacaattaagacaaaatgatatcctaagacaggacattttggacaagcttgcccttcatggtaagcttcctatggactctaacttgaggaaaaggggatgcattctcgttttcacctatggcctctgtcttggatcttttgaagacattgaccacctcatcctcaacactcttcaaactcctcttaaccttcacttactagagaatcttctatatattctcaagcagcatgaaattctgatttgggaaccatgggaagatctattgatgaattatgcgtgtttaaagactttaacattgcaagaaacctcacccaagccctcctccatcattcaagtgcctcataagcctctagttctttggtggataaaatgcaactcagatggagctataagaggtaaccctggtcttgtagggtgtggagggatcttcagagatgacaacaactag

SEQ ID NO: 40786 - DNA, 2004 bp, Glycine max
  Peptide Sequence Number=SeqID_157564
atgggaaaccgcttatccgaagtcgccgcaggccgcgccgccatcggcggcaccgccgccgattttctcaatctggccgccgctccaatcgacgctgtcgagaacttcctcaggtcccgcggccaccacggcctcttctctcagatcgagttatcgttttccgcttctggcttgcgtgatcgtgatgtgctcttcaagagtaatccaatgatggttctttatgcaagaggaaaaaatggagcacttgaggagctttgccgcacggaagtagttctgaattcatcaagtccaagatggattactaaacacaccctcatttatcattttgaggttgttcaggttttagtgtttcgtgtgtatgatgttgatactcagtttcacaatgtagatataaagatgcttgatctagatgaacagcaatttcttggcgaggcaacctgtgcactatctcagataatcacacaacctgataagtcattgactatagatctatacacagaagattctgtcggatctaccctttccaaaaactgtgggaaactcatggtgcatggtgaggaatgtattagctcaaagactgcaatagagatggtattcaggtgttcagatttggaatacaagtatctcttctcaagaactgacccctttttattgatatcaaaagttgtggaggctggtgcccaaattccaatttgcaaaacagaagttataaggaatgatctcaacccaatatggaaatcggtgtttgtgaatattcaacaagtgggaagcaaggacagtcctttgataatagagtgctataactttaatagcaatggaaaacatgatttaatgggaaaagtgcagagatctttggtggagttggagaacattcataataatggccaaggagaaaatttatttttgccttctgctgatggacaaaaccatgataacaaggtgttgaagagccaactatttgtggaaaaatttactgaaagtgtccaatatactttcttggattacttggcggggggatttgaattgaatttcatggtggctgttgactttacagatacatcatttgcaccaattctgtggctgttgtgtcttgagtgcacccattttgtctccaccatcacctctgactgccatgtggcattcaatctcttatttattggtgttcctcaccttgttggatcagctgaagaagttcaacataaattcacaattgctgcactagtggaggagtctggatgtgtcctgtttaccttgaggaaccatttgtgggttccacaaaatgctaatcctctaaggccattgttgtcaggctcaacagctgcttcaaatggaaatccacgccttccagattctttgcattatattgatccttcaggacgaccaaatgcataccagagggcaattgtcgaggttggggaagtgttacagttgtatgattcagacaaacgatttcctacttggggatttggagcacgaccaattgatggtcctgtttgccattgtttcaacttgaacggaagtagtcattactgtgaagtggaagggatccaaggaattctgatggcttacacaagtgccctgcttaatgtatctcttgcaggacctacactttttggaccggtcataagcactgctgcactgattgccagccaatctgtagcaaatggtggaagaaagtactttgttttattaataatcacagatggagtagtgacagatctccaagaaacaaaagatgctattgtcaaagcatctgacctgccattgtcaatccttattgttggggtaggaggagctgatttcaaagaaatggaggttttggatgcagacaagggagagaggctagaaagttcatatggacgcgttgcttcacgtgatatagtccaatttattccatttcgggaggttcaaagtggactttcagttgttcaagcatttctagcagaattaccggctcaatttttaacttacgtgaggagcagaaatatccagccgaacctctag

SEQ ID NO: 40787 - DNA, 1035 bp, Glycine max
  Peptide Sequence Number=SeqID_157565
atggcggaaaggcgtggtggttttttgaaaaaatgccaccgaatagcggtggcgtggcgggtttcgaatggcggcgtcatggcggccgccatagtcatggtggtcattgcggcaattatgaatgaatgtcatgaattgatgctctggatggagtggtcaacttttggcaagttcaggctaaggggagcctctcgtcttagcactaccgattgtgcatcccaaaagcagaggagatggccagaagatttagcttggcatccagagggaaacagcctattttcagtatacagtgctgatggtggagactctcaagtatcgattacaaatttgaataaaggacaagggggagaacgtgtaaaattcttagaggacaagccgcatgttaagggaattatcaatggcattgtttttatgccctgggaaaatacatgttttgtaactggtggaagtgaccatgctgttattctttggaatgagcaggatgatgagaagtggaagccaaaggcattgcacaggaatcttcactcatctgctgtaatgggagttgctggtatgcagcagaagcagatggtgttgtcggttggtgcagacaggagaatatttgggtatgatgtacgtgtaggaagagcagatttcaagcatcaggttgatagtaaatgcatgagtgtcctgcccaatccatctgacttcaatttattcatggttcaaacagggacgcacgagaggcagcttcggttgtttgatatcagattgaggaatacagaacttcatgcttttggatggaagcaagaaagcagtgattctcaatcagctctgataaatcaggcttggtctcctgatggacattatataacatctgggtctgcagatcctgtgattcacatatttgatataaggtatactgctcacaagccttcccaatctataagagcgcatcagaaacgagtcttcagagccatgtggcttcagtctattcctcttgtcatttccatatcatctgatctcaacattggactgcacaaggtttactcttga

SEQ ID NO: 40788 - DNA, 1452 bp, Glycine max
  Peptide Sequence Number=SeqID_157566
atggaaggtgaagaggtgttggatgtggacattcaggaggagaagctttctggctttattttcatgtgtaatagaattacaaaaccggagtgctactgttaccgagttttcgggcttcctgctgggagaaaggatgttgttgagaagatcaatcctgggacatacctttttctgtttgacactgatgtcaagcttctctatggcatatacatggcaacctcgactgggaagctaaacatagaaccattagctttttgtcagaaattccctgctcaggtgaacctttacatcgtcgatgatgcacacagaaagaaacctgaccacgctgtaaaaatcacatcttctgtcatgattggtagttttgagggaatattgttagcatcaatgatgtttcctgtgcaattcaaaatttacaaagactgtttacccttgccagtgaattgctttaaacatgccattcgagataattaccagaaaggctccaacaaatttaatcctgaactcaatattagacaagtaagaagtctaatagaattgtttcgcccattacatgaattgccaattgcacctggacgtccttttatacagaaaccaatgaatattgtttatcatcagatatcagagccacccatttcggagggtgcatttttgtctaggatgtcacccaatcaagctccaaggctgttgaactataaacatgtaaatgaactcaggaagcctactggttgtgcctatcctgttcataatgttatgccttattcagctgcagcacagcttgtggcatcccaaggttcaacgaatcagctttattaccctgcaagtacacttgctctggagggtacttatgcacctgggataggcagcagtcatactcaaccactaccagatcctcaatattcacatcaaactatccttaacccacaacctgaatttcattcttccctgatgaacagcggtcatgctcagcaattgcaagagtctcaagatgcacatcataacatcatacatccccaatctgaatttcattcttcactgatggctatgggtagcagtcatactcaatcactgcaaggtcctcaatatccatatcagagtatcccaaacccatcacacgagttttataccccagtggcaaatgcaggcagcagtcaaccccagttgtcacgggatactcactatacacaccagaatatcctaaacttgcaacctgatgcttattccaccatggcgaatacaggcagtagttatgctcaattattgccagatccccaacacacacatcagaatgcccaaaatcctcagcctgattccaattcttccttggtgaatatgagccatgccactgtcacgatgcaattgcatactgtgtcatctttatatcatccatatgttcctcaagaagttgcaccttccatgtattcatcgcaatggtatgtttcaacttcattctaa

SEQ ID NO: 40789 - DNA, 441 bp, Glycine max
  Peptide Sequence Number=SeqID_157567
atgcgcatggctagcttctgcccttccttttttctttggagagcaaaaagtttaaggagggataccgaggaagagccctttgggctgtctgatgaggaggagtttgttgggagtggtaaagttgggcgaactactgaggagaagcttaaacacagtttatttggtgatgatgaaggtatgctcagtgcatctcaaaagggtttaatagggattaccttgaattctgactggtatgtgccggtttctaaagagaaatctgatcaagatgttgcatgtaggggccttgacttcatgtttggatgggttaccaacttgaggaaggacattatcgaaggtcacacaggcaagaacttcattgaggagaacagttggaagtatgcattgttggatgagcgacagcgtgaaaaaaaattgatttcctttgttagggaaaaaaactga

SEQ ID NO: 40790 - DNA, 280 bp, Glycine max
  Peptide Sequence Number=SeqID_157568
atgcagcttctaagggtactaccgaaaggaaagcttagtgcaggtgtaaaccatggagtaaactactacaacaacctcatcaatgagctcatggctaatggtctgcaaccgtatgtgatcgttttccattgcgacgttccccaagccttaaaggatgagtatggtggttttttaagtcctcacaatgtagatgattttagggactatgctaaactttgcttcaaggaatttggcaatagagtgaaacattggattactttgaatgaaccgaggagtgtga

SEQ ID NO: 40791 - DNA, 258 bp, Glycine max
  Peptide Sequence Number=SeqID_157569
atggcatcagtgctctgcataggagggccagctagagctgagactggtgctggtgcgggaactggggctggagttgaggttgaagcatctgaagggaccctggccctggccttgcgggacccagggaaaggcagggaagcccaacctagaggtgttggactaggccatctgagaaatctatctagagatgatggagcccaagtccatgtccatcttcatgacaaggccatacaccaacctcgccctgtccatgtttag

SEQ ID NO: 40792 - DNA, 915 bp, Glycine max
  Peptide Sequence Number=SeqID_157570
atggaattggtgaggaaattcaaaccagtcgacctttctcatccttatgagaacccatattccctttggaaggatgatatcttttcgcgaaaaacaaaatatgaatatgttactattacacaaggacatggtggtggtctttgggttcttatgaaaatgggaaggaatataaggatattagttgttgttatgagttttctttccatcacatttaacctcttggtgggtggaggatgtgcacaaagttgcctcaatgccagtcctactatttctttacgagatcaattctatggttacttgattgatcttggatctcaattgtcttcccttgagctcttattagtgactttaaatagattcttggggagtgtaagaagaagacactacagaggagtgaggcagcgtccatggggaaagtgggctgcagagattcacgatccaaagaaagcagcgagggtatggcttggaacattcgaaactgctgaagctgcagctcttgcttatgatgaagctgctctcagattcaaaggaagcaaagcaaagctcaatttccctgaaagggttcaaggcacagctagcgaatttggttacctcacaaatcagtacatgtcatcaagcagcactaattctaaccctattgctccacacttgactactcaagaaacttattcgccaagtcactttcaatatgcacagcaacaattcatgagtggtgggagtaacagcttcagtaaccaagatatgcttcggttctatgggggagacaacatgtttgtttcttctcagcagtctgcatcttcgtcttcttctactgcactgtctcagcagcagcaagaagagttgctgaaattttcgatgcaatttggaggttcttctcattctaatcattctgggaattggaggggtggacattga

SEQ ID NO: 40793 - DNA, 249 bp, Glycine max
  Peptide Sequence Number=SeqID_157571
atggagggaagatcaatatcacattcttctgaaagagaagaggaatatggtttgttcccaatatattctgaaaggtcccagcaagacatgtcagccatggtttctgctctcacacaagtcattggtggctccaatagtgattctcttcatatgcatgaaggccttttaacttcctcacacaacaacacctcaacccagaatactaacgaacaatcccaagtacaacaacaagaacaaggctggggttga

SEQ ID NO: 40794 - DNA, 486 bp, Glycine max
  Peptide Sequence Number=SeqID_157572
atggcctcaaagaagagacgtgcttcatcctctcgacttcaagaaccctatgacacatccagatttgtgtgtgaggtcacttgggagagatacaagactaatgtgcacaacaggaatatcctcccaaagaggaatatagagctggcctactcccactacgacgagttcctccgagagctagagaggcgccagtggcacagggccttgaccaggcagatggataatcatattgaccttgccttggtcaaggagttttatgctaatctctataacccagaggatcgctcccccaaacaatgcaagggggcatcgtggaagctgcttaggaaagacttgactacccttgcacagacatggagtgtcatttcctactccaaccttgcccctgcttctcacacctctgatctaaacatggacagggcgaggttggtgtatggccttgtcatgaagatggacatggacttgggctccatcatctctagatag

SEQ ID NO: 40795 - DNA, 551 bp, Glycine max
  Peptide Sequence Number=SeqID_157573
ggagtgtaagaagaagacactacagaggagtgaggcagcgtccatggggaaagtgggctgcagagattcgcgatccaaagaaagcagcgagggtatggcttggaacattcgaaactgctgaagctgcagctcttgcttatgatgaagctgcactcagattcaaaggaagcaaagcaaagctcaatttccctgaaagggttcaaggcacagctagcgaatttggttacctcacaaatcagcacatgtcatcaagcagcactaattctaaccctgttgctccacacttgactactcaagaaacttattcaccaagtcactttcaatatgcacagcaacaattcatgagtggtgagagtaacagcttcagtaaccaagatatgcttcgtttctatgggggagacaacatgtttgtttcttctcagcaatctgcatcttcgtcttcttctactgcactgtctcagcagcagcaagaagagttgctgaaattttcgatgcaatttggaggttcttctcattctaatcattctgggaattggaggggtggacattga

SEQ ID NO: 40796 - DNA, 300 bp, Glycine max
  Peptide Sequence Number=SeqID_157574
atgtcatcacgtcgacttggcggctcctcaccagaatcttactccctgccactgtcattctgctcccacgaacaagctagtgctaaagatcctggaaggtcagtgcacaatgccccccatgatcatacacaacatccaacgtatgaacctggccaaaagctagtgccaaagaccctggaaggtcagtgcacagtgccccccacgaacatacacaacatgcacatgccaatgcatttccaacatcaatcaacattccattttcatgtcattcacaacataaatatcatctcatctcaatga

SEQ ID NO: 40797 - DNA, 522 bp, Glycine max
  Peptide Sequence Number=SeqID_157575
atggatccggacgcattcaccgccagcctattcaagtgggacccacgtaccgtcctcccacccgctccggcgccgcccccgcgcccgtccctcctcgaatacgcgatggctcccccgccggtgaccacggcgttccaccctgcaaggacggcggctccgcgcgagctcggaggactggaggagcttttccaggcctacggcatccgctactacacggcggcgaagatcgccgagcttgggttcacggtgagcacgctggtggacatgaaagacgaggagctcgacgacatgatgaacagcctttcccagattttccgctgggacctcctcgtcggcgagcgctacggcatcaaagccgccgtcagagccgaacgccgccgcgtcgaagacgacgacatcaagcgccgcaacaacaacagcaacaacctcctctccacggacaccaccaccaacgccctcgacgccctctctcaagaaggtaccatacaccatacaccatacacttattttaaacctaattaa

SEQ ID NO: 40798 - DNA, 243 bp, Glycine max
  Peptide Sequence Number=SeqID_157576
atgcaacagcaaacaaaaagaggtgagattataaggcaaaagaagtcaattgagtatgatgagaggtccatctcagaataccatataggcaccaaaattcaactaagtcaccctgttgagttcaactattacttcaacattgtattattgttgcttttccttttaacccgtgccatcacccaacacgttcttacattttgctctaaaatttactaccgccaccaaactatctatcaactatag

SEQ ID NO: 40799 - DNA, 423 bp, Glycine max
  Peptide Sequence Number=SeqID_157577
atgggtatggcaaagggacagcctggggatgacgttgacttcttggatatggctgaccaagacggggatggtagtggcctttcgtggggatggcggtggcctacatgcgcgtccccacatcaattgcagaccttccgcgcactagtggagagcgcggaccggaagttcgactatgtgcacgacgtgccggcgtacgacaacggcacaagccagcatcaacaagagaactgcactccagaaggttgtgcgacgatgacataccacatacatgagcaaaagaaccacgtgcgcgaagctggtgaagtgcaggttgacatggtgggaacacggcgagaccgaaccacctgccagattttctttgttgttaataaggagacacagggaacatgggcaaagaatgagggctgctcttattgctcttag

SEQ ID NO: 40800 - DNA, 1314 bp, Glycine max
  Peptide Sequence Number=SeqID_157578
atggatttttggaaagtgggtttgcttagtcttctttgtgccgcttctgcttttgcaattggggctgtggagctgggtcgacatcaacctactgagagaatttcagttgtggtgaatttcattccggttagctgtcatgttggtttgaccattttgtgtattggttatggtagtgctggtgatgtgttagaagatgatccagtgggaaggttgaaggtttttgtttatgaacttccaagcaaatataataagaaaattctgcaaaaggaccctagatgcctcaatcatatgtttgctgctgagatctttatgcaccgttttctcttatctagccctgtccggacccttaatcccgaagaagctgattggttttatacccctgtctacaccacctgtgacttgacaccaaatggccttcctttacctttcaagtcaccacgaatgatgagaagtgccatacagcttatttcttcaaactggccttattggaacaggacagaaggggcagatcatttctttgtgacccctcatgactttggggcatgcttccattatcaagaagagaaggcaattgaaagaggaattcttccattgcttcagcgtgctaccttggttcaaacatttggacagaggaatcatgtgtgcttgaaagagggctcaatcaccattcctccgtatgctccaccacagaaaatgcacacacacctaattcctgaaaagactcccaggtccatttttgtttacttccgaggactgttttatgatgttggaaatgaccctgaaggtggatactatgcaagaggtgccagagcagcagtgtgggagaactttaaggacaatccactgtttgacatttccactgagcatccaacaacatattacgaggatatgcaacgagcagtgttctgtttgtgtccacttggatgggccccttggagcccaagactggttgaagctgtggtatttggctgcatcccagttatcattgcagatgatattgtgctgccatttgctgatgcaatcccatgggaagagataggtgtatttgttgatgagaaggatgtccctcagttagatactatactcacatctattccaccagaagttatcttgaggaaacagagattgcttgccaacccttctatgaagcaagctatgctgttcccacaaccagcgcaaccaggagatgctttccatcaagttttaaatggccttgcacgtaaattgccacacgacagaagtgtattcttgaaaccaggggagaaggccttgaattggactgctggccctgtgggggaccttaaaccttggtag

SEQ ID NO: 40801 - DNA, 522 bp, Glycine max
  Peptide Sequence Number=SeqID_157579
atggccccgaggaagcttgcctcaaagaggtccaggaaggacaaggcagccgaaggaactagttccgctccggagtatgatagtcaccgctttaggagtgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacgggttcgatgaggaggccatcgcccagctgctatatatggatgacgttgctcctcagcaacatcctgcccaccgatcataa

SEQ ID NO: 40802 - DNA, 288 bp, Glycine max
  Peptide Sequence Number=SeqID_157580
atggtgcctgtggaactgttgtggcggggaatgtccctagttgtgatgcttgctgctctggttccctttcgcccttcgaccgtcgtacacgtgattgagactccgcaccttgctcgcttccttgttggccgacaggcctcctacttgactcggaagcaagatcggccaccccggccccagcattgctctaattggagctctgagctggagcagtcttgctttggctcccctgaccgacctcaggcctccagatcaagtgcgcattcccatactgtaggatgggcctga

SEQ ID NO: 40803 - DNA, 237 bp, Glycine max
  Peptide Sequence Number=SeqID_157581
atgacaagcagagaccaagtttggtcattctgcacccttgtatcatccagaggcggtgggcccgatgatacgcggaaatacccgagtgaggctgacatagtcttctgcaccttttgttcctccgggaacaacaagtcatttacatgcggaaatttcatggtcacccgcgactctcgtcaaccgggaggagcgaaattagtgtcatacactgattttcgtccggggacctttgcttga

SEQ ID NO: 40804 - DNA, 312 bp, Glycine max
  Peptide Sequence Number=SeqID_157582
atgacattttcagttgcatttgcctatttggagggtgaatgtataaacaatgttgtctgggctcttgaatggtttagaggaatttttataagatgtgatgcaatccctcaagttactgttatggacagagattcaacattgatgaatgcagtgaaaactgtgttccctgagacaactaacttgttgtgtcggtttcacatcgataagaatattaaggcaatatgtaaaacccttgtggggttgagtctgcagaacagccttggagatctatgtagtgtttatgaagccatgaaaaacatgatcactctgtaa

SEQ ID NO: 40805 - DNA, 339 bp, Glycine max
  Peptide Sequence Number=SeqID_157583
atggtatcaagatataagttaaaccagattgctactgagtttgagcgagtgaattatgctggcattgacagttctcgttatggatgtattatgagaactactcatgatcttctatgtgcatgtgagctagctagatatgttgctggtttatctgagcccgaagtctgcataaccgaagagatggaagccatatcaaagtggattaaaggtcttgatatatgtggcaaagtgactctaaagattaaactttgggaaattgcataccctgatctaaattcgatgtgtgctcctcctgaaaagatcaaaactaaaggtgctcaaaagaaacatatgacctaa

SEQ ID NO: 40806 - DNA, 453 bp, Glycine max
  Peptide Sequence Number=SeqID_157584
atgcaggggcagactgcccacaaagcagaatctgcgaaaaaggaacatacagatcacctatttattcattgcatcaaaatccaaccaatttggtcgaaatcgatgtcatggatgaatatcaaaggcgctttccccttcagcccgaaacagcacttcatgcagcacatttctatccagatggaaggattaagggctaagcgatggaggtattggtggctaccagtaacatggtctatatggaagctcagaaacagaattttgtttgcaaatgcagaatttgatactaatcggctttttgaagatgctatctttataatttggacttggcttagacaatttgagaaggacttcacagtccactataatcagtggtcaaagggagtgcatatagtttcagaaatacttgtacactacacaagtagacctattagactacttatgtactacatataa

SEQ ID NO: 40807 - DNA, 1170 bp, Glycine max
  Peptide Sequence Number=SeqID_157585
gatgaggagttgactgatttcattgatggcaacattgatgttgccattgtgaaggagttttatgcaaacctctattaccccgaggacaaatcacctaagcaggtgagggtgaggggtcatctcaataagtgtgatgaggatacgcttaacactttcttgaagacccctgttattgtggaagaggggccttatcctcaggagttagctactaagctctgtatcccagggaggggattcgagcttaatgctaatggttatccgttgaagatattgaggaagaacatgaccaccctagctcagacatggagtgttctttccttctctaacctaattcctacctcccatacttctgatgtcaccctagacaaagccaaactcatttatggcatcatcatgaagatggacatgaatgtgaggtacctcatctcccaccaaatctccctcattgctcagcatgatacatctagacttgtattcttggccttgattacaactttatgtaaggctaggggagttcagtctaactcgaggtccctggagagcctgagtcctgccattaatttggcatatattaagaagaactgttggaatcttgatgatccaacagtaactttcagaggacccaagaaggccagaggaaagagatctgagaccccttccacttcagcaccagagacaggaagtccttcttcttctacacttcctccctcttcctccacagagaccccagtgattcctccagcaccttcacagattccaattctagctcctctctctacagaccaatcttcttcctctagagcgggtggggcctctatagcccaggagcctatgactgaggagccactagcactagcaccatcaccatcaccaacagcagcagaggaggagaccactccagatcagaccccacagccatctccatcctctgcatctgcacctgaggagactcagccatcagcactggatcttaatgaagatcagtcacaggaggaacatgacgcagattggctaagcgagcctcattcgctttgtgaggctgccaactcgcttagcggatgcaaaaccctagaagaggataggttagagagtagcacacttagcacacagccagcccgcccaacgaggatgttgtctcttcttgcgcttagcgtgctcagactcgcttag

SEQ ID NO: 40808 - DNA, 315 bp, Glycine max
  Peptide Sequence Number=SeqID_157586
atgaaagcaaaatgcaaccaaaggtggcttggggacgcaaaaacagcaagtcccgtggctttggcatttttgaaagtgggggggaagttttgggtgaagaaaacgttcccttccccctcttttaacccatctcgtgcaggggctgctcgcccaggcaagctaacctgtacttttttttttagggaagacataagtatggctctttacgggtcggcgttcgcttactcgaacccccttagggatactaggctacctcccagcggcgctttccatttgtccagagctgggcaagggacgatgatctatcggtcgtga

SEQ ID NO: 40809 - DNA, 174 bp, Glycine max
  Peptide Sequence Number=SeqID_157587
atggcagaaccacctgcaactgcacctattgatgtagacatgcctcgatatgcagtggacccttgccaatggatagcaaaaaggttggaacacttgaccaacatgaggatggttactgctgaaactgaagcatacactctgaccgaggagtgcctgagaattgccagggtgtga

SEQ ID NO: 40810 - DNA, 249 bp, Glycine max
  Peptide Sequence Number=SeqID_157588
atggtggtgagcttcttcaagactcatcttctgcttgaagtggcatcttctctctctctctcttccttctccattccgctgtcattcatcttccaagaagaaaaggaatccattgatgaagaagattctaggcctacaagctccacatggagctacatcatgtggtatcaagagcatcttcatctagtttcctacatgatgcctatgatgaagttgagttgtggtgctgagttgtggctggatttgtga

SEQ ID NO: 40811 - DNA, 138 bp, Glycine max
  Peptide Sequence Number=SeqID_157589
atggaaatgtctaacttggaatcaagactgaaagcacttaagctagagcttgatgaagaaaagaaagagaggctgcagaaaaacagatatgaaagtgctcatttaagcttgaactctcagaataagaaagaaaactaa

SEQ ID NO: 40812 - DNA, 276 bp, Glycine max
  Peptide Sequence Number=SeqID_157590
gccctaacggagaccctcggcaagctccctcaacaactacaagcggtgaactacatgggagctctgaatcgccaaggatttcaaggctacaaccaaggaggaccgttgggattcaaccaagggaggaactttacacaaggctcaagctggaggaatcatccggggaaccagttcaacaaggagcaaagaagtcaacctggccagaattccaaccaagggattgatctttatgagaagactagtaagcttgaggagacactgactcaattcatgtag

SEQ ID NO: 40813 - DNA, 1803 bp, Glycine max
  Peptide Sequence Number=SeqID_157591
cgccgcgctttcgcggctggcaggcccgatgtgggtgatgccctgcgcgacatgtttgatcaccgtgccgtcgcgcatcgccgcgtgcgtggtgatgccgcgcagcagcggctgctgcacttctttgagctcttcgatggtacccatgccgttgtgcagcagcaggatcggcgcgtggcgcggcagcacgctttgcagcggatcgttagcgatgaaggtgtgattgctgacgtggcccgcggatcaaccacgttgaccgaacagtacggctgcggagaagaaaagatgccatctttcgatatcgtttccgaagtcgaactgccggaagtgcgtaatgcggtggagaatgccaaccgtgagatctcaacccgtttcgatttccgcaacgtgagcgccagctttgagctcaacgaaaagaatgagaccatcaaagtcaccagcgaatcggattttcaggtgaagcagctggtggatattctgcgtgaaaagctgctgaagcgcggcattgaaggcgcggcgattgaagtaccggaagagattgtgcacagcggtaaaagctggagcgttgaagcgaagctgaaaaaaggcatcgaaagcgatgtcgcgaagaaaatcgttaagctgatcaaagacagcaaactgaaagtgcagacgcagattcagggtgaagagctgcgcgtcaccggtaaatcccgcgacgatctgcagggtgcgatggcgctggtgcgcggtggcaacctggcggcggggctggtgggcggcgatactctgccggcaagtgactttccgtcagcgtttcgccctcatcggcgagcgccagcagcacgcgcagcagactacgtagctggcgcacattgcccggccacggctgctgcgccagcgccgtcagcagcgcctgagacagctggcgaactcctgcagacgatagagcaaatcttcacgaaattcgccggcggtcacgcgctgggccagatcgcgatgcgtggcgcaaatcacggcaaaattcaccggccagctgcgactggagccgagtggcgccacctctttttcctgcagcacgcgcagcaaacgggtctgcagcgtcagcggcatgtcaccgatttcatccagaaacagcacgccgccatccgcttcgcgaattttgccgatgtagccatttttactggcgccagtaaatgcgccgggctggtagccaaacagttcggattcaatcagcgcttcggggatggcggcacagttgatggcgacaaacttgcccgtgcgccagcggctttgctggtgcagagcacggctgacatactccttgccgctgccggtttcaccataaatgcacagcgaaacgccggcatccagcaaccgcagcatttttgcgccgtcagctcccagcacgcgcggcaagtcatgcgtacgactgtccggcacgctgacgtggctgcgctgcggcgcgcgcaagcggaaccagtagcgctgcgcgccaatgtcgaccgcggcgggaacgctgttggcctgctgctgcagttgcggaaacagctgctgaaacgtcaggctggcaaagcggtcggcgctgagagccagttcgcgcatcgccagccggttggctgcggtcagcacattgtcagagaataccagcagcagttcatcactggtgtcgatgccctgcggctgcggatgcagactgagcagccactgctgcggatgcaggctctgcttcacccacagtgtgccggacccgagatatccagcacgccggctatctggccgttgggcatctgcaacggcatcgcggcgcagtacagaccctga

SEQ ID NO: 40814 - DNA, 2470 bp, Glycine max
  Peptide Sequence Number=SeqID_157592
tcattctgtaaacgaacatggtgcatctcacggtagcgtgaagtcttacatgatcggcttcatcctctcgatcatcctgacggcgatcccgttctggatggtgatggatggcagtgcttctcacggcaccattctgggtgctggtgcacctggtctacttcctgcatctggacagcaaatccgagggtggctggaacatggtggccattgtcttctccgcagtcattatcctgattgtggtgattggctcactgtggattatgtggaacctcaactacaacatgatggcccactaaagagtcacgccattgattaccccctgtttctcgtcgctttggtgggcgtttcgctggtggtcgcatccggttgtgtattcaacaatgtgattgaccgcgacatcgacatcaaaatggagagaacgcggaaccgtgttctggtcaaaggcctgatctcggcgaaagtaagcctggtttatgcaaccgcattgggtattgctggctttgcgttgctgtattttggcgctaacccgctggccatgtggctggcggtgatgggcttcgtcgtctatgtcggcatttacagcctctacatgaagcgtcattcggtctatggcacgctgattggcagcctctctggcgctgcgccgccagtgattggctactgcgcggtgaccaaccagtttgatgctggcgcgttaatcttactggctatctttagcctgtggcagatgccgcactcctacgcgattgccatcttccgcttcaaagattatcaggccgccaatattccggttctgccggtggtgaaaggcatctccgtggcgaaaaatcatattacgctgtacatcctggcgttcatgattgccacgctgatgctgtcgctgggcggttatgctggctacaaatatctggtggtggctgccgccgtcagcgtatggtggctgggtatggcactgtcaggttacaaaacctcaaacgataaggtttgggcgcgtaaactgtttgtgttctccattgtcgccatcactgcgctgagcgtgatgatgtcggtggactttatggccccggcctctaaggacctgctgacttacgtctgggcgcgcaacctgtgccgctgcaacctgaagtcccaggggcataaacttacagaggttggaatgaacgataatagaatgacaccagttgagcttcgggcaacatggggtttaggcacagttttttccctgcgcatgctgggaatgtttatggtcctgccggtactgaccacttacggtatggctttacagggcgccagcgaaacgttgatcggtctggcaattggtatttatggtctggcgcaggccgtgtttcagatcccctttggtctgctgtccgaccgtatcggccgcaagccgctgattgtcggtggcctgctgctgtttgtgctcggtagccttattgccgccaccagcacctccatctggggcattatccttggtcgcgcgctgcaaggatccggtgccattgccgcggcggtgatggcgctgctgtcagacctgacccgtgaacagaaccgcaccaaagcgatggcgtttatcggcatcagcttcggcgttacctttgcgattgccatggtggtcggcccgattgtcacgcatgcgctgggtctgcacgcgctgttctggatgattgccctgctcgccagcctgggtatcgtgatcaccctgctggtcgtgcccaatgcgccgggccacgtgctgaaccgcgaatccgggatggtcaaaggcagcattcgcgcagtgctggccaatcccaaattgctgaagctgaatatcggcattctctgtctgcacattttgctgatgtcgagcttcgtcgcgctgccgggccagtttgaacaggcgggcttcccggcggctgaacactggaaagtctatctggtgaccatgctggtggcgtttgtcgccgtggtgccgtttattatctatgccgaggtaaagcgccgcatgaagcgggtgtttgtcggttgcgtggcgctgatcatcatcgcggaaattgtgctgtggggcgccgcgggccacttctggacgctggtgattggcgtgcagctgtttttcctcgcctttaacctgatggaagcgattctgccgtcgctgatcagcaaagagtcgccggcgggctacaaaggcacggccatgggcatttattctaccagccagtttattggcgtcgcgattggcggcagcctgggcggctggattttcggccacttcgatgcgcaaacggtgtttctggagccgccatacgtcagcagcctgcgcctggtgctgagtgatgcggtgctggcggtaccgaatctggagaagcggctgcgcgcgcagcccggcgtggcgtcagtgtttatcgtgccggaagagaaaagtgcctacattaaaattgacagcaaagtgacgagccgcgtggagctggaggcgctgctcgccagcagttaa

SEQ ID NO: 40815 - DNA, 1041 bp, Glycine max
  Peptide Sequence Number=SeqID_157593
atgaatatgcaaatcaaaaccaccatgaaagccgcgattgtaaaggcgtttggtgaaccgctggtgattgagcaggtgccggtgccgtccgttgggccagggcagattctggtgaaaatcgccgccaccggcgtgtgccataccgacctgcacgccgccgaaggcgactggccgatcaagcccaatccgccgtttattcccggccatgaaggcgtcgggcaggtggtggccattggcgaaggggtgaaacatctcaaactgggcgatcgcgtcggtgtgccgtggctttactcggcgtgtggccactgcgagcactgcctcgacagctgggagacgctgtgtctgtcgcagcagaatgccggctattcggtcaacggcagctttgccgagtactgcctggcggatgccaactacgtaggcatcattcctgacaatgttgagtttaatgaagtggctccgattttgtgtgccggcgtaaccgtctataaaggtctgaagatgaccgataccaaaccgggtgactgggtggtggtttccggcatcggcggcctggggcatatggctattcagtatgcggtggcgatggggctcaacgtggcggcggtcgatatcgacgacgataagctggcatttgccaaacggctcggtgccagcgtggttgccaatgcgaagcaggtcgatccggcgaaggtgtttcaggagagctttggcggtgcgcacggcgtgctggtaacggcggtctcgccaaaagcgtttgaacaggcgatcggcacgctgcgtcgcggcggtaccatggtgcttaacggcctgccgccggggaaattcgatctctcgatcttcgacatggtactggatggcattacggtgcgcggctcgattgtcggtacgcgtaaagatctgcaggaggcgctggattttgccggtcgccataaggtgaaagcgaatgtcgcggttgagccgctgactaatatcaacgatatctttgcgcgcatgcacgctggcaaaattgaagggcgtattgtggtggatatgtcgctgtag

SEQ ID NO: 40816 - DNA, 258 bp, Glycine max
  Peptide Sequence Number=SeqID_157594
atgtgcccatcaatgaaaagatcagttgggtttaatggtatgcggttctacgcaaaaataaagggtttacgaaaggtggtggtggtgcatgcaaacaatgttgtaggggaaggggtcacacacatttacggaggtaatgatgcctcgcatgtggtggttgggtttggtggctatgatggcgcgaaggtggtggtggtttgggttgcgacactttgtgttagagatgacattgtcattgcattggtcgaaacaccttga

SEQ ID NO: 40817 - DNA, 1267 bp, Glycine max
  Peptide Sequence Number=SeqID_157595
gttcccttctccaaagagaaagaacagcaagcaatcgttacccattacctatttcactttccacaccactctcatcctatatctctttcttccttattcctctgtcaagccactcgataatatgcagagtctttcaccacctacttccaacgcgctcaatttgaagcatgtttttcgcccgcgacttggcgcgtcaagccgaatctctgtcaaatgcgcttttgggtttgagccggtgagctacggagtcggctccagccgagccgattggcagagctcctgcgccatcttagccagcaaggtcgtttctcaggaacaaccctccgctgaccagaacagcggcaccaccgaccacatcgccgccgtcaacggtcacaaagccgccgtcagcgacttccaactcgttccaattggaaacctagcagaggccaacaacaagccgctcccgccgaagccgctcacgatctccgacctctcgccggccccgatgcacggctccaagctccgcgtcgcgtaccaaggcgttcccggcgcgtactctgaagccgctgccggcaaggcctatccgaactgcgaggccattccgtgcgaccagttcgaggtggcgttccaggcggtggagctctggatcgccgatcgggcggttttaccggttgaaaactcactcggcggttcgatccaccggaactacgatctcctcctccgccaccgccttcacatagttggcgaggtccagctcccggtccatcactgcctcctcgctctccccggcgtccgaaaggagttcctcacgcgcgtgatttcgcatccgcaggcactcgcgcagtgcgagcacactctcaccaaactcggcctgaacgtggcgcgcgaggccgtggacgacaccgccggcgctgccgagttcgtcgccagcaacaatctccgcgacaccgccgccatcgcgagcgcacgcgcggcggagctctacggcctgaacgtgatggcggacggaatccaagacgatccgagcaacgtcacgcggtttgtgatgctcgcgagagagcctatcatccccgcgcacggaacttcggtgcttttcaaagtgctttccgcgttcgcgtttcgcaacatcagtttgacgaagatcgagtcgcggccgcaccggaaccgtccgattaggctggtggatgacgcgaacgttggaaccgcgaagcactttgagtacttgttctacgttgattttgaggcttccatggctgaggttagggcacagaacgcgttggcagag

SEQ ID NO: 40818 - DNA, 1317 bp, Glycine max
  Peptide Sequence Number=SeqID_157596
gaggatacttgttcggtgatttcgactgtgctctttgtatctggagtgactacactgttgcatacaagttttgggtcgaggttgcccttgatacaagggccttcttttgtttatctggctccggtgttggccatcatcaactcccccgaatttcaaggattaaatggaaataaattcaaacatataatgaaggagctgcaaggggctataattattggatcggcttttcaaacttttcttggatattctggacttatgtcactgttagtaaggttgatcaatcctgtggttgtatccccaactattgctgcagtaggactttcattttacagttatggttttccgctagttggtacatgtctggagattggtgcagtgcagatcttagtggttattgttttttctctttatcttcgtaaaatatctgttcttggacaccgcatatttctaatatatgcagttcctttgggtctggcaattacatgggcagttgctttcttgctgactgaagctggagcctacaactacaaagggtgtgacataaatatacctgcctcaaatatggtttctgagcactgcagaaagcatgtctcaaggatgaagtattgtcgagttgatacttctaatgcattgaaatcatccccgtggtttagatttccttatccattacaatggggtactcctgtctttcactggaaaatggctcttgtgatgtgcgtggtttccttgatctcatctgtggattcggttggttcgtatcatgcatcttcattattggtagcatccagacctccaactcccggagttcttagtcgaggaattggtttggaaggtctttctagtgtcttggctggtctctggggaactggaacaggttctactaccttaaccgaaaatgttcatacaattgctgtcactaaaatgggaagccgcagagcaattcaattgggtgcatgctttctgattgtgttgtctctcgtgggtaaggttggagggttcattgcttcaattcccgaagtaatggttgctggtctcctatgctttatgtgggcaatgcttgcagcattgggcttgtctaatctacgttatagtgaggccggaagctctcgcaacatcatcataattgggttatcattgtttttctctctttccatacctgcctactttcaacaatatggcatctctccaaattccaacttgtcggttccaagttatttccaaccctacattgtagcttctcatgggcctttccgcagcaaatatggagggtgtactagcgctaataataaatatacgagtattggggagtcatcataa

SEQ ID NO: 40819 - DNA, 441 bp, Glycine max
  Peptide Sequence Number=SeqID_157597
atggcccgagctccttcagacgctatagttccagcaccagctccagtccctccaccttcaacacctatttcagcttcagccgacccctctatacctagcagtgacgttatcgtgcccatgctacagagcattcatcacaacattttcctggtgatgcagagtagcttggtctggagtccagccttccttttgggggggggaggtgaggctcctgcggcccaggagccacggacacaggtcgctgaagacactctagaggctagggaggctaaggataccccagaggtagaggcagaagcggatgttgcagacacaccaatggaagctcctgaggaggcttcaggcacaacaaaggcggacattgacgatgattatgtagcaaatgtcactacggtgcaggagacttgggacccatggcccacttcagctcaagatgattga

SEQ ID NO: 40820 - DNA, 594 bp, Glycine max
  Peptide Sequence Number=SeqID_157598
atgtccaattccgatcccaaaacgagaccccgtccgggaccgtggccgccggcgccggcgccggtcgtcaaggcaatgccgcctgcttcatgggccaagaaaacgggcttcaagcccaagttctccggcgaggccaatgccagcgactcgggccagataagcctgcagcccaagcccagggagcccgacacaaacgtggatctcgaagcgggtcgggccagggatccggcgaatggtgtggcccaccagaacaaggttccgccgcttccaccttccaaggatcagctcgtgaagaagcgaagggaccccgacggactccccaagagctccgttcctagtaccaatggccaagccactgcggagcctccaccgccgccgcctccgcggaggacggcgaggcacgaggaagttgtggacgcgccgccgcaggacgacgacgatttcgtgtcgaggcattcgcatatgaagtatgagctcagagattcacctggtttagttcccattggtgtgtacggtattcaacattacttatcgatattgggttcgttgattctcattccgctcgttatagttccggcaatgggaggctctcat

SEQ ID NO: 40821 - DNA, 372 bp, Glycine max
  Peptide Sequence Number=SeqID_157599
atgtatccccctgttgcgcttttgcggcatctgcatcatgccgtcacacatgcgttgtatgtgggtctcgtcttttgtcgtgggaagtcggaagatccatatcgtcttcttaactgcacacatggggcactgcgcccccaaatgcgcaaagcagaacaagcaccacatacaccagttagcccttcgtccattaagcatgaacgcaagttaggctcagaggcaattaatcgaacgcgaagcgtggcactgattaatattcacgaatttgggataactagtggaagggaaaactgccaggaaaccacattacaagcgaaacctcaaagagagttgggcttcgtcctcaaaaggaaacaacaccagaaaatctag

SEQ ID NO: 40822 - DNA, 732 bp, Glycine max
  Peptide Sequence Number=SeqID_157600
atggatgttacaatgaagaaagtagagagtgaatctccttattattgttcctcttcatcaccatcatccacttcctctgaaagcaaactctcatcagcatcaccgtgcaacccgaactctccaccggacccttcatcgtggcatgcagaaacttcaaagaaagtagtagtgttgatccctcacaaaaggaaagcggggagaaagaagtttcgagagacacgccacccggtgtacagaggggttcggcagaggaacggtaacaaatgggtgtgtgaagttcgtgaaccgaacaagaagtcgaggatatggctcgggacatatccttcgccagaaatggcagctagggcacatgacgtggccgtcctagcacttaagggcacctctgctgtgttcaatttccctgattcggtttctcttcttccggttgcaaactcatcttctgctgctgatataagacttgctgcatcaaaagtttcatcggtttttggcccttcttcttcatctagttcccgcgtcgagactaagccttgtttggttgatggttttgttaagactgagaataacgttgatgaggtcaaaacagtgttttttgatgaagaggcgttctataatatgcctgttttcttagatagtatggcagaggctcttctcattactccaccttctatgaagagagcatttgattgggacgaggttgattgtgaaacagacctcactctctggacagattaa

SEQ ID NO: 40823 - DNA, 474 bp, Glycine max
  Peptide Sequence Number=SeqID_157601
atgggtccaacttcaaaagcttgtactcctctgcaccaccataagaatttcttcgccgcccaagacaacgacgactccctccactgcttctacgtcaaatccgtcaaggaaatgccctactacatctccgtcctccaaatcagcgccgccattagctctgccgacgccgaggcacccaccgccaccccctccaaggccgttccatctttcaaggaaaacgttggcagcggcttaacggttttctgccccaccgacagcaccgtcagcggtttcgtgccaaagtacaagaacctgaccaaagcgcagaaggtttcacttttgttataccacgcgactcctgtatacgagtcactgcagatgctcaagtccagcaaccaaatcatgaacactcttaccacagagggagtgaacaagtacgacttgagtgaagggaaagaggtgaacctcatcaccaaagtcaatacatcagtctag

SEQ ID NO: 40824 - DNA, 162 bp, Glycine max
  Peptide Sequence Number=SeqID_157602
atggagtcaaagagagaatccagagagaggaagttacgaagcaggaaccacattaagttgctgaaaatacttgcgttactgggaagtgacaacaagcaagctagtggacacatgtacagtgtacttggtgatataatgagagggaatgggaggagaggatga

SEQ ID NO: 40825 - DNA, 489 bp, Glycine max
  Peptide Sequence Number=SeqID_157603
atgacagtgagacagagagggaaaggaggaattggagccctaccagaagaagacgtccctttcatgtttcgtcgtcctataataataacggacgtggaggtcgccgccggggcagaactcggtgaggaggcagagccatttggcggcgtcgatggtggcgtagagggtggggaggaaggggtggtcgagcgattcgagaatttctcgctcggtcttggctcttccctccttgctgcggctggcgagctccttcttgtccatgaccttggcggcgaacatgacggagagggagccgtcgttgagttcggcgaggtagacggagctgatgtcgccggagccaaggcggcgggagaagaggaggtcggaggggaggatgcggcggctgggggagtccgatcggatccggtggatggcggcccagcgggggtcggaggagggcgcgtggggcttgctgttggcggggaggtgggcggaggaggaggccgttag

SEQ ID NO: 40826 - DNA, 201 bp, Glycine max
  Peptide Sequence Number=SeqID_157604
atgggtacaactgattttacacttgtctaccatggagacacgtcttgtgctcttgctggttatttagattttgactatgctgtagatttggatgcaaggagaactgtgacaagcttctatggaggatgggtctttgagcttcaaaaaggtccttcaatggtgattttcggccatggagttgcagcgaaagataaaggataa

SEQ ID NO: 40827 - DNA, 336 bp, Glycine max
  Peptide Sequence Number=SeqID_157605
atggggatcgcacccacaagacacccagtggacccggaaaagtccaacagggccctggggtttccagctctggttacgggcctctatcagtcctacagggtgcccgtaccccccagcaaggtcatgccatcccgacatagggatcgcgcccgcaggacacccggtggacccaaagaagtccaacagggtcctggggtttccagctctgattacgggcctctgtcagttctacggagtgcccgtcgccccaacaagatcattaggccccgcattaatcgggctttcatcaagaagtactgcgcccccagacgggcgcagggcgagacaccacagtag

SEQ ID NO: 40828 - DNA, 198 bp, Glycine max
  Peptide Sequence Number=SeqID_157606
atggctggtatattcttccttttgaaacagcaaaatagtttagagattatgagcgtcattattttggggacgccacaacgtgcccttttgcgggcaagcgaaggtgaggctcacgggtgcgctttccaaaggaggaaagatgcgcggagtcaccaccaacgtttatttgtggaaaacgtcggaaaaaccgaaggaccg

SEQ ID NO: 40829 - DNA, 1363 bp, Glycine max
  Peptide Sequence Number=SeqID_157607
atgctttcttccggagatgcagcaagggcagcaacagacagagcgcgttcatatgcctctgagcgcctgaatgaggaaattacagactggctaagctctgcaggaactgcacgcacgaaactcagtgtcgataataagggacggctgaacggtagcgaactcgatgtcctggtgcctttcagggatacgcctgatgcctttcttttcacgcaggcagggatccgtcatattgatgatcgaaccacggcaaacctcggtctcggccagcgccactttgtcgataataagtggatgttcggatataacgcctttctcgactacgatttgactcgtgaccactcccgcctcggtcttggtctcgagtatgggcgtgattatttaaaagtcgggacaaacggctattttcgtctgagcaactggagaggttcaccagatcttaaagattacgatgaacgaccagctaatggttttgacattcgaagtgaggcatggctgcctcagtaccctcagctcggtgcatctctggcgtatgagcagtattttggtaacgaagtgggggtaatcagtaaggatgtgcgcggaaaaaatcctgcagcgttcagtgccggcctgacctacactcccatacctttagtatccctgggtctcgaacgtaagcaggacaccaatggcgacgggaatacccttcttaatctcggccttaactatgaaatgggggcgccatggtctaagcaaatcgacccggatgcagtacgtgatatgcgcacccttaccggaaatcgttacgatcttgttgaacgaaacaaccagattgtcctcgaataccgtaagcaggaagtcattcgcttaaagctgccttctcttgtcactggtttgtctggtgaaacccggcctcttgatatcgggatcaatgccaaatatggccttgattatgtggagtgggatgatgcaagccttgtacaggctggcggaaaggttcagggtcagaaaggccagtacagcgttgttctgcctccatacacgccgtcgggtgaaaacagctggacgatatccgcggtggcctacgacaaaaaagggaatgtctcgaagcgtaaggaaacacaagtcagcgtcacctctgcgggtatcagtgcaacaaagagtacgttttcaagctcagaggctgctcttcctgccgatggagaaagcacctcagatcttatccttgaacttcgggatgaaaataataaccctgtaacgggcctgtcagataaagtcgttctgaacattgccatgcaggctggtgatggttctgaaccgacgttatcagcagtacaggaaacctccgcaggcacatacaagtcagtaatgacggctggaacgc

SEQ ID NO: 40830 - DNA, 584 bp, Glycine max
  Peptide Sequence Number=SeqID_157608
gtgcgagaagagtagcgcacggatcatcttctgcttgcccgctctttgtgtatgtagattgggaccaacatttggctaggatagggggcagaacgatcagctggtttcctcgatggaaggaaggaaatgagggagtccttttctcatgtggggagtacccaaacattccgttgatagggacgaggggttgtattaactacaatcccacacttgctataagacagttagggtaccccatgaggggagcaccggcggaagaaagcctctctcctttccttgtgagagatttcgacgcgcaaagtttcaagattatacaaagaatccacaaggcatgggaaagcccgttaaggaaagataaagaacttaggggcatccgtaatggcatcatcggtggttatcatgaatggttgaaagttcatacacgagggttagattggctctccaagttgaaaattattaacgaggagaacttcgaagctccgaaagaggatgaagaagtccgagctctaaaaactgaactacgaaaagcaagacttgccaaagaaaaattcaagttagtcgctacagacatccggaaagagtga

SEQ ID NO: 40831 - DNA, 1833 bp, Glycine max
  Peptide Sequence Number=SeqID_157609
gtagagcatgtgttgattgaccggctgacagagtttatgaacgttgatttgcaagatgcaaaggattctcgccgtcgttttgacaaagctgtgcattcgtatgatcagtcacgagagaagtttgtctctttgaagaagaatacaccggaagatgttgttgctgaattagaagaggatctacaaaactcaaaatcagcatttgagaaaagtcgcttcaatctagtaaactctctcatgaatattgaagtgaaaaagaagtacgagttcttggagtccattagtgcaataatggatgctcatttgagatattttaaactgggttatgacttactaagccaaatggagccctatattcaccaggtgctaacatatgcacagcaatcaaaagaacttgctaatattgagcaagataagcttgcaaaacggattcaggaatacagaacacaggcagagctggagaatatacgagcttctagcaattatatagaaaccgttctaggttctgatggcacccatgttgtgggtttgaactcttacagaagttttgaagcaggggtgcaacctgcaacaaccaaaggggaggcaagtaattggccttttctggttcaaacagttaaacagggttatctgttaaaacgatcatcaagctcacgtggagattggaaacggaggttctttgtacttgataaccaagggaatttatattattacagagtgaagggtgtcaaacccatggctgaaaatgaagctgataggatggactgggtaaacaaaattactggagctatcacatcgctttttaattctcagtttcttcaacagcctcaatttggtagagtgcattcacagaataaaaactcagcagctggtgcttctttggcaagtcaatcagaggatagtcagaaatcattgagggatggcatatattccaaggaagtggttagtgtgtcaaagattttaaggggaattcctgggaatgataaatgtgctgagtgcagtgctcctgatccagactgggcatctctaaaccttggcatattgctgtgtattgaatgctctggagtgcatcgaaatcttggtgttcatgtctcaaaggtgagatctataacattagatgttagggtttgggaaaataccgttctagagttatttgataacttaggtaatgcttattgtaattctgtctgggagggcttgcttctacttgatcatgaaaggttaggtgaatcaaatgtgcctatgaaaccttgctctacagatgccttccaacacaaggagaagtacatccaagcaaagtatgtagagaaatcactgatcatccgagaagaggatatacctgggaatccttcagtttccataagaatctggcaagcagttcaggctgtaaatgtacgagaagtgtatcgccttattgtcacatcaacatcaaatctgataaacacaaagtattatgatgagtctcaccatgctgctgatgccaaagggcatcagcatgatcctgaagcctgtctgagagttgaagagactactgagacagagaggtgtttccgtggatggtcattattacatctggcatgtcattctggcagtgcactgatggttgagttgttgctccaatttggtgctgatgtaaacatgtgtgactatcatgaaagaactcccttgcaccattgcattacaagtgggaaaaatcaattggcaaagtttctattaagaaggggtgcaaggccgtcagttaaagatgccggaggactcactgtacttgaaagagcaatggagaggggagcaataactgacgaagaactatttatcttgcttgctgaatgccagtga

SEQ ID NO: 40832 - DNA, 147 bp, Glycine max
  Peptide Sequence Number=SeqID_157610
atggtcaaataccgcgccaaatccaagacagagatgaaccaaggtgcttggggacgggtacgagtagatgctaggcccgtgatcagtagatcatcgtcccgtgtctggctccggacgatcaagaagcactactgggaggcagcctag

SEQ ID NO: 40833 - DNA, 1017 bp, Glycine max
  Peptide Sequence Number=SeqID_157611
atgatagattcaaatccaccactcgtgcaacactatggggcacttgtgagaaactctggtgaagaagccaaaaaggctaaaagttttaatgatcaaaatcatcctttagtggatgcatgtgacctacccttgatagaccttagtggccttaaaagttctaatgaaagagaaaggaaggcttgcactgcagcaatatgcaaggcagcatcagaatggggattttttcaagtggtgaatcatggtataagccatgacttgctaagaaaaatgagagaggaacaagtgaagttgtttgaagtaccgtttgagaagaaagttacttgcgggcttctaaataacccatataggtgggggacaccaacagctactcgttcaaaacacttctcatggtctgaagctttccacattcctctcaccatgatctcagaagctgcttcctggggtgaattcacttctttgagggaagcaataaatgagtttgcaccagcgatgttagaagtatctaggttgttggccagcattctagcacaaaacctgggctacccggaggatgcacttgaaaaactctgtgatgctggcacatgctttctgcgattaaatcactatccatgctgcccaaaatctaaagatgaaatttttggattagttcctcacactgacagcgattttcttactatcctttatcaagatcacgtcggtggactccaactcatgaaagattccaaatgggtcgctgtaaaaccaaacccagatgctctcattgttaacattggggacctttttcaggcttggagtaatgatgagtacaaaagcgtggagcacaaggttgtggcaaataacaaaatggaaagatactccatagcatatttcctatgtccttcttacagtactgtcataaacggctgcaaaggaccttctgtatataggaagttcacgtttggagaatacagacaccaaattcaagaagatgtcaagaaaataggacacaaaattggactatcaagatttctactttaa

SEQ ID NO: 40834 - DNA, 471 bp, Glycine max
  Peptide Sequence Number=SeqID_157612
atggacctgacagttgaagatttgatggccatagcagaacagtatgttaaagattatgagaacaaggatcgaaaagaaagatcaagtagacagcgtgaatcaaaatggcaatttcaagatacaaatgaaacgggaactactcttgattcctcttgtgagaacagaatttcatccgggtctggaagggaagatttatctaattctacttcaacaactggtgaattaattgctacaagcacctctcaaacaggtgatcctgctcaagacatgctggacctgttcttgggtcccttgctgaggaaaactcttgagaaggagaagatcaaatctgttgtggaaaatgccaagattacccatgagttctctaggcaaagtcaagataaacttgctggagaagaaatggtccccttgatgaaaaaaagaaacaccttgaaagacaaggtggcaatgtttcttgaccaagatatgtag

SEQ ID NO: 40835 - DNA, 399 bp, Glycine max
  Peptide Sequence Number=SeqID_157613
atggttcctatgggtaattattttgggctaagtagttcgtctgagatgatgatatattctgggaattcaagcatcattaacagtagtaatcctgtcatgggtcaaatgagtcaagctggtaatctatccagttcctcgcttcttctcgattcggtcccggggctgaagcacgacacagggttggctgttgagtggtctgttgatgaacagtacagattggaagaaggccttgccaaatatgctgatgagccaagtatcatgaggtatatcaaaattgctgccctgttgccagataaaactgttcgtgatgttgctttgaggtgtagatggttgacatggaacttccttttcccaatgcattcaaatttacttgtctcgccatctcctcctaaaccttag

SEQ ID NO: 40836 - DNA, 681 bp, Glycine max
  Peptide Sequence Number=SeqID_157614
tggtacagcaccgaaaatgtgcaaggcagggaagactactcggttgccgatgccatgttgcagtttgtaaagcaacacaacattgctgttcgaggccacaacatattttgggatgatcctcgttaccaacctggttgggttccttcactctccccatatcagcttaactctgcagtggaaaagagggtgagatccgttgtgtcaagatataggggccaacttatttcttgggatgtggtgaatgaaaatttgcacttttcattctttgaaggtaaacttggacaagccttttcaggtaggatcttccatgaggctcataatattgatggacaaacaactttgttcctgaatgaatataacaccattgaggatagtagagatggtgtgtcaatccctgcaaggtatatccagaagcttaaaaaaattcaaagttatcctgggaatgcaggattgccaattggaattgggcttgaggctcatttctctggtccgggtattaactttccttatttgagagcttccatcgattatcttgctgctactcgtttgccaatttggattacagaactagatgttgcaagccagcctaggcagtcacagtactttgagcttgctcttagagagttacatggccaccctatgggaatgttgtggacagactcctttctgaatggaggttaa

SEQ ID NO: 40837 - DNA, 144 bp, Glycine max
  Peptide Sequence Number=SeqID_157615
atggcagcgacaagcagaagcctccctcagcaaggtgatgccaaaatgaacgttgtgaattttcaaactattcctagaggaagtgcacacgtgtctatcccaacatgggaagtgggaggaccctatattgataaggatgattag

SEQ ID NO: 40838 - DNA, 201 bp, Glycine max
  Peptide Sequence Number=SeqID_157616
atgtgggatgctaccgtgtttagggtgtttaatgaagacttcccattgtacataaagcatgaagatctctctgaaattgcacacggtggtcaatgtcttagcatatttgttatacagttgtggattatgcatctaactgagacaggtatgcgagcagggaatttcaatgtgtatggatttctcgagccacagtctatctag

SEQ ID NO: 40839 - DNA, 189 bp, Glycine max
  Peptide Sequence Number=SeqID_157617
atggtcagggtcactccattttgtgagaatgctccaaccatatgggatcaacataggcttaagggaacactcaaaccgagtgtctttaaccccaaggcccagactccgaagaatccgttagggcctcaccttcctcattcaggtccaacccctaaaacaattctttttacacacaaacacacctcatga

SEQ ID NO: 40840 - DNA, 318 bp, Glycine max
  Peptide Sequence Number=SeqID_157618
atggggctcgggattttgcctcttttctgcgcaagctgtcggagtgccggccattcagcattgcgccatagccgccacgaccgaactatgatattgataataaaagcgaatacgcttagctgcggctgtcacagcgcacctgctaaaatatctggagacgggctgccgggcgcgggcgatgccattatgcaggtctacgatggcgcacaaccgctggacgtgacgcgtaaatcggatgattcaccggtcacggcggccgatctggcggcacatcaggttatcgtgcagggcttagcggcgctgacgcctgacgtgccg

SEQ ID NO: 40841 - DNA, 1149 bp, Glycine max
  Peptide Sequence Number=SeqID_157619
gcagcaggtgcggcgctcggcggtattttcgggcccgtgggagcgatcatcgggcgtgcggccggcgcgctggctggcaacgccgtggatcgcgccttgctttcagacggtcgtaccgtgtccggggcacggctctcgaccgcgcgtattcccggtgcggatgaaggcgccgcgataaaccggctttacggtacggcgaggatcggcggcaccctgatctgggcgacacgtttcgaagaaagccgtgtcgtgcagagacgtggtggcaaaggcaaccgcggcccaagggcggagacctatcgatatttcgccaatctcgccatcggtctctgcgaggcggaggcggccctcgtgcggcgcgtctgggccgatgggcgcgaaattgacctgaccggcatcgagatgcgcttttatcccggcagcgcaacgcagttgcccgatccgctgatcgaggcgaaacaggggagcggcaatgctcccgcctttcgcggcctcgcttatgtcgtcatcgagcgcctgccgcttgaagcctatggcaaccgcattccgctcatgcagttcgaggtggtgcggccggtcggcgggctggagaagtcgatccgcgccgtgaccgtcattccgggcgcaaccgaacatggttacgcaacggtgccggtttccgagcatacgggcatgggtgaaagccgcgtgatgaaccgtaacggcctgacggccgagacggactggcgcgctgccatcgatgaattgcaggcgctttgccccgctcttcaaagcgtggcgctggtggtgagctggttcggcacggatatgcgggcgggcgaatgccgcatcctgccgggtgttgaagtgggggaccgggagggcgagacgacgccgtggtccgttgccggcctgacacgcgccggggcgcatccggtcagccatcatcatggcggtcccgcctatggcggcacgccgaataatgaaggcgtgctgcaggcgatagcgacctcaaggcgcgggcctgaagtctgcctttatccctttgtgagatggacgtgccgcggcaacggctgcggatccctatggcaaggccgaacaggacgcctatgctggggggcgcatcacctgctttcccgccccggagcccggatcgccgatcgtaccgcg

SEQ ID NO: 40842 - DNA, 240 bp, Glycine max
  Peptide Sequence Number=SeqID_157620
atgtcatcaagtctatgcaaatatctttattccacacggatggattattcagaaggacactatccagtatatagtatttcaaacactgcgtttccaccaagtgaagggaaattctcagaagcatgcgttaatcttccatccatcacttcgcaggggtccctggtagaagcaactaatgatcaaggttcctcccacagagggacatctgacataaacttgagattttgcatactaccgtaa

SEQ ID NO: 40843 - DNA, 1586 bp, Glycine max
  Peptide Sequence Number=SeqID_157621
acaaagaaactaatgaaccaaaaggagatgctaccgtaacatatgaggatccgcatgctgctgtagctgctgttgaatggtttaacaacaaagattttcatggcaatacaattggagtttttatagcagagtcaaaaaacaaggatgagcaagcatataatgcagcagttgaacctgtagttgctgatgatgttggtggactagaggaaactaccaaggatgttaatggtggtagtggaagaggtagaggtcaaaatgattcttcaggcaaagcatggcaacaagatggcgattggttgtgtctgaatacaagttgctccaatgtgaactttgcttttcgtggtgcttgtaatcgctgtggaactgctcgtcctgctggtgcttctggaatttcaggggctggtggccgtggcaagggacgtgctgcacaagaatcagggggcattggccggccagctggtggaggactctttggtcccaatgattggccttgtccaatgtgtgggaatatcaattgggcaaagcggactaaatgcaatatctgcaatacaaataagcctgggcataatgagggtggtgtaagaggaggacgaggtggaggttacaaagagcttgatgaagaggaaatagaagaaactagacgtcgtagaagggaagctgaagatgatggggagttgtatgatgaatttggaaatcttaagaaaaaataccgtgccaaaacacagcaagctgaagctgcacgtgggcttcctggttcagggcgtgctggttgggaggtcgaggaactagggatgctagagaaagtagagacagaggaagggagcgcaatgatggggagagcaggaacagagagcgaagcgaaaaagagaggcctagcagttggaatagagagagggagaggggaagagaccgagattgggattatgttgatcgagatagagattatgggcgagatcgagatcgggaccgaagtagacaccgttactgaaattagcagcaagagtgcatccggatgtgttgactaccatgctgtgttggccttttgtggaaggatttcaattgctttgaattcaatccttaagtttgggggatcaacttcctgcaatctgattaatgcccattttacttggcatggaccttttgtacaacctatgactgcatcttggatacgggaacagtgtgccaatatgagctctcgggcaggcaagggacctgctatcagaagttaccggcggagaaagacagctttggaccttgaccttaaccgtttaccggctggtgagaatcgtgagcaggagggaccttcaactcaggcggtgcctcaagaaattcaacttgaacagcagccacaggttactcaacctccgatgattgacgtggaagccattgatgatgatgttgttgaatgtaccccaagggcttttgctgaggggggaagtgttaaaaagacacccgaacctccaaaggagcttgtcttcaactgtccaatatgtatgggccctatggattgcatcaaggctgctataagtgctcagggtaaatgccctacctgtagaaaaaaggttgttgcgaaagatcttataagg

SEQ ID NO: 40844 - DNA, 198 bp, Glycine max
  Peptide Sequence Number=SeqID_157622
atgaagaggttgtgggagaactacgatgaccctaacaacattaggaagaaaataatagaggaatgtagtggtggtaaggaaggagataggtgcatgacatcgaagaagggtgtgaaaaacaatggaggcaaaggtgataaggttggcgaaacatgggaggaggagggaggtttgcaaatagaaaataggatggagtaa

SEQ ID NO: 40845 - DNA, 363 bp, Glycine max
  Peptide Sequence Number=SeqID_157623
atggctgatgcaagtgcatattgtgacattgacacacagttctttattacaatcgaagtaatttctcatcagtgcagtgtgacattgcattgtcgcttagagaaggagaaagaagttcacggagttggtgtccacctcctcatgattgacagcatcggagcttttcattggatggatcgtgcatcgatgttcttgtctcaaagagaaaacagcaaaaaaaaacttttccttcagaccatgtcagaagctgtagttcagaatattagaaaacttcttcaggtgcaccctatgcttattatagccacaaagtcagtggtttttgggaatagatattctacagcttcaaatgatgtcaaagtgtga

SEQ ID NO: 40846 - DNA, 711 bp, Glycine max
  Peptide Sequence Number=SeqID_157624
atgaacatcatgtctacccaccagtgtagttggcctgtgagaattcaggatcatcctgacaaaggaagtattaacaaggctccattttccagaggatcggaattccttaatgttggataccatgctcaaaaatatggccatagtgccagaaaatgtaggcccatttttgccagttcagtgagcaacagtatggatccttctgattcagatgacactgataagaaaaaacctcagaatggtgaaatgggaggagtgaatagtgaaatgcttagagagagtctcgagaaaatagttggagaagatgattccacgtttagtggatttgaccttgctactcttatcaggaacaaatatgggaggtcttatgatgtacagttgataaagaaggaattcatgggaagaaatctccttgcgatgaatgtcatgtggaagtacatggagcagagatctttcccattgaccgaagaagagtatattttgaggcttgatgatattgcaaacaccttaaaatgttggggagctgtctcacatattcggaacagcctagaaaagtcgaaggaacgacctcggataggcaaggtgctgtttttaaactttgaaagttggttgaagactgtttctttcttggataataatatcattaacgagaaagaagggcatagtgaaaggtggatacatgtctttcttagagaagacagaagatacaaataa

SEQ ID NO: 40847 - DNA, 565 bp, Glycine max
  Peptide Sequence Number=SeqID_157625
tggcacattccttgaagatgccatgcttgtctcatgtggacattcttttggtggtctcatgctgaggagagtcattgaaacgtcaaaatgtactctctgcaatgtggaaattgaaactggttctttgatccctaatcatgctcttagagctgcagcagctgctgtcaagcatgaggatgatcggaggttatttcgtaatgccgctctccgaaagcggcggaaagaaatgggtgaccaaatggattcaatgagaagagtgaatggggaaaatggagattttactgctgccgatggacttcagcggggagtacaatatccatttttggtaaatgagaaagttgttattaagggcaacaggagaacaccagaaaaatttgttgggaaagaagctgtgattacatctcagtgtctcaatggctgcagtgccaatggtggtagtggcggtgatggtggtgggagtgtcgatattggtcatgacgatgttagtggtaatggcagagccggtggtggtggtgctgatgtttgtgggggtggcggcaagggtaggaccattgttaaatgttag

SEQ ID NO: 40848 - DNA, 1683 bp, Glycine max
  Peptide Sequence Number=SeqID_157626
atgctagctttacctcggtggagcaacacccttgtctccctattcaagaaacaccaaacattggaacaatgcaagcagattcaatccatcatcgtcacttccggtctctattcaacacaagacaacaacactcttttcctcaccaaactcctccaatgtgtcccattttctcaaaatcaaaatacatgtctcttgcttctcttcgacaccatcaacactcccaacactcgcctcttaaacaaaatgatcgcagcctgctcccacccccacatttcccttctatgctacgccaaactgcgacaaaagggcgtgcaaccagacaaacacaccttccctttgcttctcaagacattctccaagtccattgcccaaaacccttttatgatttatgctcaaattttcaaacttgggtttgatcttgatcttttcattggcaatgccctgattccggcttttgcgaattctgggtttgtggaaagtgcacgccaagtgtttgatgaaagtcccttccaggacactgttgcttggaccgcattaatcaatgggtatgttaaaaacgattgtcctggcgaggcactcaagtgttttgtgaagatgagattgagggacaggagtgttgatgcggtcactgttgctagcattttacgtgctgctgctttggtgggagatgctgatttcggaaggtgggttcatgggttttatgtggaagcggggagagtgcaattggatggttatgtttttagtgctcttatggatatgtatttcaagtgtggtcattgtgaagatgcctgcaaggtgtttaatgagttgcctcacagagatgtagtgtgttggaccgtgcttgtagctggttatgtgcaaagtaacaagttccaagatgcacttcgtgccttctgggacatgctatcggacaatgttgcacccaatgattttacactctcaagtgttcttagtgcctgtgctcaaatgggggctttggatcaaggaaggttggttcatcaatacattgagtgtaataagataaatatgaatgtaacgttagggactgcattggtggatatgtatgcaaaatgtgggagtattgatgaagctttaagggtgtttgaaaacatgccagttaagaacgtgtacacttggacagtgataattaatggtttggctgtgcatggggatgcgttaggagcattgaatatcttctgttgcatgttaaaaagtggtattcaacccaatgaagttacctttgtcggtgttcttgctgcatgttctcatggaggttttgtagaggaagggaaaaggttatttgaattgatgaaacatgcttatcatttgaagccagagatggaccattatggttgcatggttgatatgcttggtcgagcagggtatttggaagatgccaagcaaattattgataatatgccaatgaagcctagccctggtgtattgggggctttatttggtgcctgcttggtccacaaagcttttgaaatgggtgaacatatagggaatttattggtaaatcagcagccaaaccatagtggtagttatgcacttctggctaacttgtataaaatgtgtcaaaactgggaagcagctgctcaggtcaggaagctcatgaaaggattacgagtggtaaaggctccaggatatagtcggatagaggtggatggttttaattcatga

SEQ ID NO: 40849 - DNA, 255 bp, Glycine max
  Peptide Sequence Number=SeqID_157627
atggcatcggcgttcgtcaagctcgatgattcccctatgttccagagacagttatattctctcgaagaaacaactgatgagttaacggatcggtgccagaaactatataaagggtgcaggaagtttatgaatgatttccttgaatacagcagaaagaagtatagggctagtttttctcctctgttcatggttgtcccaaggggatttctattgttgatcaaatatgctaagaaattagacagctttgttgcattt

SEQ ID NO: 40850 - DNA, 261 bp, Glycine max
  Peptide Sequence Number=SeqID_157628
atggataagatgaatgtacacataataacaagggggaccctaagggcaaagggtcacttaggggcagttggagctcgcccaggtgagctgaaacttagtgctgaagcaatgagctcgcccaagcaagttagtttcttcatcatgaagctatttgggggcccaggcgagccaaagactagcctaggcgagctagggttcaggaaaaccaaggaaaagacccttttgccccccttttgggtatttttcgtgttcttgatctaa

SEQ ID NO: 40851 - DNA, 869 bp, Glycine max
  Peptide Sequence Number=SeqID_157629
gaattgcacttcggtcgcgcggccctgcggctggggatcgccactcccacgctgagcgtgcagatccaggacatcgagcgtcgcctcagcacgcgcctgttcgaccgcagccggcgcgaagtgctgttgacctccgcaggcgaggtgttcctggcggaagcccgcgatgtgctgcgccgattcgaacaggccgaaccctgggccggcgcgccgggcggggatcagctcagccggttccgcagccgctacccgggcgtggaactgcaggtgagcgaatggccgatgggcgagctcccgcagctgctgcaggaaggccgggtggatgtggtgttctgccggcctccgatggatgtacccgacagtttcggcgaacacaccctggtcgaagaccagttctgcgtggccctgccggaaacccatccgctggcgcaggcccgcgcgccggtacagccggcgtcattggcccgggaaagcttcgtcatgccggagcagccggtgggcgcaatggaagtcgggcgccgcggcgggttcattccacgtatccgttcccagcccgggcatctggcggcggtgttggccgaggtgtcggtcggcgttggttcggtggcgatcgtgccatcggtactgcaacgcacgctggtgctgcccggaatgatctatctgccactggccggccccaccatcgtctcgaccatcgctgtgcagtaccggcgggcggagacctcgcctgtggtgcgacggctgatcgagcaggtgaaggagacgccgtgcaggcgcatcgacatgttgcccctggcctgagcgccgcgcggcaggtggacgattgctacacttgcgccacctgcatacgcattcgatggacatcatga

SEQ ID NO: 40852 - DNA, 681 bp, Glycine max
  Peptide Sequence Number=SeqID_157630
atggtggcaatgagtggtgattgtggcaacgttggctatggttgtggtggcggtgagggaagtgttattgttggtagtggtggtggtggtgacgatggtagcaatgttagtggtgatggtggtggtagtgatagtggtgggggtgcgatggtggcaacaattggtgattgcgaaaatgttggctatggttgtggtggcagtgacgaaagtggtattgttcgtagtggtggtgatggtgtagtggcaatgacgacgatgtcggtggtggcaccaagtggtgatggttgcaacgacattagtagtgggtgtggtggtggtgacggatgtggtggtggttgtaacatccgtgattttttacttctcggcggctcacctactacaacacttcacacgatgacacttcactcaatattcttattggtcaaaaccatccaccgatcagaatcctttgtagcctttggatccctctctttccgatgtgatttgtttgcgtgttacatggtggtagtgataatgacgatgatagtgacaataatgatggtaacaatgttagtggtgatggtgatgtcagtggtgatagttatggcgaggacgatgatggtggtggtggtggtagcagtagtggcagtcagttatgatggtggcggtggtgtggtggtggtaatgatggagcaatggtga

SEQ ID NO: 40853 - DNA, 413 bp, Glycine max
  Peptide Sequence Number=SeqID_157631
tggtcgccgtgcatatcgatgagtcgctgctggaagacgggatttatcaaaccgcgaaagcgcagccgattttacgcgccggcgggccgacggcctactacagcattgatgaaagccagcgcttcgatatgatccgcccggacgctcccatgagaacctttctgctcgcccccgcttttatcgcccttgctcttctctcctcacccacacaggccaacaaccccgagaccgctgccgtggccgttggcccgctgcgcccgtccggctcagtttccgcctccggcgccagcaccctcgacgatttacaggcgcaactggcgcaaaaagcccaccagcagggggcgattgcctggcgaataaacgccgctggcggcggcaacaaattagccggcagcgcgataatttataaataa

SEQ ID NO: 40854 - DNA, 916 bp, Glycine max
  Peptide Sequence Number=SeqID_157632
caccacacccgccgcgcttaatgcgccgctacagggcgcgtcccattcgccattcaggctgcgcaactgttgggaagggcgatcggtgcgggcctcttcgctattacgccagctggcgaaaggggggatgtgctgcaaggcgattaagttgggtaacgccagggttttcccagtcacgacgttggcgaattggagctccaccgcggtggcggccgctctagaactagtggatcccccgggctgcaggaattcgatcggtcgccggccgaagcggcgcggccggcgtaacactctggcgcggcagggtgatgatgaattccgtgaaggcacccggttccgaggcgacgtcaaccgtcccgccgtgctgcttgaccacgatgtcgtggctcagcgacaggccgagccccgttccctcgcccgccggcttggtggtgaagaacgggtcgaacatcttggctctgacgctgtcggggatgccggtaccgttgtcgcgcacgcggatctcgacgctgtcgccccggtcccgggtcgcgaccgacagcgtcggttcgtagccgggatcaccgtcggcggcccgcttctcggtggcgtagaagccgttcgacatcaggttcagaaggacccgcgttatctcctgggggtagaggtcggcgagaccggacgccggatcgtaatcgcgcacgagggtcacgttgaagctcggtttcgccgcgcgggccccgtgataggcaagattcaggctctcctcgaccagcccgttgacctcgaccggtcgatgctcgccggatccggtgcgcgagtgcagcagcatgttcttgacgatcgagtccgcgcgcttgccgtgctggacgacatcaagcttatcgataccgtcgacctcgagggggggcccggtaccagcttttgttccctttag

SEQ ID NO: 40855 - DNA, 384 bp, Glycine max
  Peptide Sequence Number=SeqID_157633
atggaggagaagagcaagcgtggacataaggaacattcgtgtactgaaagcccaacgctcaacatcgacccaccatccccagttgcaagacacttgaagtggaagatcgcccgcactaagcggcatggccaaatgacgtctaaagtggcacaagaaattgcagacaaaattgattcattacaggaacaagcaacacaggggagttttgttccgcatgggcgacaagacatactcaacacggcccttggccgacctgagcatccaggccgtgttcgcgtcgcagggacaggtgtcacaataagccaatactttggccaagcctcacgtgcttctagcacatcgtcaccatcgatcaaccaacaacaattggctgatatcatcggt

SEQ ID NO: 40856 - DNA, 1170 bp, Glycine max
  Peptide Sequence Number=SeqID_157634
atggcgacggtgatgcagaagatcaaagatatcgaagatgagatggcaaagacccaaaaaaacaaggctactgctcatcatctgggcttgctgaaggctaaattagcaaagttgcggagggaactccttacaccttcatcaaaaggagctggaggtgctggtgaaggttttgatgttactaaaagtggggattcaagagttggtcttgtgggcttcccttcagttggcaaatctactctactaaataagttgaccgggacattttctgaggttgcttcctatgagtttactaccttaacttgcatcccaggtgtgatcacatatcgtggagctaaaatccagttgttggatctccctggaattatcgagggtgctaaggatggaaagggtagaggaaggcaggttattagtactgcaagaacatgcaattgcattttgattgtccttgatgcaattaagccaataactcataagcgtcttatcgaaaaagagctagagggatttggtataagtgtatgtactggtagtcttgttagtagtctcatagatttctatttggcctccgactttgactttggtccaaagaaggagggttttagaagtgaagcagggggtcttacatccaaattagccacaagggaagtgttactgcatgtaaccatttgttcatgtggcaggttaaacaaagagccaccaaatctgacttttaggaagaaagacaaaggtggactcaatctcacctcaactgtcaccacaacacatctagatcttgagactgtgaaggctatatgtagtgagtacagaattcacaatgcagatattactctcaggtatgatgccactgctgatgaccttatagatgtcattgagggaagtagggtgtatataccttgtatctatgttgtgaacaagattgatcagatcacacttgaggaactggagatcttggataagctacctcattactgcccaatcagtgcacatctggagtggaaccttgatggtcttctggagaaaatttgggaatatctcaacttaactcgtatttatactaaacctaaagggatgaatcctgattatgaagaccctgtaatattatcctctaagaagaggacagttgaggacttctgcgatcgcattcacaaggacatgcttaaacagtttaagtag

SEQ ID NO: 40857 - DNA, 609 bp, Glycine max
  Peptide Sequence Number=SeqID_157635
atgccggataaccggaatcacggccatggtgttgggaagttcctccctcgtggcatccatgagcttctccatcgattccgctgctttcttgaaagccttcacatcacagcacgcacattctcacaatcagaatctaacaccgaatcgacaacacaaaacaaaccaggagcgtcggaatcgcggagcaaaacagccacgttgcacatatcgccgtctgcacgagaaaacaaacacgcgcgggcaaagacgttgagaacggtgacgtggcggttggtaaggttccagtgcggaagcgatggagatccaacggtggtggaggtgtggttcgaaggttgtgcagtcaaggagcacagggattggggaagggaacggtgttttgtgcaggagagggtgcggtgtgagttaacgttggtggcgaaagcgtggttcgtgtgcggaacaacgatgcctgggtttgaagcttggaaatggaatcgcagggcactctgcatttctgtgtgcgatacaaacacaagcagtgaatccaccataaccagacaagactgttctttctgcacattatgggccccagaaaggaggagacagcaattgcttcctgcaccaccttaa

SEQ ID NO: 40858 - DNA, 1608 bp, Glycine max
  Peptide Sequence Number=SeqID_157636
atgggtctggcattgaacatctcagtgtgttgtttcccacagcagcgttgccccactctcttcaaacccaccattaccaaacaaaccctctccttccccaccgcttccgctttctcctccgtaactcaactcagcgtgggccaggatttacccgccaactacagcgattgggttcccagtcccgaccccgagcttcgcagaagatgcggcattctgctccacccgacgtcgtttcgcggcccctacggcatcggcgatctcggcgacgaggcgttccgtttcatcgactggctccaccactcgggttgctccgtctggcaggttcttcctctcgtgccacctggcagaaaggccaacgaagaaggatccccttattctggccaggatgcgaattgtggcaacacgctcttgatctctcttgagggcctcgtcgaggatgggttgttggaaaaacacgagcttcctcaaccaattgatgcagggcgggttaatttttcactcgttgctgatcttaaggatcctttgataactaaggctgcagagaggctcatttcaagtgaaggggaactcaaaacacagcttgagaattttcgaagggatcctgacatatcatgttggcttgaagatgcagcctattttgctgctattgacgatagtttaaacacaatcagctggcagtggcagaaagttcacagctatgcacagagtaagggaatcagcataatgggagacatgccaatatatgttggttatcatagcgcagatgtttgggcaaataagaaacagtttttactgaacaggaagggctttcctcttttagttagtggtgttcctcctgacgcattcagtgaaactggtcagctttggggcagggcgagccctggtgcagcggtaaagttgtgtcttggtgacttgttggtcatgggttcgaatccggaaacagcctctttgcatatgcaagggattgaccactttagaggatttgctggatattgggctgttccctctgaagcaaaagtagctatgcttggaaagtggaaggtaggacctggaatatccttatttgatgccattttcagagctgttggaaggattaatattatagcagaagacttgggagttatcactgaggatgtagtccaactaagaagatccattggagcacctggaatggctgttctccagtttgggtttggaggtggtgctaataaccctcatttgccccataatcacgagtgcaatcaagttgtctatacagggactcatgacaatgacacaaaaggacctgggtatgctctgcagaaatcagtcaaagtttgtgataggaaactgattggaggttggtgggaagctttgaaccaagaagagaaatccaatggagatgaaatttcatgggcgctaatccagagagtattggcttctgttgctcaaacagcaataatacctatgcaagatgttcttggattgggtaattctgccaggatgaatattcccgcaactcagtttggaaactggggttggagaattggaagttcggtgagctttgatggcttggagagagaggcagacagactcagagaaatgctttcaatgtatggccgactttga

SEQ ID NO: 40859 - DNA, 1113 bp, Glycine max
  Peptide Sequence Number=SeqID_157637
atggcctctgggaagacaactgtgggacggatattgtcagaggcgctttcttattcgttttatgatagtgatgcattggtggtgaaggaggttggtggaatatctgtaactgatatattcaagcactatggagagcctttttttcgtaataaggagactgaggtgttgcagaaggtgtcaataatgcatagacatcttatttctactggtggaggtgctgtcgggattagtgtttggttggatgtacctgtagaagtcttgactcagagaataacagctgaaggaactgattctcgcccacttctacattatgaaggaggagatgcatacacaaagactatcacgcatttgtcttccctttttgaagaaagaagtgaagcatatgcaaacgccaatgtgaaggtctccttggaaaatatggcagcaaaactgggccgaagagatgtgttagatttatctccaactgctattgcaatggagtttcaagatgaagcgccacgaaacctaaagtggttcaaggcttgcaaattttcagctatggtgcattccaagaagcttggaagaacagagccaaatggttctgccggtgatgcattggtggaggaggaggttgatggaacagccgtagctgatatattcaagcacaatggagagcctttttttcgtaataaggaggagaaaattggtacctctgaaggtggtggacatactgaggtattgcggaagttgtcaatgatgcatagatatgtcatttctactggtggaggcgctgttgtgagacccatcaattggaaatatatgcagcaggggattagtgtttggttggatgtacctgtagaagccttggctcagagaataacagctgtaggaactgattctcgaccacttctacattatgaagaaggagatgcatacacaaagactttcatgcgtttgtctgccctttttaaagaaagaagtgaagcatatgcaaacgccaatgtgaaggtctccttggaaaatatggcagcaaaattgggtagcagagatgagtcagatttatctccaactgctattgcaatggaggcgctcgaacagatcaaaggctttcttatgggtgaagatggctgttaa

SEQ ID NO: 40860 - DNA, 1038 bp, Glycine max
  Peptide Sequence Number=SeqID_157638
atgagcaaaagagctaataagaggaaagcgaagcaagacgaacagcccaaacaacgcaagaagcgatccacaacaattaaacctgccgagcacgaagagtacttcgaggatcagcgcaacttggaagacttatggagggaaacattccctgtcggaacagagtgggatcaattggattctgtgtatcaatacaagtggaatttctctaacctggaaaatgcgtttgaagagggtggtgtacttcatgggaaaagggtttatctctttggttgcaccgagcctcaactggtctggttcaaagatgaaagcaaagttgtctgcatacctgttgttgtagctgttgtatcacctttcccaccgtctgataaaattgggattaactcagttcagagagagttcgaagagataattcccatgaaacaaatgaaaatggactggattccatatatcccccttgaggaccgggctgcattgaaacatctgaagttggatcgtgtaaagaaatacgagtattgcttgccttacttctaccatccgtttaaggaagatgaacttgaacagagcactgaagttcaaataatatttccagcagagccaaagccggttttctgtgaatttgattgggaattagatgagcttgaggagttcactgataagctcatagaggaggaggagttattggaagatcaaaaagatacctttaaggaatttgtcaaagaaaaagtacgggaagcaaagaaagctaatagagaggcaagggaagctcgaagaaaagccattcaagaaatgagtgaggaagctagagctgcatttgagaatatgagattttataagttctaccctgtgcaaagtccagatgcacctgatgtatctaatgttaaggtaggtattatggaaaggctcatgaggttctgtaattggattcaagacgatgccaacttcgtctgcaggcttgttttacctgacactaaggatttagtcatctatgacgttcagaaggcaacctcctggtgcctggttagaagtgtaggtgtctga

SEQ ID NO: 40861 - DNA, 1251 bp, Glycine max
  Peptide Sequence Number=SeqID_157639
atggctttgagatctggttcatcttccttcacctacgatctgttcctcagcttcagaggctctgacacacgccagggtttcgccgccaatctctacaaagctcttgctaacaggggaatctacacttccatcgacgatgaggagcttcagagtggagaggagataacaccgacgcttctgaaagcaattgaagagtccaggatttccatggccgtgctctctgtaaactatgcttcttcctcgttttgtttagatgaacttgcaaccatctttgactgcgccgagaggaaagcactgttggttttttataaagtggaaccttctcacgtgcgacaccggaaagttagttatggagaagcgttggctaagaaggaagaaaggttcaagcataacatggacaagttgccaaaatggaagatgcctttttatcaagcagctaacttgtctggctatcatttcaaagatggatatgcacatgaatatgagttcattgggaggatggttgagcaggtctgctgcaagattaatcccacttgtttacatgttgcggattatttggttggactagagtcacaagtgtcaaaagtaatgaagcttttggacgttggatctgatgatggtgtccaccacatgacagggatccatgaaaaatcaaacaaacatgagctacaacatttccaaagcatccttctttcatatatacttggaaagaagaaaattaagttagcaagtgagcaacaaggagtttcaatgatacaacatagactccagcgaaagaaggttctcttgattctagatgatgttgacaagctcgagcaattacttccattggctttggaagaagtcaaggatttacagtttattgcaaagctcttttctcaattccaccaaagtagggagccttcaagttctttctggtttcataataagttccctgacaaagttctttctcttgttattgcacctgtgggtgataacggatctagaatgtttagtcccaatcccatggtgttcatcaatggcaaagctcatgaatctgtcattagttggaatgaggaaatggtgagaatggaaatggattgtatatatcttgttgatttacaactgatttttggtaatctgtatgaagtgcctttagaaaatgaatggaaccatgtggaggttacatatgtgggtgtgataaagacttcaatccttaaagcaagcagaatctatgtaatcaagcaggagagaagcacagaggatatttaa

SEQ ID NO: 40862 - DNA, 3438 bp, Glycine max
  Peptide Sequence Number=SeqID_157640
atggctgaagatatcccgcgagttggtgggttttcggctggtctggctgtgatattgaacgataaggacagtaagaaaaattcgccaaagactcggcttctttcttgctgtgacgatttgggtcagcagtctgtggagcgaacccttgagtacgtgtttggtctcccgaacagatcactcaattcattgactggcctggttgatcgtaattttatttgctctgtcattaggaatgatttctcaagatataatgtgaaattgagtgattctcatggtgaaagagatgggatttgtattaatagtaaaaatggcaatgggcatgttgttataggcctagaagaatccagcatctgcggtgatattaaagtcatcaagtcaccttttcttatagagagcatggcgatgttcagtagtgccagggctagtgcttgtgtttggaaaggaaaatggatgtatgaagttatgttggaaacatctggcatacagcagcttggttgggccactctttcttgccctttcactgaccacaaaggtgttggtgatgctgatgattcatatgcttatgatgggagacgagttagcaagtggaacaaggatgctgagacatatggccagtcatgggttgttggtgatatcattggatgttgtatagatttagaccgagatgaaatattattctacaggaatggtaattccctaggggtggcattccaaggaattcgaaaattgggtcctggttttggttattatccagcagtttctctctcccagggtgaaagatgtgagttgaactttggagctcgaccctttaagtatccaattgaaggttaccttcctcttcaggctcctccctctaagagctactttgtcacccaattgctgcaatgctggtcaaggctgttggacatgcattcggtggaacgagctgagcattctttagttcagaaattgagaagagtgaagaggtttgtttcattggaagaaattttccatccagcttcttatgccatatgtgaggaattattttctatccttgaagcagatgatgggatcacagagtatatggtttggggtccaatgttgtctttcatgtttgaagtttttggtttgcatgcaccccatgattactcaagcatggataaagtagttgagattctgctacaatttcaaggatcacatgtgctatttgaacacatcctaaatgccctttcctgtggttgcaaaatagcctcattagttctaattgagtgtccttactctggatcatattctcaccttgcattggcatgtcatctactaagacaagaggaacttatggttctttggtggaagtcaccagattttgaattcttgtttgaagggtttctttcacgaaagactcctaacaaacaggatcttgactccatgataccaactgtttggtggcctggttcatgtgaagatgcatcttatgagggtaacatgatgttgacaaccacagctttgtctgaatcaattggcaagattgaagagaagcatagggacctttgtcgcttagtgatacaatttataccacctacgaattctccccagttacctggagcagtatttaggacatttttacggagccttctactgaagaacagaggagcagaacgaaatattccaccacctggagtttctagcaactcggttcttgtttcagtttacacagttgtactccattttctatctgagggatttgccttgggtgacatctgtggctggttgaagagctgcaaagcagatgttggtttccttcatagaggtggtgaacaaacttttcctgtacatttatttctgaaaaatgatccccatagagctgatatttccaggcttgggggatcctatagccatttatcaaagctacacccaacaattgatcatgaaatggaagtgattcaatgggatgaaggttgcatggatagtgaagaaaccagggtcacccattcaaccaggcagaagccatgctgttgttctagttatgattctgattttacaaggaacttcaaggttccagctaaatacctggccaaaggttctagtggtcattgtagctctattccggaaagacctgctcatgttgctgctgaatgcagtgatgggagtttgaacgatgagataactgataaaccaagctccagtgatcaatctgaacctgagtatggttaccgccaagtgcaccatatgaagtctgtaccaaaggatactaatatgtctacagatacactacaagaagaagagctacttgatgctttgctatggttgtatcatgttggtcttgctccgaattttaagcaggcatcatactacatgactcatcaggcacagtcaatttcccttttggaggaaactgataagcaaatcagagaacgagcttgcagtgagcaattgaagcatttgaaagaagctcgtaatgaatatagagaagaggtcacctttgtagttacacatttcaatgatccgagaatatcaagtgcagatcttagggatcttcttcttcagtctatatctgtcctggtgcaataccgggagtatttggctacctttgagagcaatgaggccgccacccaaagaatgccgaaagctttattatcagcttttgataacagatcttggattccagtgatgaacatactcctacgattatgcaagggttctggttttagtttttcaaagaatggagaatcatcttcgtcatcagttcttttccaacggttgctaagagaagcttgcataagtgatgaagggttgttttcatcttttctaaaccgtctgttcaatacactcagctggaccatgactgaattttcagtttctgttcgagaaatgcaagaaaagtaccagcaaaggaaatgctgtgtcatatttgatctttcatgtaatcttacaaggattctagagttctgtactcatgagattcctcaagcattcctgtctggaccggacacaaacctccgaaggtcccttagacggcataaccaacctccagaaaaagtaaacagaggcatgatattggcacctctagtagggattatcttaaatttattggatgctacaaattcagcagaatatcgagaaaacaatgatcttttagatgtttttgcaagcatggactgtccagatactgttcagtatggattccagtatcttttggattataactgggatggatcttttcggggggaagcttatgtggcaaaatatgagcaactagagaattttctaagtctccttacttgccgcactgtgttacatcatgataaagtggatagtgtgggagatacagatcttgatgatggcttgtgctgcatatgttatgcatgtgaagcaaatgctcaaattgcaccttgttcacacagaccggctaaggaggagcttctattttatggttgcttggttccggttgaagtcagctag

SEQ ID NO: 40863 - DNA, 483 bp, Glycine max
  Peptide Sequence Number=SeqID_157641
atgttgctaagcttagtgactggtgggtgggaattgggaaccactttcaggcaggggtccttaatgcccatcctactaggaaatgactgtggcacatggcactgtaacatcacggaaaaaagaaaaggaagtgaggatctagtgacatcatcgtcatgtcctcgacccgatgaaagtaacattatcttacttaacgaaacaattgtcgagttacgtatcattgtcagaggtgtagaggttgtcgagttggatgaccgcatgcgatacggagcaagagcactggtcattggtgaggtcactgcgacactagaagaggcaatagacgacatcataggaggcaaagatggtgaagttgttgtggttggtgaaggtgatagagttgacgaaggaggtgaggagcaagttgacaatgttttcattagcgaaatacgaagtgaacttaggctaggagtagacttgcacaaaagtgataagggttcttaa

SEQ ID NO: 40864 - DNA, 336 bp, Glycine max
  Peptide Sequence Number=SeqID_157642
atggagcaacctaagaattacctaaccccacctgcaaaacaactagaaaattcccaggcagatacaagaagtatagcacatgtcgtctatcctaggattcaatggcacaatgtatttctaactacaaagcggagggaatcattaaggcgttggaccttgaaacgatctcaagtgatatttaacaaaaagaagtttggttattgtagaagcaagcttcatgatgaatcaagattgattcaaagaagttttgatgataacaaaggtaatgacaaaaagctcaaaggtcaagaacacttcatgataacaaagatgatgatctcaagaatcaaagaatga

SEQ ID NO: 40865 - DNA, 351 bp, Glycine max
  Peptide Sequence Number=SeqID_157643
atggagcagagtaaggagtgttgcagtagcacaagtaatcgtaattccctttctgaagctaatggaatatcagataaaaatgctccttggttatcagtgccacagtttggggactgggatcagaagggacaagtgccggactactcgctagatttctctaaaattcgggaaacgaggaagcaaaacaagacaaatatttcaagggcaagtcttggtaacgaagaggagctcacggcttctgccactaacaatgcaaacactgtccacagtgatgagcaccagcacccccactacaaccaaaccaactctccaactctactatttgttggtattgtggaaaattgggaatag

SEQ ID NO: 40866 - DNA, 1473 bp, Glycine max
  Peptide Sequence Number=SeqID_157644
atgggagagttggaattgaagtttttctctgacaatgaggcaatctatatcaaaatgttttgtgtgtccctgaaagctaccattgaagctcacaatagtggatccaaacattggtattctgcatcagaagaagagcgtgagggaggtgccaagaaagatgcagaatctagtgatggatcagtgaatgatgggatagagtcactaaaggccttcaattggaaagaggaatttgtggaaaagaataagcctcgaggatttggtctgtctgagtatgaaaaaatgtgctcatggtcatggaagactacattacgaggagtaggagccgctttttggttgcgacttgggaggaagaagaagaagaagatgtctgcaactgcaagtgcaactttgctaggcatgccggggccatgggcttacgattatcacgagccatctgatccctatacaactaaaattggaggactccctgactggccccttcccataaacaccgatttgcttcgctgcgccgagtgcaccggccaactatgtctggtggcgcaggtttacgctcccctttctcaccaccggactctcttcgttctcggttgcgtctcgcccaattgcggaaccgcttggcgcgttcttcgacttcagaacgttgctgacgtggacacctctcagcaaaaacacgccgcgtccgttgctgaagttccaattgccaccgtgtcggacgacgacgacgacgacgacgcaattgacatggatttcgaacaactcggtaaggcactcttcgaagccgggacgctcgcttccaacaccaagcgcaagaaaccgcggaagaaatgccagaacaagctcccttcgtcttctccacatccaaaaacaacaacaactatagttcaaaatgacgtgcctgtggtgccatgcttttatatatatgcacaggaagagcagtctttgggggatattagttctgtatgttctagttactcgtccctttctattaaagggaatggaagtgacgtggaggatcccgatccttcacaggctgaagaaacctgggaaaaggaacaatatgaatacgataaagctttgaatgccgataggacgtacctcaagttcaagaaacgattggacgcgtatcctgagcaatgttttagatattcatatggtgggagaccaattttagctgcagctgataaaataaaccccggcagttgcagtctctgtggcagaccaatgcaatttgagatgcagctgatgcctccattactatactttcttcaggaagcacttggtgaccagagaaagatggtggaaaaatgggattggatgacccttattgtatatacttgctcagagagttgctgtgaagggattgaacaagcaaagtccaataacaagggctggattatagcagaggaggcagttgtagctcaatgtgaggaacccttggccgttcagcttggtgttgaggaagctatagcttaa

SEQ ID NO: 40867 - DNA, 165 bp, Glycine max
  Peptide Sequence Number=SeqID_157645
atggaagaaaacgaactgcatttctgtgttttttctggaaaacacgatgaactcgctaagcgagcatatgaactcgctatgcgcacctaccgtgctaagcgagttcatcttgtgaggatgaacactcatcctcctgttgagatacatgtggctaagcgaggctga

SEQ ID NO: 40868 - DNA, 471 bp, Glycine max
  Peptide Sequence Number=SeqID_157646
atggattactattttggaaaccctaatcctaaaccttatgataaccgtcactctgccgtagtgaacacggaatctccttcctccgagttcatgctatctgattatctcgtgttggaagatgctgtcgataatcaagagtcttggtcacaaagcactgaaactgaatcatcggagaaaggaaactccagcgatgtcagtcatggaaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaagattaaacaaatcaatgtctagacatgattatgaatggagggggaaatccgggaatcatgtcaaccatgcactgttaaataggataggatattgggcccgatatgtgatacctagctag

SEQ ID NO: 40869 - DNA, 183 bp, Glycine max
  Peptide Sequence Number=SeqID_157647
atgaaggaaaccattaggtccttccaagaatggactcgggaagattccagcaaaagcatgatctccgtttccttcaatggccctgagcttttcctctatttgatccaatttccctttttcgccatagcaggagggactctccccgtcgcaaaatgcaagggttgtggttgtgggcgacattga

SEQ ID NO: 40870 - DNA, 710 bp, Glycine max
  Peptide Sequence Number=SeqID_157648
atggcaacccctgcgcccgcgaaacgcggcaaaaaaccccgtacggctccggtggccagtgcccctgccggcggccaggtacaatctctgacgcgcggtctgcgtttgctggagctgattgccgaatcacacggtagcgtggcgctgaccgagctggcgcaacaggccgggcttcccaactccaccactcatcgcctgctgactaccatgcagcagcagggatttgtgcatcaggtgggcgacctcggtttatggaccattggcgctcatgcctttgtggtcggcagcagttttctgcagagccgcaatctgctggcgattgtgcacccgattctgcgccggctgatggaagaagccggcgaaaccgtgaatctggcggtgctggatctcagtgattatcaggcggtgattattgaccaggtacagtgcacccagctgatgcgcatgtcagcgccgattggcggcaagttgccgatgcatgcgtccggtgccggcaaagcgtttctcgctcaccttagcgatgatcaggtcaccactctgctgcatcagaagggattacatcactacacgccgaaaaccctgatgtcgccgcatagcctgaaggagaatctggcgctgatccgtaagatgggtttttcgcacgacgacgaagagcacgcgctcggcctgcgctgtgtggcggcaccgatttatgatgaacacggcgaacc

SEQ ID NO: 40871 - DNA, 411 bp, Glycine max
  Peptide Sequence Number=SeqID_157649
atggaaaccattttcgtttttaatggtatgaatgcaaacgctggcttactggtcggatctgctggtcgttttgccgccggtggccgcaaacgggtgacttttgctcatttgaaagttgtgccagattttcgcggcagccgcttcgctgactggccgtgcgatgtgaaaggcaataatgacctgctggtgctgagtaagccggacgtcattcgcgaaatccacgatgcttacctggcggctggcgcggatattctcgaaaccaacaccttcaacgccaccccgattgccatggccgactatgaaatggccgcgctgtcggcggagatcaacttcgaagcggcgaaactggcgcgcgcctgcgccgacgcgtggacggcaaaaacgcccgatcgcccgcgctacgttgctggc

SEQ ID NO: 40872 - DNA, 1110 bp, Glycine max
  Peptide Sequence Number=SeqID_157650
atgacgtcaacttcaatcactaccttttccatctactcccaatcccaaccaaagttcctcaatttgcttcaacacccactcattcacacccgcaccaaacgcacatcaatttcgtttcagccaccgatagttcgcgccacccttttctctacattcacttcttcccacaccccttccacaccctcctcaaatttcccatctggaagggctttatccaagttcctctcagaaaaggttgcatttttcctcattgggtcgtttctcttatcgggttgcttcagcaaaagatctgccttcgcagaagcagctccttccgtgggttctggcgcagtgttggagcagaatatgaatcccactgaagagaaaaacgaggaagagaaaagtgaggaagaggtggaggaaatgtgggagagcattttggagaaggatccgaaaaatgttgaggctctgaaggtggttttgtatgggaagattaggaaagggaagtcgaaggaggctgtgaagtttgtggaggatttgattgctgcggagccgaatgaggttgagtggaggctcttgctggcactttgttatgagactatggggcaattgagcaaggctaaaaaattgttcagggaaatcttgaagaagaggcctcttctagttagagctttgcattgtgttggtattattatttgtactatttctgcagaaaagggtttggctatggcgatgcacaaaaatcatgaaggccctgctgtatttgaaatgctaaataatgctcaagagttagcttctcgtgaaaatagagttactgaggagagaaatataagaatcttaattgcacaaatgcatgttgtccagggtaatttggaggagggcttaaaaagatttcaagaattgattgatcaaaatcctcgagattttaggccttatatttgccagggtataatatacagtctcctgggtaaaaatgaggaagcagcacaacagtttgaaacatatcaaactcttgtacctgaagaatttcctcagagaggatttcttgatgatgttgccatagcagcaaaaagaacatccctggaacagtttaagaaggaatttagggatcaattttcttatcggaaataa

SEQ ID NO: 40873 - DNA, 474 bp, Glycine max
  Peptide Sequence Number=SeqID_157651
atggcacacaagaaaggaactcctcttcaccccggagcgatggatatttatctgttttctctaactgatgagaacttgaagagcattgagcctggcaactttgagcgtcattgggaaatttttcgctacgacggaaggccaaagtttcccattgatttttctggccagggacaggacaaatggccagtggcagccaaaggtgtcgtgtaccaagaacgatttggttgttcttgtgaaaaattggaccttgctggcaatgcttcatttgctttcaaccagtattttcagacaagggaccaaagtgttgaggcgtgtgatttcaatggaatggcaactattgtgaaacaggatccatccaagggaagttgcttgttccctatagaaattcagagcagtggtgaaatgctcagagcaatgtgtacaattggaagcctttttattggattgccattgtttttcataacatttacgtag

SEQ ID NO: 40874 - DNA, 129 bp, Glycine max
  Peptide Sequence Number=SeqID_157652
atgattgttgtcatcaccaccgttgacggtagtcatgttgatggtgacaacgatggttataacgatgatcaccgtgatgatggggcagcgatcacagttgtagacttgatgtacgccgatcatcactag

SEQ ID NO: 40875 - DNA, 1215 bp, Glycine max
  Peptide Sequence Number=SeqID_157653
atggctgattttttcgtctttgatattgctgaaacattgctagagaagcttgcttcttatgtttctgaagaagcttctcgagcctatgatgtgtacgaggatcttcaagggatcaaagacaccttgtcaattgtgaaaggcgtgctgttggatgcagaagagaagaaggagcagaagcacgggttgcgcgaatggctcaggcagattcaaaatgtctgctttgatgctgaagacgtattggatggatttgagtgccataacttgagaaagcaagttgtcaaagcatcaggcagcaccgggatgaaggtaggccacttcttttcttcgtccaattctcttgttttccgtcttaggatggctcgtcaaatcaaacatgttaggtgtagattggataagatagcagctgatgggaacaagtttggtctagagaggatttctgttgaccacagacttgtgcaaaggagagaaatgacttattcacatattgatgcttcaggagtgatgggaagggacaatgatagggaagaaattatcaagcttttgatgcaacctcaccctcatggggatggtgatggagataaaagtgtgtgtgttattcccatagtgggtattggaggcttggggaagactacacttgcaaggttggtgttcaatgataagaggatggatgaacttttccaattaaagatgtgggtgtgtgtctctgatgactttgacattaggcagataattattaaaatcatcaactgtgcttcagcttctacctcagctccatcaattgctcttgctcaccatgaaagcattaacaacttagatattgagcagctacaaagtcagcttagacacaagctttctggtctgacgtatttactggtcttggatgacatatggaatgatgatcgtgcaaaatggatagaattaaatgatttaataaaagttggtgcagtgggaagcaaaattttagtgacaacacggagtgactcaattgcttcaatggtgggcactgtaccctcttatgttttagaaggtctgtctgtggagaattgtttgtctctgtttgttaaatgggcattcaaggaaggtgaagaaaaaaaatacccaaatctagtggatataggaaaagaaatggtgaaaaaatgccaaggggttccactagctgttcgaactttaggaagttctctgttcttgaattttgatttagaaagatgggaattt

SEQ ID NO: 40876 - DNA, 639 bp, Glycine max
  Peptide Sequence Number=SeqID_157654
atgaaccagcagagcaaaagaaagcatgcattagaacaagctcaagcccttggaattaaagttcaagaggcagaaacaagggttttctccaacacctccgatcctactcctcaaacattaacctggctttggagaattctgcatggaatgatgagaatcagctccaggacacatatcttaacagaaagtcttttggattttgattatcatgcccctgtggatgtcacattccaaaaccctgattcatctgaaatttccctcaccgatgtcagccattatttagactcagacccgtctaatctggttcaaaatccaaggaaagatgggaagaagcatagtccatacattgctgatacaaccacagccaatgctcaggtatgtacacttgctcagacagttagatttgatgcaagaaccatgctgttgaaccgaaagtggtatgaagaggcatgttgtctagtggatatgagggtgctcacgagattaagaagagaacaaatacagtggaggtgtagtgcaactttaggccaagttgacaagtgggtgtatgaagaagccaacacaaatttcattcatgatatgcaaatgttgaacaagcccattaacacaaatccaaactttttcaggaagctagtgtag

SEQ ID NO: 40877 - DNA, 1029 bp, Glycine max
  Peptide Sequence Number=SeqID_157655
atggaggattacaggtcctctaatgaagccagtcattatgcagtaagacaagggttattgtattggaaagacagattagtcattccagtggaagaagagatggttcaaagaattttgcaagagtaccatagttcacccattggtggccatgcggggattacaagaacactagcaagattgaaggctcaattttactggcctaagatgcaggaacatgtcaaagagtatgtacaaaattgtgtgatttgtcaacaagcaaaagtgagtaacacactgccctcaggactcctgcagcctttgcccattccccagcaagtttgggaaaatgtagctatggattttatcacaggtttgcctagtgttaatggtttttctgtcattatggtggtagtggatagactcactaaatatgctcacttcctacctctaaaagctgattacagtagtaagtcagttgctgaaactttcatgaacaatatagtgaagctgcacggcattccaaaatccatcgtgtctgatagagatagagttttcactagttctttttggcagaatttattcaaattacaaggcactacactagctatgtcatcagcatatcacccacaaacagatgggcaatctgaaattctgaacaaatgcctggagatgtatcttaggtgttttacttatgagaatcccaaaggatgggtcaaagctctaccatggtcagaattctggtataacactgcattccacactagcttgggattgactccattcaaagcattatatggaagagagcctcctacacttaccagacagccttgtactactttagatccggtggagttaagagaacaattgatcaacagagataacttgttagctaagctcaagaacaatctggccagagcacaacaagtcatgaagacgcaagctgacaagaagagacaagaagtatctatgaagggtggaacaaagaaggagaaggaatggaacacttgtagcatgaccctattcctagttccttgcacccgtctcatttga

SEQ ID NO: 40878 - DNA, 279 bp, Glycine max
  Peptide Sequence Number=SeqID_157656
atggccgaatattttctctttgatattgctgaatcactgttagggaagcttgcatcttacgtttatgatgaagcttctcgagcatatgatctgtgtgaggatgtgcaaggcatcaaagacactttgtcaattgtgaaaggtgtgctgttggatgctgaggagaagaaggagcagaagcatgggttgcgtgaatggctcaggcagattcaaaacgtatgcctagatgctgaagatgttttggatggatttgagtgccacaatctaacatcccatttttaa

SEQ ID NO: 40879 - DNA, 2646 bp, Glycine max
  Peptide Sequence Number=SeqID_157657
atggctgaatcatttgtgttccatattgctgaatcactgttgcagaagcttgcttcttatgtttctgaagaagcttctcgagcctatgatgtgtacgaggatcttcaagtgattaaaggcaccttgtcaattgtgaaaggtgtgctgttggatgcagaagagaagaaggagcagaagcacgggttgcgcgaatggctcatgcagattcaaaacgtctgctttgatgctgaagacgtattggatggatttgagtgccaaaacttgagaaagcaagttgtcaaagcatcaggcagcacaaggatgaaggtaggccacttcttttcttcgtccaattctcttgttttccgtcttagcatggctcgtcaaatcaaacatgttaggtgtagattggataagatagcagctgatgggaacaagtttggtctagagaggatttctgttgaccacagacttgtgcaaagaagagaaatgacttattcacatattgatgcttcaggagtgattggaagggataatgatagggaagaaattatcaagcttttgatgcaacctcaccctcatggggatggtgatggagataaaagtgtgtgtgttattcccatagtgggtcttggaggcatggggaagactacacttgcaaagttggtgttcaatgataagaggattgatgaacttttccaattaaagatgtgggtgtgtgtctctgatgactttgacattaggcagataattattaaaatcatcaactgtgcttcagcttctacctcagctccatcaattgctcttgctcaccatgaaagcattaacaacttagatattgagcagctacaaagtcagcttagacacaagctttctggtctgacgtatttactggtcttggatgacatatggaatgatgatcgtgcaaaatggatagaattaaatgatttaataaaagttggtgcagtgggaagcaaaattttagtgacaacacggagtgactcaattgcttcaatggtgggcactgtaccctcttatgttttagaaggtctgtctgtggagaattgtttgtctctgtttgttaaatgggcattcaaggaaggtgaagaaaaaaaatacccaaatctagtggatataggaaaagaaatggtgaaaaaatgccaaggggttccactagctgttcgaactttaggaagttctctgttcttgaattttgatttagaaagatgggaatttgtaagagaccatgagatctggaacttaaaccaaaagaaagatgacattttacctgcccttaagttgagctatgatcaaatgccatcttatttgaggcagtgttttgcttatttttccctctttcccaaggattttggccacattggttctcattttgtgagtctttggggatcatttggattacttcgatctccctctggaagtcaaaaggtggagaatattgcaagacaatatatagccgagttacattcaagatcatttctcgaggattttgtggactttggccatgtttactatttcaaagtacatgatttggtacatgatcttgcgtcatatgttgccaaagaggagtttctagtggtagactcccgtactcgcaatatacccaagcaagtaaggcatttatcggttgttgaaaatgattcactaagccatgctttattccccaagtccagaagtgtaagaactatatattttcccatgttcggagtgggtcttgacagtgaagctcttatggatacatggatagcaagatacaaatacttaagggttttacatttaagtgattcctcttttgagactctacccaattcaattgctaaattggagcacttgcgagctctcaatcttgcaaataactgcaaaataaaaagacttcctcattcgatatgcaaactccaaaatttgcaagttttgtcactgagaggatgcatggagcttcaaacattgcctaaaggattagggatgttaatgagccttcgaaaattttatataaccacaaaacaatctattctgtcagaggatgaatttgcaagattgagaaatcttcatactctgagttttgaatattgtgacaatttgaaatttttgttcaaagtggcacaagtcagttctcttgaagttttgatcgttcaatcatgtgggagcctagagtcgttacctcttcatattctccctaagctggagtctctgtttgtaaaacggtgcgagaggctaaatttgtcgttcaacagtgaaagtcctatccaaaaattgaggatgaaattgctgcatcttgagcattttccaaggcaacagatattgcctcaatggattgaaggagccacaaacactttacagacattgtttattgtaaattttcatagtcttgagatgcttcctgagtggctgacaacaatgactcatgttaagatgctccatattgttaactgtcctcggctgttgtatttcccaagtgacatgaatcgcctcagtgccctagaagatttggacatagatggttgtcctgaattgtgtcgaaaatgtcagccactatctggtgagtactggtcctccattgctcacataaaacgcgtttcttttggtgaaaaaaaagaagggaaactgctttttcaaactcaaacatggatccggttggggttgcgcgattag

SEQ ID NO: 40880 - DNA, 1155 bp, Glycine max
  Peptide Sequence Number=SeqID_157658
atggattttggcaacctttactttttcaagatacatgatttggtacatgatcttgcgctatatgttgcgaaaggggagcttctagtggtaaactcccatactcacaacatacctgagcaagtaaggcatttatcaattgttgaaattgattcatttagccatgcattgtttcccaagtccagaagagtgagaactatattgtttccggtcgatggagtgggtgttgacagtgaagctcttttggatacatggatagcaagatacaaatgcctacgggttttagatttaagtgattccacctttgagactcttcctgattcaatatctaagttggagcatctgcgagctctccatgttacaaacaattgcaaaataaaaagactccctcattctgtatgcaaactccaaaatttgcaatttttatcactaagaggatgcatggagcttgaaacattgcctaaaggattagggatgttaatcagccttgaacaattgtatataactacaaaacaatctattctgtcagaggatgaatttgcaagcttgagaaatcttcaatatttgagttttgaatattgtgacaatttaaagtttttattcagaggggtacaaatcccttcccttgaagttttgctcattcaatcgtgtgggaggctagagtccttacctcttcattttctccctaaactagaggtcctgtttgtaatacaatgcgagatgctaaatctgtcgttgaacaatgaaagcccaattcaaagattgaggctaaaacttctgtatctggagcattttccaaggcaacaggcattgcctcattggattcaaggtgctgctgacactttgcaaacgttgtcaattttaaattgtcatagtcttaagatgcttcctgaatggctgacaacaatgactcgtcttaagacgctccatattgttaactgtcctcaactgttgtctcttccaagtgacatgcatcacctcactgcccttgaagtcttgatcatagatggttgtcctgaactgtgtcgaaaatgtcagccacaatctggtgtgtgttggtccttcatcgctcacatcaaatgcgtttgcattggagaaacaaaagggaaacttcattctcaaatgctgtctaggctgcgattgaggttgcgtgattag

SEQ ID NO: 40881 - DNA, 1095 bp, Glycine max
  Peptide Sequence Number=SeqID_157659
atggcccagctggagccggaattgtgggccgaggcccgccggctcgggctgccaatcgtgaccgaattctttggcgctgaaatggcttcagagcttaaatcactgcatcagcagggcctgctgggcccggacaatatcttcaaccactgcacagcactgcctgatgagggctgggaaatcctgcgtgaagccggcgtacgggtgaacgtctgtccgcgctcagattcgcactatggcattgaaagcgggatgtttgccattgaggccgcgcagcgccatggcatcaatcctggcctgagcgtggataacgaaacgtcttacagcacagatatgtttatggaaatgcgcgtggcgttctatctgcagcgagtaatgggtatgcataagcagcactgctgtgattcagggcattctctgacaacgctcccggcagcgcagctgctgaagtcggcaaccgtcgatggtgcgacctgtgctggactacaggataaagtgggtagcctgacgccaggcaaacaggccgacctgatcctgattaacgctgctgatctcaatctctatccgaacgggaatgccttcgggacggtggtgcatgcaactgaacgcagcaacatcgataccgtcatgattggcgggcgcatcgtcaagcagaacggcaaagttctgggcgtggacagcgagcgtcttcgtgctgccatcgatgaatcacgcgaacaccttttcgccgccgccgggtatgagccggacatctttgcggagaaattcctgccgctgacgaccctgaacagtcagctcgcaaaaggactcgggggcgatccggtcaccgccgcgttcttttcctttacggccggggcgttgagcctcgggatttactcgctgctacgtggagggttatttagctctctcgctgctattccttcgcagccagcatggagtctggcgggcggcctgatcggtgcctgtgcgttgttcagctacgtggtgctggcaccgaaaatcggtttttcagccctgctcgggctggcaatcgttgggcagttactctcgtcgcagatgattgaccatttcggtctgctgggtgctgtacggcgaccg

SEQ ID NO: 40882 - DNA, 189 bp, Glycine max
  Peptide Sequence Number=SeqID_157660
atggcagaagaaagcgagggaccgatagaggaaagggagatcatacctgtttggctctctgtcgtccccaatacgtccccccgacggccagctgtacccaagaaattgacgtcattcccgggacgttcccttgccaccctgttccgtccccatcctcatgcagtaccggaaacaggggacaccacctag

SEQ ID NO: 40883 - DNA, 372 bp, Glycine max
  Peptide Sequence Number=SeqID_157661
atgctccaaccatatgagatcagcataggcttaaaggagcactcaaacccggtgacccccaaggcctacactccgaagagtccgtcagggcctctccctcctgattcagacagctctggatttctgcgggaaagaaaaaggctacaatgcgaagggtttttctctcatttcagacatgatatcgaaattcccaacggtgagaatgctcggaattgtgttgcgaacatgatactcaaatttcacgacgatccaacggtgaacggattcgagatcgttgtttttctgagactggtttggtgggctgcgggaaaaagaaagggttttgagaggagaaggggaaaaacgaaaatgaggccaaaaggaggcagctga

SEQ ID NO: 40884 - DNA, 1209 bp, Glycine max
  Peptide Sequence Number=SeqID_157662
atggccgaatcttttgtctttgatattgctgaatcactgctggggaaacttgcttcttatgcttatgaagaggcttctcgagcctacggtgtgtatgaggatctgaaggggatcaaagacacattgtcaattgtgaaaggggtgctgttggatgctgaggagaagaaggagcacaagcatgggttgcgcgaatggctcaggcagattcaaaatgtttgcttcgatgctgaagatgtgttggatgaatttgagtgccaaggctcgcaaaagcaagttgttaaagcttcaggcagcgtcagggtgaaggtaggccacttcttttcttcatctaattcgcttgttttccgtcttaggatggctcatcaaattaaagatgttagggaaagattagataagatagcagcagatgggaataagtttggtcttgagaagattgaggttgacctcaggcttgtgcaaaggagagaaatgacttattcccatgtggatgcttcagatgtgattggaagggagactgataaggaagaaattatcaagctcttgatgcaaccccaccctgatggtgatgggtatggtgatagaagtctgtgtgttattcccatagtgggtattggagggttggggaagaccacacttgcaaagttggtgttcaatgataagaggatggatgaacttttccaattgaagatgtgggtttgtatctctgatgaatttgacattaggcagattattattaaaatcatcaattctgcttcagcttcagctccaaatattgctcttgcttaccaagaaaacatcaacagcttagatattgagcagcttcaaactcgtcttagacacaagctttctcttcagaaatttttactggtcttggatgatatatggaatgatgattatacaaaatggattgacttgaaaaatttaataaaagttggtgcagtgggaagcaaaatcatagtgacaacgcgaagtaactccattgcttcaatgatgggcactattccctcttatgttttagagggcctttctccagagaattgtatatcgctgtttgtgagatgggcatttaaggaaggtcaagagaaggaatatccaaatctaatggagatcggaaaggaaattgtgaaaaaatgcaaaggggttcctttggcagtgagaagcttgggaagttctctgttctcaacttctgatttagataagtgggaattt

SEQ ID NO: 40885 - DNA, 239 bp, Glycine max
  Peptide Sequence Number=SeqID_157663
atgtgtgtttttaattgcttgaaggagcacaacataatagggaaaggaggtgccgacattctgtacaaaggcgtaattttgaatagagatcaggttgccatgaaaaggttacttgctttgagcaaaggatctttccttatcatggctttaatgcagagattcagactttgggaaggattcaacatggacacattgttagagcgtcgggtttctgttcaaaccgggagagaaatctcttg

SEQ ID NO: 40886 - DNA, 300 bp, Glycine max
  Peptide Sequence Number=SeqID_157664
atggggacacaaaagtctaatatgtttgatgcacctttcaaatacatggtgcctgaagataaggaaattcccgacagacctttgccatcacattggactccttctatgcaggcatataacacttctgggtctactccaactccctttttaaatcaacaggcagctggttctcacatgcctctctacatgtgggtaaatcaggtaaacaacacactacttcaatccgatgctttgcatgatccaaggatgctctccagtaaacccacagtagctggggtaatcctaaatctttcatcatag

SEQ ID NO: 40887 - DNA, 996 bp, Glycine max
  Peptide Sequence Number=SeqID_157665
atggtagatgcttgtacacggaatatacctgagcatgtaaggcacatatcaattgttgaaaatggtttacctgaccatgccgtgttccccaaatccagaagtctgagaacaattacttttcccattgaaggagtgggtcttgccagtgaaattattttgaagacatgggtatcaagatacagatacttacgggtcttagatttaagtgattcttcttttgagactcttcctaattcaattgctaaattggggcatttgcgagttctcgacctttccaataatggcaaaatcaaaagacttcctaattctatttgcaaactccagaatttgcaagttttttcagtcagtggatgcatggagcttaaagcattgcctaaaggaatcgggatgttgattaaccttcgagagctgaaaataaccacaaagcaatcttctctgtcacaggatgaatttgcaaacttgagcaatcttcaaaccttgagttttgaatattgtgtcaatttgaaatttttgttggaaaaggcacaactcactcaactcagttcccttcaaatattggttgttagatcatgtgggagcctaatgtccttacccctttatattctccctaaactagacgctctgtttgttgcagactgtgggatgataaatttgtttttgggtgatgaaagcccaatcaaaagatggaggatgaaatttctgcatgtagagaattttccgtggctacaagtacttcctgaatggatcgaaggagctgcggatactttacagacattgatgatttataatttgcctaaacttaagtttcttcctgagtgtttacctagaatgactcatcttaagaggctccatgttgcagaatgtccttcactgctctttcatccaagtcacatccattgcctcactaccctagaagatttgagcgtagatggttgtcctgcatgggactgggagtacatggcaagtcgtagtttacctgacaacaccatgaagtaa

SEQ ID NO: 40888 - DNA, 2199 bp, Glycine max
  Peptide Sequence Number=SeqID_157666
atgatacaaaagtcttggattaagaagatgatgatgattgatgattcctatctaggaaacttgtattggatctttgttggatgggctacgagattgtatgctggcgaatcagattggagtttggacttttctttctttaaagttgtaattgatcttactgatgctggtcatgagcacatacaagatatcattgggttgttgttcaaatacattgagcttctacaacggtccggtgtttgcaaatggattttcgaagagctttctgcggtttgtgagaccaagtttcattatcaggacaaaattcgtcctagtgattatgttgttgatattgcatcaaatatgcagttctatcctgtaaaaggttggttgacaggatcatccttgccttccaaatttagtccaagtgttatccaaatggtactggatcagctttctccagacaatgttcgaatcttttgggagtctaaaaaatttgaagggcttactgataaggtggagccatggtatggaactgcatattcccttgaaaaaatcactggctctgcaattcagggttgggtactttctgctccagatgaaaatatgcatcttccagctcctaacaaattcattccaactgacttgtcacttaaagttgtgcaagaaaaagaaaagtttccagttttattaagcaggtcaacttattcagccttatggtataagccagatacattgttttctacacctaaggcttatgtaaagattgatttcaattgcccatattctggaaactctcctgaggctaaagttttgacacatattttcacagagttattgatggattacttgaatgaatatgttgctaaatacaagtcgaaggagttcttactgaatttctctttttcagcttattatgctcaggttgctggtttatattacagcataagtcacacagatggtggtttcgaggtgactctccgtggttacaatcacaaattaaggattctacttgaaactatagttgaaaagattgcgacatttgaagtgaaaactgacaggttttcagttatcaaggaaatggtaaccaaagaataccagaatttcaagtaccaacaaccttatcaacaggctatgtactattgttctttgatcttacaagatcaaacctggccttggatagaacagctagacgtacttcctgctcttcaagttgaagatcttgctaaatttgtaccagcaatgctctccaggacctttttagagttttatatagcagggaacattgaaagccacgaagcaccgtcaatggttaagcacatagaagatgttctctttaattgttcaaaacctctgtgcaagcctttattctcatctcaacatttggcaaatcgggttgttaaacttgaaagtggcatgaattacttctacccttcagaatgtcttaatcctgaaaatgagaattctgctcttgtgcactatatacaggttggtcgagatgactttaagctgaatgttaaacttcagctttttgcccttgttgcaaagcaaccaacatttcatcagctgcgatcagttgagcagctggggtacattactgtgctcatgcagaggaattattgtggtatacatggactacagtttattatccaatccacagtaaagtctcctggaaacattgagcaaagggtcgaggcatttctccaaatgtttgagaccaaactcctcgagatgacagttgatgaattcaagatatgcctgacttactccttgtgttgtgtgagttttgaattaaattctcactggaagaagtacaaacatagattcaatatgaataataaaggatatctacatgttcacttgatgggaatgtgcacaaatgtgaagctagagaaacacaaaaatttgtgggaagaatcatcattcttctggcaagagattaactatggtactttgaggtttgataggaaagactatgagattgaagcattaaggcagctcactcttcaagaattgatagatttcttcaatgaatatgtcaaagttggtgcacctcgaaagaaaactttaagtgtacgagtacatgggaaccgccattcatctgaatacaaagcagaagtctcagaaccacacttggctaaaatagataatatctgtacttttagaagatcacagtctctttatggttcatttaaaggactttctgggcagatgaaattatag

SEQ ID NO: 40889 - DNA, 552 bp, Glycine max
  Peptide Sequence Number=SeqID_157667
atggcagtggggaaggaagacgtggagatcgtgaaggcgcgcatcgacaagagggattacagaagagtcgtgctccgcaactcgctccaagtgctcctcattagcgatcccgacaccgataagtgtgctgcttccatggacgttggcgtcggttacttcagtgaccctgctggcctcgaaggcctcgcccatttcctcggtattttcgctttatccgactttgactctcttctgtcgcgtatcggtttcgatatgtttaggattttcgtcgttgagcacatgctgttttatgcgagtgaaaaatacccagttgaagatagctactccaagtatattactgagaaatcagaaactcttaaaggggaagatggtggtgagactcatggaggaagcaccaatgcttttacatcttctgaacacaccaactatttttttgatgttaacacagatggctttgaagaggctctggacagattcgctcaattcttcaataaaccattgatgtctgctgatgccactatgagggaaattaaagctgttgactctggttag

SEQ ID NO: 40890 - DNA, 1222 bp, Glycine max
  Peptide Sequence Number=SeqID_157668
atgactgaattagtcctcttcagcatcgcggagtcactcatagcaaagcttgcttctcaagcatatgaagaaacttctcaggtgctgggtttataccaccatctgcaagagtttacacagactctctcattagtcaaggctgtgctgttagatgctgaggaaaagcagcagcagaactatgagttgcaggaatggctgaggcaggtcaaacatgttttctctgatgctgaaaatgtgttggatgaatttgagtgtgaaacactacgaaaggaagtggttcaagctcatggcagcgccacaaccaaggtagctcattttttctcaacttctaatccacttgtttttcgttatagattggctcaacacataaaaaaaatcaagaagagattagacaaggttgcagcagacagacataagtttggtcttgaaacaactgacattgatcgacgtgttgtgcataggagggatatgacatactcctacgttgttgattcggatgtgataggaaggaatcatgataaggaaaatattatacgacttttggtgcagcagaatcctaataataatgacaaaagtctctctgtaatttctattgtggggattccaggcttgggaaagaccacactagcaaagattgtgttcaatgataggaggatacatgagttattccagttgaagatgtgggtttgtgtgtctaatgactttaacattaagcaagtggttattaaaatccttaattctaataaggattctgctcaccaacaaaatttagacatggtagacatggagcaactgcaaagtcaattaagaaacaaacttgccagtaaaaaattcttacttgtcttggatgacgtatggaatgaagatcttgtaaaatgggttgagctgagggatttaatacaagtagatgctacaggaagtaaaattttagtgactacacgcagtcacgtgactgcttccatgatgggtactgttccctcttacattttagaagggctttccttggaggattcgttgtctctgtttgtcaaatgggcatttaaagaagaagagaaaaggaattcctatttggtaaatattgggaaagaaattgtgaaaaaatgcaatggggttcctttggcagtgagaacattaggaagtttactgttttcaaaagataacagagaggaatgggaatttgtgagagataatgaaatttggaattcaatgaaatctgaaagtg

SEQ ID NO: 40891 - DNA, 558 bp, Glycine max
  Peptide Sequence Number=SeqID_157669
atgggcctcctcgatcacttgtgggatgacaccgtcgccggtcctcgcccggagaacggccttggcaagctccgaaagcaccacaccttcgctttccgatctgcctccggcaaggaatcagacagcggaagcgtgaaatcgtacggtgaagatttgccggaggatgcggtgagagtgacgcgaagtatcatgatcgtgaaaccacctggtggtaaccagagtccgagcggatccgctccggcttcccccgccggttctactcctccggtgtctcctttttcgggacgtgcacacagtgtgcttatgcacatccaggttttgaaggtgtcagctagcgacataaccttaagggttttattagaaagtttcatgacatcttatttaaaacaaaagcagctagatattgaagtggaagtttctatagaagatgctgttgatgaagtaatatatgagctagagagtccttccgttttcggagaaggtcgacatcagatgcgtacgagaagacaggccagaacagaccaagctcttcttctcctttcgatgtgtgacaaatga

SEQ ID NO: 40892 - DNA, 146 bp, Glycine max
  Peptide Sequence Number=SeqID_157670
caaaggtcaaagcggagaacagggaaagagaggaataccttgacctgcgccgaaagagcacggcagagtgtgaagaaacgaggggcggtgaagtgcggtgtggtaggaaattagggtttggatttggctctcattttatacgctaa

SEQ ID NO: 40893 - DNA, 204 bp, Glycine max
  Peptide Sequence Number=SeqID_157671
atgtgtgcgagtcaacgggcgagtaaacccgtaaggcgcaaggaagctgattggtgggatccccctaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 40894 - DNA, 270 bp, Glycine max
  Peptide Sequence Number=SeqID_157672
atgccaggagctgatcacaagcaacccaatcacaagggtggtgagacttcaagttcaaccgagagcaatggtggcagtcaaaatgtccgtttgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcaggttcctggaattgctccttatag

SEQ ID NO: 40895 - DNA, 615 bp, Glycine max
  Peptide Sequence Number=SeqID_157673
ataaccacaaagctacgtgttttgccagaggatgagattgcaaacttgagttctcttcggattctcagaatcgaattttgcaacaatgtggaatctttgtttgaagggattaaactccctactcttaaagtattgtgtattgccaattgccagagtctaaagtcgttgccacttgatattgaacattttcctgaattagagactttgttagttgacaactgtgatgtgttggaattttccaaggagcataacaaccaaaattccaacttgaggctgaagattgtaaatttcatttcattgccacagttggtgaccttgcctcattggcttcaaggatcgaaggacacattgcaatacttgttaatttcaagctgcaacaatcttgtggggcttcctgaatggctatcagctatgacttgtctgaaaacactgtgtgtcacaagttgtcctaacatgttgtctctcccggatggcatccatcgcctaaccacccttgaacgattggaaattgatggatatcctgaatcgctccaacacttaaccattgatgaaccggaagaagtcaaggaagagaatggagcagggaattcagataggacacctccaactaggtga

SEQ ID NO: 40896 - DNA, 431 bp, Glycine max
  Peptide Sequence Number=SeqID_157674
atggatccaatctcaatcaaactggatgatgacaattactcagcatggaaggctgaagccttaggaaaaatcaaagaaagcagccttgagaagttcatcacaatgaaggactttggaggtcagccacccatgttgagtgaagaatacaaaagctggatagagcaggatcaggttctttatacgtggcttcttgattccttgcatccaaagcttcttcaccgaatcgaaagatgtgaatgtgctttggaattctggaaggttatagaggtcgaaacattggtgctagaaggacggcctagaccactcttgccccttagcctcgactggggtgcttgttccggcaaccgcaaagtcccacatcacttaagagtcgaggtcacggcggacaataccttggatacgggaactctaatgatgtatgtgaatttgag

SEQ ID NO: 40897 - DNA, 192 bp, Glycine max
  Peptide Sequence Number=SeqID_157675
ctagaaattgaagagatacgtcaacaatataaacgtaatttggaagaaactgccatggtccaactgatgcgcatgaatcttgatgcggagtgtccagagactagcaatgaagacatggccatagaggaagagcttggaccagaatccgcagcagcagatatattattgtccctgaagcctggcacctcttag

SEQ ID NO: 40898 - DNA, 303 bp, Glycine max
  Peptide Sequence Number=SeqID_157676
atgccatgcaaaacacagctcatggagaaatcggctatccaaatcaagaatgtgatgtaccagaacataacaggtacaagtacttctgatatagctgttaagttggcttgcagtgaaaactttccatgccaggagatagaggagatgctgccgatgctttatgtaacaatgttgaattgtcttacttgggagacgttaaccctcgttgcaaatcacaaagagagatcacaaaggcatctactactacctccatatggaaaaaaggacacattcatgtgtatggggccaacatgtgatatataa

SEQ ID NO: 40899 - DNA, 351 bp, Glycine max
  Peptide Sequence Number=SeqID_157677
atgagtaaggtttctggtgttatttcccgtcaagttttgcctgcttgtgggcttgtggctctctttgtttattctgccctttcctcagggcaaggtcaagacaacctgtcaagaggtataagaagctcattgctgacatttttccctcgtaaccaggtggaagtgccaaatgatagaagcattggaaaattatgtgattatactgccagaaatcctttatgcatcccaaagaactatcctatctcaaagaagattcaccagcttcagctgctgactgaaaattctaggatcttcttcctatctaaatgcatcaaatgcttgcaaaaggagcagaagtatgcaacacattga

SEQ ID NO: 40900 - DNA, 156 bp, Glycine max
  Peptide Sequence Number=SeqID_157678
atgtcccagtcaggttacatgaattctccaaggaaaagtgagttgtatgcatcagatgaaatatggatggtgtgggaagcaggatggcgagggatgacgatggtgcttgacacatacatgcaatgcatccattgtcggcaaagttacgagcaatag

SEQ ID NO: 40901 - DNA, 573 bp, Glycine max
  Peptide Sequence Number=SeqID_157679
atgggtggcataggggttggagtgggggagacatttttggatctaaaagagaaaggaaaagggtgtgagaatttggtgagtgggaaaaagaggaatttccctagtgcaacgcgatatgtggaggtttgtggatcacatggtggtggtggttgcttgggtgatggtacgatgatgggtttagtggggtgtaaaggtggagttgggtggttgcaatggtggtgtttgggtgcggcaatggtgtttggtgattgggtggaggttaggtgtggtggtcatggagttttaggggagaggaagcttgggagaagaaagaagcgcaagcggagagccaccgccatcgtcggttccacttccgtttcctccgaaaccagtcacactgatggccccaaccagctctacactcacattcatgacgctgctgttgggtgcgagcagattaaagccattgttgacgattttcattttggtgagctaaggcaaagcaagagtgggtgggcgaagaacgtgtggcttgagaggagcgagcactgtctgtctcgtctcttgagaggaaagaccgagagagaggaatga

SEQ ID NO: 40902 - DNA, 879 bp, Glycine max
  Peptide Sequence Number=SeqID_157680
atggggactccggaatttcctcatctcggcaagcattgctctgtttcttattgcaagcagcttgatttcttgcccttcacatgcgatcgctgcaatcaggtatattgtttgttgcatcgaggttatattaaacataagtgcacaaaggccaacaaacaagatgtcacagttgccatatgtcctctctgtgccaaaggagttcgcctcattccagatcaagaccctaacataacatgggacaaccatgttaacgttgattgcgacccatcaaattacgagaaagtcacagagaagagaaaatgccctgcccccggatgcaaagaggtcttggtattctccaacacaatcaagtgcagggactgcctgaaagaccattgcttgaagcaccggttcggccccgatcacaaatgttctggtccccaaaagttggagacaagtttttcattcatgggtcttttgaataggagtagaaaagaggggccaaagcccaatttagcttcaacaacatcatctaagtggagttcaagctttctcaacgtggcctctaatattcgcgcctcagctgaaacgggcatgtcgaaattgagcgatgaaattaaccaagtttggcaggcagctactactagagatgggatggggcagagcagtggcagtggaaatagaaatgatcaccaagtggagcaatgccctcagtgtagatcaaagttttcctctgtgactgctttggtggatcatgtgcaacaggttcatgaaagaaatgggaaccgattaggggttaagaagattgatgcatgtcctaagtgtagtaagggatttctagaccctgtgtcccttgtggagcatgttgagagggatcatggaggtggttctggagcgtag

SEQ ID NO: 40903 - DNA, 306 bp, Glycine max
  Peptide Sequence Number=SeqID_157681
atggggagtgaaatgcaaccctttgtagagacaccaccaaaagtggtggaaccaaaccgttattcacataggtcaattgagacactggtggtggtcatagcagtgatcacaatagttggtgtcattgcaggaatgattgctagattgtgtggtggaaggcactttgggggcaatggggagaatgacatagaaggttgggttgaaaagaagtgtagaagttgcattgatggaggactcccacctccacctcctccacctgaagaaccaaagccagcaccagcaccggaaggggatgcaagtaaatga

SEQ ID NO: 40904 - DNA, 1437 bp, Glycine max
  Peptide Sequence Number=SeqID_157682
atggccctcctcaaacacctcctcctctcattcaccatgatcatcatttcttttgttgcttgttatagcactttgcaagaggacccacctagtagtatatatgttgatcattcaccttctattgacgatggtgggacagtcaagaacttgatcgagcaaagcacaaatgttttgagcttaaacaggtttgacaagcgtaattcgcttaaaaaggttagtgtcaatgattatggagctaaggggaatggtgatactgatgacacagaggctttcaagaaggcttgggatgtagtatgttcttctggggaagcaattcttgtggtgcctcaggcgaattatttgctcaaaccaatcagattctctggcccttgcgaacctaacgttgaagtccagatttctggaacccttgatgcatcagatgatccatcagattacgaagatgacagcaaacactggcttgtatttgacaatattaagaaactatttgtttatggtggtggaaccattgatggaaacggcaacatatggtggaaaaactcatgcaaaaggaacaaaaagcgtccctgcaaggatgccccaacggctctgactttctataattgcgaggacttaacagttgagaatttgagaatagaaaatgctcaacaaatccacgtttcatttcaggactccgtgaatgttcaggtttctggccttaacgtgaccgcaccagaggatagccccaacactgatgggattcatgtcaccaatacgcaaaatattcaaatctcaagctctgtgataggaactggtgatgattgtatatctattgtacatggatctaaagatgtagaagccacagatattacctgtggaccgggccatggtatcagtattggaagcttaggggccggaaaatccaaggaatttgtttcaggaatacgagtgaatagagccaagatttttggaactaaaaatggagttagaattaagacatggcagggaggttcaggaagtgctagcgacatccagtttcagaacattgaaatggacaatgtgaccaaccccataataataaatcagaattactgcgacaagaaaaagaagccatgcaaaaaactgctctcgaagaaatccgcgatccaaatcaagaatgtgttgtaccagaacataacgggcacaagtgcttctgatatagctgtgaggtttgattgcagcgataaatttccatgccaggagatagtgttgcagaacatagacctccaatgtgaaggaggagatgatgccgatgctatgtgtaacaatgttgaattgtcttacttaggacacgttaggcctcgttgcaactcaaaaaagagaaaggcatttactactattacctccatattgaaatacttctcatgttggaagcagggttggttaggtggcgaggaattagaagggaagaggagatgctag

SEQ ID NO: 40905 - DNA, 2664 bp, Glycine max
  Peptide Sequence Number=SeqID_157683
atggaatttgtatgcttgttgtatattctgctagcttggtgtctttcaagttctgaacttgttggtgctgagcttcaggaccaagatatattaaatgccatcaaccaagagcttagagtccctggatggggggatgccaacaactcaaattactgcacttggcaaggtgtcagctgtggtaaccactcaatggtggaaggcttggatctgtctcaccggaatcttcgaggtaatgtaactctaatgtctgagctcaaagctttgaagcggcttgatctttcgaataataactttgatggatcaattcctcctgcttttggaaatttatctgatcttgaagttctagatttgtcttcaaataagttccagggttcaattccacctcagttgggtggtctcacaaacctcaaatcattgaacctttccaataatgtgcttgtgggagagattccaattgaacttcagggcttagagaaattgcaggattttcaaatttctagtaatcatttgagtggtcttgtaccttcttgggtgggaaatttaaccaatctgaggcttttcactgcttatgagaaccgtttagatggcaggattccagatgatctaggcttgatttccgatcttcaaatacttaacctgcactctaaccagcttgaaggtccaataccagcaagcatttttgtgccagggaagttggaagttctggttctcacccagaataattttagtggtgagcttcctaaggaaattgggaattgcaaagccctttccagcattcgaattggaaacaaccatctagtaggtaccattccaaagaccattggaaatcttagtagtctaacttactttgaagccgataataataatctttccggtgaggttgtgtctgaatttgctcagtgttctaatctgactctcctgaatttggcttcaaatgggtttactggaacaattccacaagactttggacagcttatgaaccttcaggaattaattctttctggaaatagcctatttggtgatattccaacatcgattctgagttgcaaaagtcttaacaagcttgatattagcaacaaccgattcaatgggacaattccaaatgaaatctgcaatatctcccgattgcagtacttgctgttggatcagaatttcattacaggagagatccctcatgaaattggaaattgtgcaaaacttcttgaattacaattgggcagtaatattttgactggaactattcctcctgagattggtcgcattaggaacttgcagatagctttaaatttgagcttcaatcatcttcatggatcactgccccctgaattaggaaagctggacaaacttgtttctctggatgtttcaaacaatcggctatcgggtaatatcccacctgagcttaagggaatgttgagcttgatagaggtgaacttctcaaataatctgttcggaggtcctgtgccaacatttgtaccatttcagaagagtcctagttcaagttatttgggcaataaagggctttgtggagagcctttgaactcttcatgtggagacctttatgatgatcacaaggcttaccatcacagggtttcttacagaatcatactggctgtaattggttctggtttggctgtttttatgtcagtaaccatagtggtcttgctgtttatgatcagggagaggcaagaaaaagtagccaaagatgctgggattgttgaagatggttccaatgacaacccaactataattgcagggactgtttttgttgataatctaaaacaagcagtagaccttgataccgtcattaaagcaacgctgaaagacagcaacaagctcagcagtggaactttcagcactgtttacaaggcagtcatgccttctggggtggtcttatctgttaggagactgaagtctgtagacaagacaataatccaccaccagaacaagatgattagagaacttgaaagactgagcaaagtttgccatgataatctagtgcgtcccattggctatgtcatttatgaagatgttgctcttctcttgcatcattattttccaaatggaacattagctcagcttcttcatgaatctaccaggaaacctgaatatcagcctgactggccatctaggttatccattgccattggtgtggcagaaggtttggctttccttcatcatgtggcaatcattcatcttgatatctcttctggcaatgttctcttggatgcaaattccaagccgttggttgcggagattgagatttcaaaacttcttgatccaaccaaaggcactgcaagtattagtgcagttgctggttcctttggttacataccaccagaatatgcatatactatgcaagtcacagcaccaggaaatgtttatagctatggtgttgttctgctggaaatccttacaactagactaccagttgatgaggattttggtgaaggtgtagatttggtgaaatgggttcatagtgctccagtaagaggggatactcccgagcagatattggatgctaagcttagcacagtttcctttggttggaggaaagaaatgcttgctgctttgaaggtcgcgatgctgtgcactgacaacacaccagccaaacgaccaaaaatgaagaatgtagtggaaatgcttcgagagataacacaaaattga

SEQ ID NO: 40906 - DNA, 2955 bp, Glycine max
  Peptide Sequence Number=SeqID_157684
atggcgaccaagtttttagctttagcttgtttacgtaacaatgaggggtcggggtacctatcgccacgacctcactacccgtcgatgccgaaatatccaaagggagtgacagaagaagaaggaagcagtaacgtatcgtccaaggcacttttctccgtcgtcggaatgacttgctccgcctgtgctgcctccgtcgagaaagccgtcaagcgtcttcccggaattcgccaagccgtcgttgatgttctcaacaaccgtgcccaagtcctcttctatccatcctttgttaacgaagagaccattcgtgaggtcattgaagatgctggattccaagccacattcatcagagatgataacgagacatctgttcagatatgccgcatacgtatccaaggcatgacatgcacgtcgtgttcctccaccgtcgaatccgctctacaatcaatccaaggagtggtgaaagcccaagtggctcttgcaactgaggaagctgaagttcactacactccaaacgttgttacctacaaccaaatcttggaagctgttgaagacacgggctttcaggccacgcttataagcacaggcgaagacatgagcagaatagacattcaagttgaaggcataagaactggtcgttccatgagactcattgaaaattctcttcaggccctccctggggtccaaggtgtagaaacacaccctgagttcaacaaagtatctctttcttataaaccagacttgacaggaccgagaaatttcatcaatgtgatcgaagaaacgggatctaggcgtttcaaggctaagattttccctgaagaaggaggaagaaggaatagtcataggagggaggaaataaggcaatactatagatctttcttgtggagtttggtgcttactattcctgtgtttctaacctctatggtgcttatgtatatccctggaattaagcatggagtagatgctaaagttgtgaacatgcttacagtgggcgagattataagatgggtgcttgctacaccagtgcagttcattatagggaagaggttttactctggtgcttacaaagcattacgccttggctctcccaacatggatgttttgattgccttggggacaaatgcagcatacttttactcagtgtattctgtgctgagagctgctacatctcagggtttcaagggtactgatttctttgagactagtgctatgcttatttcgtttattttgctagggaagtaccttgaggttttggccaagggcaagacgtccaatgcaattgccaagctcatgaacttgacacctgacactgctatactgttgaccctggacagtgaaggaaatgttgttggtgaagaggaaattgatagcaggctgattcagaagaatgatgtgattaaagttattcctggtgcaaaggtggctgcggatggatttgttatttggggtcagagccacgtgaatgagagcatgattacaggtgaggcacgtcctgtggctaagaggaaaggtgaaactgttattggaggaactgtgaatgagaatggagtgttgcatgttaaggctacctgggttggatcagagagtgctctttctcagattgttagacttgttgagtcagcacagatggccaaggctcctgtgcagaagtttgctgaccgcatttctaaatactttgtgcctctggttattttaatctcattttcaacttggcttgcatggtttttagctggaagatttcatgcttaccccaagtcttggataccatcttccatggatagctttcagcttgctttgcagtttgggatttctgtcatggtcatagcttgtccatgtgctttaggtttagcaacgccaactgctgttatggttggcactggagtaggtgcatctcagggaatacttatcaaaggaggtcaagcattagaaaatacacataaggtgaactgtgttgtatttgacaaaacaggtactctcacaatcgggaagcctgtggtagtaaatacaaagttgttgacaaatatggtactccgggaattctatgaacttgtggctgcagctgaggtgaatagtgagcatccactggctaaggccatagttgagtatgccaaaaaactgagagatgatgagaaccccatttggccagaggcacgggattttgtgtccattgctggacatggagttaaggccatggttagaaacaaggaaatacttgtgggtaacaagagcttgatggaagaccacaatgttgcacttcccatcgatgctgaagagatgcttgcagaagcagaagcaatggctcaaactggaattatagtgtctattaatagggaagtagttggggttttagcagtatctgatccattgaaaccagctgcacaagaagtcatttccattctcaagtctatgaaaattaggagcatcatggtgactggggacaattggggaactgccaattctatagcaagggaagttggaattgaaacagttattgctgaggccaaaccagatcagaaagcagagaaagtcaaggacttgcaggcttctgggtgcagggtggctatggtgggggatggtatcaatgactcaccagcacttgtggcagcagatgtaggaatggcaattggtgctggtacagacattgctattgaggctgctgatattgtcctaatgaagagcaacttggaggatgtcataactgccattgatctttccagaaaaacgttttctcgtatccgcctcaactacatatgggctttgggctataatctacttggcattccaattgctgctggagctctttttccttctacacaatttcggttgccaccatggattgctggggctgccatggctgcatcttctgtcagtgttgtgtgctgctctctaatgttgaagtattataggagacccaagaagctggacaaccttgagatacgaggcataagcattgagtga

SEQ ID NO: 40907 - DNA, 600 bp, Glycine max
  Peptide Sequence Number=SeqID_157685
atggcagagatgataagggattcaagagtaatggagaaagtacaaatcgaggtgagagaggtattcaatatgaaaggaagggttgacgaaatttgcatcgatgagctgaaatatttaaaatcagttgtcaaagagacactaaggttacacccaccagctccacttttacttccaagagaatgtggacaggcatgtgagattaatgggtatcatataccagtcaaaagtaaggtaattgtgaatgcttgggcaattggaagagatccaaagtactggagtgaagcagagaggttttatccagagagattcattgatagctctattgactacaaagggactaattttgagtacattccatttggtgctggaagaagaatatgccctggcagcacttttggtttgatcaatgttgaggtggcacttgcatttttgttgtatcactttgattggaagcttccaaacggaatgaaaagtgaggacttggacatgactgagcaatttggagtgacagttagaagaaaaaatgacctatacttgataccggtcccttctaatcctttccagcgtatatatccgttgaacagtgtgaattggtcttaa

SEQ ID NO: 40908 - DNA, 396 bp, Glycine max
  Peptide Sequence Number=SeqID_157686
atgattgtgaagatctccccaagttggagatgcatcaagggtccatatattttggccaaatctcttaattttcggtgtggtgtagatgtaacaaaatggtctatgttccctatgataggtatcttccatggtcctggaggtatctttggtgatgagtcagttttcttgagattgctccctattttcagtgccacaaagatgaagagggaaaaggacatgataacggccaacattttaagtacttcagaatccatgatacagaagaggattttggttgccgtttattgctttctactggtttctgctgctgctgttgctcgtagtgtcgatggtggtggtggtggtatcggccatggtggtggtagtagttgtagtggcaaaagagtcatattttaa

SEQ ID NO: 40909 - DNA, 1950 bp, Glycine max
  Peptide Sequence Number=SeqID_157687
atggtaaagatacccgaatccggtgggcttgttagtgcagtttatttttttggcatcaaagtggttgaatccatggattctgattatggtattcccagggaactctcagatcttcaaaagattcggtctttgtaccagccagagctccctccttgtctccagggaaccactgtgagggttgaatttggtgacgcaaccaccactgctgaccccactgatgcactcaccgtctgcagggcttttcctaacacttatggacaccctttggctcactttctcagggccactgccaaagtccctgatgctcagatcataactgagttccctcctattagggtggggattgtcttttgtgggagacaatctcctggagggcataatgtcatttggggtatccacaatgctctcaaaattcacaatcccaacagtgttttgcttggatttcttggtggttcagaaggtctatttgcccagaaaactctggagataactgacgatattctttcgacgtacaaaaatcaaggtggttatgatttgcttgggcggacgaaggatcaaattaggaccacagaacaagttaatgctgcacttgctgcatgcaacaatttgaaacttgatggccttgtcataatcggaggggtgacatcaaacacagatgctgcacagcttgctgaaacatttgttgtagcaaaatgccccacaaaggtggttggtgttcctgtcactctgaatggagatcttaaaaaccagtttgtagaaactaatgttggttttgatacaatttgtaaggttaattctcagctcatcagcaatgtctgcactgatgctctctctgcagagaaggtaattcttggtgaggaggttgctgcatcaaagcttaccctttctgaaattgcaaaacagattactgatgcaattcaggctagagcagagcaagacaaataccatggagtcattctccttccagaagggctgatagagagtattcctgaagtgtatgccctcttgaaggaaattcatggtttactcagacaaggtgttgaagttgacaagatatcttctcagctaacaccatgggcatctgctttatttgaatttctgccaccctttattaggagacagttgctcctttaccctgaatccgacgactcagcacagttatcacagattgaaactgagaaattactagcatatcttgtggaagtcgagattaacaagcgtctgcattgtggattggctttaattgcttttagtgacttgaagaaagaaggcacatacaaggggaagaaattcaatgccatttgccacttttttggttatcaagctcgtggatctctgccatcaaaatttgactgtgattacgcatatgtccttgggcacatctgctaccatatactggccgctggtctaaatggatacatggcaactttaactaacctgaagaatccagtaaacaagtggaaatgtggggctgctccaattgcatctatgatgactgtaaagcgctggtctccaaatccaggagctacatcaattggaaaacctgctattcatccagctactgtggacttgagaggcaaagcatatgagctgttgagacaaaaggcacaaagctttcttatggatgacatctacagaaatccaggtccacttcagtttgatggtcccggcgcagatgccaaggttataactctttctgttgaagaccaggactacatgggccgcattaagaaacttcaggagtaccttgaacaggtcttgccaattaaccttgttattttaacagcactagagtttagggcatatttttcttattcaatggttcgaaccattgtcaagccaggatgccctcaggaggttttgaaagctgctctaagcgtcatggcgtcggttaccgaagttctagctgcaatgtcaacatcttataccaacaccctggcatccctgtga

SEQ ID NO: 40910 - DNA, 2661 bp, Glycine max
  Peptide Sequence Number=SeqID_157688
atggcaaccaaactagtcatcttcatcaggacttttagaaccccttactggtctcttgtcaccatggattcagaagtacttaacttattagcccttatcttgccctttttactcttcgttattgtggcactgaaaataggaagaagaaatctcaagaaatctgagtcaactccaaaaatacccccaggaccatggaagctacctatcatagggaatatactccatcttgttacatctacaccacaccgaaaattaagagacttggccaaaatatatggacccttgatgcatctccaacttggggagctcttcataatcgttgtttcctcagcagagtatgctaaggagataatgaaaacccatgatgtcatctttgcacaaaggcctcatagtcttgcttcagatatattatcctatgaatccacaaatattatttcggcaccttacggacattattggagacagctacgaaaaatatgcactgtggagcttttcactcaaaaacgtgtcaattcattcaagccaataagagaagaggagctcggcaatcttgtcaaaatgattgattcccatggagggtcttcttccatcaacctcactgaagcagtacttctgtcaatatataacatcatttcaagagctgcgtttggcatgaaatgcaaagaccaagaagaattcatatccgtggtaaaagaagccataacaattggagcaggttttcacataggagatttgtttccttctgctaaatggcttcaacttgttagtggtttgaggcctaagcttgatataatacatgaaaaaattgaccggatactaggagacatcatcaatgaacacaaagcagcaaagtcaaaagccagagaaggccaggatgaagcagaggaagatttggtggatgttctcctaaaattcaaggatggtaatgatagaaaccaggacatttgtttaactactaacaatatcaaggctataatcctggacatctttggtgctggaggtgagacatcagcaactaccataaattgggcaatggcagagatgataaagaatccaagagcaatgaataaagcacaacttgaagtaagagaggtattcgacatgaaaggaatggttgatgaaatttgcattgatcaactcaaatatttgaaatcagttgtcaaagagaccctaaggttacacccaccagctcctcttttacttccaagagaatgtggacagacatgtgagattcatgggtatcatatacctggcaaaagtaaggtaattgtaaatgcctggacaattggaagagatccaaactattggactgaagcagagagatttcatccagagagattctttgatagttctattgactacaaagggactaattttgagtacattccatttggtgctggaagaagaatatgccctggcatcacacttggtttgataaatgttgagctgacacttgcatttttgttgtatcactttgattggaagcttccaaatggaatgaaaagtgaggacttggacatgactgagaaatttggagtgactgttagaagaaaagatgacctatacttgatacctgtcacttctcgtccttttctggtcttcacaatcattgtttcctcagcagaatatgctaaggagataatgaaaacccatgatctcatctttgcatcgaggcctcacactctagttgcagatatattggcttatgaatcaacaagtctttctatcaacctcgctgaaatagtagttttatcaatatataatatcatttcaagagccgcttttggcatgaaatcgcaaaaccaagaagaattcatatcagctgtaaaagaattagtaacagttgcagcgggttttaacataggagatctgtttccttctgttaaatggcttcaacgtgttactggcaaaatcaaagccatagaaggcaaggatgaaacagaggaagatttggtagatgttctcctgaaattcctggatgttaatgatagtaaccaggacatttgtttaactattaacaatatgaaggctataatactggacatctttgccgctggaggtgagacagctacaactaccataaattgggtaatggcagagataataagggatccaagagtaatgaagaaagcacaagttgaagtgagagaggtattcaacacgaaaggaagggttgatgaaatttgcatcaatgaactcaaatatttaaaatcagttgtcaaagagaccctaaggttacaccctccagctcctcttttacttcctagagaatgtggacagacatgtgagattgatgggtatcatatacctgtcaaaagtaaggtaattgtgaatgcttgggcaattggaagagatccgaagtactggagtgaagcagagaggttttatccagagagattcattgatagctctattgactacaaagggactaattttgagtacattccatttgttgctggaagaagaatatgcccaggaagcacatttggtttgatcaatgttgagcttgcacttgcatttttgttgtatcactttgattggaagcttccaaatgaaatgaaaagtgaggacttggacatgactgaggaatttggattgactgttacaagaaaagaggacatatacttgatacctgtcacttctcgtccttttagttactaa

SEQ ID NO: 40911 - DNA, 735 bp, Glycine max
  Peptide Sequence Number=SeqID_157689
cggttgttccttatgtttgatttttttcttgccaaactatggcaagaagatcattcttctcgtagtgtgccttttgcagtagctacaggttcccctggtgaggctactgggatagaatttgagtctactggaacttcgagcttccttctcacgaaagcatccaagattccttttcgagataaatttgattcacaagctgctaaatgtgtcttcttaggctactcatcaacaaagaaaggatatcaatggtatcattctgactttggaaaattgtttgttacaagagatgttgaatttgaagaaacaacatcttactataacaagtctgaagatgttttgcacgatgtttttcctttgcctatttcatacaatattcctatagattctgagttaattatctctccaaactctcctgacattgcaattgatacatgcaacaaacccacttgtcctgcctctattgataaagatacagaatctgccaatacacctttaaacacaaaaggagcttcatctgattgttcccaagttgattcatttgattgcactcaaggtgagttagttccaactgagcatgtgactctagagctccaagatgttcatcatcgtcaatatcctgctcgaaaccatgcacatccactaaatttgcaagattttgttattgttaatcatgaaaattgtatctattccttgaaaacaaaagaattttcacaaaatgattctactatttactga

SEQ ID NO: 40912 - DNA, 183 bp, Glycine max
  Peptide Sequence Number=SeqID_157690
atggatattcctctggctttcagagaccaagtacgaagtttacattttagaagctacatacaaggatccggtggttgtgctacaaggaatgtccatgaatttacgcaggaagacatagaaaagatgtctaagcgatgggaaggagcttcatccttgtatctgcagcttgatgtgaaggcttaa

SEQ ID NO: 40913 - DNA, 270 bp, Glycine max
  Peptide Sequence Number=SeqID_157691
atgctacaatgcgaagggttttcctctaagctcagatatgattttgaaattgctaacggtgagaatgttcgaaattgggttgcgaacgtggtacttaaatttcacgataatccaacggtgaacgagtccgagatcgtcgtttttctgagacaggtttggtgggctgcgggaaaaagaaagggtgcgatgatttacttcacgggcgaggtctctggttcaagttcaggatggcccagctgcgtcaaggaaaagaatagaaaactgacttga

SEQ ID NO: 40914 - DNA, 526 bp, Glycine max
  Peptide Sequence Number=SeqID_157692
atgttgtcgcccgaagcgtgccttgggcacttggcgtatctgattatttttttttgccacgctaagtttcccacgctaatcgttgctttactccatgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcag

SEQ ID NO: 40915 - DNA, 1638 bp, Glycine max
  Peptide Sequence Number=SeqID_157693
atggaagctaagcctcttcgaactgttccctcttcacacaacacttctggggtaggaggtggaccccagaagaagattggcatggaacacaagatggaaagtcgtgttgttgatgagaggaagagggttgttatggtcaaggaagagaacagcacttcttctcccaacagtgttgaacttcatctcgggtttgatgcttctcattcgactccacaagaaataaaccatgtgatcactgaagctcagaggcgtgagcttcaccatcaagttttcatcttcaaccatttggcttataatcttcctcctccttatcaccttgtgcaattccctagcaacatgtcagaatacagtttcctgggttttgatcatgggattatggtggatccagaacctcataggtgtagaagaactgatggaaagaaatggaggtgtggtaagaatgtggtgcctaaccagaagtactgtgaaaggcacatgcacagaggtcgaaatcgttcaagaaagcctgtggaaacatctcaagttaactctcctttggcaacaaagccttgtagcaagtcacacaccaaaccatcctcaaagacacaatttgaaatttcaagtccaaaccttatcgccattccacatattgacacatcaagtaccccatcaaggagcctcagtgtcaccaattgctcttctgctaataataggtcgaaaaatagggcaggttatgctgactacctcatgtcgttttcttccgcgtccacagtgtcccctggaaccactcttgccactccagttgcccctaagatagctgccttcagcagtgcgacatccgttgttgcttcagatagcaaaagttgcctaaagatatgccagaaagataaccagtccaagagctgtatcagcaacaacatcggtgttaaaagcggtgggaaaggaagcattgttggtgatactaatactaatggcatctctactggaataagcttctccccaacgagtgttcttcaagaactagagtattacagaatagagacagataccctttcttcccccacactgccagaacaacaaactcaatcctatcaaacctttttccatttagtggggtcagtgatatatgactgtcatgttatgtttcagttgatcatgaatcctgatgttgctcaaacgtttcttaatagtctcacatgttcctaccaatccccacaaatacaaaggggaatcaatagcatcatagcaatttcagtttctggttgcaacccttcatacctgaatgacggaaccaacatagaagctgcatccggtaggtgccggagaacagatggtaagaagtggcagtgcaagagtgctgttcttcctggtcagaaatactgtgccacacacatgcatagaggtgccaaaaagcgtctcacaagccatgaaccagcagctactgctaccagttccgccgttaccgttgcgcggttgccttactcttcagccactaccaacatacagaaagcgcattgtgcaattccaaacacaaatctttccatgtcagtccaagccagggaagcattcatacaatgtaatgagaaaagtcaaagtagcagtgacactgatactactatcagtgacaccttgaatgagtatagctatgcttctttctga

SEQ ID NO: 40916 - DNA, 930 bp, Glycine max
  Peptide Sequence Number=SeqID_157694
atggtggaaaatagacttaggtggtttgggcatgtagagagaagaccggtagactctgtagtgaggagagtagaccagatggggagaagacaaacaattcgaggcagaggaagacccaaaaagactataagagaggttatcaaaaaggatctcgaacttaatgatttggatagaagtatggtacttgatagaacattatggcggaagttgatccatgtagccgaccccacctaccgtatctccaaagcacaagatactgaagatgactctgttgactatatggaaaaaaattggtcagggaaccttcatacggcggataggtctgaaaggaatgcagctttggtttcacctttgctagccacatatactcagagaaagaacaagtctgttcgttttgaaagtgaaactgacttggcaacctatggaagctcatcagatgattggcatatgaaggaaaacaagtcaccaaatagccaaagtgcatataaaccatctccttatcctaccccgttgaagttatttgacgagatgcaaacaccaggaactgtgtaccctgcatcattggaagagttacgtacgggtaaggctcaagttcggtcccagtttgtctatccaactaacaaaccaggtgataatgtcttctggtgcaaaatactcgaggagagagattttaaccttgaagaagattcaagtgagctgagtgatttggttgagaaagctcaaaatgaaactcctaccccagaaaaagggtccaagaaattttcaaaagaaaatgacgatgaggtcaaatcaaatttgtctgctagaataagtcctgtgtcaaccatcaaggagcattcgcctatgccatttaagtggtggtatgacaatggcatcccgaattcaacaactaagtacaaggagcatctgattagtgctcattgtccctag

SEQ ID NO: 40917 - DNA, 416 bp, Glycine max
  Peptide Sequence Number=SeqID_157695
atgtcgagacatggtactaaaggagaaagggagttgctacgtgcacccagcattattgctggggaacccagcaaacatgttgccggaaaacacttccggaagaccttattccagaagttactgaggcctattccggaagaagtggttccggaagtgtctttcggaagaacttcttccggaatgggcctcagtaacttccggaagaacgtcttccagaagtttctgaggcctattccggaagaagttcttccgaaagacacttccggaaccacttcttccggaataggcctcagtaacttctggaagaaggtcttccggaagttcttccggaaacttccggatgaacttcttccggaacctccggatgacgatcttccggaacctccggatgacgatcttccggacgaagtttgtgg

SEQ ID NO: 40918 - DNA, 255 bp, Glycine max
  Peptide Sequence Number=SeqID_157696
atggattctagccttaccactaaaggggaagggagactgggaaacactgtaggcaaaagcattaagaatgctttagaggtggttgtcgctttgtctactgacaagattcacaaatcacaatggaacactatagtatcatttgattcatttgatgttagtgttagaaacaaatggaatgtggctgtgtttcaagatgctgtattagtattagaatttggatgtttggactgccttgttagttattacattacttga

SEQ ID NO: 40919 - DNA, 484 bp, Glycine max
  Peptide Sequence Number=SeqID_157697
acccttcttccgaaaactttccggaaaatgttcttccggaacttccggaagaacccctaacgggtcttccggaagtctccgccgtcagcctcctttccccatttttttcggcgtcctctcctctcgtcttctaccctaaggttactatcctaaggggagttagggagactaacctcgttcgcggagaagaagaagacgaggttcgcgcttgccttgccggagaagaagaagcagttcgcggagaagggagaacaagcttcgcggaaggaatgagcagcagcagaaaactctacaagtgcaaaaaggagaactttgagggttgttatgaccttatgggagtagagacttcattacagtcccgaaatactcaactgttaaaggatgttactactcttatctccttagatgttgcttatgggaatagcatcctaaagcataataatccaatggtcattaggattgtcatagcaaatgttgatgtcag

SEQ ID NO: 40920 - DNA, 1098 bp, Glycine max
  Peptide Sequence Number=SeqID_157698
acacaaaactcattgctaagggatgacacatgtttcttcattcaaccagacatcactcagtcatacaatgtccatgttgaattccaccctttacctggggaggagctctcatctggggtgcctcaatcctctctcgaattcttgtctaactcggccaagattttgagttctagcaatggcttgattctttgtcgcgccaccggcgagaatgaagtgaagctgttcattaccaacccagcaacacaatcttggttgcctattcccacccctggtgagtataaacaaaatggtacaagtattggtgctgttgatctcaagattgttcttgaatgtgatgacaaagatgattacatggtgtatcttttttatgacaacttagttgattggtcttcttcaaatttggattgcaaagtttatcattccaatgaaggagtgtggaaatcaaagcaagaaagattttttactggcagtaggaaactgaaatttgacatgcctgttcatcacagaggagctgttcacttcatctcagattgttttccttcctggaacaaaaaaagtccttatttcaggccatacattatgtcatacaattttgagagtggaaattcaagaatgctgagagttcctaaagaagcaagaaagggttctcatgacttgacttgtgacatggggattttcaaatggggaaaagccactgatccaaatcaatcaatttgtttggtgaggctgaggaagcatgtgttcaccatatggactttgacacactatgagacaagtgagtggagaagggttttgaagataagagtgaaagcaatggtgaaggatcatcctattataagagtaaagggctatgcagttttgaatggtgatcttttggtctttgccactgagaagaaggtctatggctgtggtttgaaagatatgaggattcaggaaatctgtgatcatgaatttgacttcaatgttcttcgcttcacttcatacaaggacactttgcgcacatttggtactggtgctggaactttgcctctttctctgcacacgtgtggtactagagctggaactttgcctcttccttcacacaagcagttttggtag

SEQ ID NO: 40921 - DNA, 201 bp, Glycine max
  Peptide Sequence Number=SeqID_157699
atgacgaaacccaaaccaaactataccatgaatgtaatagatcaagccaagtcttctaggattttcaaagtctactggaactacttcaggtcaatgacaagagacaggttggcccaaagcaaaggtggaagagagaaatcgtatgtagaaattgtgtcattgaagcaactattaattactttgacgtccatgtggacttga

SEQ ID NO: 40922 - DNA, 1116 bp, Glycine max
  Peptide Sequence Number=SeqID_157700
atggtgaatgcaattgggttaaatgttggaaagaagagaaaaggtagtgaggatgatgggatggcattgaaacgtgttcaaaagaaaaaagagttgcttgtagagactgatggagatgtgttgagtgctaaaaacgatggcaaaggtggtgaggaaaacagcaacattggctcactgcttcagtcaatagagaaaaacataggagcttttgatgaagggaagagtgaagaacggaatgggaagggtaatttgtcaagagaaaggaagagaagcaagtacttgtcccctcctttcactattccaatcagggggcaaagggaggtatacatagaaccagaatcccttaaagtttccagaaaagctaaagtatcacagagaagcgcaggggccgatggcttgagttctcttccaatgtataaggggagaagttccttatatagccagggatcattatgcgaattatacaagaaaaatcaacctggaaggaagagaaagatgctagaatctgaagaagatggaatgttgaaagaactaaatctgtctactgatgaacatttatcatcactgaagcaaaattatgggccaaagaagagaagaaaggaaactgcttccggcaagaaggggaacgaggaaaatgctgcaggattctctatgccttcaagatctgatcttgtctcggtgtttagcaagtttggagctctgaatgaagcagaaactaatatgttccgcactaactacacagctagagtgtccttccttcgaacttctgatgcccagaaggcatataaccattcccaaaacaataacccttttggatctcctgttgatgtaacttttcagcttctgcattcctctgatgtgtgttgttgctcctatagtggatttgttttaactgaagggattattggattgcttttttcacggagtcctgcaacactaagtagtggtgtgctctttgagggtggtttactattcctcaacagctttagcatgaagagtacaaagagaaacatcaacccaattgccaacatggttgggattccaatacctaaatcagtgcaaatggggcaagacaaaatttctgttgacgatactaagagaaataacagtgcatga

SEQ ID NO: 40923 - DNA, 303 bp, Glycine max
  Peptide Sequence Number=SeqID_157701
atggctcacctcgacaaggacctcactctcttggtcttgcagtactttaatgaagaaaatttgaaggaagcagcacgctcgcttgggcatgaaagtggattatactttgacttgaaatattttgaggacatagtgcttgagggaaggtgggatgagactgagaactatctttcagtgttcacaaatgaatcgcatgaagacagtacaagtggaggtttcaatctctcctccgtctctctgacgtttggaaattctatcggagcagtcgaaggaataactgaaggaatctcagggaaccgctag

SEQ ID NO: 40924 - DNA, 357 bp, Glycine max
  Peptide Sequence Number=SeqID_157702
atgagatgcactctggactccatattcaaagttgggtttggaacagaattgaattgcttggatggatcgagcaaagagggtagtgagttcatgaaggcctttgatgagtcaaatgctttgatttattggcgctatgttgatcctttctggaagctcaagaggtttcttaacattggttgtgaagctacccttaagagaaacgtgaaaataatagatgattttgtccatggagtaattaagaccagaaaggcacaattggcacttcagcaagaatattgcatcaatttgtcatcactaataaagtactcaaaaattcaattgtcgaattcacaggaattttgtttgcatttaaattga

SEQ ID NO: 40925 - DNA, 207 bp, Glycine max
  Peptide Sequence Number=SeqID_157703
atgactacgtcggactttaggcgaagttatatgaagaatcttagggacaaaaacaacgggaagctacacctgttgttaaggatattgagtacgtggattgacagtctgtatgtttcttacggattgacaatacgtaagaaccatcgtaaccaatgcatctcgaccaaaacggacacaacaaccaaggactacctcttccgtgaatga

SEQ ID NO: 40926 - DNA, 252 bp, Glycine max
  Peptide Sequence Number=SeqID_157704
atggtaagtgggtctttgggtagccctcttgggtggaagttggtgcacccaatcaacacctcctcccggaaaagtcaccttgtcctcaaggtggaatctcacgtaactcgtcccacttctcccatgacgtttcttctgaagtgtcagaggagaggcatcttcgttccatttgctgctcaaaatgtgaagtggtttgacgaaggggtggttatccgtagcatgcggtgggagtgggtccgtaacctgaaataa

SEQ ID NO: 40927 - DNA, 1989 bp, Glycine max
  Peptide Sequence Number=SeqID_157705
atggtgatttttcatttgggttctttaacatttcagatgaacctaaccagtttagtgctggcattcgtttcaattcgaagtctataccatatgaccaacaaacagtggtccgggttgctggagctcatgataaagggaactgatcctgttgattccttaaaaggattcattgcatggaggagaggaactggcaacagagctgttgcttcagccactcttcgtgataatggcaatcttgttctgatagacacagaacaaaacatcatttggcaaagttttgatactccatctgatacactccttcccggacagagtttatctgtttatgagacacttcgggctatgaccaagaaccccatgtctagtacctacactctttacatgaatccttccagtcaattgcagcttcagtgggatagtcatattatttattggacaagtgaaagcccttcttctgcttcaaatctgactgcatttcttacagctggtggagctttgcaacttcaagacccaagtttgaaagctgtttggagtgtgtttggagaaggccataatgattatgtgaactacagatttcttaggctagacgtggatggcaatctctgcttgtattcgtggattgaagcttcacaatcatggagatcagtctggcaagctgttgaggatcagtgcaaagtctttgcaacatgtggccagcgtggtgtctgcgtcttcactgcttcaggctctactgattgcaggtgcccttttgaggtaactgagtctaaccaatgtttggttccttatgatcaggagtgtgaatctggatccaatatgcttacatacaagaacacatatctgtatggaatttatcctcctgatgattcagttgtcataagtactttgcagcaatgtgagcagttatgtctgaatgatacgcagtgtacggttgcaaccttttccaacaatggtagaccacaatgctccataaagaaaactaaatatgttactggccatgcagatccatctctaagctcaatatcttttattaaaagatgttcaggtccatttgctgtaaatcctggtctcacaaagtcacctccaccaaaactgcctcctaggctttgtgttccttgtctaatgggggcagtctcaggaacaagaaaaaactctactatgcaaaatgttgctttagctttcacaagcccaaatccaaagggcttaaatgtgttctccttctcagaaatcaagagcctcaccagggatctcaaggatcgaattgggccaaatatgttcaagggtgtgctaccaaaaaatcacctgattgcggttaaagacctaaatgcatccatagaagaaaggaagttccagactccggagtgctgttatgaagttgggcaacatccaccacaagaaccttgtgaagctggaaggttgttgttggagtttgggagccatgggaacttaaaatgtgagaatgtcatgttggatgaaaactcagtggccaaggtgtgtgaatatgggtttgcaatagaggatggtgaggccacatattgtggcttttcagctgagaaggatgtgggggattttggaaagttggtattaaccttgctaacagggtgtcaagatcatgaacaactttgtgagtgggcttatactgaatggatggaagggagggcagttaatgtggttgataaaagaattgatggtgttgtcaatgcagaggaacttgaacgagcgttaagaatctcattctggtggtgccttcaaatggatgaacgtagaagaccttctatggaggaggtagtgagagtactagatggtacattgaatgttgatccaccaccgcaaccatgtcttgcacaggccgttacacgaagacgattcacaagaaaatggtccagaataagtgattttagtagtgtttatgcctgctcaatttttagggacttgttttcatttgtttcactttttcagtcaccttcgtgttcaacttgtatagtagaatag

SEQ ID NO: 40928 - DNA, 537 bp, Glycine max
  Peptide Sequence Number=SeqID_157706
atggcagagcaagatactgcaaaaactgcctttcacactcatcagggacactacgaatataaggtcatgtcatttggcctctccaatgcttcttcaaatgtccaagctaccataaagtttatcgtgggatatgcttccatagcttccccattgacgtccttgcttcagaaggatgacctcaaacatgctatgactcaagcctcggtattggccttgtcgaacttttcgacacccttcacacttgagactaatgcttccaggtccgctatgggtgcaattcttatgcaacacgatcacccaatggccttcttcagcaagacactggagcaacaggtctatttgtcgaagctcttaggatacaactatttgatccaatataagtcaggaaagccaaacgttgttgctgatgcattatccagacttccaccacctgccaatggccaattcctcgtgctatcaatgcctaatttcatcttcctcgatgctttgcaagaacacttacaggccagtgcctcattccaagcacgagttcaatag

SEQ ID NO: 40929 - DNA, 1053 bp, Glycine max
  Peptide Sequence Number=SeqID_157707
atgtctccaccacctatggtaacatctcttgcctactatcccaaagataacaacatatttggtattggctttgatgactccactatacttatataccatgtccgtcaagctagggggacgttattcaagcttactcagaaaggcgttgttaatgagtacctcgatgagtttggaaagccagcaaaccacattgtcgatttaccaccctcattcctccttagctgcttcatttcaggtctgatgttgaagcttcaccgggaggtaccaccaccaccccactaccaaacacccctccacttttaccctcccccacacccaaccctacactacacccaaacccaggttaagcgtctcaatccggaggaaatgactcataaacgtgagagggacctctattacaactgtgatgaaaaatgggggcccaaccacccgtgtaaggttcatttattcatgttgatagctgaagaagatgacgttgctcctaaccctcctcctttatcacctgataccttacccgatacaacctcaccagactcaacccatgcccaaatcaattttcaatgccctttcaaggacatcgacaccagaagcccttcatctctatggttttgttcatcattctcttgtgacggtgctcatcaatgggaataccacccacaaattcatccaatccagggtagccaaatatctacaacttcacaccataaccaccacgctattacaattgatagtgggaaacgtggtgccgacattgttcttggtattcaatggctcaagcaacttgggcccaccatcacttgttatgacacccttaccatgcaattccggtacgatggtgcatttgtcactcttcaggttgagatagagaaacaggtcacagaaatgttgtctgcaagtgttattcagcttagtcatagcccgttctcgtcacagatgcttttggtgaagaagagagatgggaactggcgcttctatgttgactacagagccttgaatgtgttaatggttaaggaccattttcctatgtcgatgattgatgagctactagattga

SEQ ID NO: 40930 - DNA, 942 bp, Glycine max
  Peptide Sequence Number=SeqID_157708
atggctaaatcaaccaccgatccaactcaagatccaactaaccctcttcaccttcatcattcagatggacttggccttgttctcacatctcaaacccttgatcacaagaattacatcacccggaacaaagcaatgaagctctctggcaagaacaaaatcacaacatctctcctcaccttcttccgtgatatggccctgatgcggcgcatgaagattgccgcggactccctctacaaggccaagctcatccgcggcttttgccacctctacgacggccaggaggccgtcgccgtcggcatggaggccgcttcacaaaaatggactccatcatcaccgcctactgcgaccactgcaccttcctcggccgcggcggcacgctccccgaggtcttcgccgagctcatgggctgcagggatgggtgctcgaaggggaagggagagtgggttctacggtgggcatgggattgttggggcgcaggttccgttgcggtgtgggttggcgtttgcgcagaagtactccaaggatgagagtgtcacttttgctatgtatggagatggtgctgccaatcagggacagctctttgaggaggcgcttaacattgctgcactttgggatcttcctgctattttgattactgattttgagaaacatgctgataaccttacaaactactacaaagtttatgaagaaagtccccgtgatcatatcctattggcttggaattgtgctcgtgcgacgctgctatgccctgcgatagagtatcctagggatcgtggggcgtgttctacagtgcgtatgggttgtgtgggtggcatcgccctctgcgaccaacgcgccgccgcacacggaggttgcatcccagtcaaatcagcgagattgcattgtcgtcgcagacttggagggccaccaggtcgcgtcgagaaccgcaccaggctgcgttga

SEQ ID NO: 40931 - DNA, 360 bp, Glycine max
  Peptide Sequence Number=SeqID_157709
atggcgtcaacctctactacaagaactcgaatcaagtggcaaaagcttaaggaaacaaagcagcaaacatcaatgacaaggccatgcgagcatgctactccttcttcttcaagctccaaagaacaaggtattaagtatgttgaggaagagagtattaatgaagaagatgtttgttcaagtggttgtgctacaccgaaggctaaaaggttcagaataccagaggtgcaaacatgtccaccagctcctaagaagagaagggtagtgcccaattgctcgtcaaaaagatccccaatagcattttttgcttcaccggatatagagttgttcttcttttctgcactcagaaatgtttcggcttga

SEQ ID NO: 40932 - DNA, 147 bp, Glycine max
  Peptide Sequence Number=SeqID_157710
atggtaccacatctacccttttgcaataagggaaacgaagaagacaaagtacgaaaatttgagaacaacttaacaagaaggaaagactttaccttagggttgcactgtgccacaaacagtgaggacgatggcggagaccaatgtcag

SEQ ID NO: 40933 - DNA, 507 bp, Glycine max
  Peptide Sequence Number=SeqID_157711
atggggttcattggaagtgtggtggaggccctgctaggtcaagttctaatgtggggcattaggccttctgagatggtgatcatgtccagttctaggacttcaacactggaggtagaggcttacccagctttagaagaattgatctctcaacttagcacacttaatcttgaacgtgttagacaaatcaagagtcgtttggttgcactctccagtcgtgtgcagaaggtatatgctaggtcaagctcaaccaacccaagtgttacccttgctcatgtgatcaagtcccagaaacaataccggtggaacaatgggatattaggagaagggttgttcccatataaggtttataggaaagctacattgtgcactcatcctgataaagtacaacaaaagtggtcagctgatcgaggtacgaggtttgtttgctacgtcatcagtctcttggctggacttgctagacgtaatcttgcagatacagaggtacaagctgatcgaggtacgagctga

SEQ ID NO: 40934 - DNA, 1989 bp, Glycine max
  Peptide Sequence Number=SeqID_157712
atggagggagaagaagagttgctatggaaatctgagcctcaacgcgaatccatagtctctgtctcgctcgcacgtgcgataacttctcttctcacttcccgcccaaagaagcttcacgactctattcatcgtctctcctcacattcacgctcgcacacttcactcgcttccctcgaagactctctctggttcttcctcagcttcgtaaccgattctagaaccaacaactcttccctcgatgaagttcttcttcccgtcatcgacaacgcgttgaagtcgaagcatggtgaccaagcgatgattctgctgagctggctcttccaggacgagcttctttttcagcccgttgctgaggctcttgctagcattgtctccagaaagcacgtgcacgatcgctacttgttgcttggttggtgtctccttctccggaatcttgttgagttcgagaattcagctcatcagtccatgtttggtggaataagggggaggtatggcgatttgttgaagatactctccacctgccttccggatttggctggcattgtgagtaaaggaagcactttgcaagatggttttgagttgccatctcgccttggagtgtctgccgctgattgttttttgtccctttcgggagcattaacgaaagtggccgagagtaagaagtcaaaattaaatacaagagcaaaagatcaggaaattacttttgtacagtctcctactattgacaagaaagtgaacttggaatcaaaatctttgttgatgtcaaagattgaaagggactatactctgtggcatcatttagatgacattatttgtttggtgcaaagactcctttcttggagcaagaaaagtcgttttttacatgccaaaggcttggggcaagttcttaaatggctggaggagataaaggatcactatgggtcctttcaacatgaagcagcattgaagacagattctaatgttctcaagactggggatttactgctctcttcttgctggaagcattatagcatgctcctacacctggaagataagaagttctctcagcattacaaggaactgttgaaccagtatatgtctggcattcagcattatatggacaaccacactggtggtggctatactgacaacaatgatggtgggttggagaccagaaaattctttttgaattgtttatgcttactgctgggacgtctggacagcaagagatttgaaagcatggtgtcagaatttgggatgaatatttcatgcattctagtaccacagcttaattgcactgatgaagatgtgatagttggggtagtttcaatattcaaggctatcattctgaggccagattactcacaagaagatgcacttactgacaataggcaggcaaatagtgtgataccttttctgcttcaccttctagatgagcaggatggtacagctaaagctgttgttatgctgatagcagaatactgctcaatgagcgaaggtgatcagtgccttatggaagttctaaagcgccttgcttctggaaacatttcacagagaagaaatgctatggatgttatatcagaagtcttgcatatatcatcaaagtcacaaaatttaatgccttcttctgcttggcaagatatggccaacaaattgctagagcggcttggagatgaagaaactaagattcgtgagcaggcatccaaattacttccaatgatagaccctccattgtacttgcctgcactggttggtcttgtctactctccagatgagagccaatcatctgctagtgatgccatcattggggtcctcaaacatcacaaccagagaattgaaataatattcttgcttcttgactgtcttagcaacatgagtaaaagcctagaccttacacagtctactggagataaaggcttaactcaatcccaaaatctagctcatagggtgagggttgccctcacttatatactctatcttgacactatctctaaccgatgtgggatttga

SEQ ID NO: 40935 - DNA, 1535 bp, Glycine max
  Peptide Sequence Number=SeqID_157713
atggttgttctgagcgactgcagagacatttgcaaggtgctggtgtggttcacacacacaaggtccctccggaagggtctccaactccatgggcaagttatcaaattagggttcgaagccattccattggtgtgccaccacttgatcaacttctactccaaaaccaacctccctcactcttcgctcaaactcttcgattcttttccccacaaatccgccaccacatggagctccgtcatctcctccttcgcccagaacgacctccccctccctgctctccgcttcttccgccgcatgctccgccacggcctcctccccgacgatcacacactccccaccgccgccaagtccgtcgctgccctctcctccctccccctcgccctctccctccacgccctctccctcaaaaccgcccaccaccacgacgtcttcgtcggaagctccctcgtcgacacgtacgctaaatgcggcgacgtcaacctcgcgcgcaaggtgttcgacgaaatgcctcacaaaaacgtcgtctcctggagcggtatgatatacggatattctcagatgggtctcgacgaggaggctttgaacctgtttaaacgtgctctggagcaggattatgatataagggttaatgattttacgctttctagtgttttgagggtgtgtagtgcttccacgttgtttgagctggggaagcaagtgcatggactgtgctttaaaacaagttttgattcttcatgctttgtggctagctcgttgatctcgttgtactctaagtgcggggttgtagaaggaggttacaaggtttttgaggaggtgaaagttaggaaccttggcatgtggaacgcaatgttgattgcgtgtgctcagcatgcacatacagggagaacatttgagctgtttgaagagatggagcgtgttggggtgaagcctaacttcatcacatttttgtgtctgctttatgcgtgcagccatgcagggttggtggagaagggggaacactgctttgggttgatgaaggagcatggtattgaaccggggtcgcagcattatgctacattggtggatttgcttggtcgtgctgggaagttggaggaagcggttctggttatcaaggaaatgccaatgcagcccacagaatctgtttggggggctttgttgacagggtgtaggattcatggaaacactgaattggcttcctttgtggctgataaggtttttgagatgggtgctgtgagttctgggattcaggttttgttgtctaatgcttatgctgctgctggaagatgggaggaagcggcaagggcgaggaagatgatgagggatcaaggaataaagaaggaaactgggttgagttgggtggaggaggggaatagggttcatacatttgctgctggggataggtctcatgggaaaaccagggaaatttatgagaagttggaggagttgggagaggaaatggcgaaagccggttatgttgcagacacttcttttgtgttgaaagaagtggatggggatgagaaaagtcaaactataag

SEQ ID NO: 40936 - DNA, 360 bp, Glycine max
  Peptide Sequence Number=SeqID_157714
atggttaatatctcacctctctatgacgatgttagctggccggcagatgaaggtgttttaggcgtcgtaggcgtagccccctgggcaacactggatttttgccagcagctgtatggcctggttcaggcagataaagagtggcaatatccgcgacttattattgataataatagtaaaattcccagccgcgggcgtcatttgcaactgggtgaacgtgatccttctccgtggattcacgcaactattacagaactcgctgctgcgggtgcgacggttgccgttgtgccttgctgtatcatgatgcgcttacgcaacagcacgccgagatcgtcaatgtcgctgcatccacccaacagctag

SEQ ID NO: 40937 - DNA, 204 bp, Glycine max
  Peptide Sequence Number=SeqID_157715
atggcatttgggaccacggcagctcgcccaggcgagcttatgcttcatcttgaagtaactggcttgcccagacaagctggttccttcagccctaagcaatttgggggcccaagcgagccagaggctagcttgggcgagctagggtccagaaaattcaccaaaaagacccttttgccccccctttggtatctttcgcatccttga

SEQ ID NO: 40938 - DNA, 279 bp, Glycine max
  Peptide Sequence Number=SeqID_157716
atgtctcctccacctctaggacctcacaatcactcacaaactcatctcaagctctcaggatggcttcctcttcaagctctggtctctgcagatcttcacacaacaaaatctctcaaactctctggaacttggacctttctctctctagaactctctaaacatgcagaagtttcaagaaaaggccaaactcctttccaaaatctgatttcaggcttaaataggtggctttgttcgtgctccttttctcactcaacggatggactgaagcggtgcacttag

SEQ ID NO: 40939 - DNA, 488 bp, Glycine max
  Peptide Sequence Number=SeqID_157717
atggagacatttcaagtctcactagttatcaagaactacataggtctgaattcctcattggaggatacgtatgagcaagagccttgcttttgtcggccgccccagaatcttagtcatactgaccctgaggcggcgggcccgatgacaagcagagacaaaatttggtcattctgcacccttgtatcatccagaggcggcgggcccgatgatacgcggagataccttacggttatctgcacccttttgtcatccagaggcggcgggcccgatgacaagcagagacaaaatttggcggcgggcccgatgatacgcggagataccttacgattatccgcacccttttgtcatccagaggcggcgggcccgatgacaagcagagacaaaatttggtcattctgcacccttgtgtcatccagaggcggcgggcccgatgatacgcagagataccttacggttatccgcacccttgtgtcatccagaggcggcgg

SEQ ID NO: 40940 - DNA, 312 bp, Glycine max
  Peptide Sequence Number=SeqID_157718
atggaggttaaagtgcagcagaattttggctttgtgcagaaaaatgcttgtgtgtggttggctgtggaaagtctagtgcagaatgagttctggatgtttgctagtagatcccaacggtcaaaatgtaggcttatgcactatagacttccacttgggaggattgatggggacccggtattgagagaaacgaggatatgggctacgtgggagtacgtgagctcagttggaggtgagcaacaggggatggtgggtttatgcgcgcattgtggatgtggaaaacttgttgtgcaccatcgcccgaccgccacctag

SEQ ID NO: 40941 - DNA, 606 bp, Glycine max
  Peptide Sequence Number=SeqID_157719
gcgcatatgaagggaattacaggagcaccgtaccgggcacgttgtgatgctttgacggtcacagatgtgtgctggttgccttacactgagcatggagggtttggttacattcagagcatccctccgccgcctgttagcgcttcattgtcatatgatgatatagatgacaggtggatgcattttgcggaccacgctcaggcctcaaagattcatcgtaggctaggctcaggcctttcaaagcctggcctggcctggccttttcccatccctactgggcaggtatctgcggattacatggagtggtttttccgaatatctcacccattcatgataccaacccaggcacgtgaccagcccagacatgcacctgccgcagaccctgaggagtacttgcagccgcccatcccacaggttctagtggcatttgacccccctccacatgcagtggcgatcgtagagaggttggagcgtgtgctcaaccttaggatgttcactgtaggcacaaagttacatgatattatgcaggattgcctcacaatcgccagagggggtgccagtatagatggaagtgtcagggctcgacagagacggcgcacagagcattga

SEQ ID NO: 40942 - DNA, 191 bp, Glycine max
  Peptide Sequence Number=SeqID_157720
atgtggaagccccaaaagttcaagtacatctacttgctggccactttgtacgttttcacgctaacgattccgtccgccgtcgccgtttattgggcttttggtgatatgcttcttaaccactcaaatgcattctctctcctcccaaagaatggtttccgtgacgccgccgtatcctcatgctcattcaccag

SEQ ID NO: 40943 - DNA, 507 bp, Glycine max
  Peptide Sequence Number=SeqID_157721
atggcgaaagtggtcacacagcttaagccgctcctgcctaagctgccggacgggttccatatcggggtgaacatcagcgccagacacatcaatgccccttctttcatcggtgactgccgaatcttcggcaaggggtttcagggtaaagccgtgaagctggttcttgaggtgaccgaacgtgaaccgttgatcgataatcctcatctggtggaaaacctcaacgcgctgcataacgccggttttgtcatagcactggatgattttggtaccgggtattccgggctgtcatgcctcaatgcgcttgccatagattatattaaaatttataaaagctttgttaaccgggtatcagaggagaatgactcaacgatcctgctggactgcgttattgacctggcgaaaaaactttcattgcggatcgtggccgaaggcgtagaaacgaaagagcagctggagtatctcaaccgtaatgagattaccctgctgcagggtttattattttggtaa

SEQ ID NO: 40944 - DNA, 357 bp, Glycine max
  Peptide Sequence Number=SeqID_157722
atgacatctattgtttgcaaggatcgttcccacaagacacccagtggacccgaagaagtccaacagggtcctggggtttccagctctgattatgggcctctgtcaattctacggagtgcccgtcgcccccagcaaggcaggcgtagggcgaggcaccacaacagcctggggaaggccagcagcgagcaacagacgcaccaccatcacctccagaatccacctcagttcatctacaaaggctggagcgttgcatacgacacgtggtcgaccagcagaagaccaagtccaaagccacagctgttttggatgaaaaaacatgtttctgtgaagaaaatccaagccgaggtgcttccgtaa

SEQ ID NO: 40945 - DNA, 288 bp, Glycine max
  Peptide Sequence Number=SeqID_157723
atggcaaataaccaatgtccgttcatcattgagggaacatctctcacaaggccaccaagcttcactggagaagactacctctattggaaggacaaaatggagataactaccaaaaagatctgggacttattgagcacaaactatgaaggcactgaggatgtcaaactagagaaggatacaactctgaccatacattatgaaagcttcaacatgaaggatggagagtttgtggatgatatgtttggaagacttcaagttcttttgaacaatctagaagctcttggatag

SEQ ID NO: 40946 - DNA, 282 bp, Glycine max
  Peptide Sequence Number=SeqID_157724
atggcaactgtgggatctgaacctgcttgtgcaagaacggttcatgatgttgcatcttctttcagctctaaatggcagcactcttctacggttaagaagcagccacgtgctcgaattcctcaatgttctctcaggattagagcttgtagttccatggctaacaaaaaggacatctacaaccaagtggatgttccacatccaccaatgtcaatggcccactcatctgattctggaaaaatgcctatgggattaatgggagacctcttacctcttatcatttag

SEQ ID NO: 40947 - DNA, 1023 bp, Glycine max
  Peptide Sequence Number=SeqID_157725
atggagacacgggccagtaataagaaagcatcacatctccctttgcagcaattcatttctgttaccacccctcttcttgatttggaaaaggaagctgaggtatcaagctcaggagtgtctcaagagagggtggtcatagaagatgctgagaaagatgaattcaaagtcaatgactgtcccatagagcaaaaccaaccctttgaaaatctcttcggtctcgcgccgattattaccctcccacttgggaaactcatggctgcaaccctttccaccagaccagtccgagtgccattcacaaaagggtcttttttgttgaatccagggccattctctttgaaggaacatgtgctgatcaccatctttgctacctctggatctagcggtgtttatgcaattaacatcatcacaattgttaaggctttttatcataggagcatccatccagtgtctctattcagggcatttcatgaaaaagaaaaaaggcctaaaggaggaaacactaggctgcaattctttttcctagtctttgtaattggttcaggcatgaacagccttggcatcagctcatttggcctcgattggaacactgttgccggcttcttaggcagtcctttagctatacctggctttgccatcatcaacttgttgattggatttgtgctggatatctatgtggtgattcctgttgctaattggagcaatttatatgatgccaaaaagtttcccctcattagttctcacacgtttgactctactggtgcaatatataatgttactcggattctaaatcccataacttttgaaattgatttgaatagttataacaattacagcaagatctatcttagtaatgcatttgtatttgagtatggattgggctttgcaactttgattgccactatttcgcatgttgccctcttccacggggagatgattcttcaggtgtggaggaagacaacaagaacactaaaagaacaacttggagatgtccatacaagaatcatgaagaaaaactatgaataa

SEQ ID NO: 40948 - DNA, 447 bp, Glycine max
  Peptide Sequence Number=SeqID_157726
atgacagtggcttttatcatgcacaaatattcagttagttggaaaattgaagatgcagttcttcgtgctgaaatgtttgcatcgacagccttggaaatggaagaagcaacgtggattaagcaggaagaaatggtacgtgattttgatatgtgggatgatccagctaagtccaatgacatccttgtcaagttggcaaacagtgccaaagtggttgattctctaaaggacttgaaatacaaggtagaggaagcaaagctgatcaatcagttggctgagataaatgctattgattatgggctttataaacaagcatatgaaacatcattggatgtcagcgagattgtggatctgtacgagatttctaagcttcttaaagggccttttgatatggcaggagcatgtttggttataaaagctggacctaagggcatgtatccaaaggtttga

SEQ ID NO: 40949 - DNA, 1125 bp, Glycine max
  Peptide Sequence Number=SeqID_157727
atggtgatggaagccaattcaaatacatcagactcagcgaactacatgggcagaattcctacaagccctttattatatgcaagattaagaactggagagcttgttctccgtcttggtgctgattgcccatctggagatctgacgttactggagactggcgagcctgcatactctcctgtcacccaggagggacccttgcttacagaagatctgatcaaagagacagaggagtttgtgctgcggacaggaagtgttggtgctggatgctctcaactcctctctgatatgcaggctttcaaggctgcaaatcctggttgcattttggaagattttgtgagatggtactcgcctcctgattggatggaaagtgagggaagtactgaagacagagattctttttatggtggtgagtcaatgtctagcagaggtcaactaagtttgcgaatgcaaaaagaaggtaatttgtggcgtgaattgtgggaaacatctaaatcagttccagctgttaaacagacacctctctatgatgaggatttagcagtggagggcattctagatgcatttgaggacatccagccttcagagctttacagacagctgtttgtttctcttctcggtttaggatttgcaattgctgaaactatgctgtctggcgacattgacacctcaaagttgttcaatgattgcaaggagtacatagttaccacttctcaaagtgacggattccatgagaaagtcaatgaacttgttcagatgtatgaaacggtggagaaaatgttgctgaatccagacaaggcactgaagatgatgaagcacatggaagaatcaactatgactactgatgaaccaaagcgcaggttttctactggtgagccaaagcaccggtttaagcgatttagccatatctttggtggcaaagataaactgttgacgcctgtcaggaaagatgaggtaaacgatgaagaaaagcagattcgacattctttctcaagtttctttgacagcaagtcatctttattttcaaagaagcctcctaagcctggaaacctataccctggtgagcaacctctctctctggaaagattggacagttatttagacaaagttcagtttcaccctatttag

SEQ ID NO: 40950 - DNA, 1071 bp, Glycine max
  Peptide Sequence Number=SeqID_157728
atgacgcttggttgcatctccaccttcaacttctttcttgatcaaatctgttattgggttattaatagaaaagataataggagagataaaaagagagaagaagcagttttattaacccacttaatcagtgattacaatactgttgatgctgccattatagaagttggtcttggaggtaaagaagactcaactaatgtgattaaagaacctacagtttgcggcattacttctctgggcatggatcatactgagatattaggagatactattggacagatagcttcacacaaggcagggatttttaagtactttatgtgtttgtgtgccccctccccaccttccttttttgccttctcttctgaaaaatggatgccttccctattcttgaagcctaaggtacctgccttcactgtaccccaacctcctgaagcaatggatgttatccttgagagggccaaagaactcatgcccaatgcacgatgctcccacctggtgcagtctggggaaggcatggcaatagagcaaaatggggagtcgggggttgcttttgcccttcttgtctgcaccctcaccaaggacaatgttccactggaagtgactgaaccttttgattgtaaacaaattaagggattagagcttggcttatcgggtgatcaccaattctataatgctgctcttgcagtctctctttctagatgttggcttcagagaacagggaactggggagaaaaatatcaaaacgattctaatttgccacatgaatttattagaggcctttcaacagcatatttttctggaagagctcagattgtttacgactcttatccaaattctgacggctcagaaatcttttctaaaaattatggtggagagttgatattttatttggatggagctcatagtccagagagcatggaggcttgcgcaaagtggttctctaatgccgtaagaagatatgaaattctgccacatttgtctttcaaagtagaaaatgcagaggaatcttcagaaaatggccacctcctacatgaaagcaagaccttggggcagtttgagaaatcttttaggcag

SEQ ID NO: 40951 - DNA, 501 bp, Glycine max
  Peptide Sequence Number=SeqID_157729
atggtaggagtatcacatttcacttggtggcatatgaaatccaccatcaagacaaaatgggcttattcttgtttacctgcatttacatgcatacataatttcacaggacaaagatttatatataagacatcatctgaagttcattttgaaagggaaagcaattctgtcaccaatggacaattgcaaaatttcccaacatcttcatacgaaactgccatggaaaaaatttcatctcttattacttgccaaaggcgtggggaaaagccaccgattgccaacaaattagaagtaatgtcactgtatcttaagatattgggtttggaagaagatataaacaggcttaacattattcatgtggcaggcacaaaggggaagggttcaacgtgcatattctgtgaggcaatcttaagggagtgtggctttcgcaccggagttttcacatcccctcacctaatcgatgtgcgtgaaagatttcgtatagatgggttagtaattgaatga

SEQ ID NO: 40952 - DNA, 321 bp, Glycine max
  Peptide Sequence Number=SeqID_157730
atggcattgaactcttggaatttcaacttgctgggtgagcatttagcattaaagtctgttgcatcagtggataacagttcggtgatggagccaaggcagaaggaatgtataggagcagtcatggtgattcaagttataaggagtcaacccttgtccccaccaccaccggacctcagtttgcatacagtggctagtggggtttcacagttgatccccacggatggacaccaaagattcatgttttgtaaaactgatgacatgttaatagagaagatgtggaaaaagatagcagcatcaccagtggagatccagattaattag

SEQ ID NO: 40953 - DNA, 540 bp, Glycine max
  Peptide Sequence Number=SeqID_157731
atgtatcttagatgggccaaaagacaaggttatgaaggaaggattgttgacaagtgtctgtacaagaatggaggaattaattctgcgattatagagtttgaatttgagtgtgcatatggctatctttcaggggaaaaaggagttcactacttgataagaggttctccaaatgaatcttctcagcttgaggctagctcagcaactgtagatgttattcccatgtttcttgagagtgcttgtgatcttgaaattgattctgaggatttgattatctcatctcccttgattcatgggaaaaacaagagacaaactgatcatacagtttgcattcaacatatacctactggcataagtgtccaatcctatggtgagagaagccactttgcaaataagatgaaagcactaaacagactgaaagctaaacttttagtgacaacaaaggaacaaggagttgcaagtataaaaagtatacagaagaaaacattgtcaatttatggcaagaagaaattcggaggtatgtctctcatccgcacaagttag

SEQ ID NO: 40954 - DNA, 1155 bp, Glycine max
  Peptide Sequence Number=SeqID_157732
atgactcaggtagacgattacgaccttaagatactgacactactacaatctaacggccgccttaccaaccaggaactcagtgatttagtcggactttcggcgtcgcaatgttcacgccggcgcattaatctcgaacaggcaaatcttattctcggctatcacgcgcggctctcgccggacgcggaagcggcgattgtcgacgcgttcaaaaccaccggtgacgccgactatctgttaaaagtcgcggtggccgatttagcggcgctgagcgcgctgatcagtcagctcgtcgctggccatcaaagcgtggcccacgtgaaaacctcggtgatttgtgccgtttttcgcgcaaagcgcgcaccagaaaccgaatttgtgcatgaatcgattattttacagcagattgatgcacataaacctgcaataaagcgccttagttatcaattggataatcgctggcacccatcggcggcgacaggaagccgccgatgtggtgcgttttttgcaaatgaacgccatcatttgcaaagagatcgcaccatggataacgctgtacaaccttcccgcattccccacacccgtacagaagatgcgctggcgatcgtgcttggcacgctgatggtgtcgtttggcgtcattttgctgaaacaggcgggcgcgctgaccggcggtacggcgggcgtggcttttctcatcagctacctgtcgccgctctcgttcggcagcgccttctttctgattaacctgccgttttactggctggccattcgccgcatgggctgggaatttaccctgaaaaccttctgtgcggtggggctggtatcgctgttcacccatttgcacccgctgtttatccatttttctgcgctaaatccgttttatgcgacattgttcggtaacgtggtgatggggattgggtttatagtgttgtttcgtcacaaagccagcctcggtggtatcaatattctggcgctctggctgcaggatcgctctggtctgcgcgccggcaaactgcaaatggcgctggatacctgtgtggtactggcctcgctttttgtggtatcgctgccgatgctgctggcctccatcgccggcgcggtgatgctcaatctcatcatcgccatgaatcaccgtcccggccgctattttgtttga

SEQ ID NO: 40955 - DNA, 165 bp, Glycine max
  Peptide Sequence Number=SeqID_157733
atgggaaatgaagggcagtccattgcagacacccaagacagtgcaatcgtgattcaatgggtagctaccaacaacagtgataatgggttctcgagtaaatcatgtatggagcaaggtgcggaacaatacctgctttcattgttcttaaatcctaataggacgtga

SEQ ID NO: 40956 - DNA, 288 bp, Glycine max
  Peptide Sequence Number=SeqID_157734
atgcctgatggtcttattgaagcagtcccttcttggtcgtctttactcgagaatagatcgatcggtgtgaacatttcaacaacggtgaaaagtgaggcagttttttgtcatgtgattatgttcaaagcttggttttgccatatcgaaactaagttagtattggtctcagtacttgaacatcttgcgatgaagaagaaaaataacaatgacgaacttagtataagacttggagaaaagtttggtggtcgacatcaaaccctagtagacacccaagccccttataagtga

SEQ ID NO: 40957 - DNA, 240 bp, Glycine max
  Peptide Sequence Number=SeqID_157735
gttggtggaaagattgaaaaagaaaacacttctctctgccccattacgagggagaaggaaaggaagcagaagggtaataccattgatggtgaaatggataaggcaaggaaaagatttagcactgagtatccatccatcaaccaagtcaaatatgagaatcaagtattactgcactgtgtgccagatagttatgagaatggcagccagttgaagcatcatcgtaaagaaattcatgaggtg

SEQ ID NO: 40958 - DNA, 189 bp, Glycine max
  Peptide Sequence Number=SeqID_157736
atggctgcgggactgcgtcagagaacacccttccacaagacttcagtgctaaatcttttccttgccttatccatttcaccatcaatggtattaccctgcgatgtattattttggttaaccgctggttcttgtgactggatcactgcatcttgttggagatgtattaaagctcttgaaaagatgatttaa

SEQ ID NO: 40959 - DNA, 582 bp, Glycine max
  Peptide Sequence Number=SeqID_157737
atgtttaacttcacaatgtttgatgacattgtaagtggctcaatcagcactgactttttgatagatgttattagtgaggttgttgagattgggcagtggaatctacatggcaaaccaaagaaagttgtatttactatgaaggatggatgtgaaagtatcatgagttgtactttatgggagtcattggctctgaagtttaaggattgttttgataggcatgtttctggttctgtggtgttgttgctcaatctggctaaaatcaaagaaggaaacggttgttgtttcattgaagcaaaattggggttgctgaaccatggttcagtctttaaagcgcaaatattgactcatgagtttcctttgcatttcaaaacctcatgtgcttcttccatcaacagtggaaaaaccatggataatgtgccaaaaatcaagacagagtctggcttgaaagatgaaaatcatctacctcacgtggcacgacagagtcatgctccaccaatgttactgcagacaccttttaaccagacaactaacacgtgtacaacctctgcgcctggtaagattgttgttacctatacattgtag

SEQ ID NO: 40960 - DNA, 906 bp, Glycine max
  Peptide Sequence Number=SeqID_157738
atggttgatgggatggctcccaagaggcataagacggtcatcaacatgggagtcagaactgaaaaattgggcctacctacttcaccaccttatctctccctagtatctaatgtccacaacaacagcaacaacgtatcttttttgcgtggtgttaactttgcctccggaggtgctggaatattcaatgtctcagataatggttttaggcaatcaatacctttgccaaagcaagtggactactactcactagtgcacgaacaactggcacaacaaataggagcatcttctcttgggaaacacctctcaaagtccatcttcattgtggtgattggaggcaacgatatctttggttactttgactcaaaggatcttcaaaagaaaaacacccctcagcagtacgtggattccatggcttccacattaaaagtgctactacagagattatacaacaatggtgcaaagaaatttgagattgctggtgttggtgcaattgggtgctgccctgcatacagggtcaagaacaaaacagaatgcgtttctgaagccaatgacttgtcggttaaatataatgaagctcttcaatccatgttaaaggaatggcaattggagaacagggacataggttactcttactttgatacttatgctgccatccaagacctcgttcacaatccaacttcatacggatttgctaatgtgaaagctgcatgttgtggatttggtgagttgaatgcccaaattccgtgcctgccaatttcgagcatgtgttccaatagaaaagaccatattttctgggatgcattccatcctacagaagcagctgctcgcatctttgtggatgaaatttttaatggaccttcaaaatacatatctcctattaatatggaacagttactggccatctga

SEQ ID NO: 40961 - DNA, 228 bp, Glycine max
  Peptide Sequence Number=SeqID_157739
atgaagaagatccaaggcctacaagctccacatggagctacatcagctttggcccaaaacaagatattacagaaatccatgtctcaatgtcacatcctattagagcattgtgttccagcagcctctagcataaggctttccaaaatcatccacctaatcatctgctcccacaaacacaaagctcgagatcatcacaagatccaaacgcaaacaacacatagggagtga

SEQ ID NO: 40962 - DNA, 495 bp, Glycine max
  Peptide Sequence Number=SeqID_157740
atgtccttagggtgttcacgatgttcatggcatcacttcttgaacaccaacgacatcgacacaaggaagatctttatgttgaagacgttgtcgtcactagtgatggtggaggacatgaacgaagagttggaggaaatgctaaaggtatcctttgagaacttgagtgcaacagatttcgcattgcaacttagaagcttgttatgcggcttcctgaaatttagtgtcatgctcattggaggcacatggtgcacaaccacgaccactgttgatgcaaaaatattaaggtttgggggtaaaaggaaacttgaactctcaaagtgttatgttaagataagaaacataagtgggtttagaagggatacggaaagggggatatatatgaaagagtggggtgaattgggtgccctgactggttgcaacaactccttccatgagcaattagtctatgggcaggaaggttgtgctgcaaggtccttacccttgaatggacgatga

SEQ ID NO: 40963 - DNA, 576 bp, Glycine max
  Peptide Sequence Number=SeqID_157741
atgtggttttctgagtatctttttctggagagaagttgggccaaggatgaaagcacattaaagtcaggcatccagcaactgagtgatttccctcttcccttttggttggctctctttgtagaaggaacacgctttacacaggccaaactattagctgctcaggaatatgcaacttccactggattgtctgttcccagaaatgttttgattccaagaactaagattatggctaacaaaatggaagacaggataaggattatggttttattggctcaagtaagtcatatgcgctcatttgttcctgccatttatgatataacagtagctatccctaagagttcccctgctcctacaatgctaagactcttcaagggacaaccttcagtgggcattcctatttgtcctcataagagaggtcgagctcttgcctcagtgtcagcatttcgttgtaatcctgttgaggactggacatcatctccagctgctggagtagtggtagaaatgatgtaccctgtctgtccagaagaacttgagccaggattggctcctgacacacccattttctccatggcttag

SEQ ID NO: 40964 - DNA, 609 bp, Glycine max
  Peptide Sequence Number=SeqID_157742
atggacaatgggtgtatgatagacacaccaacctcaacacattttatgggtgtcacctttaatattttggctctgaatcttgttaatcggcttcctattattagttttactttatggaaaaatttatataccactgctctgaatggatatgttaaatttgcaccgcctctgccacaacctcctgctcctgagtatcatcccatggatgacgtcatttatgtgcttaattcccctgctcggggagatccacctactaatgatgcattttcagagccaccaccctttgtcatcgatcaccctatggatgatgcatttgaccatgttcatgatgtagatgacatacctattcccgatgaagattgcattcatgctcttgttgttcaatatcacatgccattagatctgcttcctctggacaagtctccacccttttatgtgcttggcatggccgatgaatttttgacttcatcttcttcttctccaccctatattatcgatcatcgtgagaaagggggcgatgtgcctgatggacacatgcatgatatggatgatgttgacttggatgacttagaggggacagagacagatcatggagaggactctttttga

SEQ ID NO: 40965 - DNA, 276 bp, Glycine max
  Peptide Sequence Number=SeqID_157743
atgaggttcacacttgaagaatttgagaaagagccttctaatggaactctaaagactcttcctaagcttgcagctctttctacgtccttacttgcttggttggagccgaaatacactagaggccatatactagaatcagaggggatagtggatgcaaagaaggcattgttggagttgacatatgttagaaataggcaagataaggcagtatcttgggatacggtggatgtgcaagcatcagaggaacatggtgtaggttgtccaaaaagtgtatag

SEQ ID NO: 40966 - DNA, 2679 bp, Glycine max
  Peptide Sequence Number=SeqID_157744
atggttcagatcgcgaggaggaagaagggacggccgtcgaaggcggatctggcgcgccgctccggcgagtctcagtccgatccccggcggagcctccggcgccggagcgtgaggtacaacatcattgactacgacggagattatcttgacgacgacgaggaggacgagaggaggcgcgagaagaagaagctcaagctcatggcgaagctgaaccaggacggcggagaagaagaagaagaggaagagcgggaagaagaagaagaaaacgagactgcaacgaaccacactcgtgccgagtcgcgtgaggagcacgcgccggtagaagaatacgacgacgaaaaagagcaagaggaggagaacgaaaacgaacaagaggaagagaatgaagaagacgaagacagtgtggtcaagggcagaaaagtggaatcgaaagggctccactctgtttctgttaatgtttctgtttcaggagctccggtgattcttcaatctgggattccgttgcctgataagaggactctggaattgatccttgacaagcttcagaagaaggatacttatggtgtgtttgcagaccctgttgatctggaggagcttcctgattatcttgatgtgatcgagcatcccatggactttgccactgtgaggaagaagttgggaaatggatcttatactaccttagaacaatttgaggctcgatcaatacaagaacttgggcggaagaaatttgagaagttaaggattggctttgaacgctctcagattgagcttaaatcagaagaaaaagcaggatccaattatttggttaagaagcaaccaaagaagccactggcacgtgcttcacaagaacctgttggctctgatttctcctcaggggcaactcttgctactattgcagatgtacagccaacttcccatctgatgcaaggtggtagtagatgtgagaggtctggcaatattgatggtattttggaggcaaatgctttctggatcgatgcaaatcaagagagagctgatgatgttttgtccgggaaaggtcttctctctaagtggggaaggaagtcctctgtgcttgacgaaagtcgtcgtgcatcttataatatgtccaatcaaccaattgttagatcagattcaatatttatgacctttgagagtaaaatgaagcatctggttggacttgatgctgaatattcctatgctaggagtttggctcgttttggtgcatctctaggacctattgcttggaaaattgcttcccacaggattcaaaatgcactgccagctggatgtaaatttggtcgtggttgggttggagagtatgaaccgcttccaaccccaatattaatggttaataatcgtgtccaaaaagaaactagtttggatatgaagttgcattccaccactgaattaccaaagggtaaccaaaattgtaagaatgtggaatccagcattgagcatcctgtaaatggacagatgcttgagggaaaacatccttcaatgcctgatttcgaaggaaaacctttctttggttctgctggagtaaggctcagtgctcccttcaacatccgtaatcaggagcagaacgcccaatccaggatgttaggcaagtctgagaaaaatggtttgaaacaagtggaattgaattctttaccctcaagtaatcaaaataataatggtctggttgcaaagtttacaagtcatgctcctgcagctaattctcttgcagcagagtccaagcccagagaaatggtgccaaggaacatgttcaaacagccagatactaatggagttgttggtggagagtcagctaatggaaaagtcaggaatacaagtttgaatagacaggtgactggttcatcacctgaaagcacattgcatcaatcaagcagagctgctcctgctgttgtccatggacaggagcagggtcttggtgacccagttcagttgatgagaatgttcgcagaaagggctcaaaagcaacacacttcttccaatcatttgcttgttgatattccgccagtgacactatcaggtccatctggacagagaaatgactcgggcaatgcttcagcagcagctgcccatgcatggatgtctgttggggcaggagggtttaaacaaggacccggcaattctagttcaccaaaaaatcagatatctgcagattctctgtacaactcaacaagagagttgcatcagcatatttcgagaattcggggggagtttccctctggtggaatgcctttccaaccatttcaagcagttgctcctcaacctattcacacaggtgctgtttcacagtttcccaaccggcctatggttttcccccagttagcatctgctgatcaatctagatttcaaatgcagtccccttggcgaggtattagtcctcatagccagtcaaggcagaaacaggaaacccttccacctgacttgaatattgattttgaatcaccagggtcacctctttctgttggatttagatccttttcgcctgtgtttcttctgatccgtcaaaagcatgccatcactgtaagtcaattggatcctgaagattcagggcagcaacagaagctgtttgagaacgacaaaaccatgaaagtttctagctccaagggtgcggtgagggccacaagattcttgaaattatctgatgctcctataacatattgctcctag

SEQ ID NO: 40967 - DNA, 318 bp, Glycine max
  Peptide Sequence Number=SeqID_157745
atgttcagcaacttaaggagtcaagatgtgccccaagtgactcaaaccccacccatccaaggttctgttgtgtggaaaccacctagagttggattgtttaagttaaattttgatgcatccgtaaggcaaggtactggaactggtatgggaatgatagttagggaccaccaagggcaagtgcttgtagctgcaacgtatttatcagatgttgtaatggagattagagaggtagaagcaacaactttcagatgggctattattaaagcagtgttggataaactaggttccatcgcaattgaaccaaatcatatctactga

SEQ ID NO: 40968 - DNA, 2574 bp, Glycine max
  Peptide Sequence Number=SeqID_157746
atggttcagatcgcaaggaggaggaagaagggacggccgtcgaaggcggatctggcgcgccgctcaggccagtctccggccgccgcatcgcagcctgattctcggcggagcctccggcgccgaagcgtgaggtacaacatcatcgactacgacggcgattacctctccgatgaggaggatgagaggaggcgcgagaagaagaagctgaagctcatggcgaagctgaaccaggacggcgaagaagaagaagagcgagaagaagaagaagaaatcgagacgacgccgagccgcactcgcgccgagccggtggaagaatacgatgacgacgaaaaagaacaagaggaagagaacgaaaacgaacaagaggaagagaacgaagaagacaaagacagtgtggtaaagggcagaaaagtggaatcgaaagggctccactcttttcctgtttcaggagctccggtgattcttcaatctgggattccattgcctgataagaggactctggaattgatacttgacaagcttcagaagaaagacacttatggtgtgtttgcagaccctgttgatccagaagagcttcctgattatcacgatgtgatcaagcatcccatggactttgccactgtgaggaagaagttgggaaatgaatcttcttatactaccttagaacaatttgagagtgatgtatttttaatttgctcaaatgcaatgcagtacaatgcaccggagactatataccacaaacaggctcgatcaatacaagaacttggacggaaaaaatttgagaagttaaggattggctttgaacgctctcagattgagctgaaatcagaacaaaaagcaggatccaattatttggttaagaagcaaccaaagaagccacttgcatgtgcctcacaagaacctgttggctctgatttctcctcaggggcaactcttgctactattgcagatgtacagccaacttcccatctgatgcaaagtggtagatgtgagaggactggcaatattggtggtattttggaggcaaatgctttctggattgatgcaaatcaagagaaagctgaagatgttttgtcagggaaagttcttctctctaagtggggaaggaagtcctttgtgcttgacgaaagtcgccgtgcatcttataatatgtccaatctaccaattgctagatcagattcaatatttatgacctttgagagtggaatgaagcatctagttactgttggacttcatgcagaatattcctatgctaggagtgtggctcgttttagtgcatctctaggtcctattgcttggaaaattgcttcccacaggattcatcaggcactgccagctggttgtgaatttggtcgtggttgggttggagagtatgaagcacttccaaccccagtattaatggttaataattgtgtccaaaaagaaactagtttggttatgaagttgcattccgctaccgaattaccaaaggctgaccaaaattgtaagaatgtggaatccagcatcgagcatcctgttaatagacagatgcttgaaggaaaacatccttcaatgccagattccgaaggaaagcctttctttggttctgctggagtaaggctcagtgctcctgtcaacatcctaaatgaggagcagaatgcccaatccaggaaattaggcaattctgagagcaagggttcgaaacaattggagttgaattctttaccctcaagtaatcagaataataagggtctggttgcaaagtttacaagtaatgctcctgcagctaattctcttgcagcagagtccaagcccagagagatggcgtcacggaacatgttcaaacagccagatactaatggagttgttaatggagagttggctaatgtaaaagtcacaaatacaagtttgaatagacaggtgactggttcttcacctgaaagtacatcaaaccaatcaagcagagcagctccttctgttgtgcatgggcagggtgctagtgacccagttcagttgatgagattgctcgcagaaagggctcataagcaacacacttcttccaatgatttgcttgttgatactcctccagtgacactgtcaggtccatctggacagagagatgactcgggcaatgcttcagcagcagctgccgaggcatggatgtctgctggggcaggagggtttaaacaaggacccagaaattctagttcccccaaaaatcagatatctgcagattccttgtacaactcaacaagagagttccgtcagcatatttcaagaattcggggggagtttccccctggtggaatgcctttccaaccgtttctagctgttgccgctcaacctattcatacaggtgctgtttcactgtttccaaaccagcctatggttcctcagttagcatcttttgaccaatctagatttcaaattcagtccccttggcgaggtcttagtccttgtagcctgtcaaggcagagagaggaagcccttccacctgacttgaatattggttttcaatctccagggtctcctgcaaaacaaacttctggtgtccctgttgactcacagcaaccagacctagctttgcagctatga

SEQ ID NO: 40969 - DNA, 282 bp, Glycine max
  Peptide Sequence Number=SeqID_157747
atgatgctgtcgttgacttcgggtgagaccgtgagagaactcatgttggtgggtgctgctcatgctcgtgcttgcgctggagttcgcgtggtgctcgctttggagttcgggagttcatgtgctgcgtgctgttcattccattttgattcgaaaaccgggtttggggttgggtcggcttcttccgccataaccgtcattctgtcaccaccgttaagcctatggcagccgccatggcacctccatttgaaacccgcacaccatactgtcatggcgctgccataa

SEQ ID NO: 40970 - DNA, 345 bp, Glycine max
  Peptide Sequence Number=SeqID_157748
atgtttcgtccactagtttccgtcgctaaaacgcttttttctagtagtgggtgcaggcatgatgaagttcctgaagcacaggatttccgtcaaggagaaaaaatcacacctttgggttgttgtccttggtcagccttcaccataaggcaagtgaatcgaaggctagcaagaagaagcaaaaagatagtcaaagctcaagggattcatcacgaaggcaagtgctccagcggaagctatcaattcaaagggaagaccgggggagggagcagctcatccgttatgaagcatttgagtttatgtaattttttctacattatgggtggtttttacaataagttggcatga

SEQ ID NO: 40971 - DNA, 348 bp, Glycine max
  Peptide Sequence Number=SeqID_157749
atggtgttcaaaaatcaacacgcgcacaccaaaaaggctatagctggagctggtggtgcccttgatattaattttgaactcaaaaactcaaaagccccccgatctcctcttcctcccggaaacaaagctaatttgttgttttcaagacataggcagaggaggaccaagaaaatggaaaaatgttcgcaaatatctgatggtggatcccaaaatttgaccaacgaaacctcaaatcttagcagtgattggccaagaaattgtaactcatttgacatgcaaccagttgggaattatggagacccttgtttgattttgagccatggaggaagcaaaactatgattgtttaa

SEQ ID NO: 40972 - DNA, 309 bp, Glycine max
  Peptide Sequence Number=SeqID_157750
atgtatatagttgcttgttgtttacgactgcttttatgtggtgatggtggtaacatcagcagcagcaacgatagtagaaatactggtggaggtcacggtgacagtgacagtggtggtcatgatatcaatggtgggggtagtgataatgtggttgtgacagtcaatgatggtggtggcggcgacagcagtgacagaagtagtattagtggtggtggtgataacaatgttgatgatgttggtgacaatagtgatagtagcggtggtggtggtggtggtggcgatggcggtgttggtggtggcaccaagtag

SEQ ID NO: 40973 - DNA, 348 bp, Glycine max
  Peptide Sequence Number=SeqID_157751
atgaaattatctcctgttcagctcagggttcttgtgctcaatatcactgattcaactggcaaggggaaatcttgggagttgggtggattggagagagagaaaaaagcagttatggtgattgctgagaatgagattggtgaggatcagaaggagattggtgctcctaagtctccatggaagactcctactgttgatggaaagggaggtgatgtgtctgtgatgatgggcactgagtcttggccacgtctctctgatgcacagagaccacccaagaatcttgagactgctgctgctgctgcttctgtgacaagtgctggtgagattgctcctagacctccttctatgcag

SEQ ID NO: 40974 - DNA, 1191 bp, Glycine max
  Peptide Sequence Number=SeqID_157752
atggttgggaaccctgcactccatgtttcatcattgccaacttattttttttcatctctgattatcctaccaagaaatccttcaagttccatccctcttccaattcgacgccagacacaaatcaacaggataagagttacatctgctgattcaggtcatggccaaaggccatcatcatcttcttcagaagcaaagaaaccactttcagctttgtcaaacattccgtgggccatttggaggcaaacattgcggccattaagtgattttgggttcaatggtaggagcatctgggaaggtggggttggactgtttctagtgtctggtactgtcctatttgttcttagcttgacctggttgaggggcttccaaatcagatccaaattccggaagtacacagtggtgttggagtttgctgaagcttgtggcataagcaaaggaacgcctgtgagaatcagaggggccactgttggcaatgtcattggtgtgaatccttccttgaaaagtattgaagcagttgttgaggaaaaactcaactcagtttatcttttattttcttctcctgtgggtgatgataaaacagttataccgcgaaattcattgatcaaggttaaccagtcaggtcttcttatggaaacaaaaattgaaatcactcctcgtgagccaattccaacaccttctgttggccctcttcaccaagactgtactaaggaaggtcttattgtgtgcgatcgcgaaaagatcaatggtgaccaaggaacaagtttggatacattgattggaatttacatccgccttggtcgtgacatagagaaaattggtatcatcaatagctatacaatggctcaacgagtattttccattattgaagaagcgaaaccacttcttacacagatcaaagccatggctgaagatgttcaacctttgctggctgaagtccgtgattgtggcgtgctgaaggaagttgagaatttaacccaaaaccttatccaagcttctgatgatttgagaagggtacattcatccgtcatgacccctgagaacactgaactgtttcagaagtccataaacacaattagttttaccttgaagaactttgagaatattagcaaggatattgtgggttttactggggacgagactacaaaaaggagtttgaaattacttttacagaatctcagcaggcatttgtga

SEQ ID NO: 40975 - DNA, 237 bp, Glycine max
  Peptide Sequence Number=SeqID_157753
atgtatgtcaaggtcatgaccgatgaacagttggaaactctgaggaagcaaatagcagtttatggcaccatttgtgagcaacttattgagatgcacagaacactctcagctcaacaggatcttgcagtaccatttatctccaccaagagctctaaagctcaattggctgagcagcaagacgcggttattataaattcttttatatctgtgttcgatttctaccatttctacggataa

SEQ ID NO: 40976 - DNA, 501 bp, Glycine max
  Peptide Sequence Number=SeqID_157754
gaaaatgcaacgcgggatgccgcagcggcatcccgaatcggtggcttaacggctggggtgctgctgcagccgttcgctgcggtagaagctcagcaggcaccagccgagggcgatcagtgccagcggcgcggcgacgaagccgatgttgcccatgcccagatgcaggcttacctggttgcccagcagcgcgccgctgccgatgccgaagttgtacaggccggagaagatcgccatcgccacgtcggtggcgtccggcgccaggctcagcactttggcctgcatcgacaggccgatggccatgatcgccatgccccagaagatgcacagcaccgtcaggtggctttcactgccggcggccggcaacagcagcagcaggctcaaggccagcagcgtgatggcgccgataaagaagccggaaggaaaacgctcgctgtagcggctgaacagcaggctgccgacgatgccggcggcgccgaacagcagcagcatcagcgtggtgaa

SEQ ID NO: 40977 - DNA, 174 bp, Glycine max
  Peptide Sequence Number=SeqID_157755
atgtggttgcgcaccttgcggcgatcggccagcgtgccttcgcagcggccgtgttccaggcgggtgatgcgcgaccgcgcgcgagaacagccagttgccggcgggccagcgctgcaggcggtggtagagcgaaagcaggggcgtggacatgagcggtttccggtcggcggatag

SEQ ID NO: 40978 - DNA, 357 bp, Glycine max
  Peptide Sequence Number=SeqID_157756
atggccccgaacgaagcccgtgaccgcctcgccagcggcgtgttcctgaccccgtgcgagaacaacccgggcggccgcatcaacagctacctgagcaaggcgatcatggccgagccggtggagcgcaagttcctcaaggcgctgaagagcaagggcatcgaagcgctggacttcaagagccagctggacgaggccgtggccgaaggcgtgatcacccaggacgagcgcagcctgctggaagaactgcgtacgctgaccctggacaccatcaccgtggacgacttcgacacccacgaactgcgcgcggccagctactacgaccgccagcagaaggatccgcattcgcaggcggcctga

SEQ ID NO: 40979 - DNA, 159 bp, Glycine max
  Peptide Sequence Number=SeqID_157757
atggcatgcacctcattcccacgtaccaacgtagttcaaacaggtagaggtcatgattgtgacatgaaagcatattataaatccatgctagctaatacgtgtcaacaaatcaagtgcaagcaaactagcccatatttcagaaaggaaaacacggaatag

SEQ ID NO: 40980 - DNA, 558 bp, Glycine max
  Peptide Sequence Number=SeqID_157758
atggattatgacgttcatgcattgccttttgatctcattctgattggttgcatatttaaaggaatcaataagaaatccctaaccctaaagcttggtttttggaagcacaaactgcaacaacaatggaggagaattgaaaaccagggtgtggtaatttgcgtggttgctgtagttcaaagcccaaagggcatgaacaacaacaacaatggaggagaattaaaaactagcaacagggccatgatagcgttgtgccaaggctcaaaccaccagaaactgtgccacgaggttctatcatctttgaacagcacaaacccaatggagtacatcgcaacagtggtgagaacctcgatggacagcatgatcaaagcgtttagcatgagcgacaggctgacgaagaaggtgcaggagcagttgcaatctaggagcttggacaacgttgggagcttggacaatctggtagctacatcggaaggttttggagctgaggcggtagaaggagttgcagcgacaacaacaccaacaattgatgagtcaaagttcaattttgcaccagcttag

SEQ ID NO: 40981 - DNA, 703 bp, Glycine max
  Peptide Sequence Number=SeqID_157759
atggaacggtgggaagaaagtacaaagtacaaaagtaacagagtaacctggaagatgagttttctcgcgggaaggttagctgggaaagaagctgcgtactttttccaggaatccaaacaagccgtgggaaaattagcccaaaaaaaccctcttcccaagaccaacaacaacaaccttaactttcacgaaggatatgatcatgcggatgtacttcccgaggttctaaggcactctcttccttccaaagtgtttagaaatgatgaagccacctccttttccttctctgcctccaaatgggtccttcattccgaccccaaaacccaatcttccgtatcccctgatgctctcaatcctctgcgtgcttacctttccctgccccaagtcacctttggccccaaaaggtggcaactgcctgaagcagcaaacacggtttcagcctcaacagctaatgaatcgcgtcaagacagatatgccacacatgttaacccggagaagttgaaagctgcaggtgaagggcttgcacatgttggaaaggcgtttgctgttgccactgcatttgtatttggtggtgctgcattggtatttggtatggtggcctccaagttagagctgcagaatgctgagaatatgtcaaggaagtggcatgtggaaagggacgatgttaagcagaagactatcataaaggagctttcaaaaatttggg

SEQ ID NO: 40982 - DNA, 306 bp, Glycine max
  Peptide Sequence Number=SeqID_157760
gttctgaaactttctggggacaaaatattgtcatcacgtcttataattgatgccatgggaaacttctcccctgttgtaaaacagataagaggtgggaggaagcctgatggtgtttgccttgtcgttggaacatgtgcacgtggctttgaaacaaactccactagtgatgtcatattcagcagttcatcaataaagaaagttggagattcaaaagcacaattattttgggagggtgtttcacttgacaatttggagatactgagagttatttatggaatatttcccacatatcgccagaggtattaa

SEQ ID NO: 40983 - DNA, 130 bp, Glycine max
  Peptide Sequence Number=SeqID_157761
atggcagatgtaacatgtggtccgtgtaacaacgcatggccatatccactccttttgcaagctacaccaagcttgcatatgcctcgatgtactcgacatcttcagtacctaaaagttgttggttgtaggg

SEQ ID NO: 40984 - DNA, 615 bp, Glycine max
  Peptide Sequence Number=SeqID_157762
atgggttacatggcgacccaaaagggtggacttgcaggagtgggattcaacaagaaagatttgtccaactacattgagcatcgaatgaggtctacaataaaagatggggatgcaatggcttctttgagttatttacctggtaaggcaaacaatgatcaaatgttttatgcaaaatacttgatttcagaagatgggaaattgatgaatttgttttgggctgatgttaatagtagaattgattatcaatgttttagggacatggttgtgtttgatgatatgtacaagaagaataagtacaacaagccaatggaacatgctacaagactttatagcgaagatatatttaacaaagtgaaggtgcagattgttaatgctggtggattgaatatgacacacagaactaaagctttggacaagcaacaagggaacatgcacaatgggggtggtcgtgctaaagatgatgtaggtgatccatatgtgtctgttggtgataattcatatgccatgaagtttgatgatagtgaaagagttgacaatggaacaactgatagcgaaagagctgatagtggaacaactgataaaggaagacttggcaatggaacaactatagtgtaa

SEQ ID NO: 40985 - DNA, 576 bp, Glycine max
  Peptide Sequence Number=SeqID_157763
atggaatatctcagctctcagtggggacttcattcccacacaagaaatgtagccgaagacccctcctttcgagaccacaagctgttccctccagaacccaggataatggagagtgtttcagtgagtggagaagttggtggtgctggtggagcatactcttatgaagccttgaaaagattagaccagcaatggtcaagcatatgctcctctcaagaagttgtgcaagagcctcagcaagttgtctctaccatcccaagcttgtttggctcatctgatcttgctgacaaagcagagggatcatacgatgtgttagtgtgtggaggcactctggggatcttcattgccacggccttgtgtgctaggggtcttcgagttgccattgtggaaagaaatgtgctaaaagggagagatcaggaatggaatatatcaactaaggagctcttggaacttgtagaagttggggtcctggaagaagatgacattgaaagagccacagcagtaaaattcaatcctgtaattcctgaacttcttctgtttagtttccaatttatatatagcaagaatcatctcaattag

SEQ ID NO: 40986 - DNA, 237 bp, Glycine max
  Peptide Sequence Number=SeqID_157764
atggagaagtttggtaatgggaatattcgtattggtgatgaggagctagattttatgctgggtggacttgatgtacatctccattttgtccatctagtaggggtagtcttcttcagcgaagcttggtggtcttttatgagatgctccctcattattgaactagcgttggttagctgccatctagatcttttcctctacacactgttaagtgctcaaaccttagaggcagagctctaa

SEQ ID NO: 40987 - DNA, 528 bp, Glycine max
  Peptide Sequence Number=SeqID_157765
atgtggcactattcatcaagaaatagcctaagcgtgtccgtcaccctgtcatgcataggcaactcccctcatggtaataaccatgagtctcaagggagtttcgaatcgagtgatatgcccccaattaccaacatttttcctgatgaaaaaccacaggcaacttcccccatggtaatcaacatgagtctcaaggaagtttcgaatcgagtgataggccccccaattaacaacatttttcctcatgaaaagccacagggatatccaacaagtcactgcaccccctatgtgcatacacaacatatatccatcacaatgacatcatcaacatcaagaatcatctcatctcagtatcatcatcaacatcaatatcatctcatctcaatgtcatcatcaacactaaaaatcatctcatctcaatatcatcgacatcacaagatattgcattcctcatatatatatatatacacaaattcatgcctgagattcacattccccaaatctttagacaacacaaatatcatacaatag

SEQ ID NO: 40988 - DNA, 507 bp, Glycine max
  Peptide Sequence Number=SeqID_157766
atgtacaagaaggtgactgaagctgatattgaggagtttgaagcaaactatcggggatctgactcagagaaaaatgatttgattgatttgtacaagaagtgcaagggtaacatgaataggcttttttgttcaatgctttgttcagatcctaaacttgattcacaccgattcaaggatattctcgatgaggctatagcttcaggagaactaaaggcaaaaaaagcctaccagaaatgggctaaggaagtatctgaaatcaaaccgcccacaaatcctttgaggaggagggaaaagtcaaataagcagtcagagacagatctatgtgcaatcatagcacaacgccgaaatgagagaaaagggcagtttgatttaatgttctcatctctagtttcaaaatatggtggtggtgatacgccagaaccctctgaagaggagtttgaagctacacggagaaagctggagactggtagatcctctaaaaactcgaagcaatcaaagcgaaagtaa

SEQ ID NO: 40989 - DNA, 1947 bp, Glycine max
  Peptide Sequence Number=SeqID_157767
atggagacagagaacggtgacaccaggtccaaaaagatggaagagtatgaagtcatagagcaaattggaagaggagcttttggctctgccttcctcgttcttcacaagtccgagaaaaagaggtatgtgctgaaaaagattaggttggccaaacagacagagaagttcaaacgtacagcacaccaagagatgaacctgattgcaaaactgaataacccatatattgtggactacaaagatgcttgggtggagaaggaggaccacatatgcattataaccggctattgtgaaggaggtgacatggcagagaacataaagaaagcccgagggtcattttttcctgaggagaaggtctgcaaatggctgactcagttgttgatagctgtggactacttgcattccaatcgtgtgatccacagagatcttaagtgttccaacatattcctcaccaaagacaacaacattcggcttggtgactttggtcttgcaaagcgacttaatgcagaagaccttgcttcctcggttgttggaactccaaattacatgtgtcctgagctcctcgctgatataccttatgggtataaatctgatatgtggtctcttggttgctgcatgtttgagattgctgcacatcaaccagcttttcgtgctccagacatggctggacttatcaataaaataaacagatcctccatttctccactgccaattgtttattcttccacactgaaacaacttatcaagagcatgcttaggaaaaacccagaacataggccaaccgcagctgaattgttaaggcatccgcttttacaaccttatgttctacgctgtcataatgcatcatctaatgttcttcctgtatatcccctagttaatccaaaggataaagcaagaagacctaataaatctagtggtggcaaggaccataaggacaaagaagcaggtttagtaaattgtttggaacggattcatccaattgagggaaatgcagatatacagataagcaatcttcctaatgatgtggtaacaatttcaaccagtgcagaagacaatcttgagaccaggatggctaatcttaccagctacatagttgaatcttctactagtattagtggctcaaaagatgggtcaacaacatctgaatcaactatttgcagtgtgtgcaaggaggactttaaaagtagacctgcaagggaaatgactaacaatgagatctcttcaaagagtacacaagattctctgcatgaagaacaaagatttgctgctaaacattttcataaattagaagacgacgacataaatgcggtgactgcagaagttgaagatgcttcttgcaatggaggtttggataatgctgaagcacagagggaagattcaaaccttgaggactctggtaaatcaacaatgtccagtgaaggcagtagcagcactgataaagataagtccatcaatgaggaaaggtcatcacttattgtacatcctattagggttgaaaatgacactgaatctggaaaccgcttgaagaaaagtgaaaaccctgatgtatatacagaggtccctcatatgaactgcttaatgtctgttagtaatgatgcacttccagttaaggatgatgacatagcaaacggacacattctttgctccacgcataaagatgataatgtagtggaggttgatcaggcaccgagtggcatttcattgagtgtaataactgaagtagatggtgatgaaacaatcaagactccgttggatagtccctgccagcaaagagctgatgctctggaatctctgctcgaattatgtgctcagctactcaagcaagataaactcgaagagcttgctggggtgctaagaccatttgggaaagaagctgtctcatcaagagaaacagcaatatggctagcaaaaagcctcatatcttcccaaaagtttaatcctgaaacctaa

SEQ ID NO: 40990 - DNA, 165 bp, Glycine max
  Peptide Sequence Number=SeqID_157768
atggcaaaacttggagactgtgcagctcatttttttattgcagcaatggttttgagcacgttttacgtgaccaaaactgtggcacaatcagaaattgcacccacatcgcaaatggagactggtgcaggtgaattgcaaggcatattggctcctattcatgtttga

SEQ ID NO: 40991 - DNA, 336 bp, Glycine max
  Peptide Sequence Number=SeqID_157769
atgactcttaaagtgacttttgaacggaggggtattagagggtttttgggtgtgaaacgaagaggcgttggtgattggaaggtacactccttcgtcctttctttttgcattcctttcttttttgcttccatcctcatgtcttcttctactaaggagtatagatctcctaccaagggtaggtccctcgtggctaaggaggttaagggcatagaggagtctgaggatgagttgtccacttcatccccttcatccatctttgattcaaaaggaacaaaggattttttagtgagtggaggtgaggaggtggagatttgtgaggagacaaggaagatatag

SEQ ID NO: 40992 - DNA, 408 bp, Glycine max
  Peptide Sequence Number=SeqID_157770
atgtcagattctaatacctaccctatatatgggaattatgcaaaagactccatgcatactcttagagattgtgaagagctcccaaaattttcagcttataaaatcaatgtggatggttcctacaaggctacttcgggcattgctgcttgtagtggctttattagagacgataatggcgatgtcacaacctggttccataagaaactccttccttgtaatgccccgttggttgagttacggggtcttaaatttggtattcacttggctaaagacatgaacctacactctgtctgtgttgagtcagattcccttgttgtagtcaatttggttaaaggtgatttagttacgcctccttatcttaagagtatcatccaaagcatcaagtttgacttgagaaagatgggttag

SEQ ID NO: 40993 - DNA, 333 bp, Glycine max
  Peptide Sequence Number=SeqID_157771
atggcgcagaagaagaaagctagggtttccgacgacgaggaaatggaagtgcaacatgatcaaaccagcctttaccaggttcttggcgtggagagaacggcgtctcagcaggaaataaagaaggcgtactacaagttggcgttgcggcttcaccccgataagaaccctggtgatgatgaggaagctaaggagaaattccagcaactgcaaaaagtgatatcgattctcggggatgaagagaagcgagctctctatgatcagactggttgtgttgatgatgctttgaccttatttagtaagacaaggctattgctcttgctggcgaatcaatga

SEQ ID NO: 40994 - DNA, 447 bp, Glycine max
  Peptide Sequence Number=SeqID_157772
atggagatgtacgttgccatctccattagaattagagaccttgatgtagctacatgtaaagcttgtaggccttggatcttcttcatcaatggactcctttgctttttgaagatcaatggcagcaaattggagaaggaggaaagcccactaatccaagatcaagtccaagattctccactaagtgtgcttaggcgtcatgaggcatgcgccctaaaatacaaggggcaacaccaagtcaactcggaagaggcacttgtgcgccatcaaaagtatgaaccacatttacgcaacgagaagttgaatgatggagcctctaactgcaagggcagtggtgcagatgtaacccttgaaggaacagataatgtctccatcaagcagtcaataaagttcaactggaaggcttcaaacaaccaagcagagtacgaatctctgatagctagcgattga

SEQ ID NO: 40995 - DNA, 264 bp, Glycine max
  Peptide Sequence Number=SeqID_157773
atgatgaggaggaatttgacctgtcccttggtcgtggggaattgtacgaggatgtttattcctcacatggcaaaaggtcaaggggatgtgatgctatggagtgctttggatgatgcgtgcgtaatcaatctttcaggtcagccaatagtaactggcgcggatgactttggctacaatgctcaggcctctggtgtgcattcctcaaattcctatgtgcactttgttcaggacgtactccatatggttttcatcgatccactttag

SEQ ID NO: 40996 - DNA, 276 bp, Glycine max
  Peptide Sequence Number=SeqID_157774
atgcagaagtactaccatctggtcaaacaactcttagagcatttcgtgcataaggaactggcccatgttgacaggggacagaaagaccaagctaatgctttagcccgcctggttagcactaagagaccaagtcagcaccagacgtttatccaggagacctcacctcccccaccatcgatgttatcgaggtcttctcaagtgggattgctcctagcggatggatgtctcctatatggacctacctggtcaccgacgccttgctttaggaggcagtag

SEQ ID NO: 40997 - DNA, 210 bp, Glycine max
  Peptide Sequence Number=SeqID_157775
atggctcaacaccgcattggccacaatggtgtttgggtggttcatggtgggtggcaagaggtggagacggggaaggaaggacatatttgtccgttatgttttctatggggtgcaggaaggaaacaaataggtgctggaagtaaaatcggagttacctcgccaaaaggcccagaaatagatgtttatcacaaaaaaaaaacagatgtttaa

SEQ ID NO: 40998 - DNA, 285 bp, Glycine max
  Peptide Sequence Number=SeqID_157776
atgaagctaaaaaatctgagtcctttatttgtagaaaactccaaagaacctaaatggatagtcagtcagaacaatagggatttttgggctcttggctctatagcctgtaaaaggtggtgggaatcagattcagattcagatttcagagtcctccccttgggaatgtgtagtctaccttcttccttctgtgcatcaacagtgttgctttgcttcttattaatctcattctctctctctctctcaaacactactatcagtgtgctgttgctgttgctgtatgtgtaa

SEQ ID NO: 40999 - DNA, 369 bp, Glycine max
  Peptide Sequence Number=SeqID_157777
atggaggccatgaaggaccaaatgacctccatgatggaggccatgatgagtattagaaggatgatggaggacaacgtggctgcaattgccaccaccagtgccgccactgaggtggatccgactcatctatctgttataaaccaaacaagtcatccagccccatacatggtaggtcagggaggagaagtattgggaagtatgggtggtccccatatggtgcaaagtaagaattctttcccaccgtacggcttgccacctaagtatacaccacccaatgcggtgcacgtgcccagtgagaatgccaaccactccattctcgttctctttgaaagccagcaaccccagttggggcatgcaccctttgcttaa

SEQ ID NO: 41000 - DNA, 213 bp, Glycine max
  Peptide Sequence Number=SeqID_157778
atggaaaagactgacccctctctcaataaagacgaagggattgcacaggatgcagatgcaccactgagggaaatggaacaagagctgaccttccatctagatccatggtctccaactattaatggatacttggaggctgtggtgattaacaagaaacggaagaaaaatgaagaagacatagtgaattcgacaaaacagcataaaaaaaattag

SEQ ID NO: 41001 - DNA, 634 bp, Glycine max
  Peptide Sequence Number=SeqID_157779
ttatgggcatgggaacgatgcccaacgttagccccgtcagttattcctccacaacaacaaaacgcgccacttgcttacagatggttaggaggtgaattgcatcacataggcaatgacaatttacttgagtttcgtcgtaaattagatgtcatgaaacgcgacgagggtgaaatctcggaaacactacattttatggtgtcgcctgctgggagaagggtttgtacttttgacgatttactgccatgtatcgagaagatcactcttctatatgaagaagaggataggatacttgaggcacatcaagatgctcccccttctcagccacaatttgaacatcaacagtttaatatactacagcgaagtgtggagactcgaggcttagggcgacgtcggcaaactgtggatgcagcaccgtacagtttgcctccgatgccagaacgagaacatggaatgtattacacaccgccagtattcacccaagaaccatcgcagatggcgccgatgtattcatacccacatgatttccaaccagggtacagtatgacaggcatatttggatcctctcctccttcaggggggactccttcattcacccaaaataatgaactaccgaccccaaatgccccacttggtg

SEQ ID NO: 41002 - DNA, 336 bp, Glycine max
  Peptide Sequence Number=SeqID_157780
atggaacttatgagactaaaacaacatgaagaaaatgacaagaaaaagaaaggaattgcacttaaagcctcatcttctattcaagaagaaaaagatgatgatttcagtttcttcgtaaagagattcaataagtttctaaggaacaaaggaaatcaaagaagaacaaacttcaattcaaagaaaagaggagaagattcatcttctgttccaaagtgctatgaatgtaatcaatctggacatctaagagttgattgccctagtttcaagagaagaatggaaaaatctgacaggaaaaccttcaaagataagaaagcaaagaaagcttacatcacttag

SEQ ID NO: 41003 - DNA, 279 bp, Glycine max
  misc_feature (4)..(4): n is a, c, g, or t
  Peptide Sequence Number=SeqID_157781
atgncaagtcagaatgagtcgtctttctcgattcctgctttcatttgcctggatcgtctttctccgccggcatgggcacatacggatcgccgctaccttcaaattgcttactctatcgcgggtgagctttcgggagtaggcagcgttggagtaagggcattagccaccataccatgtcgtcgaaagataagccagtccatgctagaactatgcttatcagggcttggaagacccttcgccaaagggcgttgctacttttactttttgtgtgactactga

SEQ ID NO: 41004 - DNA, 180 bp, Glycine max
  Peptide Sequence Number=SeqID_157782
atggaatacttacttgtcggtgatgaacaaaagcgcaaaacggaatcaaaaaatgcgaaaaaggatgaccctagggctgcaaattcgtcaatcccgtgggtatggcttttgaaaggggggaaaagaagggtggctcgcccaggcgagcccagctcgcccaggcgagcccagctcgcctag

SEQ ID NO: 41005 - DNA, 279 bp, Glycine max
  Peptide Sequence Number=SeqID_157783
atggtgatgcaatcctaccccctaagggcattggataaaagactccaagaagattgggccagagatgcaagaaaaggtcctagggtcatggccatcaaagcggggcatgttgagcttcatgtgagggcggcgaaccggagagggagatgggttaagaggagaggaaacctgaccttgggtgaggcaattgatggcctcctccaatctgtcggtggtgacttgcctagtatggtgctcaggcatattggtggtcggtcagaccatttgttagccaactag

SEQ ID NO: 41006 - DNA, 456 bp, Glycine max
  Peptide Sequence Number=SeqID_157784
atggcggatcccaacacatctgtttcaatcgtaaaagagattgaaaaatttggagtggcaagaacaggggcttgggtcatcaaaccaaggaagccttgtaatgctgtgggagttatcggaatcggccaggctaacatagcctccactttgtctgggtttggagccacttcttgtgccaaaatgatgtggttgagaggagaacacaaccacatatttcctcagaaatggttggagcgcatcattcatggttgcttgagaagtagaaggggcattataaaggccaaagggcatgaccttaaactcataatgtccctagtgcatttgaaaagctgtcttatgaatgttccgtctttcttcttaactaggagtatcggagaagagaacagactatggctaggttggattaagccaacagcgagcatagcagtgacttgcttcttcacctccattttctga

SEQ ID NO: 41007 - DNA, 393 bp, Glycine max
  Peptide Sequence Number=SeqID_157785
atgctagatgatagtggtcttattgatggtggtttccaagaatcgactttcacttggaggagagactgtaatactcaatattttcatggagtgactactattagaagaaggaaaaacacttttgaggctattcaagatactaatggcaattgggtagctaattctgatgagttggagaggttagttactaatttctttgctactctttttaaagatgatactcctagatctgatctatgtatgaatggtgtctttccacaatttcctacttataaattggattggttcaaagaagtcatttctgatgaggatattcacaaagttgttttttctatgggtaatttcaaggcccttggaaaagatggtttccaagttgtcttctataaaagctag

SEQ ID NO: 41008 - DNA, 243 bp, Glycine max
  Peptide Sequence Number=SeqID_157786
atgattgtttacctttggccttttctaacttatatttgtaaggtgtacctccttttgtcttacatcccttgtgaagcaggaatatttggaatagtcgatgcccccaatgctgtagcaacattgaccattccaacaactatatttgaccagctcacgccagaagctattgacaaaaatggggtccttgtcggagaccagactacgcaaaaattcgtggagcttgcaaaccatgtcgagaaatag

SEQ ID NO: 41009 - DNA, 213 bp, Glycine max
  Peptide Sequence Number=SeqID_157787
atggcttgtggtggccaccattggtcgtgggtggtggaggaggagtttctagggtggtttggtggagttttaagagagggaggcatgaaaattgtgtttttcatgctaaagaacatatttataatctacagatctcgcttaactagctcgtctcactcaacgatggctcacggtggccaccgttggtcgtggtggttgagaaggagtttctag

SEQ ID NO: 41010 - DNA, 438 bp, Glycine max
  Peptide Sequence Number=SeqID_157788
atgaaagagtctgagacaattaaaggttactcaaatagattgcttaacatcactaacaaggtccgggaacaaagaagattgatgagagaggaatcaacagtcaaaggagctttagcagtcaagccacaaaatgtgaccaaatacaagaactttgatggatcaggatcaagttcaaaatcaaccaatgcaaaaggaaattggaagaaatcttatccgccttgccaacactatggaaagaaaggccatcctccatttagacgttggaaaagacttgatgctaagttcagtgagtgtaatcaaatggggcgtgaagctattatttacaaaagcaagaatcaaccacatgctgaagttgcaaggtctattgatcaagaggaggagaaggagtacttgtttgctgctacatgtttctctagcattgaatcaagtcaaaattga

SEQ ID NO: 41011 - DNA, 447 bp, Glycine max
  Peptide Sequence Number=SeqID_157789
atgaaggttcaaccaattgcaattgacatcgattccaagaaggtgaaggacactggcggaaatagcagcggtggtggtggttcggaacgagtcagtgctaaagtcgcgcttgagaagctaggtctgcttggtgaaaacggtgcagaatttcatggaggagcagccactggcgcgatgctcgtcatggaagaggatgaggatgaggagactcttctggtgagggttgtcgcgcgcggtgatgaggatggtggtggctgtcacgtgcacaccgacctggatgaagaagatgaatgggttgaggcggtggggccaggggtggattgggggctggattgtgaaggaggaggaggaggggagggaggcagtggcggggatgctgttggcggtgacgaccaccgtgaagagcaacggtggcacgggagagaagagggagaagaagattgttag

SEQ ID NO: 41012 - DNA, 360 bp, Glycine max
  Peptide Sequence Number=SeqID_157790
atggatcgaagttgtatgaaagaatcacacattagtgacgagtatgagaatggggttaaacaattccttcaatttactgaatgtaaggcaccatctttgcgtgggaaatttttctatccatgtgttaaatatggaaataggagactccaattagtaaatgacataagatcacatattatatgtgacgggatcattcccaattacaaaaaatggatatggcaaggggaattgccagacatgccaacagtctctcacactgagctggttgatgtagacatgggacatcgtatagaagacatgattcacgttcttgggcaagatgattttcagcaagcacatgcaacatgcacctttgtatga

SEQ ID NO: 41013 - DNA, 216 bp, Glycine max
  Peptide Sequence Number=SeqID_157791
atgtcactgtacaaacttggctactacagcaacctgctaaatgtaattatcaaaacaaccatgcaagatctagccaagaacgttgtggccaccatagtcgaggccatgccatgccactccaccatggcacttggcaaaaactcagtcatgcaaggttgcaaagagaggcagagtcgggaagaccaagctgagacgaagaagatgcaacgctgctaa

SEQ ID NO: 41014 - DNA, 112 bp, Glycine max
  Peptide Sequence Number=SeqID_157792
tcacggatttgaaaactaaccagttgaagaacaaagaacgcacgaagaacggcggaaaatcttcacgaaattgctcacggaaacgtctcagaagagttacggaagcacctcg

SEQ ID NO: 41015 - DNA, 429 bp, Glycine max
  Peptide Sequence Number=SeqID_157793
atgccaccaagcctcctaggtattgggtggtctttcacaaccatatggatgacaattgggagtgatcgctacatacgagtacaacgtatatcgatctctaagctcccaactccaaaaagtatagtcttggagcccgtcaagagtagcaaagtgagacttatgaaacataatcacatacctcatcatcttgtagaagcaaagcttcatgatgaatcaagattgattcaaagatgttttgatgataacaaaggtgatgacaaaaagctcaaaggtcaatcaaagaatgagttcaagatagaatcaagaacacttcaagattcaagaggaaagttaatttcaagaatcaagaatgaagattcaaggatcaagcttccaagaatcaagatcaagattcaagactcaagattcaagaatcaagagaagacttaa

SEQ ID NO: 41016 - DNA, 192 bp, Glycine max
  Peptide Sequence Number=SeqID_157794
atggcggaaaggatcaatgaaagcaccaatgttaggcttggctttcgaggcccaagcaacctccgtggaaggagaaggtcgttgttgagcgtcgcacttgaagaagcgggtggtgttgcagtagatgaactcagtggcgcgcatgttgttagcaatgatggaggcggagagggtatagcaattggggagtga

SEQ ID NO: 41017 - DNA, 288 bp, Glycine max
  Peptide Sequence Number=SeqID_157795
atggttgtttccaaggtggttgtttttcttggtctgattctcgccgcccttatgtcagtggcttgctcccaatccgctgctccggctcctgctcctgctcccacaagcgatgtttttgatccaatggataaaaaagacacctgtaatcagtgttatgaaaaccggtttggtcatcgacttgatcaaggcaccggattagtaggtcagaggtctaatcggctgcatccattaagtgatgacgtgatagacggagtgttacgtcatcacgcctactcactaaccacataa

SEQ ID NO: 41018 - DNA, 1408 bp, Glycine max
  Peptide Sequence Number=SeqID_157796
atgagtgaagaacaggatgaatctctcagtgttcatagcccttactacttgcaccctagtgaaaatccagcaattgcattagtttttcctcttctggatccaacgatttacaattcttggagcagatcagctttcatggccttgagtgcgaagaacaaattgcaacttccattcatcaaagcatcttatggatggacaacacaattaatatctggaaagattagaaagcacgatactcacaagctaataataacttgggacgagcttgagagttatcaaccagatcctgtgtgtacatgtgtttctaaatgtagttgtgatgctcttgttgaagttaagaaaaggaaagatcaagatagaataatggagtttatgtgtggtctcaatgatcaatacaatcatgttagatcaaacatactcatgatggatcctttgtcgttgattaacaaagttttctcttatatggcacaacaagaaagctactatggtagagataatcacacagcagaaacatgttataggaaaaatggtttaccgcctaacttcttctccaatagaggaggtaaaggaggtggaggtagaggggggacaggaggcaaaaatagtagtggtaaagtttgcacctgctatggtatcattaatcatacagtggatgagtgctataagaagcacagttatccacctagtcacaaattctataaacttcaaggagtttcagttaataacactgttaaggaagaagaaaatgtttcaagttcagagactagtgataatggccatgacattaaaatcactcaacaataccagaggatgattggtacagttgatgtagtggaaggtctatacaagcttagagtacttactgccaatccagttcccaaggctaacaacaatttcatttctattaagtctgtgttgtcttgtaataaagaagtcgttgatgtttggcagtttagcactctcactaataacaggaagaagcttgatcctagagcttctgcttttgttttcttgggcttcaagcctcacactaaagggtatattatctttgatctttcctctagagctacaatggtatttagacatgtcattttccatgaagattgttacccttatgcctcttctagtgcctctcaatcttttcccacattccttggacattcttgtcctaccatttatgatcatggtaaagaattggatttttcctcaccaccttcacactctactatccttgataattctcaatcacctaacacttctattgatcattcacaattggattcctcagacacttcttttgatatgtcaaattcaccaattattgttgctcgtagaagatctagcaaggaaagaaccaaaccaaagaagtttcaagattttcacactacattcacatcaactattactg

SEQ ID NO: 41019 - DNA, 947 bp, Glycine max
  Peptide Sequence Number=SeqID_157797
catatgcgacaactggaagaggaaaatctgcggctgaagaggctggttgccgatctgagcctcgacaaggcgatgctgcaggtcgtgctggcaaaaaagagctgacgctggcacgcctgcgcgaatgggtcagggatttgcaagtccgctacggtgccagtgagagacaggtctgttttgcgttgcgggtcagccgcagctcgtttcgatatcgttctgtggccgccgacgacagcgcactgcggctacgcatccgtgagataaccgaaacccgggttcattacgggtaccgccgggtacacgtgatgctcaggcgggaaggctggcgcgataatcacaaaagaatctaccgcctctactatgagcagggtttgtcgctgcgcctcaaacggccacgccgcaataaatcagcccagcgccgacaaccgcagcctcagggtctgtattcgaatcacgtctggggcatggattttgtctctgatgcgttgtttgacgggcgacgactgcgcctgctgacggttatcgacctgtacacccgcgaatgtctggggatctgcgtggggcagaatttgcgttcaacagaagtggtagaaatgctgaatagcatagcgatcagacgtcctttgcctcagttgctgaaaaccgataatggttctgaatttgcagggaaaatgctggacagatgggtgcacgaaagaggcatcagaatcgacttctcacgcccgggaacaccgacggacaatgcgacggtggagtccttcaacggcaggttacggcaggagtgtctgaacgagaactggttcatgtctttggaggatgcacggtgcaaaatcgagggctggcgcatacactataaccagaggcgtccccattctgccctgggctggatgacgccttccgaatttgctgagaaatctgccggttggcagaatatgcagccagaatga

SEQ ID NO: 41020 - DNA, 438 bp, Glycine max
  Peptide Sequence Number=SeqID_157798
atggaatcatattcacaagatgtattagatgaagatatggactttggtaagatattatcgaaaattcagaggagcaaaaccaacatgaaatgggaattcgaggctggcatgcttgcagcatttggaaaggatccagaattgtgtatgaaggctgtctgtgctctttatcggcagcaaacttctgtggaacagttgagcaagggagcattgctctccaaccagcgtggattcaataagtttgatgcttacaactctaaaaaactaacacaccccatgcccgaaggctccttactatgtgaaggtatgggggagggtcattttgtacatagccttacccttgcatatgcaaagaggctatttccagatttgaacccataccaaccggtcattggagcacaactttatctctgtgccagggcttaccctctttggcattga

SEQ ID NO: 41021 - DNA, 264 bp, Glycine max
  Peptide Sequence Number=SeqID_157799
atgttttcagtttcccgccccgttaacaccacaccttcccctgctgtacacagtgattacacaccacgcgaacgctttattcgtctgccggaagtgctttacaccaccggtctgtcacgctctaccgtttacgagatgatgacccgcaagcagtttccggtccaaatctcgttgggtggcaaaaatgtcgcctggttggcctctgaagtggagcagtggatggatgagcgtattgccaaccgtcatcaggggaccacagcatga

SEQ ID NO: 41022 - DNA, 684 bp, Glycine max
  Peptide Sequence Number=SeqID_157800
atgggagaagagaaagaaatgttagacccaaatgttgttggccgtagcatgccacaatgttgtcgatgtaatgaattggaagagagatgtaagaaagctgaagtgaggtgtgaggagttgggatttgagcttcaaaagaaaaaggagcactgtgaagaacttggggctaaagttatggcactggagggagaaaagtttgaatttgaagataaggtgaaagttttgagtaaaggacttgaaaggctgatagaagttagtggtggagagataaaaccaattgttgatttggcagaggacaatgacaaagttttacaatgtgaaaagataagagccgagagtgaggttgaggtttggaaagtcaagtacaagaaattggaatcatgggccgtacaattcgggatgggaagggacgacgatgaagaaaatggaaaagagcaagaaagtaagccaataagtaatgaaggaaacttgcatcttgatacaagctttggcttctggcagaatctggagaaggtcgcggctttggggaacaaaaaaattagagatattcagtcagtaggtacaccttctgatggcatatttcatagaagtcatatcttagatgtgctaccaagcaggaaaactaaacagttgacatttcaaaccgaagagtctcacagcaaaaaatggctccgtctactctaa

SEQ ID NO: 41023 - DNA, 143 bp, Glycine max
  Peptide Sequence Number=SeqID_157801
gatcgacgtggaccactggtctctctgcccctggtggtctagtggccaaggattgtactcgtgtgggtttgcatgtctgcttcaacatagacaaagacgctgatgctactgcaggaggaggagaaagaggaggaggtgaatga

SEQ ID NO: 41024 - DNA, 225 bp, Glycine max
  Peptide Sequence Number=SeqID_157802
atgaaaaagagtttacatcaactactcaataagaatctccaactaagggttttagcctttcatggcaaggaagctccttttacactgaagaagaggaatcaagagaaattgtttgcttacaaaggagtggggatgtctcctccacctctaggaatctcacaacaacaacaacaacgccttatcccactaggtggggtcggctacatggatcaacttccgccataa

SEQ ID NO: 41025 - DNA, 144 bp, Glycine max
  Peptide Sequence Number=SeqID_157803
atggctgaggatttaggagcgattgctgaggatttggagcgggtcatcaacctcaggatggtcactgaaggcactgacttatatgacatcatgactcgttgtctgaggagagctagaggaaaagaaaaaagattgtcatattga

SEQ ID NO: 41026 - DNA, 1362 bp, Glycine max
  Peptide Sequence Number=SeqID_157804
atgtcgcactcagccgatcagcagatcgccgacaccgccaacaccccttatgagcagctggatttcgtggcggtggcgctatacggcgacgccgtacagcttaagccgctgaccaagaagcacgcagcgcaggttgacggcgcacatcgcggcgccgtccggcgctgtgccgtaggcgaagggctgagcgccgcagactcggcagaactgatggcggatcttgtgctgattgaaggtgtaggcgctgagctggttctggccgctgttgagcgtgaaagcgctgatggggaagaacgacagcagcagccctttgcggcggcagatcgaacagttgcagctgagggcctcggtgggcagttcggcgtccacggagaaggtgacggcgccgcagtggcagcttccctggaatggcatggcgatgatcctgtagcagggggcgagatcgcgatgttagaacattactatccggccaatatgggcgccaaaccggtcacggacgaacagcataaacggctggtggcggtgcaggcggcgctggaactgatcaaggccacgctgtcggataccaacgacggcaacggcgtggacttccagctgaaggcggcggagaagcacatcggcccgatggccgacgccattcaggaagccctgaacggcgtcatgcaggcgcaggccgcgcagcgcatcgacttctcgccggatgccgccggcgcttatcctgagggcatcgcctggaatgcgcgcgccggtgcgttcctggtgtcgtccctgcgtggcgggcagctcggcctggtctacccggatggccgctatcggcgcttttcgaccggcagtgggcttatcaccacctccggcatgctggtggacgccgagcgcaaccgggtgctggtgtgcaacgaagacgtgggcgtatccctcaactcagcctccggcacgcgcaatcgcgtggcgcaggtgctggagttcaatctcgataccggcgcgctgcagcagacgtacgatctttcatcgttaagccgtgggccgacgctggccaacgatctggcgctcgacgtgcagggcaatatctacgtgaccgacagcttccagccgcagatttacaagattgaccgggcaacgcgccaggtgtcgattctggtgcgctcggcgcgtttgatccccgccgacgcccccgccgcagcgcagggcacgcagccttatctcaacggcatcgtgtatcacccggatggctatctgattgcggcggactacacccgcgggctgttgtggaaggtgacgctggataacgcgcctgcaataagtgaaatcaggctgccgcagcggctgaagggccggacgggctgcggctcaaaacgcccatga

SEQ ID NO: 41027 - DNA, 306 bp, Glycine max
  Peptide Sequence Number=SeqID_157805
atggtgaacgacattttcacactatctaggcacatggaaaacattgtgcaacccaaaccaagtgctggccttaaggggaaacctcaccaacatgctctcactcatcatgccttcttgtatttcaacaaacaaaagcttgggccccctaggcctaagtcatgttttggcatttatcctaattctcgcaagctgtccgcatccaaaaaatggcatttcaccgagcacttggtgggcgcacttttgggtaccaacaacaagggaatggggacaatgtggcttgccccatcatctcagaacacaacctag

SEQ ID NO: 41028 - DNA, 177 bp, Glycine max
  Peptide Sequence Number=SeqID_157806
atgtcgcggaacttcacagattgcttaacgatgggtgtcaagttcctcgaagcggtcaagcgaagattgcatgccatcaaacaatggtccccggacgacattagggaaccgattgggaaaataaaaaaaactgtattttcccctcaccgggggcggaggacgcatgaacagcgctag

SEQ ID NO: 41029 - DNA, 219 bp, Glycine max
  Peptide Sequence Number=SeqID_157807
accgtgggcgagagatggaggcagtttaaatcagacctcacgaggaaatgggcccttgtagccgatcaggacggtgcggaggacactgtctgtgagaaatatgacattagtaaggaaaaatgggcccagttttgccagtctcgtagagacccttcttgggaggatgtgcgcaaaaaggcacaggccatccagaagcagaacactcctgataactgctaa

SEQ ID NO: 41030 - DNA, 309 bp, Glycine max
  Peptide Sequence Number=SeqID_157808
atgaaacgcaggaagagggattttatagggaagaaggaagtgcttggctgcctaccactagtgttcgcgcctggcaggccaccacttcccccctgccccacctcccctgtcaacttgtcacgtcacgccacgtgtcaatgttgtgttgcacgtgatagaatgctaggcatggagtcacgtgtttctttgctggcagcagtagagagagagagtacagagacacgtgatggcaaagtagaccatggagacgcgtgctgctggagtttgagccgcatggaaccgcgcatgtcaaacaacatgaaaaagtag

SEQ ID NO: 41031 - DNA, 384 bp, Glycine max
  Peptide Sequence Number=SeqID_157809
atggctctctaccttttcaacctttatctttcattgggcttgggcttgaatggagctagcatgatccatgtggctagaagatatttggatgtggatgattacttcaaggatgctgtttttgggatttctatggagggaacctttgttgagggaataaaggaagaggttgtactctcccctgcgcatgctctgtcccttatagctgtcggagaagatcatgtgagagaacacatcccagtcatttcttcaatgctttgtgctatgcacttctatacggatatgtgcaaaagagggacttacataggttgtaacaaactttcatatgtggcaagaagtgtgaaaagcattgaaataaatttagagactgaaacgggatttatgtga

SEQ ID NO: 41032 - DNA, 336 bp, Glycine max
  Peptide Sequence Number=SeqID_157810
atgaagattaactgggtaaatatagtcatggaaaacatgttgaagaccaaacaaattgggactttccaatgcccttgtgtagttctcatctcaaggattctagaccacttcaaggtggatgtcaccaatgagatagaaaactttgtggaacttgagtatgagttgaagattaaggtgttgaagcagatgagatacattgaagttgatgatggaagtggctggattgagaagctcaaggacaccccaattgaggacactgaagaaaagcccatgactctgcttgagatgatgatgatgatgatggcaaagatggacaaattgctgatgattcattag

SEQ ID NO: 41033 - DNA, 321 bp, Glycine max
  Peptide Sequence Number=SeqID_157811
atggaggagcactatggagatgtctaccagtttaactacctaaagaaggactcgattcaacctaaatttatgaacctagcttggttgaaggtacaacactttgtcttccctaaggttttggagtaccacggcctgcagaagcttgtgggaaaatttataaccatgagccatgatttgtggaaagaaattgatggcctatcagatgaagggatgataactaatgagaagggactccaagatgtaggagtgaagttcaacaaactggccacctacaagatcatgatgaagaatcctaaagaggcaccaaaaggaaagacatag

SEQ ID NO: 41034 - DNA, 144 bp, Glycine max
  Peptide Sequence Number=SeqID_157812
atgaagaagactttggtgttctgcggtggtggtgcacccaaagggaacatgaccattcgggttatgcatgagtatgaccttactttgaaggagcttggtggtaccaatcctgggcaggtttcgaattctacaaaggattcttaa

SEQ ID NO: 41035 - DNA, 459 bp, Glycine max
  Peptide Sequence Number=SeqID_157813
atgggagatcacttggaggatatgattcgtgaccttggacaagagtcttttcagcaggcacacgcccctatgtatgaagtattgcagagtgattcaaagaagcctttttatacggggtgcaagaattccttaaccctgtcgtctgcggtgttaagtctgcttaatgtgaaggccaggcctaatactccaattagtctaggtctaattgcatggtgtgtttgtgccaactttgctggtaaatgcatcaaaccctatttgatagaacaagctttttcttccctatttggcttgacaaaatatacaatggtaaaagccaatgccaacaagaaacacaaccctccaacatgttacatttatttgatcacctgcattcagatccacctctatcttgccatttatttgatcaactgccaagttgtctatgtaatcattgttcttgatcagtttgtatcaaattaa

SEQ ID NO: 41036 - DNA, 171 bp, Glycine max
  Peptide Sequence Number=SeqID_157814
atgacgttacgcttagcgccaccctcatgcttagcgcgacgtgcggccttgatattgatgcctgccatattcttctgtcgcgctaagcgccctgaagttgcgcttagcggtggatgcgcgcttagcccaactgatgagataagctcaactgtcacttttagcacttcatga

SEQ ID NO: 41037 - DNA, 459 bp, Glycine max
  Peptide Sequence Number=SeqID_157815
atgacgccatcaagcaacacttatgcatacaggatgctgctgctgcatacaggatgctgctgctgctgtcctttgcatacaggacagcagacacttgttatacgaatcggctctccacgcaatcgagagaatgttgctgctgtcttgtggtcactatgcaccagagatccactgcaattaaaactagcgaaagaacatggtgcagaagcagcactgcaggagttgtcagaaaatggaactaatagagctaagataaaagttggaagcatattggaactcttgcagcgaatggaagggggacctgctatcaagtcagcagcaacagcagaaccaggtagtcaaaaaggaaagaaattggaaggtgggaggtggggagaagttaagattttgggaggacccttggacacaaaatgctataccattaatggacaaataaccaaggctgtaccgaatttctga

SEQ ID NO: 41038 - DNA, 152 bp, Glycine max
  Peptide Sequence Number=SeqID_157816
atggcatccttcagccagcttcagtcacagatgcaatctcaggcacctcctgagcctctagttggtcctggtccctccggtcctcgggtgagcacaaaggggagttgtgttgatccctcaggaaacgatcctgagacgggtgactctgacag

SEQ ID NO: 41039 - DNA, 1383 bp, Glycine max
  Peptide Sequence Number=SeqID_157817
atggctagtataggaggttgtgccacgcgcctagccagtcgcgtgagagaatggaaccggaatccggaacttcgacttctcggaatccttctcaggtcactgttgtcttgggtgaatctgtctaggaatttattattagcgtatcaaagctttggtgtggtgtatggagatctgagcacttctcctctctatgtcttcacaagcaccttcaaggggaagttgcagaatcaccatgacgaggaaactatattcggcacgttttcgttgattttttggacccttactttgattccgttgcttaagtatgtattcatcctattgagtgctgatgacaacggggaagaaaggttatatgaactgtgtgattgtgatccgagcatgatccttctgtcatcaggtggaacattcgctctttattcgctgctctgtaggcatgccaagtttaatttgctccccaatcaacaagcagctgatgaggagttatcatcctataaatatggtccctcttcacaggctatagcctcttctcctctaaagaggtttctggagaaacataaaaggttaagaacagccctgcttgttgtggtattgtttggtgcttgcatggtcattggtgatggtgtgcttactccagcaatttcgggtgaacttgtcctgcttgcctgtgtcatattggttggactgtttgctctccaacattgtggcacacacaaagttgcagttatgtttgcaccaattgtaataatctggcttgtatcaatattttctattggggtgtataatacaattcattggaatccaaaaatagtccgtgctatatcgccatattatatcatcaagttttttagcaggactggtaaagaaggttgggtttctcttggagggatacttctttgtatcactggaactgaagctatgtttgcggatcttggtcatttcactgcttcgtcaataaggcttgcatttgcgtttgttatatacccgtgtttagtggtacagtatatgggtcaagctgctttcttgtctaaaaatctcgactctgttgataacggtttttatgactcaatacctgaccctgtgttttggcctgttttcataatcgccacccttgctgcaattgttgggagtcaagctgttataactgcaactttctccatcatcaagcagtgtcatgcgcttggttgctttccgcgagtcaaagttgtacacacctcaaaacatatatatggacagatctatatcccagaaatcaattggatacttatgatcctaactcttgcaataaccattggatttcaggacacgaccataattggaaatgcttatggtaatttattcccatatgagcctctctctctctctctctctccatgcttatggtaa

SEQ ID NO: 41040 - DNA, 123 bp, Glycine max
  Peptide Sequence Number=SeqID_157818
atggagaaagaggagagtaaccaaatgaaacaagtgtcaatgatggagatgaaatgcacacttgaatatgaacagcgtctacgtcaaggggaaaggtcggttgtcatttactcattgatatga

SEQ ID NO: 41041 - DNA, 852 bp, Glycine max
  Peptide Sequence Number=SeqID_157819
atggcttcttcttcttcttctcttctcccaaggtcacacattcccacacccctcatctccaaaatcagctcctcccccagaacatggagcctcttcattctcacatacccttcacaccccaaaaacaacaacaacaacaacaacaacaaaagactattcctttcccccaccaatgcagtgtacactcaaagcccctacaccccttccacaccctccaagaccgaactccacaacgaccccatcaccgtcctcaacgagaggattcggcgcgacttgagcaagaaggaggctttcagaacggtgatggactcggaggaggcggggaagtacatgaagatggtgaaggtgcagcagcagagagggttgcagaagttgaagggcgacagagagagtaaagatggggtctttagctacaaagtcgacccttacacgctccgttctggggactatgttgtgcacaggaaagtcggagttgggaggttcgttgggatgaggtttgatgttgccaagaattcttcacagcccactgagtatgtcttcattgagtatgctgatggcatggcaaagctacctgtaaacaaggctgctaaaatgctctatagatatagtttgccaaacgaaaccaaaaagccaaaggcattgagcaagttgagtgatactagtgcatgggagaaaagaaaggttaaagggaaggttgcaatacagaaaatggttgtggacttaatggaactctatctacataggctcaaacaaagaaggcctctctatccaaagagtcctgccatggccgaatttgcagccctgtttccgtatgaacctacgccggatcagaaacgggtgacgttatactaa

SEQ ID NO: 41042 - DNA, 411 bp, Glycine max
  Peptide Sequence Number=SeqID_157820
atgtaccctctcttgttctcagttacaacaacccaagtagatgtaccctctacttgtaccactaaggatgtaccctccaatgtgttaagacaaagttctcaggcggttagtcctttgaatctttgtgaacgggagacaaaagatatctcaggcgggagaagggagacacaaaagaattcaggagaacaaggtttggaaaccaaaaaatttagaaagctttttggcaaaggaagaagaagaaagatgagaagcaaaaggtttcaagatttctcaaaagtagttcaagaaattctaaaagttgtaagagttgtaattggtaatcgattaccagagagtaaaaactctggtaacttagataattttgagaaaaactattttgaaaaacaaatatgtgctatgtttgttctttga

SEQ ID NO: 41043 - DNA, 714 bp, Glycine max
  Peptide Sequence Number=SeqID_157821
gcatttattgatgttgagagggatttgacagagagagaaactccaatggacagattaatttgtggagatgttggttttggtaaaactgaggttgcactacgtgctatctcctgtgttgtctcagctaaaaaacaagcaatggttctggcaccaacaatagttctagcaaaacaacattttgatgttatttcagagcgcttttctgtatatcctgatattaaggttggactactaagcaggtttcagaccaaagcagagaaagaagagaacttggacaagattaagaatggtagcttggatattatcgttgggactcattcactcctaggagaccgtgttacatataacaaccttggtctgcttgtggttgatgaggagcagaggtttggtgtcaaacagaaggagaagattgcttcttttaaaacttctgtggatgtacttactttatctgcaacccctataccacgaactctttatttagcattaacagggtttcgtgatgctagtttaatgtcaactccacccccagaaagagttcctatcaagactcacctttcttcattcagtgaggacaaagtagtatcagccatcaagtatgagctggatcgtggtggtcaagttttttatgttctgccaagaattaaaggtgattctcagctaaaaatttctatacagacatttaaggcaccaaactttaataagttcattaactaa

SEQ ID NO: 41044 - DNA, 798 bp, Glycine max
  Peptide Sequence Number=SeqID_157822
atggagaagtttgctctgggtgaaataaaaatccttatctgcacaaatatagtagaaagtgggcttgatattcaaaatgcaaataccataatcattcaggatgttcaacaatttggcctcgcacagttgtaccaggagaggcttgctgctattgaagaatgccgcgaacttggtcaaggcttccaactagcagagaaagacatgggtataagaggttttggtgcaatttttggtgaacaacaatcaggagatgtcggaaatgttggtattgatcttttttttgagatgctcttcgagagcttgtccaaggttgaagatcaccgtgttgtttcagttccttatcactcagtgcaggttgacataaacatcaatcctcatctcccttctgactacattaattatctggagaaccctttgaaaataataaatgacgctgagagagttgctgagaaagacatctggagtctgatgcaatttacagagaatttgcgccgccaatatggaaaagagcctcgctccatggagattttactgaagaagctttacttgaggagaatggctgctgatttagggataaccagtatttactcttcagggaagatgatctatatgaaaacaaacatgagtaaaaaggtattcaagatgatgacagagtccatggcatcagatttacatagaaattcattggttcttgagggggaccaaattaaggacatcagaacagactggggactatcagttgataatggtgaatatgtgcttcctttcaagatgtataatcagagccacatcaatgag

SEQ ID NO: 41045 - DNA, 240 bp, Glycine max
  Peptide Sequence Number=SeqID_157823
atggttgagctcatccttaccctctactgctgctgctgctggctcctcaggagtcctacaaatagaggaactggaagaatagatgtagatgtagatggggcagatggaattggtgctagggctgaggaagggggaatctcaaaagatgggggagcctcagacctcttccccttggccttgcgcgaccctctgaaagtaactaagaggtcatctaggttccaacagtttttctttacataa

SEQ ID NO: 41046 - DNA, 366 bp, Glycine max
  Peptide Sequence Number=SeqID_157824
atgaaccaccatagttctccgttgaaaccccacaccgagaggaacccttcaatcggagtggaatcttccaaacttgcctcgtggtttcggttgagaatgaagcccaatctgaccttcacggttttcttcgagaaaagctatgtttttgacgattgggatgcgacatatttattgttgatgtggctattgatgactttaatagggggggggggctgcattgaccttgtcggatgtcccttgtgtgggaaactagagtggttaaagaatctaagcatttctgaggggatgcttaggagttttaattcatccatggtcattgtacttgatggtgcccatgttttatacctcatatggcatgggaaatag

SEQ ID NO: 41047 - DNA, 448 bp, Glycine max
  Peptide Sequence Number=SeqID_157825
atggatttcagaaataaacttgacaacgataccctgagtcaaatactcatgtcactacatgaaaaggctaaggggtatttcaggttctacaaaaggagcatcattttgaaattttgttcatgccaatgcaaccgtggttcaatgaaggatacgcttaaactaccaaggaacaagattagaatcacggttacctcgaagaaaaccgtgaagggttcctctcggtgtggggtttcaacggagaactatggtggttcatggtggatactggtggctatggtgatggagaagaagcttgagacgttggaaatggttttggaagaaggaaggagaaagaaatggtgtttttccaaggctacacgaatcacaaaggttgaaacactcaagtgcttctcctctcggaaaaggaagcgtttctcacacgccaaacatcgtaacaccgatcgcaacg

SEQ ID NO: 41048 - DNA, 114 bp, Glycine max
  Peptide Sequence Number=SeqID_157826
atgaacgcgctaagcggaccatgtcgcgctaagcgcgttcatcctactgatgaaccaaggctaagcgcgccctgtgcgctaagcctgagtgttattcggttgaggttgagctaa

SEQ ID NO: 41049 - DNA, 1029 bp, Glycine max
  Peptide Sequence Number=SeqID_157827
atgggttcgaaatctaccctaaggctcatgagaaccctagggccttctcttgcatctctggcccaatcttcttggagtcttctatccaatgcccttaggggttacctcatgttgcctatggatgggttccatatgtcactggtggaagataacttgctcatggcaatggttctattgattccttgtgagaaaggcaatggcactgaaaacttggatgtgttgattggagacataggcttcccggcctgcgttgggggtggactggatgattgtagagtgggagttggtgttgcctcattatcagatgaactagagccatcaaaggatgggatcttgatgggttcctttggtgtcaaggacttgcatccaactcttgtcttcctcttctttggaataaaagaggggatcataagttgtgatttgcctttgactccttctgactggagtagtccgaggatgagtcctctggactttgccctgctgctctctaaggagtctttgatcctttttagcgagtccaaaagtcttcatagctttatcttcattagtcgttctggtcagcttcttctgcctcctttgttgaatatcattttgatcaatatgagggatgggcatatttcttctaatgtcaactttcattgccttcaagttgacaacaatgaagtaggatttgttgatgagggcgacatagtggatgtcatccattcttctcagagttttcatgttcctaagaatgttgatgtagaccgtgtgtggaaggtcgaatggaatctcacccatcagatggaagagcaaaacattcctctagaacattctgataagttttgggtatatcatcagagcgtcgttggagtaatcgcagattctgtagagaagcaggtggtggtgcctgtggtgataatggtggtggcaagagcaatgtttttgttggagtttgacatgataaatggcagcggaatggagaaggaagagagagaggagacgccacttcaaggagaagatgagtctagaagaagctcaccaccatag

SEQ ID NO: 41050 - DNA, 639 bp, Glycine max
  Peptide Sequence Number=SeqID_157828
atggaaatgctagaagcccgcatccaacaccttcatcaactacaaaaagttgacagagctaaatataaggcaacttggaaaattaggcaagaaaagaaagccaaacaaagagttgatgcagcatccaaacgcacaactgctgtcaaaaggaaagttgaactgacaagacccaacaagatggtttccaaaccaactactatacctgctgaagcacccaaaatggttgagacaactccggtcacagttgctatggaaccaaaagcaaaggcgaatgaagttccaactgaatctacctcacatgaagccacctctaaagatgcaactgcagttatcatccatgctaccagctctggacctactccaatcaacttttctcctctagaggtagtgacaaaaactgaggtgaagaagatgattaggctggctatggacagctttgctgaaaaccaaaaggctgagaatgaagtgttcaaatgcaccttgcaacaagcgattgttactcaattcagtattcttggtgagtctctcattctgaacctacaacaagcccaaatgcgtctgtccagtgttgttgttgcacctatgtcgcttccatctacccaacctccaccactggtaacccacacttccaacccctaa

SEQ ID NO: 41051 - DNA, 360 bp, Glycine max
  Peptide Sequence Number=SeqID_157829
atgaaacatctaaggcattcagagcttacaactcaagaaccttatgaactgtggaagggacaaaatcccaacatatcatacttccatccttttggatgtaaatctttccttcttaacactaaagataacttgggaaaatttgactcaaaaagtgataatggaatatttctaggatactctgaaacatctaaggcattaagagtttacaacttaagaatcttaacagttgaggaagctattcatgtaaagtttgatgataatgagtttgataaagacttatcagagctagatgagtcctttgtagatcttagtctggacaatggtattaaagaaaagaaaccaagtgaaaaggaagggtaa

SEQ ID NO: 41052 - DNA, 354 bp, Glycine max
  Peptide Sequence Number=SeqID_157830
atgtcaaactccaacaaaaacattgctcttgccaccaccattatcaccacaggcaccaccactattcacattgatggagaacctactactcacgatgaacactacttcaatatcaacatgctagaaggttgtgttgtccatggacaccatcgcatatgtcacaggatgcataagaaaaaggaagcacatagcaggaaggctaggagaagaccaatgaaaaccatgtcccaaaagctctctatgggaagaacttcaaggaggtatatgggaagaaaaatgagcattacaacgttctatatgacatggccaaaatctggtccaacatcactcaaaaaagtttcttgcataaagtag

SEQ ID NO: 41053 - DNA, 564 bp, Glycine max
  Peptide Sequence Number=SeqID_157831
atgcttagggttcttcacaatataggcatttgcatcatcaaagtggatgagcttttggccttggaacaaggtgttcgaatcctgggagtagttaaccagctgaatcttctattttctgttggtcatgtcttcattgaagtagagcttgaagcccttcttcttcccttaatcacagatagggagtcttgggcaaactttgccaagcaccatgttgatatcagtacatctgctgatgtggtgctcaaaggcataaccgaagtgagctgttcgaacccagttaccgtgcaagacgaaagattattcgatgatttggtcaagggtgagaaagataggggcaaaagagtcatttcagctcacctgggcgagcaaggttacttcagggtgaagcaacaccttgcttgggcaagctgcaaggaaataggttcagtattgaaggttattgagagaagagggaaagaagaagaagaaagaagagaaaacgagactgaggcaataccgaatcgcgaccgtaatcaacttgtacatcgttcttcgttcggtgttctttgttcgtcatctggttag

SEQ ID NO: 41054 - DNA, 357 bp, Glycine max
  Peptide Sequence Number=SeqID_157832
atggtcaggatgagtcctcaatggttacctaatggtaccactagaactacttttccatcacctgcaccatctaaggagaagcagaagcaatcagccaagtccagtcatccacttgagagggcattcaagctcacttcacctgtagtaatttccagcatggatccctcaaatgagaaccctactcctcaactactgtggtccaaggagtatattgtcgcaacctaccctttgacgggagggcgaggtgaaaagccaaaggagcatcttccaaagaggaaaacacgtgagagtctccaccaacgtttatttgaggaaaacggtgttgcccttgctcctacgtatcctcaggtgcgatga

SEQ ID NO: 41055 - DNA, 357 bp, Glycine max
  Peptide Sequence Number=SeqID_157833
atgggattcttggaagctgcatatgtggataacggtgctgtggatgtccaagaaagtgctaagaaggaacgtgagcgaattgaggagttgcttagaagtagaggaattagatatggctcttaccctcgtttcactgtttacgttaaaggccaaaaggtcagtattaagtttcaaattcctcctaattgtgaagtttcacaacttatcgcaaatcttactgcacatcttggaacaaaagctgaaggccatggtggtggttcagacatgttattacgagcttgggacagtttgccaattgagaaaacaagatcatcatgtgttctcaatcttcaaaacttcttgaaaggagttttttaa

SEQ ID NO: 41056 - DNA, 321 bp, Glycine max
  Peptide Sequence Number=SeqID_157834
atgggaaccataccggggctcaacctgaaacatgtcaaaacacccgttgcactgtgtagccatttgagaaagcatataaaaagttcaatctctttcaggaatagcagagacccagagaatttagcccttcaaccaatctcgaaagtaggattgcatcttttctcgattagcagcatttccaacattcacagttggaattatcttgtcaggcctcaaaacctgtatgaagataaagttctgagaagctggagtgctcactatagggaacccctaaaagaaggaagaaaaacgacttgtaaactgtactgctctactagataa

SEQ ID NO: 41057 - DNA, 657 bp, Glycine max
  Peptide Sequence Number=SeqID_157835
atgacgctatccaccgcgccctcaccgccaccggcattagaagaggagccgttacctcacgacggcgacgattaccacggcatcgtttcactggacgacgagggtttcccgtcgcaattccccgaatcaggaacggcgtcggaaaagagcagtttcgccgcggatttctatcgcagcggaaccgattggtcctcgctgttgttgtcgctggaagatagtaaacagagcgatttagcgcaagattcggggaagaagatgaagcaggccaatctgttccagatttgggggtttaaaagaaacgacgccattggttcagttgaatctggtcccagtaaaagtggttgttgtgacgacggaggtggttcttctgagaggaagattgtgaaacctgaaaatcggtgttcgatttttcccgacacagggaaagagttcgagaacgcgaaatcttctcgcaagagaaagggttcctgtggtgaaaataggggacaatgttcactgttgatgcttttcgttatgggtgtgttgaagggtgctcagcatattttcttactcatttccattgcgatcactatggtggccttagcaagaaatggtcacatggccctatatattgctctcctctcacaggaaggctcgttcaaatgtgtctctcggtaa

SEQ ID NO: 41058 - DNA, 165 bp, Glycine max
  Peptide Sequence Number=SeqID_157836
atggctcatttacctgaaattccactaggaatatgggagttcagaagcaaaaccagtcaagacttatgtagcgtggaaggaggctgcagaggatacatgtttgccttggaggtgactgaagaacttgagacatggccagagcagaaaaaccacgctcgccaatgg

SEQ ID NO: 41059 - DNA, 240 bp, Glycine max
  Peptide Sequence Number=SeqID_157837
atgcctcagaagaagaatatatgtattccctatagatggacaaaggacaacacagatcaaatgggggaaacccgggagataatagaagtacttatggtttcttcaccaaaacgtgatgaccttgtattcccaaagggtggatgggaggatgatgagactgttacagaagctgcttgccgcgaggctttagaggaagcaggagttaaaggaatactaagagtaggttcaatttccctctag

SEQ ID NO: 41060 - DNA, 252 bp, Glycine max
  Peptide Sequence Number=SeqID_157838
atggcagaagacagaaagcctgagaaccaagaccagaatgtggaacttgaacccccttcaattgtagaagatatgccagaatgccaaagtatgtcacctaactgctataagagatcctctactatgcagcaccatgttgtttgcttcaccccaatgaaactgaaggcttgtaaaatagcatcatttgtgaaaaccggtagtgtcacaaaagggcaaaagattatgctgcttttgacaacctacaattcataa

SEQ ID NO: 41061 - DNA, 120 bp, Glycine max
  Peptide Sequence Number=SeqID_157839
atggcagaggacaaaaagcttgagaagcaagatcagaatgttgaacttgaacccccttcaattgtagtagaagatgtgtcagaatgccaattattaacaatgaaagaaaaatccggttag

SEQ ID NO: 41062 - DNA, 651 bp, Glycine max
  Peptide Sequence Number=SeqID_157840
atgaagatcttaaaagcgtatacgaagaatctacattgtccagaagcatctattgttgaaaggtatattgcagaagaagccattgaatttttttcagactacattgaaaaggcaaaacctgttggccttcctaagtctcgccatgatgacagagtggccgatacaatctttgtcgatgaaaattcttcagaaacattaagaaagctagcagatgggcctaaaagaaatgttataacttggaaaggatatgacataaacaagtattccttttacacaaaagaacaagatgacaaaagtataatgcaaaacagcggggtcaccctaagggctgaatttgaacacattgcaagtctgcatgatgacaatccctatgtagcttttatcccttactttgggttcattgatgaaatctgggagcttaactatgtcaaatttactgtatgtgctttcaaatgtaaatgggttggcagcgacaccgatgtatggaccgatgatgtaggatttacgttggtagacctaaaaaaactaggttaccacaatgaccttttcatcatggcagaacaatctaaacaagtattttatgtgcaagacccttgtgatgaaaggtggtgcatggttctacatgggaaaataattggtgttaatgtataa

SEQ ID NO: 41063 - DNA, 372 bp, Glycine max
  Peptide Sequence Number=SeqID_157841
atggacattgaagaggatactgagatcccactgattttgggtcgtccattcatgttaatcgccaattgtgtggtggatatggggaaagaaaagcacttacatgacaggaacatctgttctaagatggatgagcttaagaatgagatggttctggtggccagagccaagcttgctccagcccatgagcgagaccatctcgctaagtgcaacctgatgagaatcctaaaactggccaaatacaggctaaaggctcaagtggagaaggataaagcccccgagtggagaaggatgaaggcccaagtggagaaggatgaaggcccagaggcagagacactatcaagactattaattgttgctgaaggcccaaactaa

SEQ ID NO: 41064 - DNA, 348 bp, Glycine max
  Peptide Sequence Number=SeqID_157842
atggagcttagctgctcgtgtaaaagacccccagtcagacagttgttgattatggtgcattcatttgaaccaactcaacacgtcacctttcatgtaaaaagccaccttagaaatgtgttgctccaaaggaacttggtaaagagtaaaaaattgttctacttggaacaactagtcaagtggttcgaatccaccaaagggcattgtagaagtgacaaagaagttatgaaggtggaatggcctaggttggggaaaatgatttgttgttgtggtgtgaaatgtcagagaaggggtgaaagtgggggttgggggttagagggtggtgtgtttggtgtggaagtaattgtgtga

SEQ ID NO: 41065 - DNA, 390 bp, Glycine max
  Peptide Sequence Number=SeqID_157843
atgacatcacgaggaattcgtaatggccatcgaaagtccagaaggcagttttggtgtgtcttcaaaccatacccgtatttggtgatagcactaagtctccatgaccaatgtttggcgaaagagggatatggtggttatgagggcgaggagggggaggggtatgagcatgttcaaacacactggaaaaaactaaaagaagtgcttggaggtttggggaggatccatggctctagtttaatcgattaccatatattcgtaatcggttacacagttcaagttgagaccatgactatttttcgagtctctggtttaatcatttacgagtatatagtaatcgattatattgttcttgaaagtgttcctacaagtgatcaagaacactttaattga

SEQ ID NO: 41066 - DNA, 534 bp, Glycine max
  Peptide Sequence Number=SeqID_157844
atgattattgagacggaagatctcttatgccttcctaacagacatttcaaatctaagggtgaaggagctgccaagagacttcacaagggcctttctattaacattggaaaaactctatctcgggatatattcagcatggtaaggaagaaaggctctccaccaggtctcctatgtctcactattgccctttgtgctagaagacgcataaacatcaccaataactttactcagccatataaggatttgaaacctaccatagatgctcattacatattgaaaatcttttggcaggctctagaatgccaaaagggtagtgaggtagccaatgaagctggtactggaactgaagatgttgttgatgttggtgaagttaaagttgaagtgggacctaatgttgatgttgagactaccatcaccactactgctgatgtgaatgatgaagttggagcaaaggaagagattgtttctaaggacactattatgggtgtgcctcaagagagcatcattgaaaagaaatgtgcaactaccaaatga

SEQ ID NO: 41067 - DNA, 708 bp, Glycine max
  Peptide Sequence Number=SeqID_157845
atgaatccgcgcacgacgtcgtcgtcgaaggcgaagaaaaagcaaacgacaacgacgcaggagtcgccgcaccaaagggcatcatcatcatggggagggaggtacctcggcgtgcggcggaggccgtggggtcggtacgcggcggagattcgcgacccttccacgaaggagcggcactggctcggcacgttcgacaccgccgacgaggccgcgctggcgtacgacagagccgcacgtgccatgcggggctcacgtgcccgcaccaacttcgtctacgccgacaccacccccggctcctccgtcacccccatcatttcacccgaccaaccacaacccgacccggttctttcattcgacccgttttccctcctcgccttcccctccggttcttattctgccagcgtggcagcttctcagtttagccaacaacaacaacaaccagataataataataataataatattattaacaatagcaataataataaagatagcacgatagagcttcctccgttgccaccggatattactagctccgtgggttatgaagggttttacaataatgatggagggtattattgggaggaggatgataattacttgcataatccaatgtttagcacaatgccagcagtgtcagacaatgtggctgcagcagcagggtcgtctcaagtttttgattttggaaactcctcttttttcttctga

SEQ ID NO: 41068 - DNA, 549 bp, Glycine max
  Peptide Sequence Number=SeqID_157846
atgggatcaagtcaaaagcctccgcttcaaaagaggttctatcaagtcaaaatcaagagcttagaggtcactagtttacgagagttggggcaattaatgggtcaacttcaatggcaagccttcgcaaagcctatggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgagctttcttttattgacatcttggcgcttttgatctttggagttgtcctctttccgaatatggaagggttagtggacctagcagcgattgacactttcctcgcctttcatcatggcaaagaaagcccggtcgtcgccattttggccatgtatgacacgttcgaccggggatgcccgtctatccgctacaaggtcaccgctcgtgcgtcgaaaaaggaaaggcgaattgggacaaactcttag

SEQ ID NO: 41069 - DNA, 159 bp, Glycine max
  Peptide Sequence Number=SeqID_157847
atgcatatgacacagatgcaatttacgaatacgggagcccgagaaattgtctccttcttagatacaacgtctaggggtagcaaagtgccccaacaggggatcaagacagaacccatgtgcgatgcatatgcgaaaggcgcaacacaggaatgtacatag

SEQ ID NO: 41070 - DNA, 420 bp, Glycine max
  Peptide Sequence Number=SeqID_157848
atgactgtcgtagataacattaagacaactatccctaagactagaaatgctaaagaatttatggagttagtggaagagtgctcacaaacagttgataagtctcttgttgggacattaatgagtacgttgaccaccataaagtttgatggctcatgtactatgcacgagcatgtcattgaaatgacaaatattacaccaaggtttaagaccttagaaatgactgtgaatgggaacttcttgatacaatttattcttaactcgttatcgtttgagtatggtccgtttcaaatgagctataatagacaaatggaatggatttcttataatccaaaccataaacctagaagagaagttcgtcttcacagggaattgagtgaaagctccagtaaaagtagtcaggacttatcgtttaatccttga

SEQ ID NO: 41071 - DNA, 204 bp, Glycine max
  Peptide Sequence Number=SeqID_157849
tgttgcatgtgtgcttttttcacttgtgttgaagaatggcctgatgaagtgagcctgagcagaccaggctggacacacaaattcgagacatggggcgtggcccataacatcaagggaccattgacggctggcaaaccttgctttacagtttacagtgttgcagatattgtgggcatgtttgcagatgctggagcaagggactaa

SEQ ID NO: 41072 - DNA, 1072 bp, Glycine max
  Peptide Sequence Number=SeqID_157850
gtggtttttggtgatggtgattttaaaccttgggagaaaggaggagcagggagtgcgacttgggaaatacgagttgggaaagacacttggagaaggcaattttggaaaagtcaagttggcaagggacactcattctggcaaactatttgctgttaagatccttgacaagagcaagatcattgacctcaataacattgatcaggcatccaaaggtaaactgaaagaagctgaaggtaggaaaatattccagcagttgattgattgtgtgagcttctgccacaataaaggtgtcttccacagggatctcaagctggagaatgtacttgtggatgccaaagggaacataaagataaccgattttaatcttagtgctttgccccagcattttagggaagatgggttgctgcatacaacatgtggaagtcccaattatgttgcccctgaaattcttgccaataaaggctatgatggtgcaacatcagacatatggtcatgtggtgttatcttgtatgtaattctaacaggataccttccttttgatgacagaaatcttgcagttctctatcaaaagatttttaaaggagaagttcagataccaagatggctatcacctggttctcaaaacattataaagagaatgcttgatgccaatcctaaaacccggataacaatggctatgatcaaagaagatgaatggttcaaggagggttatactcctgcaaatccagaagatgaggaagagagtgtgtatattgatgacgaagacttttcaatccatgatgtgtcacatgaagcagatcaagggtgtccaagatcaccaacacttatcaatgcattccagttgatatcaatgtcttcaagtctagatctctctggtctttttgagcaagaggatgtttctgagaggaagataagatttacatccatccattcaccaaaagatttggttgagaggattgaagacattgtaacagaaatgggattcagagtccagaagaaaaatgggatgttgaaagtgatacaagagatcaaagtacagaaatgtccaggtagcttctcagtggaagcagag

SEQ ID NO: 41073 - DNA, 201 bp, Glycine max
  Peptide Sequence Number=SeqID_157851
atgggaatgcagacgtgtgcaagagctatacagttacggaaaagccatcgcagtctaatacctaaacaagaatttagtcattttgaaagccgaaaagaagaagtattccagaatgcaattttacttttcggattggctattccagaagccaaaaaagaggtgcagggagcaatttggagatgtaggaagcaacagccataa

SEQ ID NO: 41074 - DNA, 1368 bp, Glycine max
  Peptide Sequence Number=SeqID_157852
atggagcgaaggttgggcagagaaaccaaaggctctctaagcctacaaaaaaggatggcagagacacggcgtagggagaaacccgcaccggacctcaccgacttcatgaacgacatgtttttcggggcagcagacatggaccacaaaacctacgacctcacaggtagtacaggtgtgcacgacgacgactacgacgatgaagggttcgacgacagcactagaagcaacagtgcaaggttgacacaagaatggttacgagaggcacgacaaatcgtcgcttcctctccttcacgctgtgactcgccggctcgccctttagggtccccaaggttcggagctacacaaccaccctcaccccttccctcctcctccgaccgaagagacgctctctctagaactaggtctgcccgaagatacagagcaatggaagggatcagtgatgagatactgtcgaaaacagcaaaacacacacgtaacaaatccgacactttcgctcagccttcatcagatggggacggatcccctgcaacggcggtgcacaactggttcgccaacatcctcaaaccgaccaataacaatagcaacacacaaccatctccttctcctcctgattctcctaaatcttctctccctccacgtcagcctcatcctcgaaagtcccgcttcaaaaccgagccctctgctgcacctcacccgcaggggatccagcctcccaattcgaggcgaaccttcaagacttctacgccgtcgccggagaattctccgtcggattctgctcctctttcgccgccgaggaacctcgtggagtccgctcaccggagaacgatatcgtcttcgacatgctcgcgggagaggatcgcgccaaggcatgcttttccgaagggagaggaagctagcctcaacgggttcctcaaagagcagagaattttgcttcagaaaatctcgagaggagagttacatgctgcaaatgcgcaaatcgtgctttctgggccttccaacagcacggcgtccatggtggctgccatttgccacgcgtggctcttaggttataggcagaaggagaacgacggtggaagcgagcgtgtggtggtggttcctgtgatgaatgtgaagcgaggctccatgtggaagctgaagcaggctgcgtggctctttcaccatgctggtcttgatgccaattcattgttattcattgatgaggtggacatggaaagccttttgatgactggccaactgagcgtcctcgtggttggacaagatgtcttgaacactactggcgaggttggatcacaatgcacagttgttactgataattactgtgaggatgcctatgatttactacaaaactatatgctgaagaaactattg

SEQ ID NO: 41075 - DNA, 732 bp, Glycine max
  Peptide Sequence Number=SeqID_157853
atgggttctgctaacggactagctgctatacacgggaaagagcctctcttttcttttggattgatatctgatgtgcagtatgctgacattcctgatggtagatcattccttggtgttccacggtactacaggcatagcattgttgtgttacagagagcagtaaaagaatggaataatagtaagaggcacaagtttgtgataaattttggagatattgttgatggatattgtccaaaagatcaatctcttagcactgtaaagaaacttgtggatgaatttgagatgttcaacggaccagtgtatcatttgattggcaatcactgcctttacaatctgcctcgaagtaagttacttccactgttgaagatcaagagttttgaaagccatgcctactatgatttttcaccagtgcctgaatatagatttgtagttcttgatggctatgacataagtgcaattggctggcctcaggatcatccaaaaacattcgaggccttgaaattccttagggaaaagaatccaaatgaagacaagaacagtccaacgggtttggtgggccttgaaagaaggtttcttatgttcaatggagctattggaaaggaacaaatggaatggttgaatagtgttcttcaagaagcaacaaaattgaaacagaaggtggtggtgtgttgccatctccctctagatcctggtgcatcatctaaggaggcactgttatggaattatgctgaa

SEQ ID NO: 41076 - DNA, 2076 bp, Glycine max
  Peptide Sequence Number=SeqID_157854
atggctgcctacaccactttctccttcttttcaaccccgcagaaccaaaaaaccttttttcttcaaccctttaaacgccacgtttcgtttcttaaaccattcaaatgcgtccgacctggttcagcttcaacccgattcagaccgaaccctgttatttccagctccgcgctccgtacctcggcactggtcgttccctctaaactcgagcacctagcggaggagttcggctccctgcgggagccggtggagcgtgtgaagcggctgctgcactacgcggcggcgatggcgccgatgccggagtccaaccgggtcgacgcgaaccgggtgatggggtgcaccgcgcgcgtgtgggtggaggtggggatcgacgaagagggaaaagtgcgcgtggcggcggacagcgattcggagattacgagggggttctgcgcgtgtctggtttgggtgctcgatggttcggagccggacgaggttatgaaagtgaccaccgatgatttaacggctctgaatgtcgggttgccggggggcagtgggcgttccagggtgaacacgtggcacaatgtgctcgtcagcatgcagaagaggaccaaacagttgctggctcagagagaagggaaggttccctttgagtcttttccttcgttggttatttcttctgatggggttttccccaaaggtacctacgctgaagcacaggcaaaatatctgttccctaatgagttaaaagttgatgaactagtcaatgtgctgaaggagaagaaaattggtgttgttgcacacttttacatggatcctgaggtccaaggcattttaactgctgctcagaagcagtggccacatatccatatatctgattcactggtcatggcagattcagcagtcaaaatggcaaaagccggatgccagttcataacagttctaggtgtggattttatgtcagaaaatgtgcgtgccatccttgatcaagctggtttcagtgaggttggcgtgtataggatgtcaaatgagcaaattggatgttctctggctgatgcggcagctactcgtacttacatggaatatcttacagctgcttctaggtctacttctttgcatgtcatatacattaacactaagttagagacaaaggcatatgctcatgaacttgtgcctacaataacctgtacttcatcaaatgttgtccagactatcctacaggcatttgctcaagttccagatttgagcatattttatggacctgattcttacatgggtgcaaatatcaaagatttgttccaacaaatgacaaaaatgactgatgaagagattgctgcaatacatcctgagcacagtcaagactctattagatcattactacctcgacttcactattttcaggatggaacgtgcattgttcaccatctatttggccatgaggttgtggagaagataaaagaaatgtactgtgatgcattccttactgcccatcttgaggtacctggagagatgttttcattggcaatggaagcaaagagaaggggaatgggtgtagacagggttcaggaagctttggatagaaatatagatgatcatctccaatttgttttaggaacagaatctgggatggtgacttcaattgtggcaacagttcgtagtttgttggagcctgtgaagtcttcttctgaaagagcaaaagttactgttgaaatagtctttccagtttcatcagactcaatctcaacgaccacctcaagtttatcctccggccttcagactgccaaagtgggtgatatcatacttcctgttgtaccaggaatagctagcggggagggctgttcaattcatggtggctgtgcatcttgtccatacatgaagatgaattctcttggctcactcctgaaagttagcaatcacctacccgatgaagaaaatatcctttctgcatacaaggcagagcgatttaagttgcaaacaccgaatggcagatcagtggcagatgttggatgtgaacctatattgcacatgaggaacttccaggctactaaaaagcttccagagaagcttgttgatcagattcttcgtccccaacacagttga

SEQ ID NO: 41077 - DNA, 609 bp, Glycine max
  Peptide Sequence Number=SeqID_157855
atggacacaagcaaacaaactattcccatcaagattccccatcaaggggaaaatgaagattgggacgatgatgatcgagggtctttgatgaaaacttctcgaaagagaaaaactctttcttcgagcagcacaggacaacagggatcaaagaaaattagcaaggctaagactgatgacaaaataaagcttccaccaaaaccacctagatttcaacaaccatccaagtctatcacctccaaaccattgaaggccgatgtctcgaaaggaatagatgattctgatgaggatgtgcatataagctcatttttcaaagccatttcttctgcgacgataaagcaaaatgctaacaaaatagtggatctttcatcatctcaagatctttctcaaactggtgacgacaaggtaatcggaattaatacatgtatttctatcctaacagattcggatataccagtttcgacaattgatgcccacaatgttggagaaatagaaggcacagaaggacaagatgctcaaagtcatagtgtgtcttccccctcaaaggcaatgtcaatttcaaagcccataatcgaagaaaatgtcattgaggtggattcaactcttcactaa

SEQ ID NO: 41078 - DNA, 342 bp, Glycine max
  Peptide Sequence Number=SeqID_157856
atgggtgccaagcacctcacaaggaccaaagaatggtcgcacgtcatcgagcaaaggtccccggacgaaattaggactgttgaggaattacgtgcgggtgctgagaagctttcacaaggaaatgatcttcttgcaaagggaatagatgggttttttgaagttgttatgactagtggcgatactttgctcagatctgtgaggattgataaaactgtaaatgatcgttccccaggccataacagagacatgcaagtagttcacgaattatgcaatagcctaactctgcacaagctggatttcaaagatagctttaggggaggactattgacagatactcattag

SEQ ID NO: 41079 - DNA, 663 bp, Glycine max
  Peptide Sequence Number=SeqID_157857
atggcctctaggaagaggaaagttattgcctccagaccccgggagccctatgacaccactagattcatatctgagggcgcctgggagagatatgcacagaatgtatggaacatccttccagagaggaacgtcatcttatacatttctgagtacgaggagttccaccgggagcttgagaggcggaactggcataaagccttgaccaggcagcctgatggtcacattgatgtggccctggtcaaggaattttatgctaatctttatgattcgaagggtaaatctttgaggcaggtcagagtacggggggagcttataaagttcaatgctgagtccctcaacgccttcctggagaccccgatgatcttggagcttggggagcactacaccatgtactctagattttgtcattcacgtccagaccctcaggagttcgccgccatattatgtattccagggcgcggttttgtacttaatgctgagggagcaccttggaagctcctgatgaaggacctcaccaccctcgcccagacatggagtgtgttatcatactccaacctcgcccttacctctcatacgtctgatcttaacatggatacggcgaggttagtctacgggcttgtgatgaagatggatatggacttgggctcactcatttcaggctag

SEQ ID NO: 41080 - DNA, 1832 bp, Glycine max
  Peptide Sequence Number=SeqID_157858
ttaatcttgacaataagaatggtgagagctatgaagaggaagctaagatcatggctggcgaaatcctacatggaaagccttactcatgtctagtactaaaacccaataaaggtcaaggccctagtgatgggaaggttgagtatgattttgacatctccaaggcatatcggatttttgagcatctgataaaagaccaacaaattcgactgaagaaggggcataaaatacaatctctagacaaattaaaagggaagaaatattgtaaatggcataattcctacatccattttacgactaattgcattgtgtttcggaaagatgtacatagggctttgaaagaagatcattttaagctagctaacaaaggtttagccaaaatggaagtagatacagaccctttcccaaagctagatattaatatggtgtcttatgaagagccttctagtaaaagtaaaaagacaaagcaaaacgggatgaagactttacatatcactgccaacaatgaggacaatggttggttaaaaatgattaagccttttgctaaaaaagaggctataaagaaaatgaaacaaacattagcaataatggcatatttgaaagctagaagccaaggagaaattacaataaataaggtggcacttgccttagaccaagcttttggagttgacaccagaagaatgaaccaaaatggaggagatcaagccaaagttcaaggaaacaaatacaaccttggaagccaatgggaaaaggatgtcacacaagatatctatcaagatcatccaatggagcaagagttgaaacaaatagaagattcattgctagaagcatggttgaatgatgatgatttactaagggctgaaataaatggtaaaaccatagcaagagttttcgtcgattgtggtgccattctcaacattatacctctagctacgagaccaagtatgttagttaatgattgtccatttttgcctgatgttaggatggctgaagccttgttttattctccttacttggatcctatccaaattcctaagaatcatgacaaagataggatagtcgagacagctatggttgatacgccaaaggaaacagagcctcgggatagctattggccatcatgcgagaatcgcctagttttgaaacactacccatcaaggttgtttttaagcgacatcgacaacctcctagatgatgcaacccataattactacctgaaaatagaaaggatgctagggcaggctacttccaagaatgaatatgtgatgcctatagtcgatatgctggtagatgttgcggccatacataggtgtcttggtgcacttgggatctacaaaatgttggtgatgtcatttggattgaagaacgttagagccacctatcagaaagtcatgaatcttattttccatgatgtcatcgataagaatatggaagtttatattgatgatgtagtggtgaagtcagccgatatgaatcaacatttggccgatttagagcaagctttgcaaaaaatgagatttcatggtttgcaaatgaatccaactaagtgtgttttcgacgtactagccaataacttcctgggatttctagttcatcaaaagcctaattcggctagaaaaaagaaggcattctcaccactactgaaagtaaaggataaagatcagtttacttatgaggaagaacaaaaactagcctttgaccaaattaagcaagttttagatgcaccttcagttttagtgccagtgccaccaatactaggcaaggcattaaagttgtacatatttactgtgaaacagtctattagatgccttttaacacaagatgctgaagattga

SEQ ID NO: 41081 - DNA, 366 bp, Glycine max
  Peptide Sequence Number=SeqID_157859
atggagattataattcaacaagctcagggttcaactcaatcaatcatatataagctcaacatgggtgcaagggattcatcattcatgaacaagcactaccaaatttgtcattcaaaatttgctacggaggttccagagggtagtggagtggcaggagtgggagctggtagtgctggtggaggagctggaactggaggagtggaagaagaaggagtagaagtgtcaggtcccctagccctagtcttgcgggttcccagaaagggactcaaaagtcagagaatcggatactactcctctggctatgcacaaagctgtaaaatgtgcaagaaagccaagccgagaggagttgaactgggccatctgtaa

SEQ ID NO: 41082 - DNA, 1131 bp, Glycine max
  Peptide Sequence Number=SeqID_157860
atgacggagggaaaaatcgtctcgtgggtcaagtccgagggcgacgtcctctccaaaggtgacagcgtcgtcgtcgtcgagtccgacaaggccgacatggacgtcgagacgttctacaatggcatcctcgccgtcatcgttgtcgccgagggccagaccgcccccgtcggtgcccccatcggcctccttgcggagaccgaggccgaagttgccgaggccatggcagccgccaattctgctccaactccacctcccaaagcttccgatacttctccggcgccggcaccggcgccggaagtctctgattcaccacgtaaggcggttgcaacaccgtatgccaagaagctcgcgaagcagcacaaagtgaacataggttcggttgtcgggactggtccgtttggaagagtcactcctgctgacgtggagaaggccgccggtattttgccggcggagagcaatgtagctccggcggcggtggattcggctccaccgaaagctgctgctgcggctccggcggcatcctcggcttcaattccaggttctagtgttgtggcctttacgacaatgcaatctgcggttgcgaagaacatggtggagagtctctctgtgccgacgttccgtgttgggtacccagttaccactgatgcacttgatgctctgtatgagaaggtgagaaaaaagggtgtgaccatgacagcgattctggccaaggcagctgcaatggcactcgttcagcacccagtggtgaatgcctcgtgcaaagatgggaagaactttgcctataatagtaacattaacattgctgttgctgtggcaaccaatggtggtttgattacaccggttcttcaggatgcagataagttggacttgtatcttttgtcccaaaaatggaaagaactagtggaaaaagctcgtgccaagcaattgcaacctcatgaatataattcaggaactttcacactttcaaatttgggaatgtttggagttgacaggtttgacgccatacttcctccaggccagggggctatcatggcggttggagcatcaaaacctactgtcctagcagataaggatggtttctttactgtaaaaagtaaaatgctggttagtataatcgacaagtttgtataa

SEQ ID NO: 41083 - DNA, 600 bp, Glycine max
  Peptide Sequence Number=SeqID_157861
atgctagctgcttcttcctatcattctcctttgttcgtatcaattggtccgacctactgctctccagtggcgaacgccgaaccttcctccgccagcctggaccgcctcgaggccgccatagtcaaacttgctacagctcaactccgcttcgccacgacccaagcctccatgaactccaaacttgatgccattttcctgaaattgaataccatggtacccagccaaccttctccatcttattcctctgcgaagtcaccaccaccaaccgaaaccatgtcgcctttgcttcccaaggtaaccagccaatttttccaatcttcttcctctgcaaagccaccaccaacagcaaaaaccatgccgcctccccttcccatggtagcttcccacctccccattaacgccaagcactatgcaccctcctccgacccccgccaggtcgccagtcatcggttttgcacggagccccccagctgccacatccttccctctgacctccacttatcccttttcgttgtgttcgctgccaaggtcagggacatggagcttgaccaccccttcctacttcctacacccaacaccttgaggacaaggtgtttttga

SEQ ID NO: 41084 - DNA, 1086 bp, Glycine max
  Peptide Sequence Number=SeqID_157862
atgggccatgttggtatcatggatcttgaatacagtagaaccttctttgtgacaatcgtgtcttatttggaaaccgccaaagagctttgggatgacataaaggagagattttcagttgtgaatggtccatgcattcagcagctgaaactagacttgacccaacgcaaacaaggaggtttgtccatggtggcttatcacggaaagctgaaggctctatgggatgacttggccaactatgaacaactatcgacctgtacttgcaaaggcctcacgtgcggtaagatgtactctattctagaacatgaagaaagattacggattatcacacgaagcaaagaagaaagaatagaagtcatggccttagctgctcaagcaggtgcaaggattaaaaggcgtgagaaaagaacagatctgtctgcacgaattgcaacaaatctgggtgattgtcccagaaatgatgacaagataggtggacgaggaagaggtcagaatcgcactgaaggtactggatcaaacagtagatgtgcacagaagggtccagtaaatgctcatgttgtccaaaacttgggatccaacattagtggagatatggagaattctggcatgacaggattgagcaaggagcaatggcaaactctggtagaattgcttaacaatttgaaggtcactccaaatgaaagcatgattggtaaaactaaactcaattcatggatccttgataatggggcatctaatcacatgataggaaccttgcaacacctatgtgatgtatggaaagtgcctgggtgccctgttggacttcctaacaggcacaccgccacatctactaaagaaagaacaataaggcttgttggtggtttaagacttgaaaacgtgctttatgtgcctcagttgaattgcaacttaatttctatatcacaattatcagatgaatccaattgtaatgtccagtttactgctaatctatgtgtgatacaggaccgcactttgaagatgctgattggagcgggtgaacgaagggatggactctacttcttccgggaaattttgaaagtgaaggcttgcagagttgaagggataacttaa

SEQ ID NO: 41085 - DNA, 471 bp, Glycine max
  Peptide Sequence Number=SeqID_157863
atgagcagatcattaggtgcttatttacgatgctttacagctaagctccattcagtgttccatgtttcacttctatgttgctacatcggaccgccacccacaactctgacgtcccttccaaaggaagtatgctccatcaaagaagaccaagagttcatcgcaacagaaaaagaaaaggcaacatttgaatctccacactcgcctgatgctcaagtacctagtacttggaaagtggaactcaacatcgccctttttgaccaatcaacatcatttaactccaattccaagacagtgtgtctagctagcactcacactactcaagacacaaacacaggctcttctccatcctccgatcaagtgatgattcgtgtgcatcccgctacaagcgaatctacaccgttggcaacaaacacagatgtgccacaacaaattctagacacttctttggtcattgaggacgagaccttttga

SEQ ID NO: 41086 - DNA, 717 bp, Glycine max
  Peptide Sequence Number=SeqID_157864
atgcaacaactaccacccgaaaagaaagctctcaggtgcaaatgggtgtaccgcatgaagtatcacttggatgggacaattgaaccttttaaagcccggttagttatactcgataatcatcaagtagaagggatcaactacactaagacatttgcgccgattgctaaaatggtcacagtgtgtactgtcttagtagtagcaacaacaaaagcttgggaacttcaccaaatgggcatgcacaatgcgtttttgcatggagatttgcatgaagaagtgttcatgaaaatgcctcctggattttcagcttcacaatcggacatggtctgcaagctacgaaaatcactttacaagttaaaacaagctccacgctggtggttttccaatttctctattgctctcaaatcctttggatttcaacaatcatatcttgattactctctgttcattttgcatcgagaagacactcaacttgtggttcttgtctacgttgacaatttgatcattactggcaatactccttctgccatcaagcattttatgctctacctcagtacatgttttcatatgaaagatcttggtattttgaagtattttttgggtattgaggttgacagaaatcctacgggaatttttctttgtcagcataaatatgcgcttgatattatatttgaagctggtctccttggtgctaaacccgctgccactccattagagtag

SEQ ID NO: 41087 - DNA, 294 bp, Glycine max
  Peptide Sequence Number=SeqID_157865
atggcagggtcaaaagaaagcatcggcatatcctcaatgtggtgcgagctttgtgatttcaaagaagtttacccattgaattttggggcgaatggggatatttacactacggaagttgttgtaacatatactattgtgattccagaacctccagatatacagatcccaaacactcatgatgagaatgaaccattggggcgtggctgtcatgtcaaatatccacctactcaattacaagactacgtcatacacatgattaagaagttatctcctttcactcgttcatcggcttaa

SEQ ID NO: 41088 - DNA, 273 bp, Glycine max
  Peptide Sequence Number=SeqID_157866
atgcctggactcagcagagaattggtggaacatagattgccaatctgtgaatgcaaaaaaccagtaaagcaagcacaaagaagatttgctcatgatgtcttagaggctatcaaagtaaagattgaaaggccgctgaaggccaagtttattcgaactataggagatttaaatgcagaaacccctaaagatgaatacctcatgctaattgctaatatgttaattgattcaactgtaggcaacaaaattttaagtctattagatggttattcatga

SEQ ID NO: 41089 - DNA, 963 bp, Glycine max
  Peptide Sequence Number=SeqID_157867
atgatctctttcacagtctttgttttccttacactcttgttcactttgtcattggttaaacagctgagaaagcctactgcagaaaagagaagactactacctccaggaccaaggaaactacccttcattggcaacctccaccagcttggtacgttgccacatcaatcccttcaatacctttcaaataagcatggacctctcatgttcttgcagctgggttcaatacccaccttggtagtttcctctgctgagatggccagagagattttcaaaaaccatgactcagttttctctggcaggccttcgctatacgctgcaaaccgtttaggatacggttcaaccgtgagttttgcaccgtacggtgagtactggagggaaatgaggaagatcatgatcttggagctgctgagtccgaaaagggttcaatcgtttgaagctgtgaggtttgaagaagtcaaacttctgcttcagaccatagctctttctcatggtcctgttaacttgagtgaacttaccctttcgttgaccaacaacattgtgtgtcgtattgctcttggtaaaaggaacaggagcggggcagatgatgcaaataaggtttctgaaatgcttaaagagacacaggcgatgctgggaggattctttcccgttgacttttttccacggttggggtggctcaacaagtttagtggccttgaaaataggcttgagaagattttcagagaaatggataacttttatgaccaagtgattaaggagcatattgctgataactcttctgagaggtcaggagcagaacatgaagatgtagtcgatgtgcttcttcgagttcagaaggatccaaatcaagcaattgccatcactgatgaccaaatcaagggtgtactcgtggcaggtaatcctagagggctagaggcacctataagagcactaatattcaacaacaaaaaacactataaccagtaa

SEQ ID NO: 41090 - DNA, 1236 bp, Glycine max
  Peptide Sequence Number=SeqID_157868
atggagatggaacgcgtcttcgaatttcctcacacttacatggatcgtcgcccgagaaagagagcgagattgggctgggacatccctgaagttcccaaggctcaggtaggattgttttgtggacaagatgttgggactatttcaagctttgctccttcaaggggtccctcagaacataccactagttctctatttgttaagccagttgctcgaaatggttctcccccttggcgagatgatgacaaagatgggcattacatgtttacgcttggagaaaatttaacttctcgctataagatccataccaaaatgggtgaaggaacttttgggcaggtcttagaatgctgggatagagaaaggaaggaaatggttgccgtaaaaattgtccgtggtataaagaagtatcgagaagcagccatgatagaaattgaggtgttgcaacagcttggtaaacatgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcaaacaactattggaatgtatagcattcatgcatgatttgcgcatgattcatactgacctgaagcctgaaaacatactactagtttcacccgagtatgtcaaagttcctgactacaagagttcatctagatcatcatgttcctatttcaagagagttcccaaatcaagtgctataaaggttattgattttggcagcaccacttatgagcgagaagatcagaactacattgtatcaactcgtcattatagggctcctgaagttatccttggacttggctggagctatccatgtgatatatggagtgtgggatgtatattggttgaattatgcacaggtgaagctttgtttcagactcatgaaaatttagagcatcttgcaatgatggaaagggtacttggttcattaccacagaccatgatgaagagagtcgaccgacatgctgagaagtatgttagaaggggtagattagactggcctgagggtgcaacctcgagggagagtatcaaagctgtaatgaagcttcctaggcttcaggggttacttagatatgacccctctgaaagacttacagccaaggaagctcttagacattccttctttatgagagaacactttagaagatga

SEQ ID NO: 41091 - DNA, 249 bp, Glycine max
  Peptide Sequence Number=SeqID_157869
atggatggtatagacccctgcaactattattccacttcagtaaagatcatcactactattatcgccgcaaccactaacactctgattgttgttataaccaccgtcgttgctaccagcagtagtggcgacgatgacaacaacgatgatcatgttagtaacgacaatagtggtcatgacaactatcacaatgttgttggtggtaacgacagtaaggaggacaataatcatcttgatggtaacaatgattaa

SEQ ID NO: 41092 - DNA, 948 bp, Glycine max
  Peptide Sequence Number=SeqID_157870
atgggcttgatcctcctgggaggcaaggcacttaaggcaataaactcagaatttagtgattctcccttgaggctccaatactacatagtcatcacaggagctgcttactttttttattcattctttttcccaacaatatctgcgatgaaaaattggttgggagcttctgcggtggtcacttttacatatattatatttcttcttattgttttaatcaaagatgggagatcaaattcgaatagggattacgatattggcgaaagtgaagtcatgaacaaagtgttcaatgcttttggtgcaatttccgccatcattgtttgcaataccagcggcttgctccccgagatacagtccactctacgtaagccagcaatgaagaacatgaggaaggccctgtatttacaatatacagtgggagttctgttctattatggtgttaccgtaatgggatattgggcttatggatcaatggtgtccgcataccttcctgaaaacttaagtggtcccaaatggattgacgtcctcattaatgccatcgtctttttgcagtccatagtcacccaacatatgtttgtagcaccaattcatgaggcattggacactaagttcctagaaattgacaaggccatgcattcaggggagaacttgaaacgcttatttctcctacgtgcgcttttctttacagggaacacattcgttgctgcagcatttccttttatgggtgactttgtaaactttcttggctcattttcactcgttcctctgaccttcatgttccccagcatggtcttcatcaaggttaagggaagaacagctagaatagagaagaaggcgtggcactggttcaacatcgttttttcttttctgctcacaatagcaaccacaatttcagcaattcggttgatagtcaacaacatccaaaagtatcatttctttgcagatgcatga

SEQ ID NO: 41093 - DNA, 219 bp, Glycine max
  Peptide Sequence Number=SeqID_157871
atggcaaaaaagatgaccaaatttgataaatactgggatgtgattcatgatataatgggagatgctattgttttggatcttagctctccaatacttaaaggtggtaatgttgaaggtgatgaattatgttctttgaaatctaaaattcttgagcaaagtagtactttagtgaatgagataacttcagatgatgaaggtttatgctatataacaatgtaa

SEQ ID NO: 41094 - DNA, 492 bp, Glycine max
  Peptide Sequence Number=SeqID_157872
atggccaagactaggagggtctgccatcttctgttaaggttcttagcctttgcagcaacgcttgcagcggtgattatgatggctactagccatgagacagctaccattttcacagtgtccttcgaagcaaaatacaccaattcccctgccttcaagtactttgtgattgcatattctgttatcactgtctatggatttttggtgctcttccttcctgcaaaaagcttgctatggcaactagtggtggccttggatttggtgttcaccatgttagtcgtctcaagcttctctgcatctttggctatagctcaggtgggaaagaaaggaaacagtgatgcaggttggctaccaatatgtgattcagtccccaaatattgtgatcaagcgacaagagctttaatagctggtttcattgcaatgattatatacataattcttctgttgcattccattcatactgtcatagaccctctcctcttgagaaaaagttga

SEQ ID NO: 41095 - DNA, 1278 bp, Glycine max
  Peptide Sequence Number=SeqID_157873
atgagcataagtactaatagacggcctagccagctagatcgaataagcatccatagagctatcctaataagcaacacgttgaccaatctgattctttgggtccaacaaatctcgggtggaccccaccaagctactcctttgagcattctccatctgccaagtgttaagccttttacgtatgccacgtggctctccaacagaaaatcccaacaactacttatgttcccgcttcagcaactcccttttgccacaatgaacgattccacaaactactgcgtggcttccctcaaaaccgtaacagcccacatcacctgcctggctgtccaccgtaacctcctctacgccgcatccctcaacctcatcaacgtcttcgacctgatttcccattactcccacatcgacgccttcaaccaaagttccacctcaggcttcgtaaagtccatcaccttcaccaattcaaaagtcttcaccgcccaccaagaccgcaagattcgcgtctggctcatcactccctcaaaacgacaccgtctcctctcctccctccccaccgtaaccgaccgtctgcgccgctgcatagtaccccgaaactacgttaccgttcgccgccacaagacgaggctttggattcagcattgcgacaccgtttcgggtttggcggttaaccagaggtttatgtattcggtttcgtgggatagaagctttaaggtgtgggacttgttgagttaccggtgtttggagtccgttaaggcgcatgaggacgctattaatgccgttgccgttaacggcgacggcaccgtttacacggcgtccgcggacgggagcattaagatttggaggagggaaggcgaggcgaaacggcacaagttggtgagcaccacagggaggcggaagtcaacggtcaacgcgcttgcgttggacggcggtggtggcgcggggttgttttccggcggttgcgacggcgagatctgccggtgggagtgtgggaagaacggcgtggtgaagatggagacgctgaggggtcatggtggggccatactgtgtctaatccacgtggcgggtttgttggcgagtgcgtcagcagatctaacggttaggatctggcgacgggagagagagagtagtggtgatggtgggtattgttgcagggctgtgttggaagggcacgagaaaccggtgaagtcgttggtggcattttcggacggtgagggagactcaaacggcgtcgttacgctcttcagtggaagccttgacggggagattagggtgtggagggtgtaa

SEQ ID NO: 41096 - DNA, 153 bp, Glycine max
  Peptide Sequence Number=SeqID_157874
atggcggtaatgaatgcaggcactggagcgaagggaagaggttctgtggaggagggcagaataagtgcagaggtggttggtggtggtggatggctgtgtggagaggctgcaacggaaagaggttatgggaacaagttacttgttgcacgttaa

SEQ ID NO: 41097 - DNA, 1494 bp, Glycine max
  Peptide Sequence Number=SeqID_157875
atggcgaaagcagggaagtcacaagaagaaattgccagtgaagctatcaagcatactttgagggctctgcggaagcgccatttgcttgaggaagctgctcatgctcccgctgttctagctctttctagacccatcgtttctcagggggtggtgataatgggtattaatgctgttacttggatcatgggctctgagtggaaagagaaagaagagaatcttcaagtggaacttcagcaatgctacaaagctcaatctcgcctgtctgagcaacttgttgtggaagtagctgagtccagagcttcgaaagcgttgcttcaagagaaagaaaatgcattggctgatctgcagaaggagttgactgaattgagggatgagtgctctcaattgaaggtggacttggaagaaaagattaaatctctggaagtgattgtcagcgagaattctgaacttaaagcacaactggagcagatgactattaaagccaataaagctgaagcagaaaataagatgttgatagaccgctggatgttagaaaagatgaaggatgctgaacgcctaaatgaggccaacgcactgtatgaagagatggttgagaaactaagggccagtgggttagaacaacttgcaaggcggcaggtggatggtatagttcgccaaagtgaagaaggtgctgagttctttttagagtcaaacatcccttccatatgtaaatacaggcttcgtgcacatgaaggtggttgtgcttccatgttgtttgaatacaattccagtaaattgattactgggggacaagatcggttagttaaaatgtgggatgcaaatacaggatccttaagttctactcttcagggctgccttggctcagtattggatctcacaatcacccatgataatcgatctgtcattgctgcaagcagctcaaacaacttgtatgtatgggatgtcaactcaggtcgtgtccgccatacccttactggccacacagataaagtttgtgctgtagatgtcagcaagatttcaagtcgtcatgttgtcagtgctgcctatgatcgtacaataaaagtttgggacttagtgaaaggttactgcacaaacacaataatatttcacagcaactgcaatgctctttccttcagcatggatggtcagaccatattttcgggacatgttgatggtaaccttcggctatgggacattcaaagtggaaagttacttagtgaggttgctgcacattcacttgcagtcacatcactatccctttctcgaaatggaaatgttgtactgactagtggaagggacaatttacacaatttgtttgatgtgcgatctctggaagtttgtggcacattaaaagccatgggaaacagagtggcttctaattggagtcgctcctgtatcagcccagatgacaatcacgttgctgcagggtggagcggaattggaaaacccctagcttctgctgataagaatgggattgtttgcgtctggacatga

SEQ ID NO: 41098 - DNA, 240 bp, Glycine max
  Peptide Sequence Number=SeqID_157876
atggctatcaatctctttcaagcaaataacttgtttttcgaagtaggagttggaacatccaagaagaatcggtcaacttctgctaatgccaatgctctgaagcttacttctgaacttctccggatttttatcacagaggctgttcaacgtgctgctactattgcagaagcagagggtgctagtcaaatagaacctactcatttggagattattctccctcagttacttttagatttttaa

SEQ ID NO: 41099 - DNA, 909 bp, Glycine max
  Peptide Sequence Number=SeqID_157877
atgactaaccaagaatacattgctgattatttcaacagaatccaaacgcttgtcaatgcaatgaaggcctgcaaaggagagttaacaaatcaacaaattattgacaaggtgctgagaaccttgactctacattttgatcacattgttgtggcaatcaaggaatccaaggatctcgattcaatgaaggtggaggagttgcagaattcccttgaagcacatgaacaacgagtcaatgagaggcgaaaaggtggctggaagaagaaaggaaaaggtaaatggaaatggggaagaagtggaggagttggcatatcatcaaatggtcaagatcagtatcacactgatcttgatcaaggtgaatcttcaaatagaagaagtgcggggcaagctcaaaataaaggaggaaagaaaaagtttgataagagaaaggttcaacgttataactacaataagtgggggcactttgcaaatgaatactggagtgagaaaggaggaaagggaaaacaaaatgatgaagcgaaccttgctcaatatgaagggtcagattcagatcaagtgttgttaatggtaacccgaaactctgaaaatgataactcttcatcttggtatcttaacactggttgttcaaatcatatgattggacgtagggactggttaattgattttgatgcaaatgtcaagaataagacaaatttaccaagtcttggacaattgcttgaaaagggattctcaaaggagatgaagcaaaatcacattgagatatttgattataaacataaattgttgttgaaggctcccttgtccaagaacagaaccttcagagtgaatttaagtgcagttgaggttcaatgcttctcaaccacaaatgctgaagaagaaaagtggttgtggcactgctatttggccatttga

SEQ ID NO: 41100 - DNA, 1158 bp, Glycine max
  Peptide Sequence Number=SeqID_157878
atggtgttgtgcaaaaggggcaaatcacaaacgtgcatagaagagaagaaggcaaaacgttacgtgaaagagaaagagctgtttagagaagtgtctgtggcatgtcgaagccccaaaaaaaaaattggacactgcaaacacatgtcccacacagtgtccgccacgtgtccgaggagtgttggtgtcggaaatgtgtccaacacgtggacatggcattcatcggaagtgttcgtgcttcctaagttatggccatctcctgggcaagtcaagtcagaagacacaacaaaaagtatatcagcagacagccttcttgctttctttattcttgcatgcatgcaacctagatatgattactctggttatgggcagtcatcagggaagccaagtgagaataatacttatgcggacattgaagctgcatataagtatcttgaagagaactatggtactaagcaagaagacataatcctttatggtcaatcagttggaagtggtcctactttggatcttgccactcgtttaccccgactaagggctgttgttctccacagtcctatactatcaggattgagagtcatgtaccctgtgaaacggacatactggtttgacatttacaagaacattgacaaaattccattggtgaagtgtccagtgctgataattcatggaaccgatgatgaggttgtcgattgctctcatggcaagcaattgtgggaactttgtaaagagaaatatgaacctttatggctcaaaggagggaaccactgtaatctggaactctatccagaatacctacgacatctcagaaaattcatatcaataatagaaaactcaccatcgcaggggcaaactttgtggaaaagcataggtggagttgaagaagccagaagaagtgttgattgttttgaagctccgaggatgagtgctgatctaagggacaaaccaaggaaaagcactgataaacaagaacaactgaaatttcaagggcataagttgagtaatgttgaaacagttgagaaatcaaggatctcttttgatcatgtggcaagatctcaaagaaacaaagagaaccatgataaatctcgaaaaagcgttgatgttcattttgggagggcgaggaagagctttgactggctggataaaattcgagctcgctga

SEQ ID NO: 41101 - DNA, 996 bp, Glycine max
  Peptide Sequence Number=SeqID_157879
atgaagattgtgactcctgaggaagcttggactaaatgcaaaccaagtgtcaatcatctaagtatttttggttccctgtgttataggcacattcctgatgagaaaagaaaaaagttagatgataagagtgaagcattaatgttagttggatatcatccaactggagcatacaagctgtataatccaaattctaaaccattgaattgggaacaagccattgagcaaaagcattggagagaggctatgaatgaagaaattaatgccatagaaaggaatcaaacatgggaacttgtagatcctccaacctcaaagcagccaattgatgtaaaatgggtgtttaagttgaaactgaaaccagatgtctcaattgaaaagtacaaggcaaggatggtggctagaggctttcttcaaagggctggagaggactacactgaagtatatgcaccagttgcaagaatggaaaccatccgactggtaattgctattgctagttctaaaggttggcccttgttccaattagatgcgaaatttgctttcctcactggcccattggaggaagaggtttatgtgttgcaatccccaggtagtgatcacttggaaattgaggaattcaaggggagaatgaagtttgaatttgagatgactgacttagaagttctcaattatttccttggtctagagtgtgtttataccaagatagatattttccttcaccagaaaaggtatacccaagaagtgttcagaagatttcaagtggagaattgcaatgaagcagtgacactagtggaagcaaaactgaaactgataaaaagagaagatgagaaagcagtagatggaactttgttcaagcagatagtaggatcgcttagatttttgtgcaataacagacctgacattagttttggagtatgtttggttagcagattcatgagtgatccaagagtttcacacatggttgctgccaagcgtattcaaaggtatttaaagggaagatag

SEQ ID NO: 41102 - DNA, 126 bp, Glycine max
  Peptide Sequence Number=SeqID_157880
atggagatcgaagcaaggatcttctttgtgaggtctacgagcaataccttcactttggcacatgattggactaagcaagtagaagattttctatttgacatctacaattgggctgaacgaagatga

SEQ ID NO: 41103 - DNA, 1353 bp, Glycine max
  Peptide Sequence Number=SeqID_157881
atggatgtagaaggaagagcgagcaagggcaagtctctcactttgaacctcgagcaaggtcaacaagaaaagggtacccaaaatgatgattatggtctcgcttctgctcatgctattgaccaagattcgtggcaacaagtggggctgatgctggtgacaagcttcaattgcgggtggatattaagtttttctaatttggtcatgtggccactgggttggacatggggtatcatatgccttattgttgtgggattctacactgcctatgcaaactggctcttggcagcatttcatttcatcgatgaccgtagattcattagatacagagatctcatgggatatgtttacggcaagagtatgtaccacctcacctgggtcttccagtttttgacccttcttcttggaaatatgggtttcatcctcctcggaggcaaggcacttaaggcaataaactcagaatttagtgattctcccttgaggctccaatactacatagtcatcacaggagctgcttatttcttgtattccttcttcattccaacaatatctgcgatgagaaattggttgggagcttcagcggtgctcactttcacatatattatattacttctaattgttttagttaaagatggaaaatcaaggtcgaatagggattatgatttaagtggaagtgaagtgagcaaggttttcaatgcttttggtgccatctccgcgatcatcgttgccaacactagtggcttactccccgagattcagtccactctacgtaagccagcggtgaagaacatgaggaaggccctgtatttacaatatacagtgggagttctgttttattatggcgttaccgtaatgggatattgggcttatggaacaatggtgtcggcatatcttccagaaaacttgagtggtcctaaatggattaatgtcctcattaatgccatcgtctttttgcagtccatagtctcccaacatatgtttgtagcaccaattcatgaggcattggacactaaattcctagaaattgacaaggccatgcattcaggggagaacttgaaacgcttatttctcctacgtgcgtttttctttacagggaacacattcgttgctgcagcatttccttttatgggtgactttgtaaactttcttggctcattttcactcgttcctctgaccttcatgttccccagcatggtcttcatcaaggttaagggaagaacagctagaatagagaagaaggcgtggcactggttcaacatcgttttttcttttctgctcacaatagcaaccacaatttcagcaattcggttgatagtcaacaacatccaaaagtatcatttctttgcagatgcatga

SEQ ID NO: 41104 - DNA, 456 bp, Glycine max
  Peptide Sequence Number=SeqID_157882
atgagcgtggtatgtcgatgggttcaaggtcttggagttgctctaggggatgtggattctggtgtggattttcacaaatcaaggaggatgtttcccactactgcctataatccacctgaagattctttgagccaagatgtgattgcgactgtagagaagagtatgaaaaaatatgctgacaacctgatgcggtttcttgagggaattagttcaaggctatcacaattggaattatattgctacaatcttgacaaatctattggagaaatgaaatgcgatataaatcgtgaccatgtggagcaagagtcaaggctgaaatctcttgaaaaacatgttcaagaacttattactattctgtttatactgtgtggtttcactcattttgatgtgcttgataaattgcttatagctctaggttgcagttacacaatttgttcttgtattatactagtatag

SEQ ID NO: 41105 - DNA, 159 bp, Glycine max
  Peptide Sequence Number=SeqID_157883
atgcatgctttgttagggtcattcaacagtggaaactggtctgattctgatgaccttgataggacagggctaagttgtgtactatcccgaggaatcgagctccatgtggagcttgtagaccttggatcttcttcatcaatggagtcctttgcttcttga

SEQ ID NO: 41106 - DNA, 315 bp, Glycine max
  Peptide Sequence Number=SeqID_157884
atggagaacaacgatggtttgtggtggctaatggtggatgtgggtgatggagaaactacacgaaagcaaaggctgaaatgcttaaataagagatgctctcgggaacggaagcttctagcacactccagacatcttcttaaagatcccaacggtcagatcatgtacaggtgtcttgtgaagttgcagaccaaatttcgagaagatccaacggttaacgaaggctgggcagtgtttttaccgaggaagcttcatgtagctttctctagaagcttcattaagaggcttcctccagaagcttcctcgtggcttctttga

SEQ ID NO: 41107 - DNA, 291 bp, Glycine max
  Peptide Sequence Number=SeqID_157885
atgggcccaaaatctatcctaaggctcatgagaaccctagggccttctcttgcatctctggcccaatcttcttggagtcttctatccaatgtcatattctcgactagtcgatatcgatctagaaaaagtaatataagggagtacataatggaaatgtctactttggcatcaaaactgaaagcacttaagctagagtttggtgaagacctgctcgtgcatttagttttgatctcacttactgcacacattaggcaattcaaagtgagctataacactcagaaggtcccttaa

SEQ ID NO: 41108 - DNA, 352 bp, Glycine max
  Peptide Sequence Number=SeqID_157886
cgatgaggcgggtcattacaacctcaaacactacaacaacaacaacaacaatttcctatccatagccacaaccccagtgtaccctaaatcctatggtggctactccatagatctgaaccttggaaccccaccccaaacctcccctttcattctcgacataggaagcagccttgtattattgccttgcacctcccactacctctactcatatcaccaagttcatgtcccaaaagtttatatcaaacccacacttgatcgtcactcacacgaagctcgttctagagtctcgatactcactcaccaagttcttcaaaccataatctcaagtgtgatttatgattttttcccctga

SEQ ID NO: 41109 - DNA, 582 bp, Glycine max
  Peptide Sequence Number=SeqID_157887
atggcatttgcatggccatgctgtttggcagtgtttctgcaggtgatgggtttgttgcttgatttggctggtatggagggtacacatttggagagggaggtcttacttgagattgcattggaggtggctgtgaaggcagcacctgctgtgaccattgttgttgctgctgcggttgctgttgttgtggctgttgctgttgctgctgatagtgagaaaattgttgcacaggagatggggttacttgagatggtgttggttgtggagccacgtgttggggtgttcgatattgttgatcggatggtaaatactgattctgtgggtgctggggcacagctggatttggcagaggggtgggtggcatgtaataaggaggctgttgagggacttgagtcacatttggtgcgggagcctgagcctgagcctgaacctggggtgctggaggctgcggctgaggggctatttgatgaggcagagcaagagccaactgctggttgtttgcatcagatgcattggactccagaatatcctggaaatggagattgctgcatctttcagaactacctcatgcctatgcttggataa

SEQ ID NO: 41110 - DNA, 393 bp, Glycine max
  Peptide Sequence Number=SeqID_157888
atgtgcatagattacacagacttaaaccgagcctgcccaaaagatgcctatccattgcctaacattgactatttggcggatggagcggcaagacacataatgttaagttttttagatgcctactcaggctacaatcaaattagaatggaccctgtcaatgaggagaaagcagagttcatagctaagtcgaaaaattactgccacaaggtaatgtcatttgggttaaaaaacatcgaggctacgtatcaaagattaatatacaaggtgtttggtgctaagctaggaagaaacctagaagtgtatgtcgatgacatggtcatcaaatctaatgatttgccaacacatatcaaagacttcaaggaagtgttcggtcaactccgaaagtataactga

SEQ ID NO: 41111 - DNA, 739 bp, Glycine max
  Peptide Sequence Number=SeqID_157889
atggcttcgtctaaaggttgcttgagggagcctgaggagttaggttctagggttagaggtcctagtaaagagcaagtggcgaataacattattcacaacatagagaggtttgctaacaacataattgttgtcatgaatgttgtggtcgggccttcgaagcatctggagtatccgcctattacccttcctgggttctcatgggtagatgggaaagttggcactttcttctctcggtacaatgacaagttggacattgataatcttctcaggcaacttaccatttgtcgaataaagaaagataaacttttccctatcgatttgaggacatgctggactgatgttgatcctttggaccttgcggaagatatcacccaacatcttcaaggttcctcgatagccaacaagttgaaggttgacgtgaagaaggccaaagactctcttgactttgaactttctactaacatcgcgctagtcggagagaatttagaattgaaggcatgcatcgccacccttgagttagagttgaaaggagacgttgaaaaagaagaaaaggcacgaatccagcagaaggcctacgatgatgtgtataaggcacatgcatctggtttcaaccattccctctaccaagttatttttcattgtgaggttctcgatgagtcaatttttgacattgacaaggatgtatataacaagcaattagtccttatagatgacagtatggaggacggtgcccttatcg

SEQ ID NO: 41112 - DNA, 402 bp, Glycine max
  Peptide Sequence Number=SeqID_157890
atgattaacaagtttgagagacaaaaatcactagagacaaaaattgaaggacgaattattatgggttacattaataatgtggatcaagttaggcgttcgtttattggtctcggatgcaattgggcaattacttcctgcacctacagaaaagacggaatggacacaactacccctctcagccatcaaattctcccagtccaaccagcgcccccacccacaacaatttccacttctaccaccactaacacaacaacaccaagaccaacaacagtgatcaactcccagctcccacacgccatcctctgccctcatggagctgccggggagatggtgagtgaggatgcagagttggcgagtagatgcgtgaaaagagattgggaattagacgtagtaataatatga

SEQ ID NO: 41113 - DNA, 366 bp, Glycine max
  Peptide Sequence Number=SeqID_157891
atgaatgtgagaggcctccaagcgacttacaaaggagttaatggagggatatcaatagatgatgttgatgttcatgatgtcattgtgatgatgtatgttgtgtatgtacatgggggtgcagtgaccatgatggatatccctgggcatgtgactcggtttggaacttccgtgtgtcttaggctgatccctatggaaaggggctatttcctgatgaatggtaccacatggcatttgagagttgaggttagggagattgatgcaatcctccctagaaaggaaccagtcaccagagccatgagcaagaggctccaagagaattgggctagagctgctgaagaaggccttagggttctcatgaacctcatg

SEQ ID NO: 41114 - DNA, 99 bp, Glycine max
  Peptide Sequence Number=SeqID_157892
atggtgaaacaactaagagagaaggatattcctttgatcaagtttgtgagcggaggagctactaaagatactaaatttcaaggacaaaatttcttttaa

SEQ ID NO: 41115 - DNA, 1170 bp, Glycine max
  Peptide Sequence Number=SeqID_157893
atggaattttgtttagagtacattgaaaatgccaaaccagataggctttcggagtctcgatatgatgagtgggaggcaaggggatacgatatcaacaagtatttgttctacaccaaatcacaagtcgataaaagtacaatgcaaaacagtggggttggtcttagggcggaatcccaacactttgctattgtacataatgataatccttgtctagcatccatgccaaactttggagttattgaagaaatctgggatcttaattatgttaaattcgatgtgtgtgttttcaagtgtaagtatgttgatagcaatatggatccttgtgatgagagttggtcagtggttctacacagaaaaaccattagtcttaatcttgaagatgatgattcaactctagatacttgtctcactcctttctccacacaaatgtctaacgtcacggaaaagaagaagttaacgatgtccatgaaaatcttgatgatcatgatgaagaagaataaattaacatcgtataatatgactacgctaccgagctcccctccttctctaaagtcaacaacaccttcgtcgtcttcgccaaagaagactagaaaagcaacacagttcaaattattggctaccagacccatcgagatggagagaccaaggattcatgctaaatttgatattccaaaagcacctgaccaaaggatgaagaagaaaatccttaagaccgtagcagagcgatggaggcagtttaagtcaattttgaccgctaaatgggctctggcacaagataaggaggaggaggatgacactgtctatcagaagtgcggtattaacatagaaaatggcaacaattttgccagagtcatagagacccttcatgggagccagatgcagtcggagatgcaatcccaaggaatcatactgcctcctaagcttgaagttggtccttctgctgcccgtgttagcgcaaagggaagctttatcgatcccttgggagtttatgaggggttgaaaatcatccaaaacatcccttcgggcaatgatcaagtgaaggttggtgttgaggaagataaacatcaagctgcaggattgccgaaacctgtagataggccagaacatgaagatgatcccctataccagatgacattgatgatcccagagcttttcctcaagactatgtag

SEQ ID NO: 41116 - DNA, 1935 bp, Glycine max
  Peptide Sequence Number=SeqID_157894
atgaactattgtgggatctcatgtcaggaagggctacaagatgatggactagtttactctaatcctaagcaacaaggtatttctggagataaatcaccgaatgaaagctgttgtagcaaccatgaaggtagaggattggatttggtttccatcatgccttcatctaatcatttgaaggatggagagtcatgctatttgtcaattgcaacaagagtagaacactcaaagtcagcaagaaaatccctatgcaagaatcaagtgaaaccatcggaagtgattggtgatattgcaagccatgtaggaagtcaacaatgcctttctgtttttgatgcttgctcagctcgtagtgcctcggaacatattgctcaagaggttgatgttttagatagtcaccatggatgtggattaaggagttgtttgtcaaagtcaccaaggtttagagaatcaaatcgatattctgaaatagaaagccttccgttgatattgcagcatgtaaatgagacggatctcaatggacatagaagcatgagacacattggtgttgaaattagtccaacttcagaaactcctagaagtttatctatgaaattcaggccaaaatctttcagtgatttggttgggcaaaatgtgataggaaagtctcttttgggtgctatctctacaggaaggatatcatcattttatatcttccatggaccacgcggcacaggcaagacctctgcgtctaggatatttgccgctgcaatgaattgcctctcccctctggagcaaaagccgtgtggtctgtgtagagaatgtgttttgttctttttgggaagaagtaaaaatgtcaaggaagttgattctttgagaatcaaccgtgcagacaaggttaagtcccttgttaagagtgcatgcattcctccagcttcctcaagttttaaggtgttcattgttgatgagtgccaggtgttgcatggagaaacatgggcgtgtcttttgaattgcctagagaatgtttctccacgtgtggtttttgtgatgatcactcctgatttggataagcttcctcggagtgcagtttcccgggctcagaggtatcactttgcaaagattaaagatgctgacatagcaagaagattgaaaaagatttgtgttgaagaaggtcttgaatctgaacaagttgctttggacttcattgctgctagatcctgtggttctcttagggatgctgaaactatgctggatcaactgagtctgcttggtaaaaaaattactattagcttagtccacgagcttactggggtcatttctgatgacgaattgctggatttgctggatttggctttatcatctgacacttcaaatacagttataagagcccgcaaacttgtcagaacaaggatagatcctttgcaacttatatcacagttggcaaatcttattatggacattcttgcagggaaatgtgaacttggtgcttctgaaaccagaacaagattttgtaatagatatacctcggaagcagacatgcagaaactaagtcatgcattaagaatactgtctgaaacagagaagcagttgagaatttccaagaatcaaacaacatggttcactgctgctcttctacagttgagctccgtagaatattcatctgtggatacaaatgatgcaaagttgtgtgcacgagctgtgtccaatggagatggtgatatctgcagcacacctcctaaaggggacagcttggagcatcttgctacaacaggtcaatgtgatgacaagccatatacattaggattaggagtacaggaggatcacaaaggaacattggattctatatggtataaagccactgagatgtgtcaatctagcaggctcaaaacttttctcaggaaacaggggaagttgtcttcagtttgtattagtcaaggtcccaccactagagagtgggaataa

SEQ ID NO: 41117 - DNA, 363 bp, Glycine max
  Peptide Sequence Number=SeqID_157895
atggcagcggaatggagaaggaagagagagaggagacgccacttcaaggagaagatgagtctagaagaagctcaccaccataggaggccatggataagagcttggaggaagaaggagatgaatgaagggagagggagagaagaacacgaaattttgtgctcaaaaagagctttgaaatctgaaataattggacccaaccttggcccatgggctcagaaatctaccctaaggttcatgagaaccctagggccttcttcagcagctctagcccaatcttcttgcagcctcttgctcatggttctagtgattggtcccttcctagggaggattgcatcagtacctatcctttggattcctctttga

SEQ ID NO: 41118 - DNA, 2106 bp, Glycine max
  Peptide Sequence Number=SeqID_157896
atggcttcgagcgaggggtttctgaccgatggccagagggaactgctaaaaattgcaagtcaaaatgcggagaatctgtcttcgtcgccgaagtctcagtcgtccttgctgtctgaccatcatgtgaaagcccctgctggtggtaaggcacaaaccgctggaatagctgtgaggcatgtgcgtcggtcacactcgggaaagtatgggaaggtgaagaaggatggtgctggtggtaagggtacttggggaaaattgcttgatacagatattgtttctcacatagaccggcatgatccaaattatgacagtggcgaggaaccctatcagctggttggaactactgtcactgaccccttggatgaattcaagaaagcagtggtatccatcatagaggaatatttcagtaatggagatgtggaattggcttcatctgacctcaaagaacttggctcatgtgaatactatccttacttcattaagcgccttgtgtccgtggcaatggacagacacgataaggagaaagaaatggcttctgttctgctttcagcactttatgctgatgtcatcagccctgcacagattagggatgggttttttatacttcttgaatctgctgatgatcttgctgtggatatactggatgcagttgacatccttgcattattcttagctcgagctgttgttgatgacattcttcctccagcctttcttgccagggctaagaaggctcttccagaatcttccaagggagttcaggtaatccagactgctgaaaagagttatctctcagctccacaccatgcagaacttgtggaaaggcgatggggtggtagcactcacataaccgttgaagaagtgaagaagaagatagctgatttacttagagaatatgtggatagtggtgacacattggaagcctgtaggtgtatacgtgagttgggggtttcattcttccatcatgaggttgttaagagggctctgatacttgccatggagatacgttccgcagaacctccaatgttgaagctattaaaagaagcagcagaagaaggactggttagttccagccaaatggtgaaagggttttctcgtttggcagaatccctagatgatcttgctcttgatattccatcagctaaggcattgtttcagtcatttgtccccaaggcaatatctgaaggatggcttgatgcttcacttaccaaacctgcaactgaagatggggaaatccaagaagatgagaaggtgaggaagtacaaaaaggaatctgtaactataattcatgagtattttctttctgatgacattcctgaactgattcaaagtcttgaagatcttggagcacctgagtataacccaatatttttgaagaagcttatcactcttgctatggaccgaaagaacagagaaaaggaaatggcatctgtactgctatctgctcttcatatagagatcttctcaacagaggatatagttaatggttttgtcatgcttctggaaagtgctgaagatacagcactggatatattggatgcttcaaatgagctggctctgttcttagctcgggctgttattgacgatgtattggccccactgaatttggaagaaattggctgcaggttaccaccaaaatgcagtggtagtgaaactgtgcgtatggctcggtcactcattgctgctcgtcatgctggtgagaggctattgagatgctggggtggaggcactggatgggctgtggaggatgccaaggacaagatcatgaagctcttggaagagtatgaaagtggcggggttgtgagtgaagcttgccaatgcatccgtgacctgggaatgcctttctttaaccatgaagtagtgaagaaagctttgattatggccatggagaaaaagaatgatcgtatgctagatctactgcaggagtgcttcagtgaaggcctgatcaccattaatcagatgactaaaggcttcacccgaataaaggatggacttgatgatctggctctggacattccaaacgcaaaggagaaatttggcttctatgtggagcatgctcagtcgaatggctggcttctaccctcatttgattcacctgccacagatgcctaa

SEQ ID NO: 41119 - DNA, 1023 bp, Glycine max
  Peptide Sequence Number=SeqID_157897
atggaaggctctgaatccgattctgtgtcactttccatttccaatggcgaagagccccaattggggcgaccttcttcccccgccgctcctcctgagccgtcagatctcaatcatgcggcggaggaagagacactctccggggagcttcagagcaagttggatttgaaggatgtggatgaaagtgaggagaaagtttcggactttaacgatggtggaggagtttgtgatgaagaaactggtaagggtgatggagatagtaagggttgggagaccaatagttggaatgaggaagtgggtgttgatgttgatgttgatggtgatggtgatggtgatggtgatgatgatgttgatggtgatgttgatggtgatgatgaagtggagaagaaggaagggagaaacagtggtggaactcaccactaccctttgaggcctgaagctgaggattgtgcattttatatgaaaactgggaattgcaagtttgggtttaattgcaagttcaatcaccccattaagaggaaaagtcaggctgttaaagagaaggcaggagaaagagaagaaaccacagaaagatcaggcatgacagaatgcaagtattatcaaaggtctgggggttgtaaatttggtaaatcttgtaaatataaccacacaagaggaaaaatttcaacagcaccagcaccacttttggaacttaactttcttggcctgcctattcgtccgggggaaagagagtgcccctattacatgcgcactggctcttgcaagtttggagcaaactgcaagttcaaccatcctgatcctacagctgttggaggaggaggaggtaatcctccttcagggtatggtaatggagggtctatttcattacaaggtgtatcacaaacatctgtaccctcctggtcttctccaagaacattaaatgaagcatctccttttgtgccaatgatgctttcacctactcaaggagtttctacccaaagttctgattggaatggatatcaggtacattggaactgtagcaaatga

SEQ ID NO: 41120 - DNA, 1968 bp, Glycine max
  Peptide Sequence Number=SeqID_157898
atgggtaacccaaaccctaaccctacccctaccccggaagaggaaaagagcctcaaggaggagctgctggatcccatcctgctcggagagcgtgtgataaagcttgctcaggaggcggagtcgtctaaggtggactgcacggagctggcgcgtaaggtgcaggtggtctgtgacaacctccgctccgtggtgcgcgttgtgtcgggggctcagtgcctcaacgagcgccccatccgccgcatcgtcggcgaggtcttcaaaaacctagagcgcacgttagcgttcatccgcaagtgcaagaagcacggcggcgtcctccgccaggtcttctccatgaccaccaccgccgatttccgcaaagtctggagccttctcgaatcttccaacggcgacctggtctggctcctcaccatcttggactccaaagacggcaccaatgtctcacttccccctattgccagcaacgaccctattctcgcttgggtctggaccttcacctacactctccaattgggccagcccaaggaccgcgccgaagccgccaccgaactcggttcactcgccagagacaacgaccgtacaaaatttatcatcttggaggaaggtggggtgatgcccctccttaagcttctcaaggaagcttctttccccgatgctcagatcgcagctgccaatgctcttgttaacattacaaccaatcaagacaggattgttggtttcattgtggagtcccatgctgtccccaccattgttcaggttctcggtgattcccctatgagggttcgtgtctctgttgccaatttggtctctactatggctgagcaacatgagcttgttcgcgaggagttcatcagggccaatgtgactaggccccttgtgtccttgttgtccatggatatgggtactgtccttgctgaccccatggccggtcgcgccagcattcattcgcttgttctcaatttgtccaatgtcggggaggcgaattcggatgggagtagccgcggctccagccaccagcgaagagatagagaggttgaaagcccggagttgaggaatgaggtcaaaatcagttgtgctaaggctctttggaaactctccaaagggtgtctttcaagttgcaggaagattaccgagactaaaggtttgctttgtcttgctaagattattgagtccgagagtggggaattgcagctcaattgtcttatggctgtcatggagattgctgctgtggcagagtcgaatgctgatcttagaagagctgcttttaagcgaactgcaccggcagccaaggcagttttggatcaacttttgagggtggttcaggaggagagtgatccggcattgcggattcctgctataaaggcaattggttccttggccagaaacttctctgggaaggttccacaggttattggtcctttagttgctcagcttggtaacagagatgttgatgtggctagtgaggctgccattgctttggggaagtttgtgtgcccagacaactacaactgcattgaccattctaaggcaatacttgagcttgatgggatccctaagctaatgagcctgctgcagataaatgatcgccaacaagttcatggccttaaattactttgttaccttgccttaaatgtaggtaacagtaaggtccttgagcaagaacgtgctttgaataccctagagaggtttgctcgtcctgttcaagcacaacatcctgatatgaaggacctttttgcaaaggccatacaccacctcactctttatcagcctggagctcaattgcacagacagcccttggggcttgagccttgcattgttttgtggaagcataatatcagcttgtacaacatcactggtgataaaagtggacctgagggtatcttgaaattttctgagagacaatccaatgtttgcgaagtgaagagtgtggcagttagtgagaggagttcgagacttgaacttaaatag

SEQ ID NO: 41121 - DNA, 531 bp, Glycine max
  Peptide Sequence Number=SeqID_157899
atggcatcggatgcaacagttaattcggttagtgaggtgaacaatgctcccaatcctagaaaatctgaaggcccttcctctactccgtctcccaccacttcccttcttctctccgccgccactagcactgcttgtggcgccctcaccggctcccttttcggctacgaagctgttccaaagttcatgttcaaggatgctttcgatgggtctgtttcaggtgctggattgattaagaagaaaggctttaaaggatcctttatggaagcaggatctcaggctaagacttttgcagttctatctggagttgatagtttggttgtctgcatctttggaagacttcgaggaaagcatgatgccattaacgctgggctagctggatgttgcgctggtcttgctacaagttttccaggtacaccccaagctcttatactgaactgcctcacctatggggctttttcttttatgattgaaggggtaaccaagaaacgatcagcacttgcataccccatgtccaagaaaacaagtgcataa

SEQ ID NO: 41122 - DNA, 213 bp, Glycine max
  Peptide Sequence Number=SeqID_157900
atggagaataaagggggtggcacaacactgaaaaatggcatggaaatttgttgggagttgaccaaaattatgaagagggagagaaaaggtcctttgagccttggagacgttagtggcgctttgttgacctgcagtcccgtttcggacagaacactgttatcattgactaaatacatgcacacatgcatgagagggattcaactcaacatttga

SEQ ID NO: 41123 - DNA, 1226 bp, Glycine max
  Peptide Sequence Number=SeqID_157901
ttacaaattggatttatgccagtataatggtgaagatgatggtgtagaattttatgctataaatactgatgcccaagcactgttgcattcttctgctgagaaccctatcaaaattggagagcttctgactcgtggattaggtactggagggaatccgcttttgggggaacaagctgctgaggaatcaaaagaagctattgctaatgctcttcaaggctcggatttagtgtttgtaactgctggcatgggtgggggaactgggtctggtgctgcccccgtagtggcccgaatagcgaaagaagcaggttacttgactgcattggaagccattgaaaagctgcagaaaaatgtggatacacttatagtgattccaaatgaccgcctgcttgacatggctgatgagcagacacctcttcaagatgctttccgtctagcagatgacgttctacgacaaggagtacagggaatatcagacatcataacaatacccgggcttgtaaatgtggattttgctgatgtaaaagctgtgatgaaagactctggaactgctatgcttggtgtgggtgtttcctccagtaaaaaccgtgcagaagaagctgcagaacaggccactttggctcctttaattggctcatctattcagtcagctactggggtagtgtataacattactggaggaaaagacataactctacaggaagtgaacagagtgtctcaggttgtgactagtttagccgacccttctgccaatattatatttggcgccgttgttgacgatcgctacaatggggagattcatgtgactatcattgcaactggcttctcacagtccttccagaagatactactaacagatcctagggcagcaaagttgcttgacagagagcctgggggccaagaaagcaaggctgcatctcctcctctcaagtcctcaaactatccttcaacggagtgtgatgaaaaaagaagggagaaaaaggggtggggtgttgtgagaaaggatggtgagggaataagggaaaggattgggggtgtaggagagcgaggagggtatagggggacaatttacatttctggaggtgaaaatagcactttagagccgtattggggctatgtgggcccaagcccagtttattctgaagcagaaaatcgacgacgcgtctcacactatatgcgcaaggtgatcgattcagagcaccctgagatctctgcttcagagttcagag

SEQ ID NO: 41124 - DNA, 534 bp, Glycine max
  Peptide Sequence Number=SeqID_157902
atggaagaagagggttctcagcagccacagttggtgcttgccgagaagctattccttctccgacaacccgttcaagacattgacaaggttcgctacaaggaggatgttttcactcacatcaaggaaaacggtaactctctttcgctatctctctcatcccctttcgattttttcccatctgaaacatgttctccctctcctttctgttcagagatggtccctttgtacgagaccctagtcgccgattccgtgttggacttggatcgtgcccttttggacttcatgcgcgctaaaattgaagacgagctcaccaagctcgacgaaaagatccaacgggatggaggaaatataggaatgcttggatgtgaaacacctgtatggagggctgaccagatggaagatagtccaataatcggaggtagagggagactaaagaaaactataggtcaaaccttcgagagggactcagagtggcttatggctagcaatggcagcaaaccccaaaacatatatgatgcattgaggatggtatag

SEQ ID NO: 41125 - DNA, 996 bp, Glycine max
  Peptide Sequence Number=SeqID_157903
ccaatatatgggtccacctctaatgatcctccgcagttcaaaagagctgctggacacaaggatttgttctacattgatgacaaagacgtggatatcaaagatatcattgaagctcctttaccaaaagcaccccttgatacatcaattactagccactggttggctattgaaggtgtgcaacctgcaattcctgaaaatgctccagttgaagctccctccgagataagaaaatctgaatataaggaagatgggcttcctgttgatgttaaattacctgttaaacatttaataacaagggagcttcagctttactatgagaaaataactgacctaactttaaataagcctggatccattccttttagaagagcattggttagcttggcaacagactcgggactccatcccttagttccttatttcacattttttgttgctgatgaggtggcacagaatttaaataatttagctgttttatttgccttgatgcgccttgtgcggagccttttgcaaaattctcagatacacatagaactttatttacatcaattgatgccacctatcattacttgcattgttgcaaaaaggataggaaacagactatctgatgatcactgggagcttcggaacttcagtgctaatcttgttgcttcaatatgccaaagatgggcaaccggtgcacatttctactattgtatggtaccaaaaagagcaatgagaaggtcaagatttgggcatatttatcacaatctgcagccacgtgtgacaaagacatttcttcattctttcttggaccctacaaaagctttgcctcaacactatggtgcaattaaagggatagaagctctcggatcaagactgattcgcttgcttatacttccaaatctcgagccatatttgcatcttcttgagccagaaatgcaacctgagaagcaaaaaaatgaaatgaagaggcatgaagcttggcaagtttatggggctttgttgattacctag

SEQ ID NO: 41126 - DNA, 378 bp, Glycine max
  Peptide Sequence Number=SeqID_157904
atgaaggtcgtcgctgcatacttgctcgcagtgttgggagggaatccatctccttctgccgatgatatcaaaaacatcctcggcgcagttggagctgaggctgagcatgagttgattgagttgctcttgaccgaagtcaagggcaaagacttcaatgagctacttgctagtggaagtgaaaagatttctgcagtggctggtggtggtgcagcggttgctgttgctgctgcaccagcgggaggtgctggtggcggtgctgcacctgctgccgaagcaaaggaagaaaagaaagtagaagagaaggaggaatctgatgatgtaaggatatgggtttcagtttgttcgactaaaaggttatgcggtactaaagttcagtag

SEQ ID NO: 41127 - DNA, 171 bp, Glycine max
  Peptide Sequence Number=SeqID_157905
atggacaagggtctgattagcagagtgtttggcaaactgtttgtgggtggcaaatgtaggtcgtgggaagtgagaaacataatctcggaggctgtccattggatttccaaacttgcactagatagaaataggttgcagttcttaaagcaaggcataaatagcagaaaatag

SEQ ID NO: 41128 - DNA, 1341 bp, Glycine max
  Peptide Sequence Number=SeqID_157906
atggctggaatgacattgaagcttatttctttgtgggtggcatacttctggttgtcagggcatttgaagttttggaagaaaaagcctattggtattgagtttgccaaacacttcagatctcatcttggtccaattgaaggtctagctgttagtattgatggtctgctttgctgtacaatatcaaatgaccgctctgtgaaaatatatgacgtagtcaactttgacatgatggtcatgattcgcttgccatatattcctggtgctgttgactgggtttacaaacaaggggatgtcaaagctaggcttgccattagtgataggaactcatcttttgtgcacatatatgatgcacgagctggttcaaatgatcccatcatctctaaagagatacatatgggtcctattaaagttatgaagtacaatcctgtatgtgattctgtactttcagcagatgcaaaggggataattgaatactggagccctgctacactgcaattcccagagaatgaggtcaattttaaattgaaaagtgacactaacctctttgaaattgcaaaatgcaagacttctgtttcagctattgaggttagtcctgatggtaagcaattttctatcacatcacctgaccgtagaatacgtgtgttttggtacagaacgggtaaactaaggcgggtttatgatgaatcccttgaggttgctcaagatctccaaagaagtgatgctccattatacaggttggaagccattgattttggtcgaagaatggctgtcgagaaggaaatagagaagacagaaagtgcaccacttccaaatgcagtttttgacgaaagtgccaattttcttatatatgcaaccttgcttgggattaaaattgttaatctgcacaccaataaagttgctcgaatacttggaaaggtggagaataatgataggttcttaagaatagctttatatcaaggggatcgaaatagtaaaaaagtaagaaagatcccttcagcggctgcaaatgctaatgagagcaaggagcctttgacagatcccactctcctgtgttgtgccttcaaaaagcacaggatatatttattcagtcgaagagagccagaggagcctgaagatgcaactaaaggaagagatgtgttcaatgaaaagccacctgctgatgaacttttgtcagtttcggatattggaaagtcagttacaacatcacttcctgataatgtggttgggaatttacacttgcactccaaaggcttaccctttttatgctattgttggggcttaggtcttttagccttaatgttaatgcgtagatccattcctaaatttttctattacccctga

SEQ ID NO: 41129 - DNA, 363 bp, Glycine max
  Peptide Sequence Number=SeqID_157907
atggcagatgagaatgccaaaagttctacaaaaccccagcaacatacacctccacgaaaagcaaccttaataatcttaggaagtgataaatcaaaaatccaactaagaaccgagctagttttccttttacgtcctctgattccggctacgtactcgcatttcactttccttactcttatcgagagtgaggggggagaaaacacttacaatggcaataggaaacccttgttagtacttgtagttttacacccgttactcttgtcaggccagtgcgggaagacatcaaacagtccctccttagctcacctgtcatcgctacctaaccatatcaattataatactaatattgtaattcacacttaa

SEQ ID NO: 41130 - DNA, 513 bp, Glycine max
  Peptide Sequence Number=SeqID_157908
atggttgtatacgcatttagtttctctataaaagtagaagcagatgaatctcgtttacgtgaagtgtgtgagagtttccttggacctccaactgggatggttgaggaaacatcttcagattcaaagaacttagcatgggatcctatggtgcttggaatgaggaagcacaagcttcttagggaagacattcttccatccatggcatcaaacagaaaagtccagagattacttaatgaattcatggatcttttatccgaatatgagatcattgatgctaatcaagagcaatcaaaccccacagtaccaaattcatccttgccagaaaccaatccaattgagagcagttcactagcaacagatcaggagcacactgctccaccaaaattggatcacaataccccactggaaaaagagcaaataaatttccctccagcactcacagatgaagctagtgcagatacccctatgacagatcaagctaaccaggatgcacaagttaaggaaagtgtctaa

SEQ ID NO: 41131 - DNA, 405 bp, Glycine max
  Peptide Sequence Number=SeqID_157909
atgaccatgtcaattctcaaaggactcttgcaaggatacatgaaatcattgtttgacgagggggtggtgaatgatcaatttaacatgattgtggctttgaaacgcattggagaaccagatcgtgtggtgcagttgatagaaacatatttttcaaatgttgaaaggatcctttttgagctttcgcgtcatgttgataatccaaaagttagcttttgtaagttggcatctcttgctcgtgaaatagaagataagagtacaagtattggtgcagagcaaatgaagcttgcatgttctgatgtcatcaaagcttgtaatgagaagcaccaagaaaatttttctcgatccatgtcatggttaaaaattgagtttagtaagaccaagaacaagttggaggcctttgtacag

SEQ ID NO: 41132 - DNA, 1473 bp, Glycine max
  Peptide Sequence Number=SeqID_157910
atggaattgggaagcataattcacttccttcaagataagaccattttagtcactggtgccactggcttcctcgcaaaaatttttgtggaaaaaatattgagggttcaaccaaatgtgaagaaactttaccttcttttgagagccagggatactgaatctgctactcaacgtttacatgctgagatcatagggaaggacttatttagattgctgaaggaaaaactgggtacaagattcaattcctatgtgtcagaaaagttgacagtagtacctggagacatttctcaagaggacttgaatttgaaggacccaattctaggggaagagattttcaaccaaacagatgttatagttaatttagctgcaacaactaattttgatgaaagatatgatgttgcattgggtataaatacattaggagttatgcatgtgttgagcttcgccaaaaaatgcgtcaaactaaaagtgctaatccacgtatcaacagcttatgtatgtggagaaaaagaaggactcatactagaggatccacatcactttggcgtgtcactaaatggagtgcccggactagacattgatatggaaaaaaaaaatgtggagcagaaattgattcagcttagagaggaaggagccacagaacatgatattgaattggccatgaaggacttgggtagtgaaagagcaaagatgtatggatgggcaaacacgtatgtctttacaaaggcaatgggagaaatgcttgtaggaactacaaagggaaacatgaacgttgtaattgtacgacccacaatggttactagcactcacacagaacctttccctggttggattgaaggtttaagaaccatagacagcatagttgttgcgtacggtaaaggaaaactagcatgcttcctagcgaatcttaaggcagtttttgacgtgataccggctgacatggtggtgaatacaatgctagtggccatggtggctcatgcaaatcaacctagtgatatcatctatcatttgggttcctctgttgtaaatccagttaagtaccttaatcttcgagactatagcgtaagatatttcatggaaaatccttggataaacaaggatggaaagcccgtcaaggttggcaaagttaccatattgagcaacatggatagcttccgcaaatacatgtacattcgttacctgcttcccttaaaggggctagagctggtcaatgcagtttcatgccagtattttcagaaaatgtatcttgacttcaatcggaagatccgtactgtcatgcgattggttgaactttacaagccttacttgttcttcaatggggtgtttgataatatgaacacagaaaagttattatcatcggcaagacaaggtggggtagagacggaatttttttactttgacccaaaaatgattgattgggaggactatttcatcaatatccattttcctggtatcatcaagcatgccttaaaatga

SEQ ID NO: 41133 - DNA, 1200 bp, Glycine max
  Peptide Sequence Number=SeqID_157911
atggaggagcacccgaagaagaagaagaaaggctgccgaaaccccgagaccaagttccaattcgagttgaactcatgttccaaagccaaggacctccgcggcgcgatatccctctatgacgatgccgtttcgaacaacacccgcctcaaccagcaccacttcaacgccctcctctacctctgctccaactccgtcgccgacccctcccttaagcccactgccctcgactacggcttccgcgccttccgccacatgtccgcactcgccgtcctccccaacgaggccaccgtcaccgccgtcgcgcgcctcgctgcggcgaaaggcgacgcggattacgccttcgagttggtgaagagcatgggcaagaactataacaacgctttgccgaggctaagaacctacgatcctgctctgttctgtttctgtgaaatgcttgacgcggataaggcctatgaggtggaggagcatatgaatggggttggagtgagcttagaagaggcagaactcgccgcgcttttgaaggtgagtgcgcgttgtggtagagtggataaggtgtatgagtatttgcacaggcttaggagctctgtgaggtgtgttagtgagtccactgcggtggttattgaggagtggtttcggggcagcaaggcctctgaggttggtgaggcagaattcgatgccgggcgagttaaagagggagttttgaggaatgggggagggtggcatggtcagggatgggttgggaaaggggattgggttgtgagcagaacgagtgttgttgctgatgggcattgttgctgttgtgggcagcaattggtttgtgttgatattgatgatgtggagacggagaagtttgcagggtctgttgctgccttggcctttgaaagagaggtcaaggccaattttagtgaatttcaggcctggcttgaaaagcatgcctcttatgaagctatagtggatggagcaaatattgggctctaccaacaaaattttgccgatggtggattcaacatttctcaggttcttgatgatgttgtgaaagaactgtacaatcggagtgggaagaaatggccgcttgttgtgctgcacaacaagcgtctaagagggctgatggaaaatccttctagcagaagactggtggaggagtggatgaaaaatggtgtactgtatacaactccaaatggatccaatgatgattggtaa

SEQ ID NO: 41134 - DNA, 621 bp, Glycine max
  Peptide Sequence Number=SeqID_157912
atggctcgagaaagtgccccttctatcatatttattgacgaaattgattccctgtgtggtcagcgtggagaaggcaacgagagtgaagcttcaagacggattaaaacagagcttctggtgcagatgcagggtgtaggacacaatgatcagaaagttcttgttcttgcagcaacaaatacgccctatgccttagaccaggcaataaggcgtcgttttgataagcgcatatatattccgctaccagatttgaaggctcgccaacacatgttcaaggcaaggacaatatactcgattgttgacaggacagagggtttttctggttcagatatatctgtctgtgtaaaggatgttttatttgaacctgttcgcaaaacccaagatgcaatgttcttctttaagaatcctgagggtatgtggatcccatgtggacctaagcaacagggtgcagtacaaacctcaatgcaagagcttgctgcaaaaggacttgcttctaagatccttccgccccctattaggaggacagattttgagaaggtactcgctagacaaaggcctacagtaagcaaagccgaccttgatgttcacgagagattcacgaaggaatttggagaggaaggttaa

SEQ ID NO: 41135 - DNA, 2526 bp, Glycine max
  Peptide Sequence Number=SeqID_157913
atgtggcttccaaattgcctaaccctgaaatatgcagatgatgctaactgggcactcaccaacacttcaaccaacccaattctcagaattagacgttaccaatatcactgccacgctaaccctcttctgcaatcccatgttgttgccctcaatgcaaggacccttttacgtgacagtgatcctcgctttgcacaacaactgttcgaccaaactccccttagagacctcaaacagcataaccacttgcttttccgttactctcgctgtgaccaaacccaagaagccctcaacctctttgtctcactttatcgttctggtttatcgcctgatagttataccatgtcttgtgttttgaatgtttgtgctggtttcttggatgggacggtgggtgaacaagtgcattgtcagtgtgtcaagtgtggacttgtgcaccatcttagcgtgggaaactctcttgttgatatgtacatgaaaactgggaatattggagatgggaggagagtttttgatgaaatgggtgacagagacgtggtgtcttggaattccttactcacgggttattcatggaatggatttaatgatcaggtgtgggaattgttctgtctgatgcaagttgagggatacaggcctgactattatactgtttctactgtaattgcagctttgtccaatcagggtgaagttgctataggaatacaaatccatgccctggttataaatctcgagatgctagagctgtttttgataacatggagaacaaggatttcagtttcttggaatagtatgattgctggaaatgtgataaatggacaagatttggaagcttttgaaacgtttaacaacatgcagcttgcaggggctaagcctacgcatgcgacatttgcatctgttatcaagtcatgtgctagccttaaagagttggggttggtaagagtgctgcactgtatgactctgaagaatgggctttccactaaccaaaacttcctaactgcactcatggtagcattgactaagtgcaaggaaatggaccatgcctttagtttattctccttgatgcatcggtgtcaaagtgtggtttcttggactgctatgatcagtggatacttgcataatggtggcactgaccaggctgtgaatttgttttcccaaatgagaagggaaggtgtcaaaccaaatcatttcacttattctgccatcctgactgtgcaacatgctgttttcatttctgaaatacatgcagaagttatcaaaactaattatgagaagtcatcttcggtgggaactgcacttttagatgcctttgttaagacaggaaatattagtgatgctgttaaagtttttgagctaattgaagccaaggacgtaatagcctggtctgcaatgctagagggatatgcccaagcaggagaaactgaagaagctgctaaaatcttccatcaattaacaagggagggtattaaacaaaatgaatttaccttttgcagcatcattaatggctgtactgctcctacagcatcagtagagcaaggaaaacaattccatgcctatgcaattaaactgagattgaataatgctctgtgtgtaagtagttctcttgttaccatgtatgcaaagagaggcaatattgaaagcacacatgaagttttcaaaaggcagatggagagggacttggtttcttggaactcaatgatctctggatatgcacagcacggccaggcaaagaaagcattagagatatttgaggaaatacagaaacgaaacttggaagtggatgctataacattcattggtatcatttctgcttggacacatgctggcttagtgggaaaaggccaaaattacttaaatgtaatggtcaatgggatgctggaaaaagccttggatatcataaataggatgccatttcccccggctgcaactgtgtggcacattgtcttggcagcttctcgagtaaatctcaatatagatcttgggaaacttgcagctgaaaaaatcatttcactagagccacaagactcagccgcatatagcctattatccaatatttatgctgcagcaggaaactggcatgagaaagtcaatgtgagaaaacttatggataagagaaaagtgaaaaaagaacctgggtacagttggattgagttgagggatgctggttatcagcctgatacaaattatgtgtttcatgatattgaagatgaacaaaaagaaactattatttctcatcatagtgaaagacttgccattgccttctgcttaatagctacacttcctgaaattccccttcagattgtgaagaatctcagagtctgtggagattgccacaactttattaagttggtatcactcgttgaaaagagattgttgttagagattcaaacagatttcaccactttaaaggtggtttgtgttcatgtggtgactactggtgatgtttgggctaatatgctttttgtgtttcgaagattctttagtggatcagacctttgttttccaaagaatccatcaactctctccaaggcataa

SEQ ID NO: 41136 - DNA, 2193 bp, Glycine max
  Peptide Sequence Number=SeqID_157914
atgatagccgagaaacctagttgggttaggcatgagggcatgcaaattttctccattgatgttcaacccggagggctcaggttcgctactggtggtggtgaccacaaggttcgcatatggaatatgaagtctgttagtactgacttagaaaatgatgattcttctcaaaggcttcttgcaactctacgggatcactttgggtctgtcaactgtgttaggtgggctaagcatggaaggtatgttgcatcaggctctgatgatcaggtgatattaattcatgagagaaagcctggttcaggaaccactgaatttggcagtggagagccaccagatattgaaaactggaaagttgcaatgactttgagagggcacactgcagatgtggtggatcttaactggtctccggatgattctgcattggctagtgggagtttggacaacactatccatgtatggaatatgagcaatggcatttgcactgctgtcctaaggggccactccagcttggttaagggagttgcttgggatcctattggctcctttatagcaagtcaatctgatgataaaactgtaattatttggcgaactagtgattggagtcttgctcataggacagatggtcactgggcaaaatcacttggatcaacctttttcaggcgtcttggttggtctccttgtggtcattttatcaccactactcatggtttccagaagcctaggcattctgcccctgtgctagagagaggggaatggtctgcaacatttgattttctaggacacaatgctccaattattgtggttaagttcaaccattctatgttcagaagaaatttgactaatgctcaggaagtgaagtctgtacctgttgggtggaccaatggtgcttccaagactggaagtaaagaaccacagccttataatgttattgcaattggaagtcaggatcgaactataactgtttggactactgcaagtcctcgtcctctatttgtggctaagcatttttgtactcaaagtgttgtggatttgtcctggagccctgatggatattcactttttgcatgttccttggatggatctgtggctacatttcattttgaggtaaaagaacttggtcagagattaggtgatgctgagctagatgagttgaagagaagtcgttatggtgatgtgaaaggtcgtaaagcaaacttggctgaaagtccagcacaattactgctagaagctgcttctgccaagcaaacacctagcaaaaaagtggtttctgatgttcaacaaaaccaatctaaggcaaaggcttatgttgatgtggcagttactgcaaagaatgctgagcttcaaaatgatgatggcaagaaaagtggaggtccagttggtgatgtgtcaaacaaagctgcaacctctggccggatttctagtcctgttaagcaaagagaatatagacgacctgatgggcgtagaagaattattccagaagcagtaggagtgcctgttcagcaggaaaacatttctggtgcacttcagcaagcactcaattttcgtatagtttcttctgatcacagaaaggatattgaaagagctgtatccaatgaagatggtgcaagagtatgcaccttgggaggagcacatggcagaaatactgatataaaagagcgttctggggttactgctagggccacaatttcggagagcctagtgattgagaaggttccagcttctgctggtgatggaagcgtcaatgttgagcagtcaagcaatttgatgtcttccagttctttagctgcttgtagtggtacactttccattagagtatttgacaagaaaagtggagaagattcttctcctattcttttagaagcacgcccaagagaacatgctgtaaatgacattgtagggctgggaaatacatccataatgaaagaaacagaaattgtgtgctcaaagggtcctcatacactttggtctgataggatatcaggaaaagtcactgttttagctggcaatggaaatttttgggccgttgggtgtgacgacggatgtctgcaggcctttcatcgcatgttttataccttttggtatcttggtagcatctcttgtgcatcgatcaagtccattcaagttgttaatgtgttcatttcttgcatatttaccactggcatacataccattgtagttgtaatgttgtatgactaa

SEQ ID NO: 41137 - DNA, 300 bp, Glycine max
  Peptide Sequence Number=SeqID_157915
atgagaaatgttaaagggacacaagtgatatataataagcattttccgtgtttggcacctcgatcggtcactgctaaaccacttgatagacagttagaatccattgcatttgaaatcccagatgagtatgttgtagcaccaattcatgtaggccaaataacgccagaactgatgtgtcggtgttacatggaaggtccacgttggggtcgctattttgtggggccaattcaatttgcagtttgctataataatgaagttctttgtgctcttctggggggacaatgcatgaaggtattttga

SEQ ID NO: 41138 - DNA, 144 bp, Glycine max
  Peptide Sequence Number=SeqID_157916
atggcatgtacgggaatcgaaatttcgaaccagggagagggagaaaccctagaggtgcatcgcgatcgtgtgtgttggggaaagagggaggagaagggacaagtttacatcgtggatatgggggcaattgtctccattaagtaa

SEQ ID NO: 41139 - DNA, 746 bp, Glycine max
  Peptide Sequence Number=SeqID_157917
gagaggtgactatcaccctcggtgatgtggcatctttacttcatctgcccatcacaagcgccttccatagcttcgaggctcttcatgttgacgaagcggtgttgttgttagttgaattacttgaggtgattccagatgaagcaagagctgagatagctattgctgctgaagattatcatgagaggaaaccatgtgcctactgctggaactctaagaagacattaccagtgtcaacgtatcgaaagcgtcttgatagattgacatctgatgatgttttctggatgccttacaagagggttgtgtggcagtttgggtatgttcagaccattcctccacactctttggcgccaagattatgcttagaagatattgacggcagatggatacatttttctgagtactttgcaccggtggatcagatttgtgttgtgcctggacaatgtgcagcaaactacatcgactggttctacatgatttctcatcccttcatgagaccggcacatcccaaggattcagctagacatccacgtatcgtgcatgatgacacatatgttgaatcagatattcctcagtatttggtggcggcaacagctatggaggaagcacctatagtggatgcttgccaggcaatagctttaaggttggaacagttgttgaacctgaggatagtgatagaaggtacagaagcatacaatgtgatggaagactgtctaaggatcaccagaggtgtcactacggaatgcaat

SEQ ID NO: 41140 - DNA, 1035 bp, Glycine max
  Peptide Sequence Number=SeqID_157918
atgttaaacattatgatcgctgaaagtgaactgaaatatatgataatggaggaggtgaatgcgaatgagtgcttgttgacaagaatgcaagagatgtcactggattatcatttcacagtagagcaagaagttgggtcagccactcatgctttctttggtttcaatgggacagcgggtatatggagaattgctgctatcaatgaagctggagggtggaaagacagaacaacggtggaggacatggatcttgctgttcgtgccagccttaggggctggaagtttttgtacctcggagaccttcaggcgaaaagtgagcttccaagtactcttagagccttccgcttccagcagcatcgatggtcttgtggtcctgctaatctattccgcaaaatggtgatggagatagtaaggaacaagaaagtaaaattctggaagaaagtgtacgttatatacagcttcttctttgttcgtaaaatcatagctcacatggtcacattcttcttctactgtgtggtgcttcccttgacaattttggtccctgaagttcgtgttccaatttggggagctgtttatattccttccatcatcaccaccctcaactcagtaggcacaccaaggtccattcatctgttgttctactggatcctttttgagaatgcgatgtcattgcaccgtacgaaggcgaccttcataggcctgctagaggccgggagagccaatgagtgggtcgttactgaaaaacttggtgactctgtaaataataagaacaaaagcaatgtcaccaaagcaatcagaaaatctcgattcaaatttggtgaaagtattccgaattcagagtcaatagaaataaaatcctttaactgcatttgtttggctgatttacttcatttattggagcttggattcgctgccttcctcttcctttgtggatgctatgactatgtgcacggcaagaacaactactttttgtacctcttccttcagaccataaccttctcaatcgtaggatttggctatgttggcaccattgtttag

SEQ ID NO: 41141 - DNA, 210 bp, Glycine max
  Peptide Sequence Number=SeqID_157919
atggtgttttttgttgttgttgttgagctcaatcggcggcgatgcacgccgagcgggagtaatcatttaggaggaaggtgcaacaagttcactgggttagggaggtttcgtgaggatttcgcggagagccttgtaagcaagaaatgtgattgggaatggtgggatagccagactttggtgacacgtctgaggaggtgtctaggagagtaa

SEQ ID NO: 41142 - DNA, 516 bp, Glycine max
  Peptide Sequence Number=SeqID_157920
atggagttttggggtgccgaggttaaggttggagagtctgttaaggtagacccagccgaatttgaggcatgcatacacctttctcaggctgctcttggtgaggcaaagaaagataagcctgaaccggtggttctctacatgaaagttggtgaacagaaatttgtcttgggaaccctttccagggagaaaatccctcaaatatctctggaattggttttggaaaaggagtttgagctttcccacagttcaaagagtgccaatagcgatgaggatgatgaggatgttccattgattaacacagagaatggaaaacctgaaacaaaagctgaagacttgaaggtacctgaatctaaaaaagctgttgccaaggctagtggatcagcaaaacaagtcaaggttgttgaaccaaaaaaagataacgaggaggactctgatgatgattctgatgatgatgattttggatcttctgatgaagaggtattgatttgctttggttttgaattgttgttgctgtga

SEQ ID NO: 41143 - DNA, 2640 bp, Glycine max
  Peptide Sequence Number=SeqID_157921
atggcgaacgaccaagaccagcaagactctccccaacaaaatgccccttattccgactcctcctccgactccgactacgactccgactactcctacgacgaggcggaggacgaggccttccgccgcgccttcggccagcgcgaagacggtgacgagtcgtcgccgccggagaacctgaagcgcgatgacccggaggcgaactttcgcgccttctcggaggcgttggagagccccgcgatgaaggagctgcacgaggagctggaccctttaatcgctgagaagaaaaacccttacgacttccccagagaccatgaagaatggaccgagcaggacctcagggagctttgggccgatgggccttacgaaattggcggcacgggctgggaccctgtttgggccaccgacgacgagtggcgctatgtgaaggaacagattgcggatggtgaagagcctcccattgcgccgttttatcttccttaccggaagcattaccctcccattccggataaccattacgatattgccacccccaaggatgctattgaagagttggataggattgaggagtttctcaaatgggttagctacattttcgaagatggcagcacgtatgaagggactgtttgggatgactatgctcatgggaaaggagtttatgtttctgatgatgcattggtcagatattcaaacccagatgttgttgatgatggtttcacaattccagcctcaacctcaaggtatgaaggtgaatggtttcaaaacgatgtggagggtcatggtgtagttgaagtcgatatacctgttatagaacctgctcctgggtccaagcttgaagcaaagatgcgatctcaaggaaagataatagcaagggattttttgtccccggaagacagagaatggcttgagaaggatattgaagatatgtattatcttgcagatgggaactatgaaatccccttttatgagaatgaggaatgggttaggcaatttggaagaaagccggagaaaggtcgctaccgttatgctggtcagtggaagcatgggaggatgcatggatgtggtgtatatgaagttaatgagcgtatcttatatggtagattttattttggagaatatgtggatgaggtttcaggatgtgatgaagacatttcagcgatgcatgctggtatagcagaagttgctgctgccaaggctcgcatgtttgttaacaagccagatggaatggttagagaaaagagaggcccatatagtgatccacagcatccttacttttatgaagaagaggatgtgtggatggcacctggcttcattaaccagttttatgaagtccctgattactggaaagtatatgtgcatgaagttgatcaagaaagagaaatgtggttaaactctttttataaagctcctcttaggttacccatgccagctgagctagagcactggtggtcaaaagaggagaatcataagattcctgaatttgtccttattaacaaggaaccggagcctgatcctgaagatccttcaaagcttatatatactgaggatcctctcatcctccatacaccaactggaaatattatcaattatgtcgaggatgagaaatatggaatacgtttattctggcagccacctttgggaaaggatgaggacgtggatcctgaaaaggctgtattcctgccccttggttatgatgatttttatggaatagagaaggaggaaaaaaaggagagcatatggatgcgtactatacttgcaattgaaaatgcatgcaagccgtggtttgataagctagataaatggactgaagagcagaaaaaaattaatgaagaggaaaaaaaagcaattgaggaagatcttgaactgatagaagctgaaattggtctagaagaggccattgaggatatggaggagttattgcgcataagagagaaagaagaggaaaagaaggcaaagatgggtttgctggatgaagaagatgatgacaatgaaggtgatggtgatgatatgacttctgtaaccaaacaagatgaaaaagctcctgcaaaggttgtagaagttcccgcagaggtggaagaggaagatgatgacgattgggatgatgaagaggatgataatagtgcacaatcaagttttgggtccgttgagcagggacagacaacagatcagctgaagggaaaacctgggaaatctccattttctgcatcttcacttgcatttgcttctagcagccttatctctgctattccatccaagctgcaactatcattttcattctggaacaaggggagatcaaaaccgaagccagttcctcccccatgcattgatagcttgagtaatatgaaaactgttgattcagtcaatttccgtcctgtgaccagccagaatggtagcttgaaagcggtgggcaaaacacatgggaaagtcaagacaagaagctcttttggtgggaaatttcttggggtgcactctcagactcgatcacatttattggcttctgcaaattccagtagcaacttgaaggagccaagagtgagtagtgacatgtggttgcatgcagcaccagagagggatttagacagcatactgtctttgcattcatcattgtattattttgaacagcatagagagattatttggtga

SEQ ID NO: 41144 - DNA, 165 bp, Glycine max
  Peptide Sequence Number=SeqID_157922
atggctacagccaggggggcactcaagtatcctgtttatggcattgtgatactacggctgggaatttacacagacagacccaacgtttccaagacaacgttcctaaatgaaaaactccacacgactccggaatttcaacaaacactattgacaacaacgaagtaa

SEQ ID NO: 41145 - DNA, 216 bp, Glycine max
  Peptide Sequence Number=SeqID_157923
atgaacccaaaagcagttagtcttttgagtccagtgataacaacaaagaagttgtacccacttcttgcaatgaacccaaaagcggttagtcttttggatccattgatcaaccaagaagcaaatctgcttcttgcaatgaacccaaaagtggttagtcttttgagtccagtgtttaaccaagaagaccttctcttgaaaaatagtcaccaagagtag

SEQ ID NO: 41146 - DNA, 207 bp, Glycine max
  Peptide Sequence Number=SeqID_157924
atgaagttaggtggtaggaggagatacccaagtggttattcgtataaacactatttcgctatccgtaagactcaaagcacgatagcaagcagagacgaacgtcgtcttctgcaccctttgtcaatcgcggccaacgaacccgttgacacgcggagatttacgtcgtcttccatgcttcctgtcatcctgacccgtgaagtcaggtga

SEQ ID NO: 41147 - DNA, 783 bp, Glycine max
  Peptide Sequence Number=SeqID_157925
atgcagagataccttatggttatccgcatcatttgtcagctagaggcaagcgagcccgttgacacacagagactaacgtcgtcatctgcacctttatcatccagagacggcgagtccgatgacatgcagagataccttatggttatccgcaccttttgtcagccagaggcaagcgagcccattgacatgcagagactaacgtcgtcatctgcacctttgtcatccagagacggtgagtctgatgacatgcaaagataccttatggttatccgcaccttttgtcagctagaggcaagcgagccctttgacacgcagagactaacgtcgtcatctgcacctttgtcatccagagacggtgagttcgatgacatgcaaagattacttatggttatccacaccttttgtcagctagaggcaaacgacgctgttgacacgcagagactaacgttgtcgtctgcatctttgtcatccagagacggcgagtctgatgacatgcagagatactttatggttatccgcaccttttgtcagctagaggcaagcgagcccattgacacacagagactaacgtcgtcatctgcacctttatcatccagagacggcgagtccgatgacatgcagagataccttatggttatctgcaccttttgtcagccagaggcaagcgagcccattgacatgcagagactaacgtcgtcatctgcacctttgtcatccagagatggcgagtctgatgacatgcgaagataccttatggttatccgcaccttttgtcagctagag

SEQ ID NO: 41148 - DNA, 642 bp, Glycine max
  Peptide Sequence Number=SeqID_157926
atgagtggtgtcatttcttctaatttggccttgaaatggaacagtgaaaaactcgatagtttctctcctactaggggtcttcgtcaaggggaccttttgtctccttatttgttcttgctctatgattgcttacttttcaccaatgcaaagtcttcccaggtgtcccttgtcagagaggttctttattctttctgcttagcttcaaggatgaagatcaatgtacacacatccaggtttcttccttcggagaatgttcctagagccaaggttcttaggtttggagggatgttggagtttcaacatactttcaatatttggcagtacttgggttttcctcttttgtcagttgatagtagattggttggttggaaagggaaattgcttagtagagcaggcaaagtcacctttgcaaagtctattcttagctctatgccaatatatattatgcataacctttgtatttcggaaggtatttgtgatagcctggactcaactataaaacagttttatttggggtgggaagactggtctttggggttaaatgggcaacaaccatcactacaaggagtagaggtggcctgggtttgcactgttataggcccgctaacattgcaatgcttaagaaacatatatgggagttga

SEQ ID NO: 41149 - DNA, 279 bp, Glycine max
  Peptide Sequence Number=SeqID_157927
atgtttgatcagcaagcagttgtttctccagcaaaacctccacaaaggccggatcctgaggtcgatgatccgctatatttgatgacattgaccatcccagagcttttcttgcagcctttccaggttaactgggatgctaccatgtttggagtgtgtcatccaaacttcccgttgtacataaagtacgaagatctctctaaaatcgcacatggtagtcaatgtctcaacatatctgtcatacagttgtggattctgcatctgactaagacaagtatatga

SEQ ID NO: 41150 - DNA, 586 bp, Glycine max
  Peptide Sequence Number=SeqID_157928
ttcttatttggaaggctgcaacttcttaaccgctgcagtctccactcctgctaatagtttagcacactctttgttgttactgtggggtcctgaagcacagggagattttacccgttggtgtcaattaggtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattccttatttatccactgggtcagtctggttggttctttgctcctagttttggtgtagcagctatatttcgattcatcctctttttccaagggtttcataattggacattaaacccatttcatatgatgggagttgctggtgtattgggcgcggcactactatgcgctattcatggtgccaccgtagaaaatactttatttgaagatgtaactggtttatggatgagtgctcttggggtagtcggtttggccctgaacctacgtgcctatgacttcgtttctcaagaaatccgcgcagcggaaagatcctga

SEQ ID NO: 41151 - DNA, 459 bp, Glycine max
  Peptide Sequence Number=SeqID_157929
atgaccggcagactgcttgtcgggtcattgacatttgattgtcgcatcatgcactatatcattgttagaattttgatgcctcgttcttctaatctcgctcaagcctttgaggaggacttgattctgatgtgggctttcttgaccagtcgcctaatcgactggacccatttgattcattaccgcatgcataaggcattgcggtctagtgcacctctaccttaccctcagcttgtgactttgttacttcgacattttgaaattcctttggattctaagccttttgtgcaagttaaacgttcctttgctattggtgttggtgcagtaacctcatttggctaccgtaaggacatagatgggcaatggttgaagaaggacgcgcaacctccgcaagacaaacgtactccctctccttcgcctcaacgagatgactcctcagccctcatgcatgaagttctttag

SEQ ID NO: 41152 - DNA, 1386 bp, Glycine max
  Peptide Sequence Number=SeqID_157930
atgggaacatcagtgcaagtaacgccactgtgtggagtgtacaatgagaaccctctctcgtatttggtctccattgatggcttcaacttcctcgtcgactgtggctggaacgaccacttcgacccttcccaccttcaacccctcgccagggtagcatcaaccatagatgctgttttgctttcacatgcggatacacttcaccttggtgcccttccatatgccatgaagcggcttggactttctgccccggtttattcaacggagcctgtctacagattgggccttctcactatgtatgaccagtacctctcaagaaagcaagtgtcggagttcgatctgttcacgctcgatgatattgattctgctttccagagtgtaacgaggctaacatattctcagaatcatcatttctcaggcaagggagaagggatagtgattgcacctcatgttgctggacatcttctgggaggtactatttggaaaattacaaaggatggtgaggatgtcatatatgctgttgattttaatcataggaaagaaaggcatttgaatggaactgttctaggttcttttgtgcgtccagctgttctaataactgatgcttacaatgctttgaacaatcagccttacagacgtcaaaatgacaaagaatttggagatatcttaaagaagactctaagggcaggtggcaatgtattactacctgttgacacagttggacgagtgttggaacttattctgatgttggaattgtattgggcagatgaaaacttgaactaccctatatattttcttacatatgttgcatccagcacaattgattatgtgaagagtttccttgagtggatgagtgataccatagcaaagtcttttgaaaaaactcgtgaaaatatatttcttttgaagtatgtcacccttctgattaacaagactgagcttgacaatgctccagatggcccaaaggttgattattttgttgttctagcatccatggcaagtttggaagcaggcttttctcatgatatatttgttgagtgggccaacgatgtaaaaaatcttgtcctttttaccgaaagaggccagtttgccacactagctcgtatgcttcaagctgatccacctccaaaagctgtcaaagtcgttgtgtccaagcgtgtgcctttggttggggaagagctaatcgcctatgaagaagaacaaaatcgaattaaaaaagaggctttaaaagccagtcttatgaaagaggaagaattgaaaacatctcatggggctgataatgatattagtgatccaatggtcattgattctggcaataatcatgtaccacctgaaggtaatcagaattatccatttcagattcatgtaataattacattttctccttaa

SEQ ID NO: 41153 - DNA, 1584 bp, Glycine max
  Peptide Sequence Number=SeqID_157931
atgaagccacattttcagagtcttaagattgcttctggcattgaacttgaggaaaatgcttcaattgaaatcatagaagcaagaaatgaaagagttaatttgaggtttgagtccattccaattactcaatcttctaagtcaccacctagacatgcctcgccaaatgtgggggaggggctgccactggagccatcagaacagaaaataatggcatactttgatggtataaatgatggagggagtcttggtgataatgcaggtggacacattgatcagaacacttccttaaagatcaaaaccaaaaagaaaccctcagagagaaaacgtggaaaagctgagaaatcaattagtcttgatgttttgcaacattacttcacaggaagccttaaggatgctgcaaagagccttggtgtttgccctactacaatgaagcgcatctgtaggcagcatgggatatcacgctggccatctcgaaagataaaaaaggttaaccgttccctgtccaagctcaagtgtgttattgaatcagtccatggtgctgaacgagcatttggtttgaattctctaagtaccgtttcacttcccattgctgccggttccttttctgagccatccacttcaaacaagttcaaccgccaaacatcattgaccattaggccatcggaacctaagatcaatgaaaaggattttgatgcgtctggagcatcagaaacaaaaaggcaggctgcaatggaagatcaattccttggacttgaagcaagggcacaaagtcctgagaaagtgattaatgatagaggagtggccactcaggagattggcactaaaggcacaaacaagtttagaactggaagtggctcaagtgaaagcagtggaaatcctactcctcatggttcatgccatggtagtcccccaaatgaaatctcacctcctaaagatatatttgtaacaggccacagtgagaaatgtcttgtgttaagaggatcactggggtcaacaacactgcactcaactagtacaccgaactgcacaactgcataccctatgcctcacattgtagaaacgacagaacctcaagaactatttggaggacagctacttgagcgtgctggtagttctaaagacttgagaaatctatgcccttcagcagatgctgttttggaggatcaggttccagaagcttacaagatgaatcctcaatgttctgacttgcctcaaatgcaacacatggataaccttaataacactctgacaccttttgcagttaggaaagaggtgaagagtgtgactattaaggcaacatataaagaagatatcataaggtttaaggtctctatggactgtggtattgtggaactgaaagaggaaattgccaaaagattgaaactagaggcgggaacatttgatatcaagtatctggatgatgatcatgaatgggttttgatagcctgtgatgcagacctgcaggagtgcatggacatctcaagatcatcaggcagcaacgtaatcaggcttgtggtgcatgatatactgcccattctcggaagctcttgtgagagctcaggagattggaaaggttgtatatag

SEQ ID NO: 41154 - DNA, 1068 bp, Glycine max
  Peptide Sequence Number=SeqID_157932
atgtcagagtccaaggatgaaaatcctgaccttcctcccaagtcaaagccacaggaggaacatggttttgccatggattttgacattagcctggaaagtctatggccctcggatcatatatctttggtctctaaccccatgtctccttttctcttttccactatctctgaccaaccttgttctcctgtctgggctttttctgatgccgaagatgagaggctaatcaggattgcagcttcagcaggtaatacaaatacaacaactgaaaatctagttgaaaattatgacaacaaaaaaactgtgccaccccttgtagccatcccaacttcagaaaatccagatgcttattgtctaatcaaggaaagaatgacacaagcgcttcgccacttcaaagagttgactgaacaaaatgttctagctcaggtttgggcacctatgaggaatggaaatcggtatgcacttacaacttcaggccaaccatttgttcttgatccacatagtaatggactccatcagtatagaacagtttccctgatgtatatgttctctgtggatggggagaatgatgagatcatgggacttcccggccgagtttttcagcaaaaaattccagaatggactcccaatgttcagttttattctagtaaagagtatcagcgcctaaatcacgcgcaacattacaatgtccgcggaaccttggccctgcctgtgtttgagcttgcaggacagtcatgtgtggctgtagtggagttgataatgacttcacagaagattaactatgctcctgaggttgataaaatctgcaaagcccttgaggcggttaagttgaggagttcagaaattttggagcatcaatacattcagatatgtaacgaagaccgccagtatgcattagccgagattttggagatactgacagttgtgtgtgaaactcatagtttgcctctggcacaaacatgggttccatgtaagcatcggagtgtcttagcacatggcggtggtcataagaaaagttgctcaagttttgatggatgttgcatggggcaagtttgcatgtctataactgag

SEQ ID NO: 41155 - DNA, 153 bp, Glycine max
  Peptide Sequence Number=SeqID_157933
atgaagaaaatatccactactttgcaaggcaaggagaatgaacctccacctcaatggattgaaccaaagaatgaatggatcaaggtatgcatatgttcgaactcaaggacagtcccgaactttatcggaaagtgtactgagtcgttaaagtaa

SEQ ID NO: 41156 - DNA, 252 bp, Glycine max
  Peptide Sequence Number=SeqID_157934
atggttaccgaacctcagagcgcacgtcaaccggggcaacaccgttctcattggttcagcgaaggggactcggtgctaaagaaagtctcccaagctctgaaagacaacaaaggaaagtgggccccgaactacgaagggtctttcgttgtaaaaagggatttctccggaggggccctggtgctcgccaacatggatgacgaggagctaccttcacccgtgaactccgacgttttcaagcgatactacgcataa

SEQ ID NO: 41157 - DNA, 186 bp, Glycine max
  Peptide Sequence Number=SeqID_157935
atgcatgaaggaatgcatatgacacagatgcaatctaggaatgcggggtcccaaggtattgtccccttcttagatacaacgtctaggggtagcaaagggccccaacaggggatcaagactgaacccgtatgcgatgcatatgcaaaagacgcccccccccgcacaccacatagtacgacaatataa

SEQ ID NO: 41158 - DNA, 141 bp, Glycine max
  Peptide Sequence Number=SeqID_157936
atgtttgatgtagaaaagtgtgagattttgagggttagagaagccaaatttggggttagtggaaattggagtttaaagtgggttgatcctagtttaaaatgtcaattaggacttgtaggaaagcttgggcagagcaaatga

SEQ ID NO: 41159 - DNA, 515 bp, Glycine max
  Peptide Sequence Number=SeqID_157937
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgtaagaccat

SEQ ID NO: 41160 - DNA, 987 bp, Glycine max
  Peptide Sequence Number=SeqID_157938
atgggctttctacaagatgacagagaatatgttgaggcaatcagagaagccaaggactggggcacagctaattatctaaggaaattgtttgtattaattctgttaacaggtgccatgagcaaacctgaggaagtttggaatcaatgttggcattggctagctgatgacattgcatatcaatatactaaatcaacaatcaactcagatgaacaaaaaacaatttatcatagaattatccaagttgtcaacaacaatgaaggtggaatgttttttctatacggatttgtaggcacaggaaaaacattcatatggagaacattagcaaattcattgagagcagaaaatcaaattgtgattattgttgcttctagcggaatagcctctctattattaccaggaggcagaactgcacattccagatttaaaattcctataccaatttttgaagactcaacatgtaatattcatcaaggcaccgaattagcagaattattgaaccagacaagcctaataatttgggatgaagcaccaatggcccataaattctgttttgaagcgcttgatcaaagtttaagagatattatcacagataaatcaaagtcaagtcaaatatttggaggcaaagttatagtatttggtggagattttcgccaaatactaccagtcatcccaagaggaacgcgctcagacattgtaaatgcagcaatcaattcatcctatctatgggattcgtgtgaaatattgaccttgaccaaaaacatgcacttacacaacaatctagaatcagttgatgaacaagaaactgccacatttgctaaatggattctagacgttggagatggaattatagatgatgaaaatgatggttatgctacaattcaaattcctgctcatctactcattactcaatatgatgatccaattagtgctatagtcaaatcaacattcccagacttagatcagcaccacaataatcctgaatcttaa

SEQ ID NO: 41161 - DNA, 225 bp, Glycine max
  Peptide Sequence Number=SeqID_157939
atgaagaacggtggaaaaccttcacgaaatcgcccacggaaacgtctcgaaagcgttaaggaagtgcctcggcttggattttcttcacggaaacaatttttctcactaattttaagggaaaagagggtggtggttgccacccagctcgcccaggcaaactgggttgcttccaccagaaggcactgccttctgttggaagatcctggagggcccaagtgggcctaa

SEQ ID NO: 41162 - DNA, 682 bp, Glycine max
  Peptide Sequence Number=SeqID_157940
atgatcgcggcccagttcgtgctcacgcgcaccgtgttcggacgctatctggtcgggatcggcacgaacgaggaagcggtgcgacttgcgggggttaacccgaggccgtgtaaaattctcgtattcgcactgatgggcgcgctcgcggggctcgcgtcgctgttccagatttcgcggctcgaggcggccgatccgaacgcgggcgcgggcctcgagctgcaggtgatcgccgccgtcgtgatcggcggcacgagcctgatgggcgggcgcggctcggtgatcagcacgttcttcggcgtgttgatcatctccgtgctggccgctgggctggcgcagatcggtgcgaacgagccgaccaaacggatcatcacgggcgcggtgatcgtggtggcgacagacagaacagaccagagagaaacgggaaatggcgacgatcaaggatgtggcatccatggcgggcgtgtcgtttacgaccgtctcgcacgtggtgaacaactcgcggccggtgtctgcggatgtgcgtgcgacggtctagggcgcaatccgcgagctgaattacgtgccgtcggccgtggcacgctcgctgaaggcgcgtgcgacggcgaccatcggcctcgtcgtgccgaacagcacgaatccgtatttctcggaacttgcgcgcggcatctaggatcatggcgcg

SEQ ID NO: 41163 - DNA, 168 bp, Glycine max
  Peptide Sequence Number=SeqID_157941
atggctgaggcattaatatgttgtcaaaatttgttgaagcctacattgcaacaatttatagagctttgtccaagtcaagaattggaggaatcaaaaaatattatggcaaaatttgaaaggggaactatgggaattcaaggagctaggattgcagatggtggagtttga

SEQ ID NO: 41164 - DNA, 264 bp, Glycine max
  Peptide Sequence Number=SeqID_157942
atgtaccttgttatctttgttagtatagatgtgaccaatttgacctttgtgaactgtccactgcagatgaataagaaattgcagcaattgagggcaccaaaaaagaagcagcttcaggctacaaaactgagcgtggaaggtcgtggtggagatccagtgagctcgataaatggaaatttgaaggagagggatgtcatgaaaatacatccgtatactgcatttgtgtattcatttagtgcagcaggaaacccaaaatacatttga

SEQ ID NO: 41165 - DNA, 306 bp, Glycine max
  Peptide Sequence Number=SeqID_157943
atgaatttattccctagcgctgttcatgcattctccacccacgagtctggagccctgcgaatttattgcctagcgttgttcgccaattctccattctccactcttattcggagacccatgaattcattgcctagcgctgttcatgtgtcctccaccatcgagtctggagccccgcgaattcatttcctagcgctgttcgccaattctccattctcaatctttcgaagacccgcgaattcattgcctagcgctattcgccaattctccattctcaatctttcggagacccatgaattcattgcctag

SEQ ID NO: 41166 - DNA, 309 bp, Glycine max
  Peptide Sequence Number=SeqID_157944
atgggtctccgaataagattggaggatggagaattggcgaatagcgcaaggcaatcaattcgcggggccacaaactcgatgggctccagactcgatggtgtaggacgcatgaatagcgctagactcgatggtggcggacgcatgaatagcgctaggcaatcgattcatggactcgatggtggaggacgcatgaacagcgctaggcaatcaactcatgggtctccgaataagattgagaatggagaattggcaaacagcgctaggcaatcaattcgcggggctccagactcgatggtggaggacgcatga

SEQ ID NO: 41167 - DNA, 225 bp, Glycine max
  Peptide Sequence Number=SeqID_157945
atgtgtccacgtaggactcaccaatggaggtggcgaaaaccaccggctatgttgccagtggcagtggcgagaagccgcgtacccttccctcgtgaaatcgccagcgtgcatggcgatttggcttgcatgcagcgtgaaaatcacattactgcccataccctcccaattgtcttccctacttacaatatgaggttatccagttgtgttaaatgcatggagggatag

SEQ ID NO: 41168 - DNA, 219 bp, Glycine max
  Peptide Sequence Number=SeqID_157946
atgcacgaaacacaatgtggaccaccacgggtacatagaatgaatcgaaaagcttggttcgagcaaaataggggagatggttgccgccccgctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 41169 - DNA, 481 bp, Glycine max
  Peptide Sequence Number=SeqID_157947
atggcaaaaggtgcgcggaaattttctcaaaaggtgatcaaaaggtgcgcaaaaggtgatcagaaggtgaacaagccaccgacgcacaggattttggttggcaatcaaagggagaggaccactttaggtcatggtttcctttcttttcttgtttacttggtgacaatcccgtattgttcagatattgtctgggcaaggttttttggtaagttgggattttggctcaaggcttgtagaacggctggacatgatatctgccaaggttttctgtttttgtttagtgaggtgaacaagccaccgacgcacaggattttggttggcaatcaaagggagaggaccactttaggtcatggtttcctttcttttcttgtttacttggtgacaatcccgtattgttcagatattgtctgggcaaggttttttggtaagttgggattttggctcaaagcttgtagaacggctggacatgatatctgccaag

SEQ ID NO: 41170 - DNA, 294 bp, Glycine max
  Peptide Sequence Number=SeqID_157948
atgggtttcaggctgaaagagggctttctggcgaaaaggaggaaagcattggtttatgcccacccggctgaaaggaggctttctggccggactcgcagacaacttccaatgccttccaggcagaatgaaaaagctatggaagcttgtggtacggacttcacgcgggatgtttccgagctagattgcaaaaccgaaagccggggggagggggtcttagcgagacctcgtcctctttctctttcgatagacttcctaaaggatgatctagctgtggatgatgtcccagctcgagag

SEQ ID NO: 41171 - DNA, 761 bp, Glycine max
  Peptide Sequence Number=SeqID_157949
attctgataagcaatttcacgacgacgactttgggatgcagcggggcgatgaatctgctcgaagtgagaatgagtcaaagtttcgtaatgaactgaagcatataaagtggagacctccaggtataggaacaaagcaggactggcaagatagaataaacaacatacggaaagggagaaaggaagttgaagtaacagataaagttggcgatgtaaacgtgggctctgttccattttatgatgaaaatttgtacatcctcaatgtgaaaaatgatcttgatgccaaggcttcagaagcaattcccacggttgaaggcttaactgctgcgaccaaacatcccattcctccatcatctgtcctgaagcagttggctatagctattgaggctggaaggcaaacaaactcaatgaaagattttgtagcttcatcacctgccagagagaaggcaggcttaagtatctcttcagtgaaggctttagtgttgcgtgaaaaggaggacaaactcacctctgagtttagtagcgatgagaaagttgtgtatttgattaattcattgtttgaccaagagggagagttccttagaaggaagatcaactctgatccagaggaaacttccatatcatctttgccaagagatattcatggtgctcctcctgaaagcctagttgttaagctagccgaagtaatcggaaacttcaagacgcttcgaggaatgtctcttttttggtccagggttgttgatgaagtatgtttaactaaataa

SEQ ID NO: 41172 - DNA, 216 bp, Glycine max
  Peptide Sequence Number=SeqID_157950
atggctcttcgctcagcgaacatgcacagctcatgcttcttccagattcttcctcgcgctcagccgaggagtgttgcactcagcggatggctcgctaagccgacaggttggcttagcgagaggcaaaagcaaaataaaaaccctgagtgggaatcaccgctaaacagacgggaagagcaatgcaaagaacacatgcatgaagttgggcaacaatga

SEQ ID NO: 41173 - DNA, 426 bp, Glycine max
  Peptide Sequence Number=SeqID_157951
atgctaaattttttcactcctactccatatgaaatttcacctcacacttatatttcaacaattttccacattgagcaacgcaaaacattaagttttgtatttgacgtttatgatgaggatgaagatgtagttttcggtaattgggaagtaaggacaacagctaagttctcagcactcagcaaggtggagttcaagtctctctcacctggctttgcaactacaaatgcattgtccataactgacgagaactctttctctgagctaaatgaactcaagttagatagttgcctcaagatggttgttgttgtgtcctctaagactttacaagagttgaggaatttgaagagactcattgtgactcattggaaatggtattcaagattcatgaggaaatatcttatcccacaaagctcctacagcaactag

SEQ ID NO: 41174 - DNA, 1579 bp, Glycine max
  Peptide Sequence Number=SeqID_157952
atggagggtatggcaaacatttgtgatgatgcaaccgatggcgacaatgcgttcctaaccatgtttggtggcgatgaaagtggtggcagtggcggtagcggtggcagaagcggtggtgatcagggtggtggcaatgtggaggatgtggctctgaagaagggtccttggacaactgcagaggatgctattctaacggattatgtgacaaaacatggtgaagggaattggaatgcagtgcagaggaacacggggttgaatagatgtggcaagagttgtaggctcagatgggctaaccatttgaggcccaatttgaaaaagggtgcattctcacctgaggaagaaaagatcattgttgatcttcattcacagtttggcaacaaatgggccagaatggctgctttgttacctgggagaacagacaatgaaataaagaactattggaacacaaggattaaacgccgccaaaggcagggtctccctctctattcagatgagcatgatcataaccatcgttccacaacaccaacctctcccaccacaccttccccatgcctcacaccaacaggatcaaaccccaacattgccacaagttttgagttcttcaatcaaaaccaacaacaacaacaacaataccaacaccaataccaataccaacaacaacaacaccctctatctccaactgcatctcatcattcccctctcagttcccctcttcaacacagacaacccttcacctcttcatcacctcacaatttcttagaccattcacctcttccactctcctcctcttcaccctcccctctctccttctccttccaaaaaccagcaccaatgctaagcacccctcttcgcttcaagcgctaccgcacctctccaagctacaacaaccacctctctgaccctcctctcaccacccaattccctcaccttgatggattcaggttcccagtttcttcaggcttttctcagttttttcagccctctttattagactccgatcgaggcgtttcttcttcctcctctttggctttccaacccaagttggagctcccttcaagccagtattataaaccaccccatgagcaagacattaagcttgacattgagttcaatgatccttcttttcaaagtagtagtagtggctttctgggggatcttctcttcgaggctcaggcaatggcttcaggccagaactcaaagaaacgaggttacttgagtttgaatgagagaaatgatgtgtttgatgcatgccaaagctttgagaactttccatctagctctctttactggccttcttcaacttctgaaccaaaaccaaaggaagaggcaccggacttcagtaaattcatgaatgaggaggtgtcatcattgcttacagtggttccatcttccagtatgcatggtcatgagtggcacaataacagtgccacagaagtgtccaatgtccaatcgtctggtagtggcaagacagatgacaattttgtacttgatatcaaacccataacttcattgtttcctctctccaacaccgcaagccatgatgaaaaccaaggatgctactcttgggacaatttacctg

SEQ ID NO: 41175 - DNA, 255 bp, Glycine max
  Peptide Sequence Number=SeqID_157953
atgggtgtaaataacaatttgaatctaggcctttccggaacattttggaagttgggttgcttaaggaggaagcaactgggcggcaagctcctccacgttgttgaaaatggtttctggggctttcatggcttccaaaatccaagccgaggtgctttcgtaagcgattcttgggaaattcttcatcgttcttcatcgttctccattcgttcttcgtcgttcttcagtcttcaaccgttttcttttcttccgttttaa

SEQ ID NO: 41176 - DNA, 231 bp, Glycine max
  Peptide Sequence Number=SeqID_157954
atgaaggaaaatccactatatgcaaagtttagatttaaaatacttccttttaaagaagaattagatgcattgttcaaggatgtggtggctaagggaaaatatagttatgcaccctcttatgggacattacctaatcttataaatgaaagtgatgatgtacatcgtccatcatttgacaatgacaatgtagacctagaggaaggaatagtgaagaagtttagtacaagctag

SEQ ID NO: 41177 - DNA, 306 bp, Glycine max
  Peptide Sequence Number=SeqID_157955
atggtcgacttctttgttgatgttggggaggatcatgatggagatgctggtgatgatgttgaagaagaaaggtgttctgccagtcgtggtggcgaaatccttgaatttccatgcatcccattgtttccgccaatgggggtagcgagttaccccatgcatgtattgtttccgccagtgggggtggcgatataccccatggcacaacccatcatccatccatcatgctggcatgattcttccaggcataggggcgagaagacccaaggctggttccgccagtgccatttgcgggattcccttcattag

SEQ ID NO: 41178 - DNA, 825 bp, Glycine max
  Peptide Sequence Number=SeqID_157956
atggtggagctgaagcagaagatcttaacctctctttcgaagctctccgactgcgacacgcatcaaatcgcggtggaggacttggagaacactatcttgggactcttgccggacgccattccaatgatttttaacagtctttacgaggccgccaccaaccccaagcccgccgtcaagcgggtcacgctccgcctcctcgccgccgtctgcgccaggcactccgacgccgcggtggcccacgtcgtccgccgcctcaaagacgccaactccgccgtccgcgatgcctgccgcaacaccgtgggagccctcatcgtgcagtatttgaagggagacgatggagggggtggcaggggaggtgtagggacagtggtgggactgttcgtgaagccgctgttcgaggcaatgggggagcagaacaagggggtgcaggcgggggcggcggtgtgcatggccaagatggtggagtgtggcagtggcagcggaggaggggaggcggtgccggtggcggcgtttcagaagctgtgtccgaggatctgcaagctgctcaacagtcccgtatccgagccgtattggagtcgtattgaagccgtgtctagccttaggaagccatatcctagccgggccgcgcgaacgcaggcccccactatcacaaattatgacgtaggctctgccatttggacagaccttaggaaaacacccctcctaagtgcaatggagactactttgactaatgttttcgatgtgggactcattctgatttggctcccggcaatccatgcatggtctcaagttgcaaatgctccttccaaacttgaaccattgtag

SEQ ID NO: 41179 - DNA, 1869 bp, Glycine max
  Peptide Sequence Number=SeqID_157957
atgaatctgtatgctgtttgtgggagcgtggggagtgcgcgcagggtgtttgaggaaagtcctgtgttggatttggtctcgtggaacacgcttttggccgggtatgttcaggcaggggaggtggaggaggcggagcgtgtgtttgagggaatgccggagaggaacaccattgcttcgaattctatgattgcgctctttggaaggaaggggtgcgtggagaaggcgaggcggatttttaatggggtgagagggagggagagggatatggtttcgtggagcgcgatggtttcgtgctatgagcagaatgagatgggtgaggaggcattggttttgtttgtggagatgaaggggagtggagtggcggtggatgaggtggttgtggttagtgctttgtcggcgtgttcgagggttttgaatgttgagatggggaggtgggtgcatgggttggcggtgaaagttggggtggaggattatgttagtcttaagaatgcgttgatacatttgtactcgagttgtggggagatagtggatgcgagaagaattttcgatgatggtggtgagctcttggatctgatatcttggaactcgatgatttctgggtacttgaggtgtggttcaattcaggatgctgagatgttgttttattccatgccggagaaggatgttgtgtcttggagtgctatgatatcgggttatgctcaacatgaatgtttctcagaggctttggcattgttccaagaaatgcagcttcatggagttagaccagatgagactgctttagtgagtgccatctcggcttgcacccatctggctactttggacttgggaaaatggattcatgcttacataagtagaaataagttacaggttaatgttattctgagcacgacacttatagatatgtatatgaaatgtgggtgtgtggaaaatgcattggaggttttctatgcaatggaggaaaagggggtttctacctggaatgctgtcattcttgggttggcaatgaatggttcggtagagcagtcacttaacatgtttgcagatatgaaaaaaactgggacagttcctaatgagataacatttatgggagttcttggggcctgtcggcacatgggcctagtgaatgatgggcgtcactactttaattccatgatccacgaacacaaaatagaggctaatattaagcattatggatgcatggttgatcttttaggacgtgcaggtttgcttaaagaagcagaggaactgattgatagtatgcctatggcacctgatgttgccacttggggtgctttgcttggggcttgtagaaaacaccgtgacaatgaaatgggggagaggctgggaaggaaactcattcagcttcagcctgaccatgatggtttccatgtattgttgtcaaatatatatgcttcaaaaggaaattggggcaatgttcttgaaattaggggaattatggcacaacatggggtggtaaagacacctggttgtagcatgattgaagcaaatgggacagttcatgaattcttggccggagataagacacacccacaaataaatgatattgagcacatgttagatgtagtggctgcaaaattaaagattgagggctacgtaccaaccacaagtgaggtttcactagacatagatgaagaagagaaggaaacagcacttttcaggcacagtgagaaacttgcagtggcctttggacttatcactatttctccgccaactccaatcagagttacgaagaacttgcgcatatgtaatgattgccacactgttgtaaagttaatctccaaagcatttgatcgtgacattgtgaatcaaatgtcgttcaatcttaatgctcttgctggcaaagaatga

SEQ ID NO: 41180 - DNA, 702 bp, Glycine max
  Peptide Sequence Number=SeqID_157958
atgggtcatgcagattcaaatgctggaagaactttgaatcaggagggtggtgatcatcaaatacattgctctagagaaagaagtagaacagcttggaaaatcattcaagagtatttgatgccctttgtggagaaagaaaaataccacatctcaaaaaggtgtaggcttcaccctgacaatgacatatacagagatcaggagcaacataagtttcatacagatataaacgaatggcagtgtgggttctgtaagaaaagtttctatgaagagaaacatcttgaccagcattttgacaacagacactccaatttgcttaatttgagtgaaagccagtgcatagcagatgtttgtggtgcactgcactgtgaccatgaaatgaattctggatcaaaaaaatcaaagtgcaatcctgctgctgctgcaaaaaataaacatctatgtgagagcttagccgatagttgttttcctgtcactgagggccctgcggcaagccggacttcatgctgcactggaaataggaaacctttctccagagggcgcaggaagaagacaaatgtgttctacatctttgtgtctattttgcttgtgatactgctgctactatactacctctacatttacttatatcagagaggaatgaaaagggaaactcaagtgctgaagcgcgtctcacaagccagcagaaagaaaaagccatcttaa

SEQ ID NO: 41181 - DNA, 537 bp, Glycine max
  Peptide Sequence Number=SeqID_157959
atggtgggggtgttggtggcattgatggtggtggcaactagtggtgatgacgttggtggcgacagcgacaaatgtggtattggtgacaatgatagtggtggtggtagtgatgatggtaataccaatgtcaatagtgatagtgatgacattgacgatgatagtagtagtggtagcggcgacaatgttgatggtgacgataacaaacgtggtattggtggtaacgaaagtggcgacaacggtggtgatattagtaatatcaatgtgacgatggtagtgacagtggtggtaatggtggtgatatcgacattgagagcaatgatgataatagcgatggtgcaactttaccactccggttgtattctcccgcggctcttgaatcttgatgtaaaactcgtgccgccgcgagttgccgtcggaggaggcggtggggttaaccattggtggttgccggcgaagaggaaaaagagaaaggaattcagtgaagaggttacaatattgcatctggtagaactgcaacatctaacggttctgcaataa

SEQ ID NO: 41182 - DNA, 396 bp, Glycine max
  Peptide Sequence Number=SeqID_157960
ggcttggcaacacatgaggatatttttctcccaagtgacaattatccttactggttggcccatacaggtgaggggccctcggtgtgtttcacagtgccagaagatttttgcatgaaaggaatggctttgtgtgttgttcatgtatcaacccctgaaatcgtggcaactaaatgtcttactagtgtcgtaattgttaattgcacaaagtgcactatccagatatacaagcgagacacagtcatttcctttaacgatgaagattggcgggacataatatcacatttgggagctggagacaaggtggagattgttgtgacttttgaacatagattggtggtaaagaagacaactgtctatctcatctatgatgaaatggagcctgttatgaaggtttag

SEQ ID NO: 41183 - DNA, 253 bp, Glycine max
  Peptide Sequence Number=SeqID_157961
cacccaaggggctgactttgccgtccgcaacgcctgtcgcgacaccatgggcgcccttgccacgcaggacagtggtggggctgttcgaggcaatggggaagcagaacaagggggtgcaggcgggggcggcggtgtgcatggccaagatggtggagtgtggtggtggcagcggaggaggggaggcggtgccggtggcagcgtttcaaaagctgtgtccgaggatctgcaagctgctcaacagtcccgtatctga

SEQ ID NO: 41184 - DNA, 1533 bp, Glycine max
  Peptide Sequence Number=SeqID_157962
atgctctgtgatagtgatagcgccacgcaaatcccacatgcatctagaatattcgaggctcccatgcaagaggcacacacagaggaacccgcacgtggcaataaccgcacttgcacaaggcttggatatttacgtgattatgtccttttagcagtagaagttcatagcatttttggtccgacccaccatctccgttcagtaaccaccatcccagaacataatacccgccaggccacccttgaccgcctggaggaagccgtacaccgcctcacccaagctcaagcagccttatcccagaaccacgccaacctcgcccaaacacaaacctccatgaccaccaaactcgactctgctctcgaacacctcgtcgccttaaccattccaacccccacccctcaaccacccccgcacaccacctcacctttgccacccactccaaaaccgcatatgaagcttgacgttcctcgtttcgatgggcaggaccctgtgggctggattttcaaaatcagtcaattcttcgactaccaaggcttgcctgaccaagagaggatcaccgtagcctccttctatatggatggtccagcgctttcatgggttatacccggagctccggtgagaggttcaggtgcttcagcctatgtcgttgccgcaagcagtgactctcgcaagcttcaagaggaaaaactccaagatcgtcgtcgaccacctcgaacaccacctgtgcatcagtcacaggtgtcacctcccgtcactagctcttctctagttccctccccagctcgacctctgattaagaggctcaccgccgaggaactcacagtacgctgcgacaaaggcatttgctaccattgcgacgataagtggatcgtaggtcatcgttgccgcccacgactccacttgctcatcgcagatgaggatgacgattgcataggcatgccataccttgctccatccattgtccctgaagtttccaaccagccacaaccacctctcgacgtgccccaaatcagcttgaatgctttatccaggatgccgacactggaaacatttcgaatctatgggaccattgctcgccatcagttacagcaggttccagccactaccatgcatgtcatgattggtaatggcagcaccattgagtgtaacaccaagttcccttcggttccgatcacgattcagggattctcctttgctgtggatttgtttcaattacccatcagtggcgccgatatagtcctcggggtccagtggctgaagacacttggcccggtcaccaccgattactcatcgttgaagatgagcttcacgttcccaagccagcctacttctcttagtgctgacattcccatgctacccagcccagcattggcccaacaacttaaatgcttagcccaaacccacgacatttctgctctttaccacctcacccacgtacctgacccacaacccactttccttgtttacccttcctctactccacccacacccctacttacaaaacataaccccccactactcgaccttcttctttag

SEQ ID NO: 41185 - DNA, 618 bp, Glycine max
  Peptide Sequence Number=SeqID_157963
atgaggagaagaataatgaagttcctcaacatttctgacaatgactacatggttttcacagcaaacagaacctcagctttcaagcttgtggcagactcatatccattccaatctagcaagaagcttctgacagtttgtgactatgagaatgaggcagtggaagcaatgattagttgctcagagaagagaggagccaaggcacatagcagcacctgcaaaaccaaaagaagatgtttggatcaagtggactctttgggattgataatgatcaccaatagaacgaggtaccttataaattggctggtgaactccatgatgaagctgaagcaccctaatgcagaaggggttcccctagtcaagatttatggtcctaaggtgaatttgataggggacctgctttggctttcaatgtgtttgattggaaaggtgaaaaggttaagcctgtccttgtacagaagcttgctgataggaacaatatatctctcagctatggatttctccatcatgtttgatgtatataaactatggacttttgttgccaggttccttgatgctgattttgtggagaaggagagatggagatacacaactctcaatcagaaaacaattgaagtttaa

SEQ ID NO: 41186 - DNA, 254 bp, Glycine max
  Peptide Sequence Number=SeqID_157964
atgagtcatgggcgtttatatcagaaacaagtgaagaacgcttttgacaagaaggtacgtacgcaccggttcagcgaaggggacttggtgttgaagaaagtcttccaagctctgaaagacaacagggggaagtgggccccgaactacgaagggcctttcgttgtaaaaatggctttctccggtggggccctggtgctcaccaacatggatggcgaggagttaccttcacccgtgaactccgacgttgtcaagcg

SEQ ID NO: 41187 - DNA, 276 bp, Glycine max
  Peptide Sequence Number=SeqID_157965
atgaatcaaaatgagattatacaagagatgcaaaagagatttacacatatagttaatcatcttgcatcattaggaaaaatgtttcctaatgaagatctcattaacaaagtgttgagatgtttaagcaggcaatggcaaaaaaaagtaactgcaattatgggatcaaaagatctcaccaacatgtctcttgccactctctttgggaaacttcaagaacatgaaatagaacttatgagactcaaccaacatgaagagaatgacaaaaagaagaaatga

SEQ ID NO: 41188 - DNA, 547 bp, Glycine max
  Peptide Sequence Number=SeqID_157966
gaacgctttaaatgagattgctgctgaggttgagcatctatgttatctcggcaacaatcctttttcttgtggttgtgtgatgagaagcacacacggtcttcctcgtggatggttatgtgaggccgaagtgagcatcaaggaagaggttgagaccatatctaaaagatttgaggaacttgatgtcaacactaaaggtgcaccaaagaaatcgatgaaaagaaggcaaatatccacaaagcatgatctgtcttactgggagtatgttgatgcttttcattctgttcaaagcagcaactcttcagtgaaacatagtgcatcatcttctaaaccgccgaagccaacaaggatcatcccgatgttggatcaatttgcaccatttatacagggtttcattcacaacgttgtggatgtgaaagcggacggtaactgtgaatatcggtccattgccgctttattagggatgagggaagattcttggtcgttggttagtgtggacaagtggatggatataaaggagatgggatatgtcattgcatcacggtataac

SEQ ID NO: 41189 - DNA, 264 bp, Glycine max
  Peptide Sequence Number=SeqID_157967
atgacccgtgctgctgttctcgattgcgcaggcgatgattatcggggcggtgccggttttttttcagtctgccccgctacgttcctgaaaggtacggcgggccgcgggcgggttttgcgctggcctgttcgatcgctaatatcgccggacctgcagcaacggcgcgctgtggttcttcgccgtgtgtctgctgctcagctcgctgttggtggtcgcgctgccagcgaagctggtgaaccggtagcgaataccttacctatttga

SEQ ID NO: 41190 - DNA, 1411 bp, Glycine max
  Peptide Sequence Number=SeqID_157968
atggcgaccgtctcacagccgcaggatgcagctccacaccccgccagaccgtcacgcccacccgcacccaatcctcctcgcttatcggttatccataagattggttctaccaacaccggggaatctatttcgatgaaaactacaattccaaagctgtcgttcatgatgttcttagagtggtttatctggggggcatggttcgtgccgctttgggcgtttctcagcaaaaacggcttttcgccggttgagatcgcctggtgctacgcctgtacctccatcgctgccatcctgtcaccgattctggtcggctcgctggctgaccgtttcttccaggcacagaaagtgttatcgctgctgaccatcgccggcgcgatcctgatgttctttgccgcacagcagacgcacttcagcagcttctttccgctgctgctgctatatgcgctcacgtacatgccgaccattgcgctgaccaacagtatcgcgttctctcacgtcggtgacgtggagcgcgactatccgcgcatccgcgtgatgggcactatcggctggatcgcctccggcatcgcctgcggtttcctgccgccgctgctcggctttggcgatatctccgccagcaatgtaccgttgctgatcaccgcggccagttcgctgctgcttggcctgttcgccctgaccctgccagccaccgaacccaaaagcaccggcaagttcagcctgcgcgtggcgctcggcctcgacgcactgcatctgcttaaagatcgcagcttcctcgtatttttcgtctgttcattcctgttcagtatgccgctggcgttctactacatcttcgctgagggatatctgaccgaagtcggtctgccccacgccaccggctggatgacgctcggccaggtatcagaaatcttcttcctgctggcgctgccgttctttatcaaacgctttggcatcggcaaagtgctgctgctcggtctggtcaccgccgcgctgcgctacgtgttctttgtgttcggcggcgatcaaaacctgctgaccttcggcctgctgtttatgggcattctgctgcacggcgtcagctacgacttctacttcatcaccgcctacatttatgtggataagaaagcgccggtggcgatgcgtaacgctgcgcagggcctgatcaccctggcctgtcagggcatcggcagcctgctgggttaccgcctcggcggctatctgatgcaggagatgttcgcgtatgaccagccgcgcaacggtcagaccttcaactgggcgggaatgtggatgtttggcagcgtgatgatagtcatcatcaccatcgcctttatcgttctgttccgcgacggcaaaaaacgcagtgatgaattaaccgctttgaaaactcagcagccgctgaaagccataaataagagat

SEQ ID NO: 41191 - DNA, 172 bp, Glycine max
  Peptide Sequence Number=SeqID_157969
atgatgtgccagcgggcgttcacggcgggcggtctgagctggcacccgatcgccagcataccaatcaacgccgccaggctgggggatcgcccgtcagatagcccaatggtgggtgatatcggtgggggccggcatttcttggataaaggtcgggcatccagaaacccatggc

SEQ ID NO: 41192 - DNA, 621 bp, Glycine max
  Peptide Sequence Number=SeqID_157970
atgactgaccacaatgcgctgttggcgcggttgaccaccacgctggcgatagagagccgcacgccgctgtataaacgctttgccagtgcgattaaagaggcagtgcgcgatggcacgctggtgcacgaggagatcctgccgggcgagcgcgagttcagccagtcgctgaacatttcgcgcatcaccgtgcgtaaagccatggacgagctggaaaaagagggcgtcgtgtttcgttcccgcggctacggcacgcagatctgcagccagtttgaatattcactcaaagaaccaaaaggattgtcgcagcaggcggtgctgcgcggtaaaacgccggacaccgtgtggatcaataaaagcaaaattgcctgtagcgcagagatcgccgaaaagctggggctgagcacgggcagcgatgtctatctgctgaaacgtattcgctatgttgaccgccaggcggtctcggttgaagagtcgtgggtaccggcgcgctacattgccgatgccgatgagattgcagatcctgccggtgaaatcccagagccgggtcagtgcgcgtatgccggacgaagccctgcagcagcaaattgccctgcccgccaatgtgccggtgctggtgattaa

SEQ ID NO: 41193 - DNA, 1640 bp, Glycine max
  Peptide Sequence Number=SeqID_157971
catccagctgctgacgggcacaatttatctgctgctaaagaaattcttaaaatgttggttgcgctcgcaattgtgacaggcgcgcggccaattgtgtttgacctgcttttcacatcaatgcacactggcgggcgtgaaaaacggcagatgaagagccaagagatgttgcagaattatagtcagcgcgtccatttctattactgcattctggttgcgttaaaactctatgtgaacagcaagaaatccggcggcgtacgcgggaaaaataactttttgctgaagtggttacgcaacgcgcaaaacaacaccatctttcatcctgatatcaccagtgaaattgaatggctgcgcggcaaaattatcagcgccggaccggatgccgatttagaaccgatgctgcaatacgtttacgagacagcaaaacgcgccgaaacgctgcgtctcgggccggttagcaccagcacgctgatcaataaccagcagcccgcgcaaaatgcgcccgccgccacccaggttaacgcccgggcgcaggactacatcccattaattaccgcttatatcgccgtcgagacgaaaaatgccgcaggtgtgcagatcgcaatagcggaggcaataaatggagacagaatgcagatgaaggatatcgatgttggatttacccacgttgcgtttatggtgagggatctggagaagagcatggatttctaccgccgctatgcaggaatgaaggtgatacacacccgtgaacctgacgtcccggctgcccgcaaggcggatgacgtgtcagatacgccactgggtaaatttggacacttaggcattgcctgtgcgtcacgcgaagagatcgatcgtaaaacagcgatggccgtcgccgaaggcgtgttacgcaaagcccccgaagaggctggcgaaccggtgggatattacgtattttttgccgatcctgatggcaatacgctggagctgtctttcgggcagcgcgtcgggcttgaagcgatacgcaccgctcccgtggctgatttgccgcatctgtcgcgctatcgcaatctgccagacgttgctcgttatcagagctgggaagaatttacctggcaggacgctgagaaattatatgcgcagcaggatgcgctgccattcaacagcgataacacctggtttcagcttgccgtagcacaccaggaagacgaccggctaataggggacatcggaattcatttttttgatgaaggaagacaagctgaactcggcatgacatttgatgccggatttcagaaacagggttttgcgcttgaagcaatgagtgccatcgttactctgcttttcacgcagtttgcaaaacaccggcttacagccgtagtagacacacgagacatagtgacaattagcgaagtaagcaaggaagagtatcacttactgattcaggtctgggaggctgccgtccgggcaacgcatcatttcctgaatgaacaggatatcctgcggctcagacagcttattctggaaaattattttgacgccgttgttctgagaaagatgaccgatgaaaaccatgacattgttggattcatcggcttacaggatgagaatatcgagatgcttttcgtctcgcccgctcatcacaaaaaagggatcggtgcacg

SEQ ID NO: 41194 - DNA, 282 bp, Glycine max
  Peptide Sequence Number=SeqID_157972
atggtcgaaagggagatgattaccatgatggtagacacattgccagtgttttactatgagaagttggtaggctacatgccttccagctttgcggacttggtattcaccggggaaagaatcgaagtagggttgaagagaaggaagtttgattacgtctcctccacaagtactaatgctaggagaattggagcagctggggcaaaaaggaaggaagaagatacccatgccgtcactttggcgctcgcatgggtcaagcctctgcagacctctcatggtacctaa

SEQ ID NO: 41195 - DNA, 234 bp, Glycine max
  Peptide Sequence Number=SeqID_157973
atggcaaacaatccttcaagtgcacagaagaaagaaaaaacttctaagaggaagcaagagttagtcaaggttttctacacctatgcacatgctgaccttgaaggtaacctcttctctactataattggagtagacatggtcattgacactactgtatggaaggaagtagttggcctggacatgggtggagcccgcaagtttgatgaaacacctaatgagtacaacaagatgtag

SEQ ID NO: 41196 - DNA, 276 bp, Glycine max
  Peptide Sequence Number=SeqID_157974
atgcataggatacttttagaggatggagctaagccagtgaggcagccacagtggcgactcaaccccgtcattctagatgtggtgaaaaaggaagtgaccaagctcttacaagctggaatcatctaccccatttctgacagccagtgggtgagtccagtccaagtggttcctaagaagacaggcctcgcagtgactaagaatgaaagggatgagcttatccccataagagtgcagaatagctggcgagtctacattgattatacgaggctgaactag

SEQ ID NO: 41197 - DNA, 312 bp, Glycine max
  Peptide Sequence Number=SeqID_157975
atgtcattgcctagcgctgttcttgtgtcctcctccaacgagtctggagccccgcgaatgtcattgcctagcgctgttcgccaattctccattctccacttttattcggagacccatgaatgtcattgcctagcgctggtcatgtgtcctccaccttcgagtctggagccccgcgaatgtcattgcctagagctgttcgccaattctccattctccaatcttattcggagacccatgaattcattggctagcgctgttcatgtgtcctccgttatcaagcgcgaagcctctgaaaaaaaaaagaaggagtag

SEQ ID NO: 41198 - DNA, 669 bp, Glycine max
  Peptide Sequence Number=SeqID_157976
atgaaaagagaaaaacatgcctcctatagtagtcataactcttgcaagagcctaagtgaagaacttcgtgactattacgaacgaaggcataggtcacatcgtagacctcactcccatagaagagaaaaggaaagaaagcctcaagaggctaacattaacctcccatacttccatgggaaggacaatgtagaggctaacttagttttggaaataagggtagagcaacaatttaaaaagaagtctatagaaaaatctaatggctctcactcttatccaaagaaagaccaaggtcgaggcatcttaggggtgacaccttctaagcccaaagatgataaggggaagacaatagaaaagcaagcccctaaggctaaggacacattacttctcaatgccctaccatgtgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagccttgccttaaaacaatgtgctttcaagacatgcaaggctctggtaatcgattaccaggaagtgtaatcgattaccagaagacagggttgagaaatagctgttga

SEQ ID NO: 41199 - DNA, 321 bp, Glycine max
  Peptide Sequence Number=SeqID_157977
atgaccataatttgtctccgcgtgtcatcaggcccaccgcctatggatgataaaagggtgcagaatgaccataatttgtctctgcgtgccatcgaaaacgactgtgtctggatggcaaaagggcgcagaatgaccataatttgtctctgcgtgccatcgaaaatgactgtgtctggatggcaaaaggtgagcggaatgaccataatttgtctctgcatgtcatcgggctcgccgcctctggatgaaaaaagggtgcagaatgaccataatttgtctctgcatgccatcggacacgactgtgtctgggatggcaaaaggtga

SEQ ID NO: 41200 - DNA, 261 bp, Glycine max
  Peptide Sequence Number=SeqID_157978
atggcacacagagacaaattatggtcattctgcgtccttttgtcatctagaggcggtgggctcgatgacacgcggagacaagttatggtcatccgcacgcttttgctatctgtaagactcgacgagataaacgcgcagagacaaattatggtcattctgcgcccgttgtcattcaggaacaacaagttgagtgataaacacgcagagaaaaattatggtcattctgcgctctttatcattcaggagcagcaagtcgagtga

SEQ ID NO: 41201 - DNA, 210 bp, Glycine max
  Peptide Sequence Number=SeqID_157979
atgcagaattcaatgagggatgtgtacttaggagcctacctaaatggtgctttgaaaggacttgacgatactccacaaagtaaatcaaaggctgttactagatggattgttgttaaagatgctagaccattggaaccagagagattgaaggcgcttcgcatccagtgggcaaacttttatttgaaagttaaaaatgaaacagttagttag

SEQ ID NO: 41202 - DNA, 291 bp, Glycine max
  Peptide Sequence Number=SeqID_157980
atggctacaccacccagctcttctcctcctcctcctcctcctagtgagagactcttggtccatgtggatcctgctaccaggaaagtgaacagtccccacagaaagaagttaagaacttatttcgagatcgtcactcgtgataaggtggatgtcacctacgagaattggaagcaagtgtctgttgctcagaaggatttgatatgggaggatattcaggatgaatttgatatccctgaagcatcttatgtaaggacaaaaaagaaaatacttcaaactgtgggggagcagtga

SEQ ID NO: 41203 - DNA, 422 bp, Glycine max
  Peptide Sequence Number=SeqID_157981
ggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 41204 - DNA, 252 bp, Glycine max
  Peptide Sequence Number=SeqID_157982
atggctggccatatgggtagaggtgtcatagaggagcaggtatggaggaagggaccttggactgctgaagaggacagattgcttgttgagtatgtcaggttgcatggtgaaggcagatggaactctgttgctaggcttgcaacaaacaagaactctgagtacttcgacatccttaccttgacagtagcaagatcgcgacaccactccaaagagcacgacttcggctatggcggtggtgggaacaacaggtag

SEQ ID NO: 41205 - DNA, 210 bp, Glycine max
  Peptide Sequence Number=SeqID_157983
atggtttcctatgtgaaggcttggatgaccctttggaggtcccaactggctcttcacgtagtcctcacggtttacactaagttattacacacaaatagaggtttggatggtctcttggagactcccaatacacccccaaagaatgtccaaatacaaggaattgcaatagaaaaaactcagcactcaattgttctattacaacaaatttaa

SEQ ID NO: 41206 - DNA, 1045 bp, Glycine max
  misc_feature (948)..(948): n is a, c, g, or t
  misc_feature (986)..(986): n is a, c, g, or t
  Peptide Sequence Number=SeqID_157984
gaactggccgaaagcctgctgttcggccacgccaagggcgccttcagcggcgcgggcgcggcccgcgacggctttttccagcaggccgccgagggcaccctgtatctggatgaaggcccagtccgcgttgctgcgcgtgctggaaaacggcgaataccggccgctgggcgacgcggccagccggcggatgggttgccgcatcatggccagcgccagcatcgacctggaacaggcggtggccgggcgcggctttcgcgccgacctctattaccggctggtggcgcaagcgggcgccatgacgctgtcggccgacgcgctgcatgcgctggacgcgcacgactggcccggcaacgtccgggaattgcgcaaccgcatcgcccgcgcggtggtcatggcggacggcgccatgctgtcggccagcgacctgttccccgagcgtcgcctggcgccggcggcggacctggcggcgttgcggggcgacgccgagctgcgcgcgatccagcggaccatcgccgaaaccggcggccacctgggcgaggcggcgaaaaagctgggcatttcgcgcacgaccctgtggaagaagctgcgcgcggcgcgttgaccgccggccgcggcgccgggccagccgaagtgctcgacgatgccttgcagcgcgaattcggcgctcgcctggcggatctggttgcggctgccgctgaactggcgtgtcgcggtgtagacgatggggctggcgtcggccggccccgtcttgaagacccaggcgtagcactgcgtgccggcgggaatgcggtcgtcggtggcatcggtgacgccggtgttggccaccgcgacgttggcggggctcttgcgggtcgcgcccagcgccatgtcgcgcgccacggcttcgctggtgaggttgtggcgcgccagcgtcgattgcggcacgcccaggcagcgccgcttggccgncaccgagtacaccacgaaggcgcagtcgagcaggccgnccgcgccgggaatgtcggccagggtggccgcgatcagcccggcggtgcaggactcggcc

SEQ ID NO: 41207 - DNA, 992 bp, Glycine max
  Peptide Sequence Number=SeqID_157985
atggtccgcgtgaagacaataggggagatgacgactgaggccgcaaaggaaatcgctgagaagatcgattcctttgaggagcgggcgacacagggatccttcatccctcatgggcatcaggatgttctcaccgctgctattagacgtccagagcaccctggacatgtccgtgctgctggattcggtgtcaccatcaagcaatacttcggatcggctccatggacgtcccgcagctcttcctccctgcctcttgaagaattacagcagctgacctatcccagttcagtcttagatgcaatctcagggacttgcactgcctccagagcctctggaaacgatcctgagacgggtgactcagataggtgcggcttgtacatcgaagcaaatcctgcccgcctggttaccctggggaaagtttatgagggatccactattgttcataacactcctttgttgcttggccaagtaaaggtaggtgcgaaagaggttaaagatccaaatgctgcagttcctgtacccactgatgaggtttccttagttgggcagacaattcacaccttccttgcttggccgacacatctggtcaagtctttatcacaacagcttgttgtgtcttcggcaaaaccacctgaaaagtcggatccagaggtcgatgatctgctttatctgatgacattgaccatcccagagcttttcttgaggccttaccaggttacatgggatgccaccatgttcaaggcctttaatccagactttccgctctacataaagcacaaagacctctccgaaatcgcacacggtggtcaatgtctcagcatatcagtgcatctgactaaaacaagtatgcgagcggggaattttgatatctatggattcctcgagccacagttcattcagaggtctgggcaatcgcagtttgagactggaagttacacaaagagttggattcagagttcaaaatgtgatgtctaccttggagcctacctaaatga

SEQ ID NO: 41208 - DNA, 160 bp, Glycine max
  Peptide Sequence Number=SeqID_157986
gagcagaatcgtcttaggcaatggtcaaatgtcgggccggatccaaaggcagagaccaatcaagggacagatgcaagtagagactaggatcacgatcgatagatcgtcgtcccatgcccagctctggacaagcggaaatcgtagctgggaggcagcctag

SEQ ID NO: 41209 - DNA, 1200 bp, Glycine max
  Peptide Sequence Number=SeqID_157987
ggctgcacgccctcaccttcagaggactacacgtcgtcaccttcagagggctacacaccctcgccttcagaggactacaagtccttacctttagaggactacacgtcctcgccttcagacggctacacgtcctcacctttagagggctacacaccctcaccttcagaggactacacgtcctcaccttcagagggctacacgccctcgccttcagaggactacacgtcctcgcctttagaggactacacgccctcacctccagaggactacacgtccccgccttcataggattgcacatcctcaccatcaaaggactgcacgtcctcacctttagaggactgcacgtcctcacctttagaggactacatgtcgtcgccttcagaggactatacatcttcaccttcagaggactacacgttgtcaccttcagagggctacgcgccctcgccttcagaggactacatgtccttgcatttagagggttgcacgccctcgccttcagagggctacaagccctcgtcttcagaagactacatgtcctcaccttcaaagggctacatgtcttcaccttcggaggactacacgtcctcaccttcaaaggacagcacgtcctcgccttcagagggctgcatgtcctccccttcagaggactgcacgtcctcgccttcagtggactgcacgtcctcaccttcagagggctgcacgcccttgccttcagagggcttcatgccctcgccttcaaaggactgcatgtcctcatcttcagagggctgctcgccctcaccttcagaggactacacgtcctcacctttagaggactgcacgtcctcaccttcaaagggctgcacaccctcgccttcagagggcttcatgccttcgccttcagaggactgcatgtcctcgtctttagagggctgctcgccctcaccttcagaggactacacgtcttcaccattagagggttgcacgccctcacctttagagaactacacgtcctcgccatcagagggctgcacaccctcaccttcagaggactacacgtcctcgccatcagagggctgcacaccctcaccttcataggactacacgtcctctccatcagaggactgcacgtcctcaccttcaaaggactacacatcctcaccttcagagggctgcacgccctcaccttcagaggactgcacgtcctcgtcttcagag

SEQ ID NO: 41210 - DNA, 618 bp, Glycine max
  Peptide Sequence Number=SeqID_157988
atgcccgagcccaatagcagtgcttatgccgcagcagtggctgccgtgagtttgccggtccttaaagccagccgtggtcgtgcatttgtgctgtgcacctcgctcagggcgatgcgcgaagtgcatgccctgctacggcaggcgtttgaagagaatggcctggattatcccttgctgatgcaaggcgaaagtaaccgtaccgaactattggaccgtttccgtacgcacggcaatgccgtactggtcggttcgcaaagcttttgggagggcgtggacgtgcgcggcgaagcgctgtcatgcgtgattatcgacaagttgccatttgcgccgcctgatgatccggtgctggctgcgcgtatcgataagatgaatgccgaaggcaagaatgcttttatggagtatcagctgccatacgcggtgattacccttaagcagggtgccgggcgcttgattcgcgacgagcaggatttaggggtgttgatgatttgcgacccgcgtctggtcgataaaccttatggccgtcgcatctggcagagcttgcctcctttccggcgtacgcgcgtgcagcaagaggtcgaggatttttttaccttgattaatggcgccgctcagccatga

SEQ ID NO: 41211 - DNA, 237 bp, Glycine max
  Peptide Sequence Number=SeqID_157989
atggggctccgaataagatttgatggtggaggatgcacgagcagcgctaggcaatcaattcgtggggctccggactcgatggcaatcaattcgtggggctccggactcgatggtggaggatgcatgaatggcaaacaattcatggggctccgaataagatttgatggtggaggatgcatgaacagcgctaggcaatcaattcgtggggctccggactcgatggtggaggatgaatga

SEQ ID NO: 41212 - DNA, 435 bp, Glycine max
  Peptide Sequence Number=SeqID_157990
atgaagatggacatgaatataggagcacttatatctagacagatctcgctcattgctcagttcaactcctcgaggcttggatttccagccctcatcattgccttgtgcaaggcccgaggagtcacctcagattctctcacttatgagtcactcagcccagccattaatttggcttatattaagaagaattgttggaacctggatgacccttcagtcacttttccaaggacccaaaaatccagggctagaagatttgaggccccatgtccttcagctgcccctactccccttacttctgagcctgcaccagggccaactcctaattatgcagagcttgcaggatgtggtccagcaacgaccagttatgagcatggaggagtttctacagaaggttgcctggccaggagtctagccttctcctttgggagggggtga

SEQ ID NO: 41213 - DNA, 315 bp, Glycine max
  Peptide Sequence Number=SeqID_157991
atgccatggaaggaggagcttcaccaccaagagagtgccttggataagaagcttagagaggaagcttcaatggaggaaaaaatgagagagggggggggggggggggggcacaaaattgaaggagaaaaagaggaagagaagttaaacttggaaatgtgtctcacaagtttcacattcatcaaagttgtgacaaatgccacaagaatgaaaggtgtgactctagcacatgggaaaagaatatgccaaagacatctaagcatattccttgaaaagctagagggggggggggactacacacacccctccaatagctaa

SEQ ID NO: 41214 - DNA, 375 bp, Glycine max
  Peptide Sequence Number=SeqID_157992
atggcgtacaggattgaagcagtcattcttatggaaataggagaaccagccttcagaattacaaatttgaatctaaaccagaatgaagggaacctcaaaattgagcttgacctcattgaagaaaggatggtttcagaggaaaaattaaaacagggaaaacttgctgaaaattgggaaggatcttacaaggcactccagaaagtgggtttttcaagtcaagtaagtaaatatcaaaagacctatgaaatttgtagacaccctgggaaatgggttccaaaactaggcaccccgagaaatgagatcccaaatcgaggtagaatcctaaaaagacctaggaaatctataggcaccctgggaaatgggttcccaaattga

SEQ ID NO: 41215 - DNA, 1464 bp, Glycine max
  Peptide Sequence Number=SeqID_157993
atgttcaagttcgactcaaacatgtttcacagatttaaggaccgtttcttcaaggtcaaggcaaccaatgtcactgttgacgggaggagaggatggacaaggcttttctcaagtgattgtcagccttattggacgtgtaagccatcctatccttactgtcaacatgcgatcctcgtactattctggatggttggacctgctaaagatgatgtgcctgctcctccctcatcattgttgagctttctgctagggaaggaggtcaacctaaagccagagtcaaccctccttgagcttctgaagctgatgaagatgaagttgtcaagggccccctttagtctccaagctttgaaacaggctattgggttgatttctagttcaagtcgcctttctcccaccagctctcagggtccaccttcatcctctttggttgttcaagttgttgttgccaccacgattattttcgatcctccagtacctccatctccacctgctcagggtccaccttcttccaccacactggctatgtcagcccccttggctgctcctccttcttctactgtcgctctaaacaagatttcctctttagagactgaggtctctaaatggagagccactgctcagactgtatggcaagtagagcatcccaaggtgtccaatgctactatcgcccttgctgaaaagaatgaattggtgggcaaggtggagtgtactgctaaagagaaagaagagcttgcagcaacagtggtcaaattttccaagactaaaataaaggagtctgagctcaaagtggaaaaagagaaaggaaaaaacaaggagcttgaggaggagctcttaatgctaaaaaagaaagtcatagagaagcacgagaaggggttctttaaggcctttaggcaagctagattctttaataagggtttcgaattaggtctttttgacctgtttaaggatgtgaaggatgatgaattgcttgacgaggaagagattgctaccggggaggaggatgtcgaagaagaagacgatgagccaatgtttaggttgtgctctctatgtggacttgcatgttgccgccttatgtctatacaatgtttagcctttgatgcttgtcgtagaataatgggagtagtcctttgtgttatgctggttttaccttacttgacggatttgtatgaaataaagaacgagatgacatctgatcatctcgagtttgatttcaaatttgttgaagttgaaggtcttgccaatcaacctatgatgttccattttctatttgcagagcttcttacccaaggctgtaatgagcttaccaaggattcgacaagactcaccaagggtggaccttgggtgatgcaatcctatcccccaaaggcattggatagaagactccaagaagattggaccagagatccaggagaaggccctagggttctcatgagcctcgggatagattttgggctcatgggctaa

SEQ ID NO: 41216 - DNA, 519 bp, Glycine max
  Peptide Sequence Number=SeqID_157994
gctaacgtcaggattgaccatcgtcaagatgggctccacgatctcacaggtcgagcttgcgggtgtcctccattgaaggaatgggaaggggttgttccgataggtgactcctcgtcggaggagacacgctatgaagcttctgacaacgagtcatcttcctttgaaaggttaatgaacccacacaatgtggacgagggaaactttctacctcgtgaaagggtagggccttctaccactcctttaaacgaggagtcgatctttgtcattgcaatccttccttcttcccttttggtggctacggggaggaatgatgatagtgacatcagcgtttcaccccgtaacaggcatcgccgtagtgttggagtgccttcatctcctccctctgtcaccaattatgaatgggtaaaagattatgtcttgaagtaccactcctcgatagcatccttcgtgggtcttggggctctatggcgccaactggagttggccaaaccgggatactccagcaagatgattgtctag

SEQ ID NO: 41217 - DNA, 474 bp, Glycine max
  Peptide Sequence Number=SeqID_157995
atgtacaaagataagtgcgctcatgggcctgaaatctgtcctaaggctcatgaaaatcttagggccttttcttgcatctctggcctaatcaacttgaagtcttctatccaatgcccttgcggggtaggattgcatcatatgctatatgctataagaagcacagagaaacagtccaccacaaattcctcaccgtccaagactgataaaaaagtgggcaattaccggaagaagagaaaggtggaaatatttaatgaagtacaaagccaattacaacaaaccaacactcacgagagttacagaggaataaagatgagaaatgaacataaatgtcataaacaaagcctaatggcagcatcaagattatatgcagaaaaagtcaaggcaaagacacaaaggaagggtaggactgaatctatacttgaggagctgacaacacacaatgatagcaccatgagagcaatgcaaatactataa

SEQ ID NO: 41218 - DNA, 693 bp, Glycine max
  Peptide Sequence Number=SeqID_157996
atggaggagggagtcagagacaagcgctcttgcgtgcggggccaatggatcccctttgatgaggatgccgttaatcagttcatggggcatacattggacattgcccgaagcatggcagggagacgggtacggatcatgcgcactagcatgaccaccctgacacagatttggatgacattgttgctcagcaacattctccctagtgaccataattccgacctccctctaccgaagtgccagttggtctatgccatcttgacccaggtgaatgttcacatagcccagttgatctcaaatgccatatatcaatttgcagagatcacgcctcctagacacccagtggacccggagaagtccaacagggcactagggtttttggctttgatcacagacctttgccaattctatggagtgtcggcaggcatagtagtacgatcaggcatagcagcagtggcaggaggaccagcagcaaccaacaccaccaccacctctacggctgccgccatccttggagtttatgtctgctcacctgcggaggatatagctccagatgaacacgtatatgcagcatttgcatggttgaatgatgagcccgattttcgaactggttcaggacctgcaggggccccaggagacgaggatggagctcaggaggatgatgatatggctgatgtgctggactacttcctttga

SEQ ID NO: 41219 - DNA, 939 bp, Glycine max
  Peptide Sequence Number=SeqID_157997
atggctcagacatggagcgtcttctcgtactcaaacctagctcctacctcccgcacttcagattttaacacagacagagctaggttggtctatggcctaatcacaaggatggacatgaacattggcagtttgatctctggacaaatgaccatgatggctcagtctaactcttctcgcttaggcttcccagctttaatcacagccttgtgtagattgaggggagttggatctgatgctcttatttcctatgaaaacctaaggccggtcattgacttagcttatataataaggaactgttggaatgcgaatgaccagacagctaattttccagaggcaaggaagaccaagctcagagcagttgatgttccctcttcctttgcaccaatagctggcatccctgcatcttctacttcagccccacttccagccttagcagacttatctgcccagagctctcagacttcagatgccaaattgcaaagcttgtttgaaggacagattctcatcatgcaaagcttgcaagaactagctcagcaaaggccaattatgagtgtagagcagctcattggaaaggtggtctggcttggagcccgaccttcttttgtgggggataatgaaagttttacagcccaggcacctcaacaacatgagctagaaccagaaaacgatcacttatctgaagccatcatccctggagctgttgatttttcaaaaagaaaagtagagacgagatccaataaggctgctcatcctggaccagtgctagtactagctgatgtaccatttctagggatggatccatcttcacctcagcatgcagccgactcttccactcgtatcttagagatacctgagggccagaccacaccagtcttggctctggacacttctcctctagctactccagtattgcatctgacagataaggaggatgtttag

SEQ ID NO: 41220 - DNA, 306 bp, Glycine max
  Peptide Sequence Number=SeqID_157998
atgtcgcgggggtcaggagaccttggggacgtcaggcgagctcctggcagtcaacagataaaaggaacaaagaccacaaagcgaggaggcttgtggtggctggccagctgtgaatcttgtgtgatatatgggttatggcctctggttgtagaggcctctggtaatcgattaccagtctgtgtaatcgattacacagaggaatgggtcactggtaatcgattaccaggttttcatgtcctgaagctgtgtgattcgagtttggcctctggtaatcgattaccaaggctgtgtaatcgattaccataa

SEQ ID NO: 41221 - DNA, 685 bp, Glycine max
  Peptide Sequence Number=SeqID_157999
atggcttcttcttcatcatgtttgtcaaatatttcaattatttctggtcctgttgagggtgactgtggatgcaagataagcatatttcacagcatatttagaatgggggaagaagatataaaactacatattagaagagttgtccccacatatcaaggtcaagaagaaataccagaagagattattcctctacttcgtcaatctggttgtaactggatcatgaagatgggatatttagaaataaatgttgcattaatcactgtcttgatagaaagatggaggtcaccattaattagtccaacaaaccttagttgggttgatttatgtgaagaattgttaggagtcagaccagaagaagaaaggtttactcatgcatggatctttcgattcattggaggtgtcttatttgttgacagcgccaccaattataaaactaaatcaattggaggaaaacttgaggaaaattgggggcaactgttaggtccgatgatcaatcaatggaacaatcagactgattttagggtcgacgcttatccacgacaagaaggtctactgagttttaactccgactatatggtgtggtataggcgtaaaacaaagatgtttgttgaccctaaagatgaaaaccatggcgaccctgacgttactgtacatggtgtcgccataagggagatatacatggacg

SEQ ID NO: 41222 - DNA, 342 bp, Glycine max
  Peptide Sequence Number=SeqID_158000
atgagattgactgttgtaggcatacttgctacgttttggatctcagttgctgctgatgagccgcctaccactttgataattgatgtgactcacaagattcctgatgaagagtgcatccacaagtcaaagcttggagatcaactgtcgatgcattatactggaaagctcttttccaatggcaaaaagtttgattcttccttggatcgcaatcagccctttcaattcatgttgggagtaggccgagttatcaaaggctgggatcagatcgaattcctgcagcccgggggatccactagttctagagcggccgccaccgcggtggagctccaattcgccctatag

SEQ ID NO: 41223 - DNA, 225 bp, Glycine max
  Peptide Sequence Number=SeqID_158001
atgatatttgctcaggagcaaccatttcaaggccagtgcacctactcatctgcaacgacccataatttaatttcccccttgggagatgcgtccacctacagaccttctactcaatgtgttttagtcgactccgaccttcgcgacccttacagagcatcctccgttcccatttaccaaactgctacgtttaggcagtcaggagtgactgagatggggcgagtatga

SEQ ID NO: 41224 - DNA, 435 bp, Glycine max
  Peptide Sequence Number=SeqID_158002
atgggatcaagtcaaaagccttcacttaaaaagaggttctatccagtcaaggtcaagagcctagggatcaccagtctaagagagttagggcgattgatgggtcagctccagcggcaagcttttcgtaaagcttacagtaaaatctgggacctagccatggtagaagtctccacagaggccattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccaccaaaggcaagtcgaaaatggggtggtcggaataccgagaaaatatttggag

SEQ ID NO: 41225 - DNA, 327 bp, Glycine max
  Peptide Sequence Number=SeqID_158003
atggccacaatgatggaggccatgatgagcatggagaagatattggaagccaatgctgttgcaattgccgctaccagcgctgttgctaaggtgaacccgatgcccccatctggcctcaaccaaataaatcattcaacctcagatatggtaggtttggaaggaaaagatttgggaagtatgggcaacccccattatgtgcaaattcaaaacaagcacgccttcttgccatatagcctgcctcccaactatacaccacctaatgtggtgtacactcccaatgagaatgtcaataactccacttctatagagccaacaaccacaatctga

SEQ ID NO: 41226 - DNA, 330 bp, Glycine max
  Peptide Sequence Number=SeqID_158004
atgtgtgagatcgtggagcccatcttgacgacggttaaccctgacatcagccagctccaaatttcggtaagtacatttggcgcccgccgtggggctgcaataaaactctccttgcagccacctacacaaatggtcagtacccgatctggtctcaggtccaaggcctacaagctccacataggagctatgtcacgttgtgacaaagaagaactcagcaagttgaaggttgaccacgacgaattggaggctcatgtgagacgccctcaaggagatgagtactccccttacacgatcaatgagcgcacccagggtgaatcactacctcaatag

SEQ ID NO: 41227 - DNA, 597 bp, Glycine max
  Peptide Sequence Number=SeqID_158005
atgaagcaagaggaaaaccctgtaaaagagcacgagtcaagagaaaaatatgaggagaaagatgaggaacaagcacaacaacaatgggagaagtactcaacagtagaaaaccaacaagaaagtattctccaaatcaataaccttcctcatcaactgattgtcaagaaaggaaggcaaggagagcatgaggaaaccttaagtgccattctttttttaatcactaacacctttcctgaaatgatttggaatgtagttccagaatacatgaagttcatggaatttctagctaaaaggaccagatgcccagagctcccaaactgcagtcactatgctgcaaagcttattccagggacagcctggtctggagctcgacttttgattgtgagagattgtggaagctttacagcccagacacctcaacaggtgagacccgacgaggctactcctcttgagcccacacctgcacaggtcgaaccagtgccaactaatccaccatctccagtggcagatccatcttcttccaagcttgaagcagctccctcatcttcacctattattattatctctgaagactctatagagtcagcatctggatga

SEQ ID NO: 41228 - DNA, 234 bp, Glycine max
  Peptide Sequence Number=SeqID_158006
atgtctcctctacctctaggacctcacaatcactcacaaactcatctcaagctctcaggacggcttcctcttcaagctctggctttaaatagagttgctgatttttggtcattcgctcagccgaattctggttcgctcaaccattcatgcgctcagccagagaaggatggctcaactaatcatgcgctcagccagagaaggaaggctcagccaattaggagacatttggcttag

SEQ ID NO: 41229 - DNA, 150 bp, Glycine max
  Peptide Sequence Number=SeqID_158007
atggcgccaaaaacttgttcactttcggcaagtgcactagatcgtgtagattcctcttgttggactaaactcggccaggaccgcattaagacaaacatacaacaactaggttatcgtacctcgatccctcgtgatagtacaacaaactag

SEQ ID NO: 41230 - DNA, 393 bp, Glycine max
  Peptide Sequence Number=SeqID_158008
atggtgcgagcaaggggaaagaggaagataagtggtctcaatgagactacctttgatgccccagttggagttgcaccattggctttagacatgggtagcatgggcaaagtagttacttcacttcttgaaaaatttaatgttgatcttaagcaaattggacgtttggaggttgggagtgaaattgttattgacaaaagcaaatcaattaagaccttcttagtgcaagcttttgaggtatatgctgaaggacctgcttgtcccactggaggagcagctgcaattgccatgctcctaggaccaaatgctcttattgcttttgaaagcaaactcagaggtagtcacatgcctcatgcttatgatttttacaagccaaatcttgctaatgaatatcca

SEQ ID NO: 41231 - DNA, 225 bp, Glycine max
  Peptide Sequence Number=SeqID_158009
atggccatgatgaaagttctatgtgattcatactataaggatggttcgtacaaagaagaggaaattccggattctctaccacaacaagaaccaagcctacccaacaaggcctttgagaagggaattagaggaagcaacgatgagaatgtgaagctattgaaacaaaagtgcgaccttggaggtgttagagatagggggagcaacatgagcaacatgaagacttaa

SEQ ID NO: 41232 - DNA, 189 bp, Glycine max
  Peptide Sequence Number=SeqID_158010
atggggtgtaataattggacccaaccttggcccgtgggctcagaaatctaccctgaggttcatgagaaccttagggccttcttcgacagctctagcccaatcctcttaaagcctcttactcatggctctagtgactggtcccttcctatggaggattacattagaaaagatcaaacattgtttcaatga

SEQ ID NO: 41233 - DNA, 867 bp, Glycine max
  Peptide Sequence Number=SeqID_158011
atggcgatgttgaagaacaaaagaccaaatcccaacaaaactaccaatcttcgatggaaccaactatatcaaggcgtgcttgatatcataagcatcggcgtcacaccattagacatgaatcccacgaaggcacacagagcaacccatcgtgaacagatgaagaaagatgataaagtgatctttctaattcatcaatgcgtggattcaaatgtcctggagaaaatcattgactatgagatgaccaaagaagcatgggacgtgttggctacaacttacgcaggtgacaagcaaaccaagaaggtgagattgatggcactccggcgtcaactaggtttgcttcagatggaatcaaacgaaatggtggcgaaatttgtaaacaggttggtgattcttgctaaccagatgaagagttgtggtgaggtggtgacagattcgatgaaggttgaaaaggtactcgctggcttaactccaaacattgatcatattgtctctgcaattgaacaatcaaaggatctagaaacgttgaaattggagcaattattgggttctttggaagcacatgagttaaagatgaagaatacagaaggtatcaagaaagaggagaaggctttcgagaaagccttatttgctaaaaatcagaagaaaggtggtggtgattcttggaagaataagaaagggaaaggcaagtggaagtataacaaacaagaaagcagcgttctaaaagtgagaatcaaaagaaagaaggagaaaacaatggaaagggaaagaagaaatcaaaggagcacattcaatgctataactgtcaaaagtatgtccattatgtgtggcgtccctaaattaatgactggtttaatagtaataatttaa

SEQ ID NO: 41234 - DNA, 2103 bp, Glycine max
  Peptide Sequence Number=SeqID_158012
atggctccatacactcctcaacacaatggaactgctgagagaaggaatagaacagtgttgaatatggtgagatgcatgctgagagagaagcatcttccacatgatttctgggcagaggcagtatccacagctactcacatcttgaatagatgtcctacaaagaggcttgacagtttgacaccagaagaagcttggagtggactcaagcctagtgtgaaacacttcaaggtatttggatcactctgttacagacatatgcctgagcaaaatagaagaaaactggactcaagggctcaaaccttgattttggtaggatatcacagtactggggcctataaaatgtttgatcccttgagcaagaaaattgtgataagtaattatgtgattgtggatgagacaaaggaatgggactggagcattggtatggaaagacaaaccaatgaaacattagaagtggaactagaaggagaagaaatacaggatgaagttcagattgacaatgagcaatatgtgaatgatgagcaaaatgtgaatgatgggccagatgtgattggggttgtacctttgagaaggtcactaagacagataactccaccagtgaggtttcaagactatgatgtcttccctgatgctgcaatcaatgttaatggtgagctgatgaacttagtgttgttagcagaagcagaaccagtttcacttgaagaggcactagctaatccacattggagaaaggccatggaagaggaactgagatcaatacagaaaaacaacacttgggaaatgatgaatttaccaagtaataagaaagccatagaagtgaagtgggttttcaaaaccaaagtcaagccatctggtgaaatcgccaagtataaggaaacgctagttgcaaaagctagaattgaaattgtgagactcatagttggaatcgctagcatgaggaaatggatagtgagtcagctagatgtgaagtctgctttcctcaatggtccattagaagaagaagtatacacaaggcagccacctggctatgagaagataagcatggaagataagaagcaaaagtttttgaaatgcaccactgaacatggagtgtacttgaaggactgtggagtaactggtgtagtgatgttatgcttgtatgtggatgatcttcttgtcactagagatagcaaacaagagatttacatgtttaagaaggaaatgatggatgagtttgaaatgtctgatataggtagaatagcttatttcctaggtatggaatttgtgacaactaagagaggcatattccttcaccaaaagaaatatgcaactgatatattgaaaaggttcaatatgcttgattgcaattctgctactactccttgtgaaccaggaataaagttgtctactagtgaagacacaaatttggttgattcaacactatataggcaactcattggctcattaagatatctgtgtaattctaggccagatattacctatggagttggcttggttagtagattcatgaagaaaccatgcaaggatcatctacttgcagctaagagaattcttagatatgtgaagggcacactagaatatggaattttatttcctgcagcaaaagaaaattctgagatagaaattgttggctacacagatgcagattggagtggagatgttggtgatagaaagagcacatccgggtacatgttcatgcttggaaatgctcctatatcatggtgttcaaagaaacaagatgtggtggcattatctagttgtgaagttgagtatatctcagctgcttttggtgcaagccaagccctctggctaggaatgttactggaagagcttaacatcaagtgcagtaatgtaatgaagctcagaattgataacaaatcagccatagaccttgctaagcatccaatagctcatggacgcagtaagcatatagaggtaaaatatcattttcttcgtgaccaagttaacaagaacaaactagcacttgagtattgcagatctgaggagcagtgtgcagacatgttaaccaaagctttgaagcctaagagacttgaagaaatgaagaacaaaattgggatgcacaaattgacatatttgaattaa

SEQ ID NO: 41235 - DNA, 774 bp, Glycine max
  Peptide Sequence Number=SeqID_158013
atggctgggaatcattttccatgtgcatccattaacaaactatcattgttttgtggcacgaattaccctttttggatggtttggatgaaaatcttcatggactttgttaatagaggcatttggagcgcagtggttaatggatataccattccaacccatgtagttgataacaagattatagagaaaccttacaattcttggttgttcgtgtgcacaactacgaaagagatgtgggatttaatccaagtcacgcatgaaggaacattggaagtaaggagagctcagaagaatttgcttatccaagaatacaaaacctttaggatgaagcaaggggaaactacaggggatgtggagaaaatatttacacatattgtaaaccatctcaagggtcttggcaagatttttgaagaagaagagatcaatgtcaagccaaaggtaacaacaatttctaaatcaaaagaccttgccaccatgacacgtgatgaattgtttgggaagttgagacaatatgaaatggaattgatgagaatggttgaagaagaaactatagataaaaagcacagaggtttagcattgaagactagcattccatcaagtgacaaaagtgaggatgacaatgcagaaagttcggatgctgaaaattggaacttgcttgtgagaaagttcaacaaattccttaagaaaaagaagaactatggaaacagaacctttcaacctaagaagaatcataagaaaggagaactatcttcctccaacggatacacttgcttctag

SEQ ID NO: 41236 - DNA, 312 bp, Glycine max
  Peptide Sequence Number=SeqID_158014
atgtctcctccacctctaggacctcacaatcactcacaaactcagctcaagctctcaggacggcttcctcttcaagctcgattctctgtaggtggctttgttcgtgcttgcgctcttagcgcaattctgaaccccttagcgctcattagtggatttcggcttagcgtgtgcttttctcgctcagtggatggactgaagtggtgcgctttgctggatgacccttcgcttagtgcaaatgcacaactcatccttcttccagattcttccttacgctcagtcgaggagtgttgcgctcaacggatggctcgctaa

SEQ ID NO: 41237 - DNA, 219 bp, Glycine max
  Peptide Sequence Number=SeqID_158015
atgggcattgtttcccattgtgctcttgcttacccattcctatctcagaaggagattgagattgctattgattgtcctattctttctggggaccaggcatttgaaggccaaagggaatatacaacaactactgaggatgttgaggaagatgatgctagagttggcactagagataatggagttgctaccactattggaggaaatgatatgataaaataa

SEQ ID NO: 41238 - DNA, 630 bp, Glycine max
  Peptide Sequence Number=SeqID_158016
atgcaggaagaagaggagagacctctcataagaaaaagaaagttacctacgacttcgaccaaatctgctgaccaaacagaggcaggcaattcccaggctcaaatgcctaagaagaaaaagaaagtgaagcaggtcgagcctgaaccttctgtggctgtcgaggatggtgagccagccaagaagaaaaagaaaaagaccaagtcttcaaaagaacaaggtgacaatcaacctgttgacgtccaaccaccttcgaccgatattggcggcactgaggtagaagctgctccttctgttgctgagatgggcaaccctatcgagcaaccgaacttaccacaagaacaacctgtcgtcgaggtgcaacaaaatgtttctgcagaagaaataccctcatgggcgcgaacatctcccgctcctgaggcggatgcagtgaatgttgaggaatggggtgaaggtcaaggcattggatccagtagtcctcatggttgggcagaggttgatgaccatcatgagccgaaccagtcagataataccattcctcatgaatcaagtcagaaaagttcatctgaaggaaactttttcgatgaagacgccataaaagaggctgaagctggaggctcagacatttacccg

SEQ ID NO: 41239 - DNA, 1210 bp, Glycine max
  Peptide Sequence Number=SeqID_158017
tgtttcttttgttgagaagtttgttttggagtttgcttttgcttcgttgctgggcttgactgtgaaaagaaaagtttggtttagctctgttgttcggttggctgtgagaagaaaagtttggttttgctgcgttgctgggcttgattgtgagaagaaaaggctttgtgattataaagttatggcacgagttcctgataaaattaagttgatagatggatcaagggaagctcttaagctttctataaggatcactgatctttggttcattgggattcctgaaaagtctgaacaagccgaaatggtggttgttgattctgatggagatgaaatccatgttgtttgcaaacaagatcagctaaagcctcgcaaggctgatttgaaggaaaatttgacttatgtgatgcataattttaaagttatgaagaatgatgagaaattcagagtttgtgatcatgaatataaattatgttttactggagttactgttgttaggcaatctgatatggaacacttaccttttaggaaattcagatttgttgatttttccaatgtcattgctggtcattttcaaactagactcctggttgatgttactggcgtggttgatgaagtggtactatcctgcacactctgggaaaattactgcttacaatttttgtcttatttgaatgaggttgaagatgaaaggccgatcgttattcttttgacacatgccaggatcaaggaagcgcagggatcatatctgctgtcagttagtaattctttcaaggcgtctaaactcatgatcaacgagcttgtgctggaaattcaagactttagagagagaaaatctaatgtcagtttcttcaaacaggaaattgtttgtgttactgtcgccaagattacaactatagtgatggacaactattcatggtgttatccagcgtgcgagttaattggtcaatcaacggacgaagtcaagaggctcaaaatagaagatgacgatgttgatttaaatgcctctcctcaagcactagataggctattgggttgtttccttgcattcaaagtgaaggtgcaaccaaggttcaggaattctgttcttaaatatttagatgaatcagacttgatcaatgttgtgttggatatgcttcccgatagtgaggttgtgttttgtcaagtgtattttagttattgtgagtgtatgcatatattccatttgtttctttag

SEQ ID NO: 41240 - DNA, 312 bp, Glycine max
  Peptide Sequence Number=SeqID_158018
atggcgatccaaagtcataaaagatgcaaagacaagatgaaaataacaagaaacaagcgtagaaccatgggtttcgttctctaccgaaaccgcaagccaagttggaagattccgcttcggttgaagggttcctctcggtgtgaggtttcaatgaagaacaacgatggtttgtggtggctaatgaccaaatatcgagaagatccaacggttaacgaagggtgggcagcgtttttaccgaggcagcttcatgtagcttcctcaagaagcttcattaagaggcttcttcaagaagcttccccgtggcttctttga

SEQ ID NO: 41241 - DNA, 348 bp, Glycine max
  Peptide Sequence Number=SeqID_158019
aaagaccaaggtcaaggcatcttaggggctgcaccttctaagcccaaagatgataagagggacaaggaagaaaaactagaaaaacaaaagaaaaagaaggatagtaaggccttgtcttcaaaggccaaggggaaggaaaaagtggaaaaggattcctccaagaagattgttaagaaggaaaattattttgcaacaaaaggtgatatcaaaagaacactccttcctaaacaatccttttaccttatcctatcaagggaaacctcccttagcactatcgtacctcttgagcttgagattattcctcaagtaaaggagttgttggatgaggtttggttcataagagcttaa

SEQ ID NO: 41242 - DNA, 228 bp, Glycine max
  Peptide Sequence Number=SeqID_158020
atggataaccatgagcatgcaaatcatcgtgatacagcacaagccaagataaagaataaacgtatcaggcagcacaaagttaatgatcaggctcaaaatattgattttaatattcgtgattcatcagaggatgagcgttctgaatcaacacaagtttcttcacctgagaaccaaaattatatgtcctcagctaatgaccccgcaattaatagagaaggtaacgattaa

SEQ ID NO: 41243 - DNA, 291 bp, Glycine max
  Peptide Sequence Number=SeqID_158021
atgcacaagtacactgttgtcgccgtcaccgttggcgtcgctcggtcgtctgcgtcctctctctcgtgtgcgtcttgctcgagtatcttgtgtacgttgtgcgtcgtgcgtcgtgtgctggcctgttgccgtcgtcgcgctcgcgaatgtcgtgtgcaggtgtcgtgtgcgtcaccgttgccgtcgcgctggagactgctgctggtcttgccgctgaagactgttgtgctgttttgttcgtggcttcgttcttgcgctccgagtttccttttgcaagagaaactcgagtag

SEQ ID NO: 41244 - DNA, 465 bp, Glycine max
  Peptide Sequence Number=SeqID_158022
atgacccttgggattgaactgaggaacacgcaaactgctcccacggaagggtttttagcgcgcactgttgtttcttgtggcgatataggcttaaatggcaggcaagttgttatggggagtgtccctgcggtcttgtgcttggtgttaaagaggcagtgggttctaattccacattatgcatttagtgacactggcagaaagttgttgaagtccctcaattgtgcttccctgcatcctttcccaaagtctctgtctggtgcaatggtttatataactgagtgggacaagtttgtggagcaatccattgagctgttccgtgcagatcctgattctacacggtacgtcatgaagtacaggcactgtgatggaaagttggtactcaaggtcactgataaccaacagatttattttggaactgcttgtgcatgtttgagagtgaaaatatggatcgacatgacatcataa

SEQ ID NO: 41245 - DNA, 411 bp, Glycine max
  Peptide Sequence Number=SeqID_158023
atgggtgagtggggctgcatcgtggtgcaaaaaattagggcaccacttcagctctcgccacgactctggggttcgattcaacaacccctggtggaccaagaggtcgtttccattggtggttcttcctcggaggacacttgccacagtgcctctgacaatgaatcctctttattagagaggttgagggttttgtgccatattggtggaggcactactcgcctccacaggagggcacaactttccgctgcttccctgggtgtcatcgtcccccctgccgttgctggctttgaatggctgagggatgacattctgaagaacaagtcctccatcacttttgtggcgagtgttgttgctctacgatgccaagtaaaattggcaaaccctaaggactcctacaagatatccgtctag

SEQ ID NO: 41246 - DNA, 393 bp, Glycine max
  Peptide Sequence Number=SeqID_158024
atggagagggagatgataatcgtgatggtagacacattaccagtattctactatgaaaagatgcaaaggatcaatgtgggtccgaaaagaggcaaattgaatcatcctgcttggaataatgagaaaactggggcaaatgaagagggtgagaatgagggagaaacccatgttgtgactgtcattcctatacagccaagtttcccaccaacccaacaatgtcattactcagtcaataacaacccttctccttacccaccaccaagttatccacaaaggtcatccctaaatcaacaacaaaacccacctaccacacaaccaatgctaaacaccacctctagcacaaacccaaaacaccaaccaagaaatgagttttgcagcaaaaaaagcctatag

SEQ ID NO: 41247 - DNA, 405 bp, Glycine max
  Peptide Sequence Number=SeqID_158025
atgtgtcttagaggaagtcctacgtcccacaagctaatgttccaacaaacaagtggtatcgaccagggaacgaaggatccggttttatgttttaaggaattcaaagtgaataatttgatgcttcgaaagggaggaaccactgaaggtttgaggaagggatattatgattatcaaaatactcctagggtgaatcgaaatatgttaaaaacccaaaagagaaagcatcagaggatgaggagagatacgatactagcaatgcaacataaaaatgttccaagatcatcagtatttgatagaatcagtgaaggtccatctccaagatttgaaaagaaattttcgatcaaggatcatgaggagaaagaaatgataatggactctttcaagtctagttttaaggactcttag

SEQ ID NO: 41248 - DNA, 822 bp, Glycine max
  Peptide Sequence Number=SeqID_158026
atggctcatggtggccagcggtggtcgtgggtggtgaaggaggagtttctacggtggtttaggaggagttttgagaaagaggcggttgacgaggctatgttggagcagctgctggccttactggatgtccaggccattttgtatcttccctcgacaagcgatcccctcgctgccttagatggtattatgggtgacttcccttggtggccacttgtgaagcaggtcggacttactggtgagactgtgccattgtccgctatcgtttatcctattggagaaggggttggccctattgttggcattgttgaggtcgtcctcggtgcttcttcctttattttagctaagaggaagcgaaatgacggtgttgggaaagctgtaaggttgccgcctagttcggttcacccatcaagtttgcaagatctacctctggctccttcagccgtcgaccctcctgccccagttgttgttgttgttgttattcctgctcctccacctcctcctgttgcgccttttcaaaagattgctcagactgttgaagttgatgcgccaactgcttcagctggtctggttgtggttcctttgtccacttttgttgcacccttgttgagtgctggtgtggcgaccatgagcactcttgtgatgccgcctcctccttcttcagttccccggcctaaacagaagaccctgattggcattgtgttggcctttgacaaaaatctcatccagtcagctaggatccaacatcccatgaattctgccaaggcttttcttcaaaggagtctggcaatccttaaagaaaatgggcaaaggcaccaagagtga

SEQ ID NO: 41249 - DNA, 639 bp, Glycine max
  Peptide Sequence Number=SeqID_158027
atggctactacggcgatagaagaaaacatgatggatgccgatgccatcaataaagaaaagggaatgatggacattgatgccatcagaaaagaaaaggaaatgatggacactgatgccatcaaaaaggaaatgggaatgatggatactaatgccatcagagtaaaggagaaatcaaaagatgtttctcagcaaaaagtgggtagagaattggtggaacatagaatgccaatctgcgaaggcaagaaactagtgaaacaagcaccaagaagatatgctcctaatgtcttaaaggctatcaaagcaaagatcaaaaggctattgaaggccaagtttattcgaaccacaagaaaggttggaagcaacaccctacaccttgctagccaagtcctttttctctctctacaaatccttgtagcgctcaaagagttcatcaccgtccaacctggtgtgcaacaacttggcttcaacaaaagtgacggtggcactagctaccttagggcactccactctccaaatcgtgcgagcagtagccctccatttggaaacctccgctccaaggatgccaatttgcttagtgcctctttgatggaagcttgcttgtggggcttctatggaggctggatctttgagcttcaatga

SEQ ID NO: 41250 - DNA, 642 bp, Glycine max
  Peptide Sequence Number=SeqID_158028
atggagatgaattctagacaattcatgtttgaaacacaggatgcattgtttagtagcatttactttgtgatctgtgtctcagtttgtgttgaagttgctgaatctgtcaagaaagattttggcactatcgacatacttgtgcactcgcttgctaatggaccagaggtcagcaaaccattgtctgagacatctcggaaaggatatcttgctgccctgtctgcatcaaatggatctgcaatttctcttacatacattgcttcagaaaggatcattcctggatatggtggtggtatgagttctgcaaaagctgctttagaaagtgatacaagagtgcttgcttttgaagctggtagaaagaaaagaatcagagtcaatactatatctgcaggtccattgggaagccgtgcagcgaaagcgattggtttcattgacatgatgattgactattcatttaccaatgcaccactgcagaaagaactacatgctgaggaggtaggcaacactgctgctttcttgtcatcacccttggcatcagctattacaggcgctgtcatatatgttgacaatggtctaaacgctatgggtgttggagttgacagtccaatatttaaagaacttgacattccaaaagagcatcattga

SEQ ID NO: 41251 - DNA, 279 bp, Glycine max
  Peptide Sequence Number=SeqID_158029
atgtttgtatttagcagtgctttgaaaggacttgacaatactccacaaagtaaatccaaggctgctgctaggtggattgttgttaaatgtaatagacaaaagggaagcactgagtgtgggtattacatcatgcactggatgtcaactataatcttaggaagtttcaagaataattgggaaacgtatttcaatgatgttagaccattggaaccaaagagattgaaggtgtttcgcatccagtgggcaaagtattatttgaaagttaaaaatgaaacctag

SEQ ID NO: 41252 - DNA, 747 bp, Glycine max
  Peptide Sequence Number=SeqID_158030
atggggcacaaaagattcaatatggtggcgggatttgatgttgttggagaaagatttgtcacaaaaccagaatttttttcaaagagcaggtccgagccgttgaaggatgcttttccggagctgtttgcaatgtcatctcagcagttggtgtctgtaggaaacgcaggttcatggaggagagaccaatggacgtggggcttgacttggaagagacagttaaattcgaatgaggaagagtcacttcactctttggagaccattctggttgatgtgcatctagtggcagaatctcatgacaggtggaagtggtccttacacaactccaaattattcactgtgcgcaataatagcatcttcaaggaggaggaaaaagacattcccaagactatcaatcaaattaagcacatatgttgggcctggttcatgggaaaggtaggagggtatgtacttcctatgttaggagcgggctgcattgcaattgcatttgatttcgacagttccaaagtgctcaactactctaacctacgtcacataaaaccaaaaaaacattgttttcatcgacctagttccaaggcttctacttccactgcccccattatctacccacaatctaacacagaaggccaagttttgccgtttgcatttcctcttcaaactctctctctccagggatgtgtgtatgcatgcttttggcactttcttatggacttgccactggttttctgcatgtggtatttaatcaagtaa

SEQ ID NO: 41253 - DNA, 321 bp, Glycine max
  Peptide Sequence Number=SeqID_158031
atggctaggcacatccccacaccggaaatggcagtgagaacacacgacgtcgacctgaagagcacagtttccagaacacaaaccaaaccagaatatccaaacgcaaacaagaatgcatgccgagaggggcacggttgttgcggaaaatactcaaacggtgcctcggtggaggggtcgcgacatgaaggacgaggtttccgacgacgacaagtggtgcagatcttccctcctcgcattcgtggctaccccaaatcctcccttcagagtccaccgcgtcggaagtcacttgcagatctggtttccttttttgttctttcataa

SEQ ID NO: 41254 - DNA, 240 bp, Glycine max
  Peptide Sequence Number=SeqID_158032
gaagaacgtgctcgctcaccggtcattgtagcatgttcctgttccttcccacaacttcattttggattacacttttgtcagtcagcgggggtacttccctgctcacctgataaagaaaaccaagatagtttcagcattactacacaactccaaagtaaccccaatgtccatttctttggtgtctatgatgggcatggccaatctggtagccagtgttccaatttcgttaaggataggtag

SEQ ID NO: 41255 - DNA, 345 bp, Glycine max
  Peptide Sequence Number=SeqID_158033
atgatagaagtctctattgaagccattgcatccctcactcagtattacgatcaagcactaagatgcttcacatttggggactttcagttagtaccaaccgtggaagaatttgaagaaatcttggggtgtccgataggaggaagaaaaccatatcttttttttgggttctatccctccatggcaagaatagccaaagtagtcaaaatctcgacgcaagaattggaccaagtaaaacaaaatagaaatggggtgatcggaataccgaggaagcacttggaggagaaagcgaaggctttggcggatcaaggtgaatgggcttcgttcattgatgtcttggcgctattg

SEQ ID NO: 41256 - DNA, 729 bp, Glycine max
  Peptide Sequence Number=SeqID_158034
atgaacgaccatgatatggagaaatactatgcactaattcgacaaattgaacagctgataagagataggcctctggtgaagtatgtttgtcccaaagtttatcgagaaggaataagcgctaaagtcaaagcatatcagagagacccaatacctccctttactaacagttcctcgacgcaacctagacaccaacatccagaaaatgctactgagacagtcttaaagccaaaagagcgcggccagcctttacaaaatgatgttaatatcctagaagtcaaccctcatcgtgatttcctcactcgacagtcgagccttgaaaaagagtttaaggaggccaaaatatctaaaggggacaaagtaaagattggatcgatgttagagcctcaatttgaagccaagcttgtggatgttctaagacgtaatattggagcgttttcttggagctcagctgacatgctagccaaccatgttagaaaaattcaatatttgacttggctggtgaatgtggtgatggttaagaagtcaagtgggaaatggataatatatggtgacgtcacaaatttaaacaaagcatgcttcaaggattcatatccactaccaaacatcaatcgcctagtcaatggggcatcatgttgcaaattgcttagcttcatggatgtctacttagggtataatcaaatcaagatgcatcccatggacgaggacaaaacaacttttatagttggataa

SEQ ID NO: 41257 - DNA, 273 bp, Glycine max
  Peptide Sequence Number=SeqID_158035
atgtttactaagtccttttctcggttatatggctcaatcctcagcttccatgatatgggtgtgtcataccctaatttcgtccggggaccattgtttggtggcatgcaaccttcgcttgaccgcctcgagttccgcgacattccggaagtcaaaaagaagcattgttgcgcaatccgtaaagttccgcaacatttcggatgtcaagaagagccttgttgcgtaattcgtaaagtttcgcaacattctgaaaaggaaatgggtgtcgttacataa

SEQ ID NO: 41258 - DNA, 156 bp, Glycine max
  Peptide Sequence Number=SeqID_158036
atgagttcttcaagcctcgtcgtggttaaagcacttgaggctggagaattgtgtatccctcctgatggaatgagtggagatatgaacgacaattcctcatcaaggacatccattgtgcccacgatgcttgaatctttgatggtggaaacgacataa

SEQ ID NO: 41259 - DNA, 477 bp, Glycine max
  Peptide Sequence Number=SeqID_158037
atggagtcatggatgggacccatcatttgttatctagaaagtggggatctacttttggacaaagtggaatcagccaaatacatcaagttggttgcttggtacgtgatcattggtaacaagctatataagaggggtttcaacacacctctccttaggtgtctcaccccttaccaagtcattggaaaaagtgcataccagctgtcataccctaatttcgtccaggaactatcgctcgttgatcttttgatccttgctagtcgacttacagtgttgaacgccagttacagtgcaaagaaaaaaaccattcaatgttttgatcaagaatacaaaaggataccaagcttgcccagcctagcatctggctcgcctgggccaccaaatagcttcatggtgaagaaactagctcacctaggcgagctcactgctttagggttaagttccaactcgcttgggcgagctgcaactgccccaaagtga

SEQ ID NO: 41260 - DNA, 216 bp, Glycine max
  Peptide Sequence Number=SeqID_158038
atgactatgggtgcagataaagctgtgtcttttttcaaaagaagaaagaagagttgtgactttggctcaggtaatgaagaaaagacaaactgtattgcattttatcaagttaatgggagcaaaatctttaaacaaaatttggagcagaaaaggcacaaggaaacaagtgccattagtgtcaggcttgcccaacgaggttttatgctcgcccaataa

SEQ ID NO: 41261 - DNA, 426 bp, Glycine max
  Peptide Sequence Number=SeqID_158039
atgcataaggcattacgggccaatgcacctctcccttaccctcaattggtcactctgtttctccgtcattttcaaattccgcttgatgatgaaccttttgttcaagtcaagcgttcctttgctataggtgctggtgcagtcacttcatttggataccataaggatcggaatggtcaatggctgaagaaagatgcacttcctccacaagatgagcatactccttctcctcctcctcagcaagatgattcagcccttatgactgaagttctttccgagttacgaggtcttcgtacttatgttggtgaacgttttgattctttggataatcgctttgccagaatggatatccgtctcacacagcttgaagaagatgtgggttatattcgtcagagcttcaatcttccaccaccacctccaccttcttag

SEQ ID NO: 41262 - DNA, 348 bp, Glycine max
  Peptide Sequence Number=SeqID_158040
atgagaaagaaaaataagatcaagagaagaagtacaccaatttttatactggttcactcttgtcgcaacctacccttcggcgagagggcgacgcgagggctcacgggtgcgtcttccaagaaaggaaaatgcacggagttgccaccaacgtttattcgaggaaaacatcagaaaaatcggaaaaagatgtggtctacgaactttaagtgtgaaaggttcgagagttgtatttatgcacggggaagggttatgggaattttacggaagcattacgggggtcccggaagctccggaagccattttttaacaaaatgggggaggtggttgccacccagcttgcccaggtga

SEQ ID NO: 41263 - DNA, 987 bp, Glycine max
  Peptide Sequence Number=SeqID_158041
atggttgccataaccccagccaaggttcctcaacctccatttttcagaggttacgactcgagtgcaacatgtgcttatcatggaggggccccggggcattccattgagcattgtaggaccctgaagcataaggtgcaagggctacacgtcctcgcctccaaaaggctgtatttcctcgccttcagagggctacacgtcctcgcctccagagggttgtacgtcctcgccttcaaagggctacatgccctcgcctccagagggttgtacatcctcgccttcagagggctacacgtcctcgccttcagagggctgtacgtccttgccttcagaggtctacatgtcctcgccttcaaagggttgtacgtccttgcatttagagggctacacgtcctcgcctccagagggttgtacgtcctcgccttcagagggctacacgtcctcgccttcagaggggctacacgtcctcacatccagagggctgcacgtcctcgccttcagaggattgcacgtcctcaccttcagagggctctaggtcctcaccttcagagggatacaggtcctcgctttcaaagggctcacatccacgccttcggagaactcaagcacagccagaggaggaggcaggtctacagctttgatgaggaggctatcacacaactactatgcaaaccagggcaagatttcgctcagaccgctgtagggagacgagtgcggatcatgcgcaccaacacatggatgatgttgctacttagtagcattctgcccaagttcccgtcacccctgatagaagcttgcttatggggcttctatggaggctggatctttgagcttcaatggggtcctttaatggtgatttttcaccatggagatgcagcggaagacagaggagaagagcttggagaggatgcttcaatggaggaaaagaaagagagaaggggggagcacgaaattgaaggaataaaagagggagagaagtggaactttgaa

SEQ ID NO: 41264 - DNA, 870 bp, Glycine max
  Peptide Sequence Number=SeqID_158042
atgaaactgatcccggccctgctcgcctcggcgctgctggcagccaccccgttcctggcccaggcccaggccgccgcgcctgccgctgccgcaacgcagagccaggccggcaaggtggtgatcgatgccagcagccgcatcctgtccacgctgcagcagcgcaagagcgagttcaccagcaacccggccagcctgcgcagctacattgacagcgagctgacccgcaccttcgaccgcgactacgccgcgcgcctggtgctgggcccgcacgcccgtggcgcctccgacgccgacatcaagctgtttgccgatgccatggccgacagcctgatgcagcgctacggctcgaccctgctcaacatccagggcaagccgagcttccgcctgaagggtgaaagcccgctgccgggcaatcgtggcgtgcgcgtgagcaccgaactggtgcgtgccggcaacgagccgaccccggtcgattcgataccccgctgcgccagaagggcatcaagcaggtggccaacgaactgcacagcggcagcatgcaggccgggcccgcgggcaatggcaagtaacgcactggcgctgctggaaggcgacaccctgcgcctgcgcggggtgctcgaccgtgccgcggtgatcgcgctgtggccgcagctgcaggccctgccggcgaagctgtcacggctggagctgggtgaggtcgaacgcgtggacagcgccggcctggcgctgctggccgaacttgcctcacgcgcgcgcaagagcggtcacccgctggcagtctccggcgcgccggccggctacaacgagctgagcgcagcctaccggctgtcgcccgacctggatttcaacgctacttctgctgcgagctga

SEQ ID NO: 41265 - DNA, 234 bp, Glycine max
  Peptide Sequence Number=SeqID_158043
atggcccagattagccgttcagcgctggtcccgtatagcgctgagcagatgtaccggctcgtgaatgatgtggatgcttatcctgaatttcttccgggctgtaccggcagccgcgtgctggataacagcggtaaccagatgaccgccgcggtggatgtctccaaagccggcatcagtaaaacttttaccacgcgtaacaccctgaccgataaccagagcattcatatgcagctg

SEQ ID NO: 41266 - DNA, 864 bp, Glycine max
  Peptide Sequence Number=SeqID_158044
atgcagaggctttattcaatagtgggcttgcagatgactatcagtgagaatgctttgaactgtaaacctgagtttgctcattgggacagttattctcgattcgcacgctatgttagcacggtcaatcgttacatcttaaatgaagaacagagaacattccttgatacggttcttgcgacgattaaggggcgtgatggtgagctgaaagaagggcatgtgttctatcgggcacagcgtggaatagatctatgtgaccggactgatagagacggtaattggattggtgaagatatatggggttatggagcttcacgtatgaagcctttgactgatcgagccagagaaggacgtgcaaattccttgggcattccggtgctttatgtaggaactacagtgaaaactgctatttccgaggtacgtccttggattggtgctgacgtgtcggttgctgtgtgcaagctcttgcgtccattgcggactcttgacctttcacttggacatggtcagtcatcactttctggggctatcttaagtcacgtgttgggcggacaagagccaacagcacaggagaaagagaaagctgtctggattgagatagataatgcattttcaactcctgtcacacagtcagatgaccgcgccgattatgcgccgactcagatattggctgaactgttccatagtgttggatatgatgcaattgcatacaagagtcactttggagacagcgatgagcaattgggatataacattgcgatctttgatcttagtgcagttgaaattgtcacatgtgccccttatcaagtaaaaacaattcagattgagtcggaacagatagggaatgcttggtacaaaacctcttaa

SEQ ID NO: 41267 - DNA, 732 bp, Glycine max
  Peptide Sequence Number=SeqID_158045
atggcgtttccaggccacgtgccagcagtgcttcgtgaaccagggcggcttcctgacttaaggtctgcgcctgcgggggaaattctgagcgcgtattgtgaaacacaacgcgcgcttaatccagcaatcaatccgattggagatgaaagcgtttcaggtgggcgatcgccgcatcaccagcgcccccgccagcagcaaaccgcctccggccacccacagcgccggatcgagccggtgccacagcaggctggaaatccaggacagcagcggtccaccgagctgtccgatggcataaccggtagtaagcaggccggcgagatagcgcgcgtggtgcggcgccagctcccggctgtactgcagcgacagctgcaccacgcagagaaagccgccgccaatcagcagcgccgccagcagcagaccgttgatgcccggcagtacgatggccgcgattacgcccagcgcctgcgcccacagcaccagcgccagccgccgatggctgctgccccagtggcgcgtcacgatccccagcacgatgccgatcaccgccgccccgccaaacaccggccagacaaactgcgcaaaagcgctatcaggaaagcgcgccgccgccatttgcgacaggaaggtggcgggcagaatatagccaaagccggcgtggccgtagatgaggatcagggttttcaggtcacgcgtcagcagcagcggtgtggcggctttttgcggacgatgcag

SEQ ID NO: 41268 - DNA, 279 bp, Glycine max
  Peptide Sequence Number=SeqID_158046
atggcttcttttcatatccaatattcattccttgtgcttgtgcttgctatggtgatcacattgatgaaccctaccaatgcaaccctctctccccatttctatgataaagtttgccctcaggcattgccagttataaagtcagtggttcaacgagcaattatccgtgagcgacgcatcggagcatctcttctgcgcttgcatttccatgattgtttcgtaaatatgcaatattcattcgattgtatagaatatgaaatttctcactctaagagcatctaa

SEQ ID NO: 41269 - DNA, 1500 bp, Glycine max
  Peptide Sequence Number=SeqID_158047
gggtgtgatggatcaatattgctagatgacacccgaaacttcactggcgagaagactgcattgccaaatcttaattcagtcagaggtttttctgtggttgatgaaatcaaagctgcggtggacaaagcctgcaaacgccatgtggtctcatgtgcagatatcttggccattgcagcccgtgattctatagccatatatgggggtccacactactggtaccaagtattgttgggcagaagagatgcaagaactgcaagcaaagctgctgcaaactccaatcttcctcctccaacattcagcttctcacagcttgtttccaacttcaaatctcacggcttaaacgtgagggaccttgtggccctctctggaggccacaccatagggtttgcaaggtgcaccaccttcagaaacagaatctacaacgtaagcaacaacataatagaccccacgtttgcagcatctgtgaggaagacatgtccgaaaagcggaggagacaacaacttgcatccacttgatgctacacccacaagagttgacaccacatactacacggatttgctgcacaaaaagggtcttctccattctgatcaagagctgttcaagggaaaaggcacagaaagtgacaaattggtgcaactatatagtagaatccctttggcttttgctagagattttaaagcttcaatgatcaagatggggaacatgaagcctctcactgggaggcagggagagatcagatgcaattgcagaaggggctgtgatggatcagtgctgctagatgacacaccttccttctcgggggagaagactgcacttccaaatctaaattcaattagaggatttgaggtggttaatgaaatcaaagcagcagttgacaaagcatgcaatcgtcctgtaatatcatgtgcagataacttagctgtagcagctcgagactcagtagccatagtgagtgccatacaaattaaattctcctcaagagatgcaagatatgcaagcaaggatgctgcaaatgccagtctccctcccccattcttcaacttcccacagcttcttgctagtttccaatctcatggcctggtcctctctggtggccataccattggactagcaaagtgcattatcttcagggacaggatcttcaatgacaccaacatagaccccaacttcgcagccactttgcgccatttttgcggtggagacactaatctatcaccatttgatgcctcctctccttcacaatttgacaccacatactacaaggctttattgcacaaaaagggtctcctccattctgatcaagagctattcaaggttgatggtggtgaaagtgatagattggtgcagctatacacctatgacccttatgcttttgcaagagattttggtgtttccatgattaagatgggtaacttgaagcctcttactggctatgagggagagatcaagtgtacaattgcagaaaagtcaactactagcactgcatgtcatgagtattga

SEQ ID NO: 41270 - DNA, 489 bp, Glycine max
  Peptide Sequence Number=SeqID_158048
ggatgtgatgcatctgttctgttagataacacttcgacctttactggagagaagtcagctggtgcaaatgtgaattctctgagaggttttgaagtaattgatgacatcaaaactaaagtggaggctgcttgtcccggagttgtttcttgtgcagatattctagctattgcagcccgtgattccgttgttgcattgggaggaccatcatggaatgttgggttaggcagaagagattcaaccacggcaagtaaggattctgccactacggatatcccatccccactaatggatcttagtgcccttatatcttctttttcaaaaaaggggtttaacaccaaggaaatggagcacatacaacggggcaagccaggtgtcagctattcagaggcagggtttaccatgaaagcagcattgagtcaaactttgcagcatcacttcaagtcaaactgtccaagcacttggtggagacagcaacctttccccgcttga

SEQ ID NO: 41271 - DNA, 387 bp, Glycine max
  Peptide Sequence Number=SeqID_158049
atgcatgcgcatccggtccttggatgtgatgcatctgttctgttagataacacttcgacctttactggagagaagtcagctggtgcaaatgtgaattctctgagaggttttgaagtaattgatgacatcaaaactaaagtggaggctgcttgtcccggagttgtttcttgtgcagatattctagctattgctgcccgtgattccgttgttgcattgggaggaccatcatggaatgttgggttaggcagaagagattcaaccacggcaagtaaagattctgccactacggatatcccatccccactaatggatcttagtgcccttatatcttctttttcaaaaaaggggtttaacaccaaggaaatggtagccctctcacgtaaataa

SEQ ID NO: 41272 - DNA, 682 bp, Glycine max
  Peptide Sequence Number=SeqID_158050
atgggcgttggcggcggcggtggcgccggtaaagtgtgcttcaacgatctgcacgttaacgcgctggtcgacaagtcaaccccggcgctgctgaagcactgctccagcggtaagcacctgaccaaggttgagttgtctgtctgcaaggcgggcggtactcaggttgagtacgttaaaatcaccctggatgacgtgctggtcaccgccgtgcagtacaccggcgcaggcggcgaagacaccgtgggcgtcacctactccttccaggcggcgaaagtgaaacagcaatactgggagcagagcgacaaaggcggcaaaggcgccgaaagcagcgcagccgcatgggctgcaagcactaaaatatataacgctcaatattcagctcagaatgttgccgagattatcggtgggcgtgtagccatgaatattgcgcctaatggaaagtgggaaaacacctgcgctgtacgcatgagctacatcttgaataaatctggctttcccattccttatgtaaaagatcagaccgtatcaggtgccgatcgtcaatggtatttttttagagttaaagatcttatcgcttatttgacaaagatctggggcaaacccgaccttcgagtcaagttccctcctccaggtggtggtgaattagcaggaaagaaggggatcatattgtttgaaattgcag

SEQ ID NO: 41273 - DNA, 1833 bp, Glycine max
  Peptide Sequence Number=SeqID_158051
atgaatggtgctatacttgctgcactaaatcagttaagaaatatatttggactgggtaaacgtgaagccgaggcgatttcacttgatgttacgtcgaaggtatatcgcaaacgacttgcacaggctgttgcagatggtgagttagaaatggcagatagcaaagcagccttccttcaaaatctatgtgatgaacttcattttgatccacaaaaggccagtgaacttcatgaagaaatttatcggcaaaagcttcagaaatgtgtagctgatggggagctcaatgaggaagatgttgctgctttgttgaggttgcgtgtaatgctctgcataccgcaacagattgttgaaacagctcattcagatatatgtggcagtttgtttgaaaaggttgtgaaggaggcaatcgcatcaggggttgatggatatgatgctgaaatccagaaatcagtaagaaaagcagcacatggcctgcgacttactagggaggttgctatttctattgcgagcaaggcggtaaggaagatttttattaattacataaaacgtgcacgggcagctggaaatcgtacagagtctgcgaaagaactgaagaagatgatagccttcaacaccttagttgtaactaatttggtggaggacattaaaggggagtcagctgatatttcaactgaagaacctgtgaaagaggacattacacaaactgacgacgaagaatgggaatcacttcagacactcaagaaaataagaccgaacaaagaacttacggaaaagttgggaaaacctggtcagacagaaattactctgaaagatgatcttcctgaaagggataggactgatctttacaagacatacttactttattgtctaactggtgaagtgacaagggttccgttcggtgctcagatcactactaagaaggatgattctgagtatcttcttctaaatcagcttggtgggatcctgggattgagtagtcaagaaatagtggaagtgcacaggggtctagctgagcaagcttttaggcaacaggctgaggtaattttagctgatggacagttgacaaaggccagggtggagcagcttaataacctccagaagcaagtaggcttacctcaagaatatgctcagaaaataatcaagagtataaccactacaaaaatggcagctgccattgaaactgctgtaactcaagggaggctcaatatgaagcagattagggaactcaaggaagctaatgttgatttagacagtatggtatccgagaacttgagagaaaccctcttcaaaaaaactgttgatgacattttctcatccggtacaggagagtttgacaatgaggaagtatatgaaaaaatcccatcagatctcaacattaacaaagagaaggcaagaggtgttgttcatgagcttgcaaaaagtagactatctaactcattggttcaggccgtgtctctactaagacagagaaatcacaagggagtggtttcttcactcaatgacttgctggcatgtgacaaagcagtaccctcacagccagtttcatgggaagtgccagaggagcttgctgatctatacaccatatacttgaagagtgatccaactcctgagaatttgtctcgtttgcagtatctgttgggtataaatgattcaacagctgctgctcttagggagatgggagatagattactcaataccactgctgaggaagagaagaaggctcttggagttttcaaagaaatacggcagaggatggctggagagggtggaagtagccagcggcaacaaacagtggtagtcagagagttagtaggaggagttactggaagggagtga

SEQ ID NO: 41274 - DNA, 1305 bp, Glycine max
  Peptide Sequence Number=SeqID_158052
atgaacccttccacactcaccccttcccacacccaccgtcctctcctcctaccctctcccttctacagcagacggcgtcgtttcagagtctccctccctcgctgttcctccgacgccgccgccgccgccgctccctctcctccgccaccgacgccgccgcagcgaccgcccaaggacctcaagggaatcgagctcctcgtcgacaagctctctccgccggccaggctcgccacctccgccgtcatcgtcgccggcgccgcggccgcaggctatggccttggctcccgcttcggaggcagccgctacgccgcgctcggtggagctgttgccctcggcgcggccggcggtgctgcggcgtacgctttgaacgcggctgctccgcaagtcgccgctgtgaatttgcacaactacgtcgcggcgttcgacgacccttcgaagctgaagaaggaagagattgaggccattgcctccaagtatggtgtgagcaagcaagatgaggcattcaaagctgagatttgtgatatatattccgagtttgtttcttctgtgcttcctcctggtggtgaggaacttaaaggtgacgaggttgataggattgtcagcttcaaaaattctttgggaattgatgacccggatgctgcctctatgcacatggagattgggaggaaaattttcaggcaaaggctggaagttggggaccgtgatgctgatgttgagcaacgtcgggcgtttcaaaagttgatatatgtgtcaaatcttgtatttggagatgcttcatctttccttctaccttggaagcgtgtattcaaggtcaccgattcccagattgaagtagctgtacgtgacaatgcgcagcgattgtttgcttccaagctgaaatcagttggcagagatattgatgcagaacaacttgttgcactaagaaaagaacaacaattatgtcgcctttctgatgagaatttgccatgtctgatcatctgtgagtttttcagtcctggagttagccaagcaattgcagagctggatagggtattggcatttaataatttactcatctcatttaagactcatccagatgtggatcgctttgcccgtggtgttggtccagtttctttagtgggtggagagtacgatggtgacaggaaaatagaggacttgaaactcctttacagggcatatgtttcagatgctttgtctggtgggcgcatggaagatgacaagcttgctgcactaaatcagttaagaaatatatttggactgggtaaacgtgaagccgaggcgatttcacttgatgttacgtcgaag

SEQ ID NO: 41275 - DNA, 444 bp, Glycine max
  Peptide Sequence Number=SeqID_158053
atgatgatggaaatgaagacaaatgaggatagtgaaaaaagtgcttcttccttatgtaggatagtgcataaggctcagacaatcctgcaagattggactgaagctcagttgtcaccgcaagagggagaagctcaagcattactctttgctatgaaatgggtgaagcaattatctattcagagggtaattttagaaactgattgcaaatcagtagtagatcagacatatagccaacacaattccatcactgaaggtggagtcttaattcagaaaataagaaacacgctcaaagcagatgtggactatagagtctcttttgtgagtagaaagtgttacatggctgcagatgctatggcaagatcatcgatagagaatcctgttagtcatattttccaattcattccaacgaatgtaaaccagattattgaaatggaaatatactga

SEQ ID NO: 41276 - DNA, 480 bp, Glycine max
  Peptide Sequence Number=SeqID_158054
atggtttccagggttcacaagagaacagcactgtataggagcatacaacagcttcgttcaatcactaactcccatgcgcgccgtaaaacgtctgtgatactggatgcatcgaagtacatacgtggtttaaagcagaagttgcaagaattgaaccaattagcagttgctgcagcccaaaaggacattgagtatggtcccgtaatgcccgtgctaaaagtggaaccacaagaagaggggtttatgatcaaggtgctgagtcaaaggagttgcctggggttgttggcgtttatattggaagcctttgaaaggcttggtcttgaggtgctccaggctagggcttcttgtgtggagagcttctctttagaagcatttggaatcaaagagaaaaatgacgatacccatcgagtggatgcacaagtagttgagcaagttgtgtctcaagctataaatgattggaggaaagttacaaagcaatgttga

SEQ ID NO: 41277 - DNA, 207 bp, Glycine max
  Peptide Sequence Number=SeqID_158055
atgacggttgttagtcggttaattaggcaagctttgaaaagtgttgtttttcaccttctcgctaagccaatctgcaagcttagcgagagtcccctaagcgcaactcatgggctaagcgcaaggaagactctggaagaagatgagctgtacaggttcgctaagcgtaccacttcagttcattcgctaagcgagaaaggcacgcgctaa

SEQ ID NO: 41278 - DNA, 117 bp, Glycine max
  Peptide Sequence Number=SeqID_158056
atgggcgttgacatgaagccaaccaagacatccactgatgctagcaagagtggtagtggtgggacaatcacgtgggtctgtcaccctctcccattagatcctcgtcacccaatttag

SEQ ID NO: 41279 - DNA, 261 bp, Glycine max
  Peptide Sequence Number=SeqID_158057
atgcggaggaactcgcttgcctcctctagtgatacttatttcttgccacagccctcctttttctccgaaaaacctttcactggaatattctcgtttggagtggggatcactttgtcactttgttcttctgccatcttcgccttccctttaacatttgcgggttgtgtcgacaggtcagggggtgcgaacacacgaccgttgcgggtcacgccgctcagtcccttgatattggttaccctggccgacaacgagctgatgtcg

SEQ ID NO: 41280 - DNA, 459 bp, Glycine max
  Peptide Sequence Number=SeqID_158058
atgctgacatcttcgaaaagggtgcagatgaccacattggcctctgcttgtcaatcgaacttggggtctccgaatgacgaggtgcggataaccgaaaggtgtctccgcatgctaccagactcttgggtcatgatagcaaaaggtggggtggtcgacaaaagcgaggcttttgctcctacgtatcctccatttgtgatgaagaactcagacctacgtagttctttctattcgttcattcctaaacgaccatttagaggaaacactgggcccgacagaatagaagaatatcactcgaagtgtaccaatctcacacagggcagggtttgtggtaagttgggattttggctcaaggcttgtagaacggttggacatgatatatgtcaggatgttggtttggccagcggctcagggaaaaaggagaagtcccacattatttccatgatacacatgcaacactga

SEQ ID NO: 41281 - DNA, 675 bp, Glycine max
  Peptide Sequence Number=SeqID_158059
atgcagacgcccctcagcctgttcctgggagacccgctagtgttagaggagggccaagagtgcgagtatagtcagagaaggaaccgggccgatggatttgaggaggaggtcattgcccagctgctatgcataccgggtcaggatttttcccggaccgctgccgggaggcgggtgtggatcatgcgcaccagcatgaccaccttgactcagatgtggatgacgttgttgctcagcaacgtcctgcccagcgatcataactccgacctccctctgccaaagtgtcagctggtgtacgccatcctgacacggatgagtgtccatgtggctcagttgatcgctgacgccatttatttatttgcaggtatgccaccaaccaggcaccctctagacccagataagtctaatagggccctggggtttccagcgttgatcacgggcctctgccagtcattcggggttcccgtcacacctagtaaggtgattcgaccgccgatcacccgggcctttattgagaatatgtacagcacttggttcgccagcagccggccaaccacagggggtaggtgcaaacccatgagtgtctctaccagctcagcctcagtctctatcagttcagggcagaggttgcatggcctggagatcggcctgaggcctaggcaggggaggcgcctgtag

SEQ ID NO: 41282 - DNA, 937 bp, Glycine max
  Peptide Sequence Number=SeqID_158060
ccgttgctgcgctggctggcgatcatggtggtgttcggtgtgggcgtgggcaccctgctgtacaaccagcaggccagcatcgtgcgtgcggcgttcaacgatgcaggcgctgccacggccttcttctcgcgcatcgacctggcggtgaacgcactggcgctgctgatgcagctgggcctgacccgctggctgctgtcgcgccacggcatcgcgccggccctgttgatccctggctttgcgatcctgatcggcttctcggtgcttgccgcttcacccatgccgttgatggtggccgtggtgcagtggcgttacaaggccggcgcggccatcgatacggtggtgtaccgcggcgcggacctgagctttgcgtgggtgcacaagggcttgtcgctgtttggttcacatgtggtgttcatcggtggcgtggtggttgccgcgtgcatgaccgccgccgcgtttggtgtactgcgcgaagaaaaaaagctgccacgcgaccgctgatcccgtccagtcatttcgaggagagaaaccatgtcgctgatcgcgctgctgctgaccgtgctggtcgcggtactgcacctgtacttcctggtgctggagatgttcctgtggacccgtccgctgggcttgaagacgttccgcaacacgccggagaaggcggagaccacgcgcgtgctggcggccaaccagggcctgtacaacggcttcctggcggcgggcatcgtggtggggctggtgatcaatcagccggtgctggtgacgttctcgctggcctgcgtggtggtggccgggtgctatggcgcctacagcgtgagccgccgcattttcatgatccaggcggtgcctgcgatcctggcgttggtgtttcgcgcggtagcgtagtttccagccaacggcgcagcccctcgtgggttgctcgcgtagagcttgtcatggg

SEQ ID NO: 41283 - DNA, 480 bp, Glycine max
  Peptide Sequence Number=SeqID_158061
atgaaggaaaaggtgagacaagaggttttgaagctattagaagctgggatgatctatcacatatcagacaattcatgggtgagcctagtacaggtggttcccaagaaagatgacatgattgtggtgaagaatgacaagaacgagatcattcccacaacaactgttagagggtggaggatatgtgtcaattataggaggtttaacaatgcaataaggaaggataaatttccttttcctttcacggataaaatgctagaaagggtattcgatcgagccttctactcctttttggatggctactcaggctacaaccagattgcagtcaacacacttgtcgcaacctacccttcggcgggagggcgacgcgggactcacaggagcatcttccaaggaaggaaaacacgcggagttgccaccaacgtttatttgagcaaaacgtcggaaaaaccggaaaaaaggtggtctacaaactttaagtga

SEQ ID NO: 41284 - DNA, 797 bp, Glycine max
  Peptide Sequence Number=SeqID_158062
atggctgtgagcgatggcaatacgattgcggtgaaggaagcagcttctgcggggattcacaacgtagagaaactcgtgaacatgattttgaatcaacacaacgagggtggttctgaattggaggcagttgctgacgtggcggtgaaccgcttcagagaggttatttcgctgcttgagaaaccaattaccagaaccaccggtcacgctcgtttccgaagggcccctacaacagtgccacctgtccctgttgttcagttgcagcaaatggtggatgatgattccaaacacaaactgcagaacaaaacagaacaaaaacaaaaacaaagtacctctgcttttaaggtttattgtccccctccttctcctcctctgcctcaaaatcaaaatcaccaccaccaacaacaacctttcattcttcctctgcataagaatgaagcaaatggttctactaccaactcccatttttctacgttatccggggacactgagagtttgcaacggtcatgtctctcttcggggtttcaaatttctcacgtgtcaatgcaagggggttcctttaagcgtaaacctccactttctacaaattctgtgaagaggaagtgcaattcaacgggttttcctgataccaagtgtggatcgtcctctgtgcagtgccattgctccaagaaaaggaaattgaggttgaagaatgtgattagagtgccggcaattagttccaagactgctgatattccacccgatgagtattcgtggagaaaatatggacagaaaccaataaaaggttcaccacacccaag

SEQ ID NO: 41285 - DNA, 443 bp, Glycine max
  Peptide Sequence Number=SeqID_158063
aactagcagcaacacaaccccaattgaatcctatttttggcgactatgggttcaaaaaaagcacaacaaaagttcaacaaaaccttgaactctatcagagaagctcgtggaataagattgtggacattttgaaggtggacattgatgaagtagaacctaatgttgcggccgaggtaatgaaagacaagctccattccttcaatgaacacttagatgagatatgcaacgttcagtctgcttggtttgtttttgatgaacaattaagggaacaactaataaaatccatagaaaacatggtgttgccagcatatggaaacttcctcgggaggcttcaggattttcttggtaagcacgcttatgagtacattaagtatggaatgtttgatgttcaatatcgactcaacaataatttgtttcttgtatgggagaaagaactagagtga

SEQ ID NO: 41286 - DNA, 1299 bp, Glycine max
  Peptide Sequence Number=SeqID_158064
atgctcataataaagattcggagttggctactagagccaaaggtatggagttttgtgtgctttgtttcatctgttgttgggttgctctgttacgctctcagcacctctttcaaccatttatttggaaagtggacttggtggaagacattactttatattgtctttagtttcatcgtgtgtcttgcggtcttattcgcaaaggcatgggagcgctccacctctacctggctggaagctcatatggcctttttgattttgttcttcacttctgtatactcctttttctttgataaagaagtgaaaggaaaacctgatgcttatagcctattttcctgtgctgcatttgctatcatgtctctgagtatgtcaagactgagtcactttggatttgaggttgatctcctatattttttcagcggagttcttacgatacaactcatgaaaataaaaatatggttagtcgtcgttggtgggagtttcagttattctctcatccttcttcgttctactttgggtgcttcaccgacgagaatcgagtatcgtggactacaactcagagatgatctagtcattgaaattgattcacaaggaaccagtcacagtacatctcagttgcatcctgatgttatgattatcacgcaacaagacgctcatgtccctcttgaattcccagtcaattcactttcacaacaaggcaacagtttcagtgataacaacatcatggaacggttcatgggttgtatagaggcgcttaagaaggagaacgagaaccttatggacacaatttcaaaacatgtcagcaaataccttaaggctaatgttgtcaacgaggaccaaattcatgtgtgtgaaattgatgccgatgataacttggtggtggatgcgttgttgtcgtcgggaataatcatcaacgacctccgtgaaaccgttaggctgatggtggcagcagggttgaaggtggaatgctgcagagcgtaccgtagctgtcgcaggaaattcctgagaaagagtgtttcgaatttttggttgcgaatgcaagatctcaacgtggaggaggacattgacaagctgatgatagagattcagtgttggataaaagttctgaatgtagctgtcatgatactcttccccaatgaaaggacactatgcgatcgcgtctttgaagggtccatttcctctgtggagaagtaccatgtgtcactcggaaatgatgctctctggggtgacaagagtttgaacattttaatgaacttggtatatttttcttatgctgataaggagcaagccactgttactcct

SEQ ID NO: 41287 - DNA, 438 bp, Glycine max
  Peptide Sequence Number=SeqID_158065
atgagcctcgcctcgctcgcccgcaaaagggtgggttgcgatagaggactacacatccttgccttcagaggtctgccctccctcgccttcaaaggactacacgtcctcgtcttcagaggtctacacgtcctctctgtcagaggactacacgtccacaccctcagaggactacacgtcctcggcttcagagggctgcacgccctcgccttcagagggctgcacgtctacacatcctcgccttcagagggctacacgtcctcgccttcagagaactacacgtcctcaccttcagaggactacatgtcctcgccttcagagggctacatgacctcaccttcagaggactacacgtccttccctttagagggctacacaccctcgccttcagaggactacacgtcctcgccttcagagggctgcacgtcatcgccttcatag

SEQ ID NO: 41288 - DNA, 180 bp, Glycine max
  Peptide Sequence Number=SeqID_158066
atggatttccctttagcaccagctcctcaactcctccattgggaatgggcgaatggtggtagtggaactgtggaactaactgttattttattattccctaagccgtcaataagacgccacgtgttgcaagaatctcttggagaagaggatcagacacccacactcaagagtcaagactaa

SEQ ID NO: 41289 - DNA, 1254 bp, Glycine max
  Peptide Sequence Number=SeqID_158067
atgagtagcaacatgcctgcaaaattgttgctcacaactttgtacatcctcttggtgtttcttcctatccacatgtcaccacatgatgttaacatagacacacacagtttcaaaagtagtagtagtactagtggccacaggagcaaaattggtggtggtggctcagccaaaggttgcaacaacaacaacagcaacagcaaccaattggacacaaacacaacaccatgtcaaaaatcaacaaccattcaagcagttcctgcagcttcttcacctccccttgtatttgcagaccaaagacttgaagtagtgtatccaacagtccaaaaattcaagtccaccatcacctcagatccactaggagtgaccaaaacttgggtaggatcagatatatgcagctacaaaggcttctactgtgacaccccacctgacaatagttctgccactgctttggcctctattgacttaaatggtttccaactatctgcttccacccttgatggcttcattgataatcttccagatattgctcttttccatgcaaattccaacaattttggtggcacaatctcaccccaaatagccaaactctcttacctctacgagcttgatgtcagcaacaaccaattatcagttccaccacaaattttcacacaaaacctccaagttcttttcataaacaacaacattttaactcaagggttgcctgataacttagcctccactcatattctcttactcaccttagcaaacaacaagttcatgggtccaattccaagaagtcttcctaaggctttgtccactctaagtgaagtgcttttactaaacaaccagttaactggttgtttgccttatgagattggttttcttgaagaggcaacagtgtttgatgctggcaacaatcagttaactggtcctttgcctttatctttgagttgtcttgagaaggtggaagtgctcaattttggtggtaatctattgtacggcatggtgcctgaagtggtgtgtgtaggattagtgaatttggtcaacttttcactatcagataactatttcacacatgtgggaccattttgtaggatgctgattcagagaggggttcttgatgtgaggaacaattgtattcctgatcttcctttccagagatcagtgatggagtgtgctgagttctttgcaacaccaaggatgtgtcccttcatgtggtttcatggtctcatcccttgtaagcttccttttcaacattccattcacaattag

SEQ ID NO: 41290 - DNA, 1161 bp, Glycine max
  Peptide Sequence Number=SeqID_158068
atggtggaagctggtgaggattgttgcgtgaaggtcgcggtccacgtgcgacctctcatcggcgaggagaaggttcagggatgcaaggattgcgtgactgtcgtgtcagggaagcctcagatgcaaagtgtgaacactttgataaaaatggggaaagactatggctcacttgctttcgacatcagttggatatcccttgccttcctacttcccaattatgttaatattttactccagaatttggtacaaattggtgcacattcatttacatttgatcatgtttatgggagcactggttctccctcatctgcaatgttcgatgaatgtgttgtgtcccttgttgatggtttgttccaaggatataatgctactgttcttgcatatggtcagacaggttctgggaaaacatacaccatgggcactggctttaaagatggttgccaagagggaataatacctctagttatgagttccctgtttaacaaaattgacaccttaaagcatcagattgaatttcagctgcatgtttcctttattgagattctaaaagaagaagtaagagacttgttggacccatcctctatgaacaaaccagaaactgcaaatggacatgcagggaaagtgactattcctgggaaaccaccaatacaaatccgtgagtcatcaaatggtgtcattactctagcaggatgtactgaagtcagtgttacaaccctaaaagaaatggctgcttgcctagaacaaggatcattaagtagagcaactgggagtacaaatatgaacaaccaatccagtcgttcacatgctatcttcaccatcacattagaacaaatgcgaaagctcaatagtcctggtgagatcagtttaaatgatacaatgaatgaagaatatctttgtgccaagttgcacttggtagatcttgctggatcagaacgagctaaaagaaccgggtctgatggtctgcgatttaaggaaggagtccacattaacaaaggccttctagcgcttggtaatgttattagtgcgcttggtgatgaaaagaagagaaaagaaggtgttcatgttccttatagggatagtaaacttactaggcttttgcagggtgattctagaggatcgggaaaccaaacacacacttatacaagcaataatctagcctaa

SEQ ID NO: 41291 - DNA, 609 bp, Glycine max
  Peptide Sequence Number=SeqID_158069
atggtggaagcagaggcatcatcatcgcagcctcagccgcaggcatcgagttccggccagaacggcgtcgttcgcgatttgctcacattggctcgtcagctcatcactcaaggcaaaccttcccaggccctccaagcttgtttgaggattttgaaatttgatactgggacatctcacttgtcttgtgtggcaaactcccttgaaaactttgctttaggaaaaactctcaaaaaggtggcaaaagtggttgtagcaatgaagactaaaggtggtgatgaagctgtttttcattccttgcatcgtgcccgcgaggtgtatagaagtagactgcaagagaatgctgcagttgatcaactggcttctctgtttgctgagtgtgccattgctgaagctgagcctgtagtgatcgaaccacctgccaataacattaccaccccctcaattagtccagaacctgatgctcatgggacttccatactggcagaaagtggcaggatgcaagtagtgttggatgcggtctctgatggaagcagcttcatctgtttgaagtgtggaggccttgttagtaaccatcgcaaagacgagcactatgcatactggtgttgttaa

SEQ ID NO: 41292 - DNA, 2121 bp, Glycine max
  Peptide Sequence Number=SeqID_158070
atggattcacttggtggtaacagcagaactgttatgatagcctgcataagtcctgctgatattaatgctgaggaaacccttaacactttgaagtatgcaaaccgtgcacgcaacatccaaaataagcctgttgtcaatagagatcccatgtccaacgagatgctaaaaatgcgacaacaacttgagtatctgcaagcagaactttttgctcgttctggtggctctcctgaggaagttcaggtcctcaaggaaaggattgcttggcttgaagcagttaatgaggatcttcgatgtgaacttcatgaataccgtagtagatgctctactgtagaacaatgtgaaaaggatgtttatgaaaatagctcatgtaatgtaaagactgatgggctcaagaggggcttacctatcacaacatctgattatccaatgagtgaaacaacagcaggggattcaagggaaattgaagaagtagaaaaagagtgggagcatactcttctgcaaaatagtatggacagagagttacatgaattgaataaacgcttggagcaaaaagaggtttctgagatgaagctttttggaatatctgatgctgaggcactcaagcagcattttggaaggaagataatggaactggaggatgagaaaagaactgtgcagcgagatagggatcgtcttttggctgaagttgaaaatcttgctgccaattctgatggacaaatacagaaatcagaggatatccatgcccaaaaattgaaaacacttgaagcccagattctggatctaaagaagaaacaggagagtcaggtccagctcatgaagcaaaagcaaaaaagtgatgaagcagcgaaacgattgcaagatgaaatacaatctataaaagcacaaaaggttcaactgcaacataggataaaacaagaggctgagcagtttcggcaatggaaggcttctagagagaaagagctgctgcaattaaagaaggaaggaaggagaaatgagtttgaacggcataagctgcaagctttaaatcagcgccagaaaatggtccttcaaagaaagactgaagaagctgcaatggccaccaagaggttaaaggagttgttagaagctcgtaaatcttccagccgagacacttcagttgcaatgaatggaagtggaatgaatggacagagcaatgagaagtccttacaacggtggcttgatcatgagctggaagtcatggtaaaagagcatgaagttcgttttgagtatgagaagcagagccaagtgcgagctgcccttgcagaggagttggccatgctaaagcaagtaaacgggtttgctgccaagggtctcacacctccaagaggaaagaatggatttgctagagcatcctccatgtcaccaaatgcaagaatggccagaatagcttcacttgagagcatgctgaacatatcatctaattcacttgtggcaatggcttctcaactttctgaggcagaagaacgagaacgggccttcactaatcgtggacgttggaaccagttgcgctcaatgggagaagccaagaatttgcttcaatatttattcaattctgttggagatgctaggtgccaactgtgggaaaaggacaccgagatcagggaaatgaaagatcaaatcaaagaacttgtaggtctactacggcaaagtgaaatgaagagaaaggaagctgagaaggaactaaaagtgagagagcaagatgttgcaaccacattggctacaccaacttctggaaactcaccaaattcattgaaacactatgcggaagacatcaaggaacctttatctccagagtccctgccggtacagaaacaacgcaaatatatgccaggcatcactaatagccaagtgagggaatcagcagcatttatagatcagagtagaaggatgatacccattgggcaactgtcaatgaaaaaacttgcagttgtaggacaagcttctggcaagctatggaggtggaaaagaagccaccatcagtggctagtacaatttaaatggaagtggcagaagccatggagactttctgaatggattcggcacagtgatgagacaatcatgagagcaaggccacgttcgcaggctttgccgcgaataatgtga

SEQ ID NO: 41293 - DNA, 1023 bp, Glycine max
  Peptide Sequence Number=SeqID_158071
atggttgagtctgggattgtggcggaagagcccgagctttctgctcttttggaagtcagtgtcaatgccaataaggaagacaaggtgtatgaggttttgcatcggttgcgtgctacgttgaggcaggtgtctgaatcaactttggggatagttgagaactggtttaactcagagtatgctgcgaaaattgggaaggagaagtgggatgttaagaaggtgagggaagggattgcgcggggaggtggaggatggcatggacaagggtggcttgggagtgggcggtggaaggtggtgaatactcaggtgaacgaggatggcgtgtgtctctcgtgtggggagaagcttgcgagcattgatattgatccaaaagagactgaaaattttgctgcctcattgtctaaattagcttgtcaaaaagaagctaaggcaaactttgttcattttcagacatggcttgagcggcatggtccgtttgatgctgttgtagatggtgccaatgtaggccttgccaatgggcataatttcagcttttcacagcttaacactgttgttgaacaattacgtcaaataagcccttcaaagagattgcctcttataattttgcatataagtcgggtacatggtggtcctgctcagaatccaaaaaacaagagacttatagaaaattggaaaaaaaatggcgttctttatgctacacctcaaggttcaaatgatgactggtattggttatatgctgctgttagttgtaaatgcttactgctaacaaatgacgagatgagggaccacttgttccaactattgggttctaattttttcccgagatggaaggaaaaacatcaggttcgaacatcagcctcaacttgtggacgctccctaattatgcctccccgttattcaatagttattcaggaatcagccagtggttgttggcatgtgccaactgtaactactgatgatcatgagatcccaaggaaatggttgtgtgccacaagatccagaaaagattcattacataatctatga

SEQ ID NO: 41294 - DNA, 1410 bp, Glycine max
  Peptide Sequence Number=SeqID_158072
atgggtcaagtgatacatgttgcggtggtggcagcatccttgggatgtgtttcaacccttttgatggtttttatatggcgtttgtgtcaccacaagaaagagcacagaaactttgtccaacccaatagtttggccagaatggagagcctccaagcaggaattgcaagacttcatcaacaaccaacaatctatcaccaatttgctgatcacaaaaacaaaaacaaaggcaacttttatgtgtttcataatggtgtctctagaagaggacatttgtttaattgggatgatcatccctaccttcttgttgatgctgtggaaaatggttggtctagatttgcttttactaactacaagagcaacatgccatctccttcaaagagatcaacctcaacccttttaggagcatgtgctgctggtgaatatggaagggaaactgaggctgagataagctgggaagtgtgtaatggatcagctgaatatatgcagaagattaggctcaatcctgggttgaaatttaaaaatgttcttcacacaaacaacttttccaatatgactgttgcttctgtcattaggactgctctgccacttcctggccctcctttggggaactatgccttcccacaagaggcctattttgaaatcaccatcttgtgttcttgtgtcgatgatgatcatgaatcagttgtcgcgaagagagaaggtgagaagacaaaactcctcattgaagatggttcaaatggaacaggtgaattggacagtgttgaagaaatgaaacttggacagaaagagggtggtggaaagagtggtggatctgtgatgttctcattggggttaacagctggagggggtgttcctttgagagttccaggtagctaccttcggagcattggattcaattccagtggttctgtctttcttgaaggaatgaaacttgtaatggagtctgagaaggcacaatgggtaggaactgatagggtaattggttgcgggtttgatccaaggcagaaaaaggttttcttcacattggactcagagttggtgcatgtcattcactgtcagtcagaggaatttggcactccactctgtccaactttggctgcaaatatagacattcaggttttggttaattttggacaaagtgcattcaaatatgcacctgcaaatgcacaaagaacaccaaatccatgcttcatagccccacttgtgaattcccctggtgctacccttggttatgatgacagcaaggagctcttctccatgggaaggattgattctcagtggcttaatcgatccgcaaacaaaggaaacatccccaatgggaataatactcaaatcttagattttgatgaggctgatctatttgaaatagtcttggatggttcagaaaagtctcaaaacacagtgtcatag

SEQ ID NO: 41295 - DNA, 1092 bp, Glycine max
  Peptide Sequence Number=SeqID_158073
atggtgggtttcgtgtgcaattgcacgaaggaacacggaggaggaggtggtggatctggtgatgatggtgttgtgtttggtgcaagagtaatggtggctaacaacaacaacaacaacaacagcatcgaaatcgacatggtgaagaacagccaaggaatctacgcccccaaagcctccaaggtggtcgtcctctgggacctcgacaacaaacccccccgcggcccaccctacgacgtcgccatctccctcaaaaccctcgccgcccgcttcggcgaccttgtcgacttctccgcctacgccaaccgccacgccttcgtccacctcccccagtgggtcctccagcaacgccgcgaccgcaaaaacctcgacatcctcgaacgaaagggaatcatcaccccaccggagccctacacgtgcggcgtgtgcgggcgcaagtgcaagacccacctcgacctaaaaaaacacttcaagcagctccaccagcgtgagcgccagaagaagctcaaccgtctcaagtccttgaaaggaaaaaaacggcaccgtttcaaagaacgttttttgcgcgggaaccataagtatgacgatgcggcgaggacgcttgtagtgcccaaggtcgggtacgggctggcggcggagctgaggcgagcgggggtgtttgtgaagactgtgcaggataagcctcaggcggcggattgggccttgaagaggcaaatggtgcactcgatgagtagagggattgattggctgtttttggtttcagatgattcggatttttcggagatgttgaggagggccagggaggcggatttggggaccgtggtggtcggggattgggatagggcgctcgggcgccacgctgatttgtgggtgccgtggagtggggtggagaatggggaggttggtgatttggtgcccaagagaagaagggagaatagtaggagaagagaacagggagaagaacatggttttggtttggaagatgatgatgatgatgatggtgaggatgaggaattggggcaagagtatatgttgttgtatgatgatgatgatgatgatgaaggagaagaggaagatggcttatatattttttga

SEQ ID NO: 41296 - DNA, 510 bp, Glycine max
  Peptide Sequence Number=SeqID_158074
atggaagaaagagatcaccgttgttccaacaattcaacgatgatcacaacaacaaagaaaaaaacgagcagaagaagtcccacatcggataagctgaagaatcaacacccctgtgagaagcaggcgatgaaaccgtacagaggaataaggatgcgaaagtgggggaagtgggtggcggagatcagagaacccaacaagaggtcgaggatttggttgggttcgtacacgacacccatggccgccgcacgcgcctacgacacagccgttttctacctccgaggtcccaccgcacgccttaacttccccgaactcttgttccaggacgaccaggaggagggcaatgattcggtgcagcacggtgcagcagcagggaacatgtccgctgattccattcgccgaaaagccacgcaagtcggcgccagagtcgacgctctccaaaccgcgcttcaccaccacgcgtcaagtgatgatgatgatgatgcctcggagttggggcttgaaactaattaa

SEQ ID NO: 41297 - DNA, 102 bp, Glycine max
  Peptide Sequence Number=SeqID_158075
atggcgctaagcatgacatcaaggggatttagcattgaaagatgtatcgtctccttagaacttgacagagcaggattggtgttagtcgtcttatacgactaa

SEQ ID NO: 41298 - DNA, 2016 bp, Glycine max
  Peptide Sequence Number=SeqID_158076
atggatgaagagattcaagcattagaacttaataatacttggatagaaaggtataaagcaagactagtagccaagggctacactcaggtggaaggacatgattatctagacactttttctccagtggccaagttaatcacaatgagacttttgttgtccttagctgctaccaatcaatggtatcttaatcaattggatgtgaacaatgctttcttacatggtgacttgaatgaagaggtgtacatgattattccacaaggcatgcaggacttaagtgatttaaggtactttgtaggctttgaagtagccagaaaaactgctggtatcaatttatgtcagagaaaatatgctctggacattctcagtgatgcttgtatgcttggaaatccaacagggatctttctttctgctataagtaacattcgtttaaaagactttaatgattcagattgggctgattgtattgacaccagaagatctatcactgaggtcgagtatcgggcactggctagtgccacttgtgagctacaatggctcacctatctactggaagagacaaagcacattaagattgactgccatttagttcgagagaaaatgttgaatggtcttgtgaagttgcttcctatccctcctgtaaaccaattagcagatatctacactaaggctttacttcatggcgctttccaggagcttccattgaaactgagactgagagaaacattaactactattgatcatcattgctataaccatgatgttcttgagattgttcaagcaggcttcctagaattagaaaacaatcctacaaacgcacaaaaagttgcctacaaagatgctataaaatgcgatagcaaagccttgttcttgattcttcagagtgtggatgcaagtgtggcttcaatcattgcgaaggtagtacaagctacttcaaatggaagaaggagagcggacgtgataatcatggaaaaagtcatgcacgcggtgactcaaagctttgatcacattgttgtagccattgaagaatacatagaagtagaaaatatgaagtttgaggagcttcaaggtaagccaaaggctgaagacaaactagaatcctctcataggggagaagctggtccctcaaatcaaggatacaaaaagaagaaagatagaaggaagatacaatgcttcaactgtgaaaagcggggccactatgaagctgaatgttggcatgtggtcatgaagaatgacaaattggagctatttgatccaagtcaaaggttgttgctaagatcacctatttcaaagaataggatccttcaagccaacatcagaaccactaaagtgcagtgcctctcaaccacagtaactgatcaagagaactggctatggcattttagatttaaggctatggctgaaaggcaaagtggaaggatcattaaaattctaagaactgatggtgatggagaaaatatgattgtgttgaatatggctaagagcacaataaaacagaaaaatctgccgcacaatttctggggtgaggcagtaattacaaccacctatctgtggaacagatgctctacaaagagacttaaagagaaggtactagaagaatcctggtctagcaggaaaccaactgtaggtaatttgagagtgtttggctcactatgcttcaagcatgtacctgatgagagaagaaagaaattacaagataaaagtgaagccatgatcttgtcatgggacaagaaaaatcagagaaatgggcatgactcaaccattcctatacaacttgatgaagtgcatattgatgatgaaggaaatacagaggaactgaatgagactaaaaaggacaccattcctcaaggtgttcagattcagagaccagttagagaaaggcaacccccatcaaggtatgcagactttgagatgttgcatgataatgaagtaattactgaaggggacatggcacattttgctttgccgacagatgtagaacctatcaatcatgaagatgctttgaaggaagatgcatag

SEQ ID NO: 41299 - DNA, 498 bp, Glycine max
  Peptide Sequence Number=SeqID_158077
atggctttcgaaccgggttccgcagtggaagtcagcatcgacggtggtgctggtgcacttggcaggtcatggttttccgacagattcctggtcctgtaccctaacgtggcggagaaatcaaccgtgagttttcaccagctccgactacttcccccgccggagacccgttggatattccactacggcgaaaaggtggaagtgtctttcggggactcagaacgagttccttttcaaactgtcattgggaaagctatcacagcatggctgcaggtgcttgccaatgtaaatatattggcattgtgtgtgcatgccattcgcatattgcatcttgaactctcaaatcccatttcaatgaaagctcaacctcctaactttgctagattggagctgttgatagtgaagcagcagtttcctttcgattccttcatcttggccaacgatttacctccacaagatcaatccttgaatgttcacagtccatactatcttcatccatga

SEQ ID NO: 41300 - DNA, 720 bp, Glycine max
  Peptide Sequence Number=SeqID_158078
atggcctcaacagctgaaccacttccttatagctcaagaagaagagatgagtcagagttcaatttgagagaatgggcagtgaaagctagaatccgccgagagaacaccaactctagaaggtactcaggatcttacatgagaagctttagagaagacacaaggtcatttagatcaaacataaccatttctagcactgcttcttcacccggataccccttaaaagatgatatagacccttcaacatattctttcacaactgctcttaaagcattgcaagcaagggcaggctataacaggtggggatgcttatctccagatggttttgctttaaattccaagtggaatgaagcagaaaggtatatatgcaaccctctctcaggggaggtaccattggagtgtttatctgcaaaaactcttagtggaagatcttttagaaactcaataaacagaattgccatgtctgctcctctagtttattcctcaaagcacattccaacaaagccagcaacttacatacaagaagaagtggctcttcaatttcccaatccagaaaagaagaaagagggaatcacaagagatgttggtactcaaagcacacccccttatcttagttcaaccagtcccagccctgcttcaactccatccatcacagagagatcaaaacctcgaatttctgactcccttaacttaaatgcaaaaacaacaaattccgacgaagag

SEQ ID NO: 41301 - DNA, 264 bp, Glycine max
  Peptide Sequence Number=SeqID_158079
atggatgtcctgaagaggttcaatatgactgactgtaatccttcaattactccacttgaagtggtactgaaattggataatacaagtaatgatgatgagcctgttgatccaactttgttcaagcagttgataggatcattgagatatctgtgcaacgataggctagatatcaattttgcagaaatcaaatttcatggctgccaagagaatactgagatgcctaaagggaactatgaagtgttgttcctatgtgaatcaaattag

SEQ ID NO: 41302 - DNA, 561 bp, Glycine max
  Peptide Sequence Number=SeqID_158080
atggacgagaatgtggaattggatgcttgggagattgagtacgttagttacggtggggagcaacacctccctctcgtaatgaaccttgttgatcaagaactcagcgaaccttactccatcttcacgtaccgttacttcgtctatctctggcctcagctttctttcctggtgcttcctcaactttttcactttcagatggtatgtaagatggggaacaccgtaacactttcagaggctacattgtcatgctggttgtcatcaagccctacagaggaagaggcattgcttgttactaggtctatcaaggtgattatggaatcaggttgtgaagaggttacattggaagcggaagtgacaaataaaggagcactggcactgtatggtcgccttggctttattagggccaagcgtctctttcactactatttgaatggagttgatgctttccgtctgaaacttttatttccccgctcagagttgcacccatctctgcctatgatgtctgataaatacgagagccacatgcaaagtgatcatggtgatgcaccatttaaagaatga

SEQ ID NO: 41303 - DNA, 1110 bp, Glycine max
  Peptide Sequence Number=SeqID_158081
atgttaatctcatcacctaaacaacccttcctcctcgtaaccatcttaatcaccatcttgttattgggcccaggcccaatcctcgctcgcaacgcccacgtcatcaatttccggtcaccgaacctctacccggaatccctaacgtgggacccacgcgcgcagcacttcctcctcggatccctccgccagcgcatcatcgccgccgtctccgacgcgggggtcgtggaaaccttcatctcagacaccgaccttcccgcagacgtcgccttcctcggcctcgccgtcgattccccgcgaaaccgcctcctcgccgtcgtccactccagctattccctccctccgttcaacgccctcgccgcctacgacctccgctcccgccgccgcctcttcctctcctccctcccctccgaagagatcgacgccgccaatgacgtcgccgtcgaccaccgcggcaacgccttcgtcacaaactccggcggaaacttcatctggaaggtcaccgccgacggatccgcctctatcttctccacatctccgatgtacaagacggcaacggaaattccagcaaacgacaacgacaccgcacctcacggttccctaggactcaacggaatcgcttacgtcagcaaaggttaccttttagtggtgcaatcgagcaccgggaaggttttcaaggtggacgcggtggacggcacggcaaggaaagtgttgctgaacgaggacctcgtcggcgccgacgacatcgcggtgaggaaggacggggcggcggcggtggtgtcgccgttgaaggagttgtggttggtgaagagcattgatagttgggcggagggaacggtgtacgacaacgtggaggttaatgtgcggcggttcccgacgtcggtggtggtcggagataaggagagggtgtatgtgttgtacggacacttggatgaagggagaatgggggattccggaagagagagttttgggattgctgagttaagatctaaaaaagagggtcaagatgagagcatttggatctttgtgctcattggtattggcttagcttatttttgcttttggaggtttcagatgggtcaactagttaagaaaatggacaagatcaattga

SEQ ID NO: 41304 - DNA, 348 bp, Glycine max
  Peptide Sequence Number=SeqID_158082
atggcagctgagatggtgtgtgaggacctgccaaaggaagtgtgtgctttctcattagcttcatcagggaagaggtgtttgttggagaccgagaaggtggccgacggttgcgtcgagtaccaatgccggacgtcggaagtggtggtggagagaatggcagagtacatagagacagaccaatgtgtggaggcatgtggggttgataggaactctgttggaatttcatctgatgccttctttgagcctcaattcactggcaagctttgctctccagcatgttaccagaagtgccccaacattattgaccttttcttcaacttggctgctggagaggaattgactcattaa

SEQ ID NO: 41305 - DNA, 834 bp, Glycine max
  Peptide Sequence Number=SeqID_158083
atgcaatatggcaagcttccactatcttcacaagcatcagaggagaaagaggggacagtagaagactttgatgcttataataattatgcatcttggtcttcagaaactgacatgtctgaaatggtttctgctctttctcaagttatgggaactaccaatcggaacccacacatgccacaatcaaactcctttccttcctcaacttccgtggtcaaagatcaacctcaaccatacccatctcaacctcctccagatcaagaggtgacaaagaagccacactacagaggagtgaggcagagaccatgggggaaatgggcagcagaaatccgtgacccaaaaaaagcagcaagagtgtggctaggaacctttgaaacagcagaggatgcagcccttgcatatgacaaagcagcactcaagttcaaaggcacaaaagctaagctcaatttccctgaaagacttcatcaaaatgttccctatatgcaacaacaccaacaaggttcctcaaacagaaacgtttttcccttccatgctacttcctccacttcttctagtgcaactgggtctgtttcttctcttgatgctgttgcccctccttcattgtccacacatgaccaccaagttttcccaaatctgtatcaatatgcacagattctttcaagtggtgatgaagagttcccttattacacatcccatcttttcaaccaacaacaacaacaccaacctttcagttctcaattctctaccactttttcttcctcctcatctccctcatcctacttttacaatcagcaacaacaatatgatcaacaaggacatgatcactcaaaccactag

SEQ ID NO: 41306 - DNA, 1272 bp, Glycine max
  Peptide Sequence Number=SeqID_158084
atgacctccagaaagaggaaatcatccacctctcgacctcaagaaccttatgacaccacaagatttgtttccgaggttgcttgggagaggtacgagcaaaacgtacacgccagaaacatcctcccagagaggaatgttgatctatatgtcatgcagtatgacgagttccgcaaggagctcgagaggaggcggtggcataaagccttgattaggcagcctgatggtcacatagatgtggccctggtcaaggaattttatgcaaatttgtatgacctagaggataggtcccccaggcaggggagtgatactcagcctactctaggggctccctggaagctcctgaggaaggatctcactacattggcacagacttggaccgtcttgtcttattctaacctcgcccctacctctcatacgtccgatcttaatatggacagggcaaggttagtgtatgggttggtgatgaagatggatatggatgtgggctcatttatttttggtcagatctcccagatggcccagcccaactcctctcggctaggttttcctgcactcatcattgctttgtgcatagccagaggagtagtatccaactcccttactttcgagtctctgagccccgccattaatttggcatacatcaagaaaaactgttggaaaccggatgatcccacgatcacctttccggggacctgcaagactcgggctcggggaccctcttatacttctacctctgctccagcttctacttcagcaccagctccaccaccagctcttgttcctacacctccagcactcacagcaccctccggcccctccgctcaaagcttagacgtcccggtgccgatgctgcagagccttcaccatggcttattcctagtgatgcagagcattcacaatttggctcagcatcggcccatcatcagcatggaggatttcatggcccaggttccctggccaggagtccagccttctcctgcagggggaggtgaggctcctacaacccaagagccacagccagagtcggaggcgacatcggaggagactccagaggttactcctgccaccacgcctttggaggccactgaggagggagacggtgctacagacaccaattatgccgtagacatggcagcagcatggggcacctgggacccctggcccacatcaacacaggattctattccgacgccctctccacacctcaggatgatccaacactggcacaagaggattgatgataggacacttatttatatttctgttatttag

SEQ ID NO: 41307 - DNA, 186 bp, Glycine max
  Peptide Sequence Number=SeqID_158085
atgaaagatgcacctgcttccaaatcgaacaattccagatctgtaaaccaactttctgatctatacactagatccgacgggcgcacaccgaatttcaattctgacttcagcctcacagtcactcacaagtttgcattcaacctatttggtttagtgcactccaaaggcgccacacagaattactaa

SEQ ID NO: 41308 - DNA, 108 bp, Glycine max
  Peptide Sequence Number=SeqID_158086
atgtacaattcctacaaaaagaaccataaattggaggtagagatttctgatagattctacccgtcattcctagagacagtcgctcagacattgttcatgcaacaataa

SEQ ID NO: 41309 - DNA, 339 bp, Glycine max
  Peptide Sequence Number=SeqID_158087
atgttgaatccaactcagtttcaggtcaaagaagagaatgttcaagtagttgatgactcgctcagtgaggcaaatccgctcagcgagtggcatctgcttagcgaggcatacaactcgcttagtgggttgagaaaccctaaaagaggatcagtcagagatgtgctcgcccagtgcgcagccagcccacccagcgggctgaaaggtccaagagcctttaaaacactgaagttggcggaaataaagcatagagttagagagagagcaccagaggaagctgagaagatagaaaggaagcaactaagagagcttaggttagaaggagtgaagtctagggtttag

SEQ ID NO: 41310 - DNA, 297 bp, Glycine max
  Peptide Sequence Number=SeqID_158088
atgggtgaatcaaacaaacgtgagtggtatgttgatgacaatccttcccgcctggttgcccttggaaaagtttatgaggggtcaacaaccatccacaaagtccctttgggcaataatcaagtgaaggtcggtgttgagagagttcgagatgttgatgcttgcctccctatacccactcaagaggataaacatggagttgagggaccggtgaaacctgtagatagggcacaacatgatgatgatcccttataccaaatgacattgacgatctcacagcttttccttaagcctttgtag

SEQ ID NO: 41311 - DNA, 387 bp, Glycine max
  Peptide Sequence Number=SeqID_158089
atgttgaatccaactcagtttcaagccaaagaagagatggttcaagtagttgatgactcgctcagcgaggcagatctgctcagtgagtggcattcgcttagcgaggcatacaactcacttagtgggttgagaaaccctagaagaagatcagtcagagatgtgctcgcccagcgcccagccagcccgcccagcggtctcgctaagccaaaattcacttactctcgcttagcgagccttcggaagctgaaaggtccaagagcctttaaaacattgaagttggcgaaaataaagcatagagttagagatagcgcaccagaggaagctaagaagacagaaaggaagcagctaagagagcatatgttagaaggagtgaagtctagggtttag

SEQ ID NO: 41312 - DNA, 2229 bp, Glycine max
  Peptide Sequence Number=SeqID_158090
atgttggcggtttcagtcctatttattcctgttttcactttctcttggcagagacaggctagcttatggaaatcagataacatgcccaattgctatgattttgatcaaggaataaaaactagcttgaatgtacaatcattatcccatttatcagatagtagcaaagtcaatgtagttgctactcagcatgagagtagtctcttttcaagttctttgtcggagttgtttagcaggaaattgagattatctgcaaataatgctttatatggacattcagttgacactgttgcatcccactatgaggaagagagactttttgactctcttgaagaactcgaggctcaaattattggaaatctactccccagtgatgatgatttgctttctggagtcactaatgggctcgaccacatcatccaagacagctctggtgatgacacggatgaactagaccttttcagtagtgttggagggatggatttaggacatgataattgttcatcttctgaacaaaagaattctgaaatccttgatgaagcttgtaacagtcaactagggctgcgtagtgcctcgattgctggagaacagccttacagtgaacacccttctagaacaatagttgtgagaaacattaatagtcaacacaaagaaagtaatgtttatctgcatcaaaacagccttcctctaaagtcaccaactagcttcccgggtttgcatgggatttctaaatctggtaagctggatggtggaagagttcttggtgttgagcctgccatatgcacaccatccccggaaactgctttttttcatggggtctcttcaagtgttcctaactccttaccatcactagtcagagttaaatcagctgacaacagatgtgaagttactgaatctggttcacctggccagttgaattttgatagtcaagctgctccagcttttcatccccattcccttccagaatttcatgatggtttagctaacagtgttcatcatattcctcccgaggtggcagcaaacatcaatctcaaaacacaggaaagaatagataacatgcagttctgtcaagtaaactccaatgggcgcttcatggaattcaatgaatgtgtttttaaatcctctggtaatggaagctgtcctcttcctggtcatcattacaaatggggaaactcctatcagcctcctggaatgatgtggccaaattcaccttcgtatattgatggagtttgtgcagccactaatctgccaagattgcatggacttcctaggtcaccatcacatatgatggccactgttttacccataaatggccagcatgtgccttcagctcctttttgggacagaagacatacctatgcaggggaatctcttgggaatatgcaattttccggtaacacagcagcacactgtgttgattttgtttcttataatatctttccacattttggaggaaattgtgttgaccttagagtcctacccaagaatcttggagtccattttcataaccaaggggacctaatgtttcccagaagaaaccacatgattaattcatttgagactcacaaacaacgtaccagaagccgcagaaatgaaggtttgccaaacttggatgacaagaaacagtatgaacttgatattgaccgcataaagaagggagaagataaccgaacaacactaatgataaagaacattcctaacaagtatacatccaagatgctgttagctgcaattgatgaacgccatagaggaacttatgattttgtttatctgccaattgatttcagagcaagtgcttttctctttttaaaatacttggagtttatgaacaaatgcaatgtgggatatgcattcatcaacatgatcaatcctggcttgattataccattctatcaggtgttcgatgggaagaaatgggagaaattcaacagtgagaaagtggcatcactagcatatgctcgtatacaagggaaagcagctctcattgctcacttccaaaattcaagcttgatgaatgaggataagcgctgcaggcctatcctcttcaacaccgatggccctaatgccggtgaccaggttcctttcccagttggcattaacattcgcaacaaagctggaagagtgagaaacaacactcaggaggataacctgcaagggagtcggagtctgcctaatttgggaatcagtaagctctcatctgatggagacagtcattcattggagtcagactaa

SEQ ID NO: 41313 - DNA, 153 bp, Glycine max
  Peptide Sequence Number=SeqID_158091
atgacacctgagactacgagtgaggaggacactgagactgtgagagagagtacgagtgcgagtagtgagaatgcgagggaggagactgagactacgaatgtcgcaaaagcttggaaagtcgtgaacgttctaggacctttcttgttggaataa

SEQ ID NO: 41314 - DNA, 177 bp, Glycine max
  Peptide Sequence Number=SeqID_158092
atggctaatcaaaggggtcaggtccagttgaatgagaacttctaccgggccacagttgcatggcctggagatgagcccgatttacagacaagggcaggacctgtaagggcccccagagacgaggttggagctcaggaggatgatgatatggctgatgtgctggactacttcctttga

SEQ ID NO: 41315 - DNA, 244 bp, Glycine max
  Peptide Sequence Number=SeqID_158093
gtacctacagggaagatccaacaaaggatttagcttttcatacccaggaagcatcctttacaataaagagaagaacaagatgaaagatgtcaaaaatacaagtggtgaggatgtctccttcacctctaggatctctcaatcactcacaaactcatctcaagctctcaaatcggctcctacttcaagctctagtctctgcaaatcttcacacagcaaaatctatcaaaactctctggaattgtga

SEQ ID NO: 41316 - DNA, 561 bp, Glycine max
  Peptide Sequence Number=SeqID_158094
atggcattgcagaaaaattatgttgctgaaactgatggtagaaattggttttatgattgggccactggggtatatgttgaaaatttattgatgttcaacaagttcagctcggtggaaaaagatttggttgatattattgttgttgttggtaatgtctggtgttttttggtatatactaatgctgttgtgtttcttgtctctcgtgaagttggaaagtgtatagagaagcaatatcagccccatctccaaggctgcgaaggggaaggcaaccctcaaggtactaccaatgagaaacgggcaaacccaaatccagaaatgggttctacatctcaaggggaacggaagaggaagtggttagcaaccgatggagaggaggaaactttgcaaagccaattaattgatgtcttagaaaagaatggcaaaatgctacgtgatcaacttgaagctcagaaactgaatttccagttggatcgtcaacagcagaaagacactgcaagtaacatagttgctgtactagataagcttgcagatgctctagggagaattgctgataaattgtag

SEQ ID NO: 41317 - DNA, 195 bp, Glycine max
  Peptide Sequence Number=SeqID_158095
atggatatgtattttgttaacgaaaatgcatttcaaaattactcaatccaaaactatacaaaggaggtcagtggctatggtgacaccacaaggaaagtgaggtgtgagagactaagacaacaagatgagattgtggcagagacacaagaaaggagggacaatgtccatgttgaagaaagtggagggagtgagtga

SEQ ID NO: 41318 - DNA, 445 bp, Glycine max
  Peptide Sequence Number=SeqID_158096
gttctcaatcctccacttcaacagccacgcgaccaagaccagcaggcatggctccccgcggtttcaccgccgccactgccggcatgcgccgtcgccactaccggcatgcaccgtcgccgtctcgacaacagaaacagctctaccagtaccgtcattagaggcggcggcagcaacatgctgaggttctacacggacgatgccccggggctgaagatttcgccgacgatggtgctcgtgatgagcttctgcttcatcggcttcaccacgctccacgtgtttgacaaactctaccgctccaaatctggtggcgtccccgacctaaaaagcatacgtttcaacgtcgttgctgacatcaacaacgtcttcgaagattggtcagaggtctacaacgacgtcgcatttaaagacaggcctgcaccgtcgttgaatgccgacaaggaccgat

SEQ ID NO: 41319 - DNA, 2203 bp, Glycine max
  Peptide Sequence Number=SeqID_158097
tgagcttgagggccctgcaaatggtcgtgttgctgttcgagacttcgattccgagatcgaatattcgtggtgcgataatgctaaaccatacctactcttagaccaacaccaacacgaacaacaacgcgcgaatcctagtaatgggttatggcctggtgattgtgattcccttcatagatttatggtatgtaccactgccatacatggagagggaaggttccagaatctggaagagaatctcagtgagttaatttacggtttgctggtctttgaggttagtcagggatggttggcacacttgatcaggcatcaagggtgggatttaggtagagcagtgagagtgagagaggcatcaagacttggggaggcctatgatggagatattgcatttgcaagtgccttggaaacttttggtggtgggcataatgacccaatcagtgtggcttttggaggtatgctccctttttacatcaatattatgatggttgatgaaaggttctctgttcctcctggtcctgttatgaccaaattcaccatagccttacgagaaattggtacatacaaggaagttcttcgatcacagactcgtgaaaggtttctgtcactaagaaaaggcacaaaaactggtgtagctactgccctagaagaggagcttcatagtgcaagatctacatttgagcaagctcggtttaatctggttactgccttgtcaaatgttgaagcaaagaagagatttgaatttttggaagcagtcagtgggaccatggatgcacatcttcgttacttcaaacaggggtatgaattgttgcaccaaatggagccatatattaaccaggtcttgacttatgctcagcaatcaagagaaaggtccaattatgagcaggcagccctaaatgaaagaatgcaagagtacaaacgacagattgatcgggagagtaggtgggcttcaaatggttctaatgggtctcctaatggagatggtatacaagccattggtagaagttcacataagatgatagaggcagttatgcaatctgctgccaagggaaaggttcaaactattcgacaaggttatctctcaaagcgttcctctaacttaaggggggactggaaaaggagattttttgttcttgatagtcggggaatgctgtattactaccgtaaacagtgcagcaaatcatctgggtctagtagtcaacattctggccagaggaatagctctgagcttggttctggacttttaagtcgatggctgtcttctcatcatcatggtggagtacatgatgagaaatctgttgctcatcacactgtgaacttgcttacatcaacaattaaagtagatgctgaccaatcagatttgaggttttgcttccggatcatttcaccaaccaagaactatactttgcaggcagagagtgcactggaccaaatggactggattgaaaaaatcactggtgttattgcttcattactgagttctcaaattcctgaaaggatgttgcctgcaagcccaatgggaagtggtcatcataggtctaccagtgagagtagttcttttgaaagttcagattttgatcactatgctgttgaagaatgtgcagcagatagaagttttacttctgcgcatctggagcgcccctcaagaagtttgcaacagcagcgatcctgcactaaaagtgagaagccaatagatgtgctgcgaagagtttgtgggaatgataaatgtgctgattgtggagctcctgaacctgattgggcatcactaaatcttggtgttcttgtttgcattgagtgttctggtgtacatcgtaaccttggtgtgcacatatcaaaggtcaggtctcttacattggatgttaaagtgtgggaaccttctgtcataagtttatttcagtcacttggaaatacttttgccaactcagtctgggaggaattattacaatcaagaagtgcctttcaggttgatcttgtccctacaggcttaagcacgtctgataaaccaatgatgttcttcatcaccaaaccttgtcaatctgattctctatctgtgaaggaaaagttcatccatgcaaagtatgctgagaagctttttgttcgcaagccaaaggacaatcaatactgtctcttggtagcacaacaaatctgggaggctgttcatgctaacgataaaaaagctgtataccgttacattgttaattctgat

SEQ ID NO: 41320 - DNA, 375 bp, Glycine max
  Peptide Sequence Number=SeqID_158098
atggaacgtgtgttggttgaagtactaagagatcaaagaaatttgggcaataagagtgatagagcttggaaaagggtagcatacaatactacacttgcaatgttatctgttaatttcaaagttcaagtcacttgggagaacgctaaaacctgggtcaaactttggagatcatggtatggagttgttagtgatattcttagtcagagtggatttgagtgggatgacaccaaatacatgattactgttggtgatgaaaatgcatggaacaagcaattccaaaattgggatgatatagtgtacttacgtgctaaaaatggagtcattggccgtggagtagaaattgctatggatgttgatgaagtcatgtgcacatga

SEQ ID NO: 41321 - DNA, 150 bp, Glycine max
  Peptide Sequence Number=SeqID_158099
atggcaaaccatggtatatttatatctttctgctattgggatgcttttgttgggaggagcattagcatgctatgtgttgagcaatgcacgaacaaaggagtgaaattgcacaaaaggaatgaagttgatgacttcaatcaaccattttaa

SEQ ID NO: 41322 - DNA, 563 bp, Glycine max
  Peptide Sequence Number=SeqID_158100
gtagggtactgtcataccctaatttagtccggggatcatccgttgttgggatgcgaccctcgctcgaccactttgaggcggttgcttctagaggaagcaacctagctcgcctgggcgagctgggtggcaagcatctccttccttttcctataaataagggaaggagggaagaacaaaaaggttcaaccctcctgattttcaaccattcttcgacgttcttcgtcgttcttcggtcttcaaccgtaaacttttctgtgaacaactattctgcatccattaagatcttgaatgaatctaatgcttctcataaatatcaaggttttgggaaaccaggtaagggtcaccaccaggatgtaggaggtcctgagtcagtcatctttaagaaagagaacaagcagaaatcaggaggtaataacttagcttttgtctgtcttgagtctaatatagtttatgtccctatagattcttggtggcttgatagtggttccccaacccgtattgatgtgtcttttcaagggatcataaatttgagggagcctagtctgagagaagacaagttaagg

SEQ ID NO: 41323 - DNA, 1290 bp, Glycine max
  Peptide Sequence Number=SeqID_158101
atgtgttctctactttggagttccattgcattgtgtgtagctttcctactccttgagcttggcgttgtgcacccttcaccctcacaccataggatcactcgcttgccgggtcaaccccatgttcagtttcatcagttttcaggttatgtaaccgttgatgacaaaaaccagcgtgcactttttttctactttgctgaagccgaaaaagatgcactttccaagccccttgttctgtggctcaatggagggcctggttgttcttctcttggagttggtgcattttcagagaatggaccatttaggcccaaaggtaagggcttggttagaaaccaattcagctggaacagagccagggataacttggtgttcttgcaaagctggtttataaagttcccagaatacagaaaccgaagtttgttcattgtaggagaaagctatgcaggtcattatgttcctcagctggctgaacttatgctccaattcaacaaaaaggagaagttattcaatttaaaaggcattgctcttggtaatccagttctagaatttgcaacagatttcaattcgagagctgagttcttctggtcacatggattaatttcagatacaacgtacaaaatgttcacttctgtttgtaactattcaacatatgtgagggaatactataatggtgctgtttctcctatctgttcaagtgttatgagccaagttactacggaaacaagtagatttgttgacaaatatgatgtgacccttgatgtttgtttatcttcagtgttctcacaaaccaaagtcctcaatccccagcaagtaactgaaaccatagatgtatgtgtggaagatgaaacagtcaattatctgaacaggaaagatgtgcagtcagctatgcatgcacatcttgttggagttcaaagatggtctgcttgcagcaatgtcctggattatgagctgcgtgacttggagataccaacaatcacggttgtggggaagctagtcaaggagggaataccagtattggtttacagtggtgatcaggattcagttatcccactgactggaagtagaacactagtacataaattggcaaaagaacttggattgaacaccactgtgccatacagggtgtggtttgagaagcagcaggtgggtgggtggactcaagtttatggtaacatcctttcatttgccaccatcagaggagcatcacatgaagctccattttcacagcctgagagatcacttgtgctgttcaagtccttcttagaaggaggaccactaccacaagagttttga

SEQ ID NO: 41324 - DNA, 219 bp, Glycine max
  Peptide Sequence Number=SeqID_158102
atggatcaggttgttatacaaggtggaagtctaaaggtatctggtagcagattgcgtgagcgaggtttgcttttgtttgacctgtctgtcaaagaaacaggactaccaaccgagaattatgcattcatggccatgcatgggacctccaccattaaagctaaagccaatatttgctttcgtccccacatttcatatctttccataaacagccttaattaa

SEQ ID NO: 41325 - DNA, 3648 bp, Glycine max
  Peptide Sequence Number=SeqID_158103
atggggaaggaggctgaggatgtggaagagggtgagatttcggatactgcttcggtggaagagatttcagccgaggatttcaataagcaagatgttaagttgttaaataataacaataagcccaatggaagtgatgctagggtttgggctgttcatgatctttactcaaagtaccctactatatgtcgcggctatgcatcgggcttgtataatcttgcttgggcacaggccgtgcagaataagcctttgaatgatatttttgtgatggaagtggactctgatgccaatgctaacagtaaccgcaacagctcccatcgactggcctctgttgctgtgaatcctaaggatgtggtggtggtggatgtggacaaagaggaaggggagttggaggagggtgagatcgatgctgatgcggaacccgaaggagaagcagagagtgttgttgtggctgtttctgattctgagaagcttgatgatgtgaagatggatgtttctgattccgagcagcttggtgcgaggggtgttctggagggtgttaccgttgctaatgtggttgagtcgtttgctcaaacttgcagtaagctgcaaaatacccttcctgaagtgctctctagacctgctggttctgagaaggatgatctcgttcgcttgtcatttaatgctactgaagtggtgttttgctctatggactcttcggagaaagaacagaacaaggatagcatattaagattgctttcttttgtgaaggatcaacaacaggctcaattattttctccagagcatattcagggcatgatgactgcaattgattctgttggtgctttagtaaatagtgaggctattggcaaggagaaagaattgcagaccactgagataaagactcaagaaaattcagctgtagaagtgcagatccatgagataaagactcaggaaaatcaggctgtagaagctgctgaattgatttcttatagtaagcctttgcatagggacataactgggacatcacaggctttaaaatttggacaaaatagtattaaaggcagaggggttctgctccctctgttagaccttcacaaggatcatgatgcagacagtttaccatcaccaactcgagaagcaccttcctgcttccctgtgaataagttactttctgttggagagtctatggttagatctgggtcagcatctgctaagatggaacttgatagtgaaggttctaaatttcatctatatgaaactgatgctttgaaagctgtttccacatatcaacagaagtttggtcgaagttccctttttacaaatgataaatttccaagtccaactccttcaggtgactgtgaagatgaggttgttgatacaaacgaggaggtctctagtgcttctactggtgattttttaacaagcactaaaccaactcttttggatcagccacctgtttctgctacttccatggataggtccagcatgcatggattcattagttctagagtggatgcaacaggtcctgggtctttcccggtgaaaagctctgcaaagaatagagatcccaggcttcgtttcattaattctgatgcaagtgctgtggataacctgtctacattgataaataatatgtctaaagtggaatattctggaacaacaatctcaaggaaacaaaaggctgctgaagaaccttctttggatgttactgtatcaaaaagactaaaaagttctttggaaaatactgagcataatatgagcgaagtaagaactggaagtggtggttggttggaagagaatactgggcctggagctcagttgatagagaggaatcatttaatggacaaatttggacccgaagccaaaaagactttgaatacagtcagtagttcctgtactggttctgataatttcaatgcaacaagcattagaaatgagcaggcaccaattacagctagtaatgtgctagcttccttacctgctctattgaaagaagcatctgtaaatccaatcatgcttgttaacatacttagattagctgaagcccagaagaaatctgctgattctgctgcaattatgctgctgcatccaacaagctcaaatccggcaatgggaacagactcaacagcgagtattggttcatcaatggccactggtcttcttcaaagttctgttggaatgcttcctgtttcatcacaatcaacttccacggcacaaaccctacaagatgattcaggaaagattcgcatgaaaccccgtgatccacggcgcattctccacactaataatactatccagaagagtggggacttggggaatgagcaattcaaagccattgtatcccctgtgtctaacaaccagagaacaggggacaatgtcaatgccccgaagcttgagggtagggtggataataaattagtgcctactcaatcaagtgcacaacctgatattgctcgacaattcacccggaatctgaaaaacattgctgatattatgtctgtttcccaagaatcatcaactcacactcctgtttctcaaaatttttcttctgcatctgttccgcttacttcagatagaggggaacaaaaatccgttgtgtcaagctctcagaacctgcaggctgacatggcatctgctcacgaaacagctgcatcagttacctctcgatcccagagtacatggggagatgttgagcatctttttgaaggttatgacgagcagcagaaggctgctatacagagagagagggccaggaggattgaagaacagaataaaatgtttgctgctcggaaattgtgccttgtattggacctagaccacacgctacttaattctgccaagtttgtggaagttgatcctctgcacgatgagatattgagaaagaaagaagagcaggaccgtgagaaacctcacagacatctttttcgctttcctcatatgggaatgtggactaaactcagaccaggaatctggaacttcttggagaaggctagtaagctctatgagttgcatctttacactatgggaaacaagctatatgcgacagaaatggcaaaggtgcttgatccaaagggagttttgtttgctggaagagttatctctagaggtgatgatactgattcagttgatggtgaggagagggttcccaaaagcaaagatttggaaggcgttttgggtatggaatcatctgttgtaattatagatgattctgtgagggtctggcctcataacaaactgaacttgatagtggtggaaaggtatacatacttcccctgtagtagacgtcagtttggactgcctggcccttcccttcttgagattgatcatgatgagagacctgaagctggaactctggcatcctctttggcagttattgagaaaatacaccaaatcttttttgcctctcaatccttagaagaagtggatgtcagaaatatacttgcatcagaacagagaaaaatcttagctggttgtcgcatagtatttagcagggtatttcctgttggtgaagcaaatcctcaccttcatccattgtggcagacagctgaacaatttggtgctgtttgcaccaaccagattgatgaacaggttactcacgtagttgcaaattcccctgggactgataagattcctgcattgctaacaggtcttcatgatagagtaatttaa

SEQ ID NO: 41326 - DNA, 1215 bp, Glycine max
  Peptide Sequence Number=SeqID_158104
atgcctgcgacggactaccaaggttcgtcttctccttcatcgttaacccattttggccgttcaattctgagtcttcgtcaagaacaggttcactccatttccatggaagggtcaagcttggaggctgagttggaatcctttcagcaacacgtcactgaccggttccttgaactcacttcggttgttcatgatgatttgctttcgctctcgtgggttgggaagctccttcattgcttcctgtgttgccaagaggaattcaaggccattctccacagccacagggctcaggtgttgagacccccattggatcgcatggtgtctgaatactttgagcgcagtgtgaaggctttagatgtttgcaatgccattcgtgacggtattgagcagattcgccaatggcagaagctgttggagattgtgctctatgcattggggcatcagaggagcattggtgagggccaatttcgtagagccaagaaggccctcattgatttgcacatcgggatgcttgatgatcaggactccaacgcatcaattgcacatcgaaaccggtcctttggccgcagcactggtagcagagacagtcatagtcatggtaacaatcatagcaataataatacctatcaccatcggtcattggggcattttcgatcactttcgtggagtgtttctcggacttggtctgctgctaggcagctccaagcaattgggaacaacatttatccacctaaggcaaatgagcttatggcttctggtggccttgcaatgcctgtgttcatcatgaattcgatcctgttgtttgtgatgttggcacttgtggctgcaattccgtgccaggaccgtggattacatgtccattttaccattcccaggaattactcctgggctgctgcaatcctctcacttcacgaaaggatcgtggaggagtcgaagaaacgggagcggaagaattcttgtggcttgcttaaggagattcatcagattgagaaatgtgctagagtgatgaatgatttggctgattctgtccacttcccattgacggaggggaaagaacgagaggttagacagatagtgcaggaggtttcacaagtctgtgatgctttgaaaggtggactagaccctttggagcgccaagtgagggatgtcttccatagaattgtgcgcagccgaacagaagggcttgactcacttggcaggccaagcaatgctgagtaa

SEQ ID NO: 41327 - DNA, 291 bp, Glycine max
  Peptide Sequence Number=SeqID_158105
atgaaagcagaaagcgtggttttggttaccagaggaaggaatcgaggtcgcgatggagcgggagcgcgtggagtgctaatccgaagaaggcgcgtgcacgacgggaattgcagaaaggattgcttggcggaagaagatgcggaggcgagtgagggtggcaagcgcgtggagagttcggagttcaaagaagcaatcgcggaggacgcggaaacggagaccgccatgggaacgaaacgaaacgaacgtgtttcttctgttctgctggtaaagaaaaaatgtagagatgagtaa

SEQ ID NO: 41328 - DNA, 363 bp, Glycine max
  Peptide Sequence Number=SeqID_158106
atggaaattacgtttgacgtccctaaatatgttcaagcgaagaaacaaacctataactcgtttgacgatttgcttgccaattctgagaaacctgtgttggttgacttctatgcaacctggtgtggtccttgtcaatttatggttcccatactcaatgaagtaagcactcggcttaaggataagatacaggtggtgaagattgatactgagaagtatcctagcattgctgacaaatacagaattgaggccttgccgactttcatcatgtttaaggatggagaaccttatgatcgctttgagggagcattgactgcagatcagctcattgaacgcatagaagccggcctcaaggttaagcaataa

SEQ ID NO: 41329 - DNA, 639 bp, Glycine max
  Peptide Sequence Number=SeqID_158107
atggaacatcgcatgagtcacatgacgggtcgaaacataagttttagcctaggaaccgtgttcatctactctgagccgcataacttcccggaatcgtgcatacctacgttcaatatgtcgctggtggcaaacgaggatttccagcacatacttcgtgttttgaacacgaacgtagatgggaagcagaagataatgttcgctcttacctcaatcaaaggtattgggaggcgattttctaacatttgctgcaagaaggctgatgttgacatgaacaaaagagctggtgaactgagtgctgctgagttggatagtgtgatgactgtggttgccaacccccggcaattcaagattccggactggtttttgaacagaaagaaggactacaaggatggcaagtattctcaggtggtgtcaaatgcactggatatgaagttgagggatgacttggagagacttaagaaaatcagatctataccatatgaatttgatttgtatggcttcaacactcttgtcttcatgtcaagcagtgtctggaaccatcgaggtttgagacactactggggtcttcgtgtacgtggccagcataccaagaccactggtcgtaggggtaaaactgttggtgtgtctaagaagcgctga

SEQ ID NO: 41330 - DNA, 111 bp, Glycine max
  Peptide Sequence Number=SeqID_158108
atgtttgctagtgccccggactgtggaacaaaggagtatcccgaacctacacccgaggtattgacggcgattctcaaatatcgcagaacagaacagaatgggatacgatga

SEQ ID NO: 41331 - DNA, 249 bp, Glycine max
  Peptide Sequence Number=SeqID_158109
atggagttagaatttctcaaaatgttcttgatgtggaacatcgttcttaacttcgtgtgcttgttgatgttgggtgatagtgtgaaagatgatccaaaaggtggaggaggtcattggggtgaccttcgacatgggtggattggtgatagtgataatgacgatgatagatctactttgagattgagttatgtatatttgaaaggaaaagaaaatgagcaatacaccacaatttttggggttttgatgtga

SEQ ID NO: 41332 - DNA, 480 bp, Glycine max
  Peptide Sequence Number=SeqID_158110
atgtacctagcacctaatccgaggcccggagctttaacagaatcaaatagcacagagaaagccagcatcataaacaacatcaagaaatggtgcagtccaatgattcgagctcttagtatctcaacaattggagtaggaagtttctcatttaacgccaagagcaaccattgccccgtatctggaagaggagtcgaggccgaggacggcggtgacggagcggacggagatcatttcgcagaggagggcggcgagcatgaagagcatggaggcgatgaacggaatcgccgaccggaactcggcagaccagtgccggtaggaggggacgcggaaaacggcggtgagggcgaggagggaccacagcgccggttgcagacgcgagtgccacgccggggaaaggtggcggaggtagtcgacggtgatataggacatggcggctatgcccagcccggcgttcgccggcggcgccggccaccgcattga

SEQ ID NO: 41333 - DNA, 1305 bp, Glycine max
  Peptide Sequence Number=SeqID_158111
atgtcctatatcaccgtcgactacctccgccacctttccccggcgtggcactcgcgtctgcaaccggcgctgtggtccctcctcgccctcaccgccgttttccgcgtcccctcctaccggcactggtctgccgagttccggtcggcgattccgttcatcgcctccatgctcttcatgctcgccgccctcctctgcgaaatgatctccgtccgctccgtcaccgccgtcctcggcctcgactggcacctgaacacacctcctcttccagatacggggcaatggttgctcttggcgttaaatgagaaacttcctactccaattgttgagatactaagagctcgaatcattggactgcaccatttcttgatgttgtttatgatgctggctttctctgtgctatttgattctgttaaagctccgggcctcggattaggtgctaggtacatgtttaccatggcagttggccgccttcttcgtgccataacttttgcatctacaattctgccatctgcccgtccttggtgtgctggttcccggttcagagttccgggatatcctcatcgttgggctcagaaatattatgttccctatgctacagatcatgatgctatcagccgggtgataaagctcgatacagcttacggtatgcactatgcagaatatttatttgctgggttctggtcctgcaaagtaacatactcttctttcttagttgacattggaaaaccagttggtgactaccagccagattggggttcgatgagctttctaattgattttctgcgacccactgtctccgaaggaccttcatggtacagtctgttaaagaaagctggaggtggctgcaatgacctcctatacagtggccacatgcttgttgccgtgctcacagccatggcttggacggaagcatatggaggattcagttctgctcttgtatggcttcttgtgatgcacagtgcccaaagagaaatacgagaacgccatcattacactgtagactgcgttgtagccatctatgtggggatcctcttatggaagatgacaggttttatctggtcacatgaagctacatctagtaataggaggctgactaaatttgagaagattcaaagcagactaatccaagcttccaaagactcggacattgatgaagtgagggagcttctcaaagagattgagttaagcaatgaagagagcaagaatcagactggaattaaatattcacggttgtttcgtagtgccaccattgtctttgcacttgtcattgttgttctggctttcacactgacaagtgatggatga

SEQ ID NO: 41334 - DNA, 300 bp, Glycine max
  Peptide Sequence Number=SeqID_158112
atggcgaaggcctcttgctccagaaactactactccttctctagtaccgccatgacgatgctgtcgccggtttcatcaccatcctctccgacgctagactccattcaaatccaaacaaagctcgttgctgacgagctcgttgccggagagggcgaggtactggaggtgctgccaggtgccgtgcttgggagggatctagctggagaagaagttgccgccgaggtgaaggtggcggaggaggggtatgacagcgacggagagaagaatttccaaattcactcacttaaagatagaatttga

SEQ ID NO: 41335 - DNA, 207 bp, Glycine max
  Peptide Sequence Number=SeqID_158113
aattacctcagattaaacctcttcgacgacaacaacgcctcaggatcctcacacctcagccggctcgacgagaacgctgccgcggttgccacccctgacgaccgtagaaacatcgaactcactatcgacttgctccgccacgacgagctccccccgctgccatacctcacactcgacttcgacaatgggaaaaaacccctcctctag

SEQ ID NO: 41336 - DNA, 270 bp, Glycine max
  Peptide Sequence Number=SeqID_158114
atgattcctccacactctccgggttcaagattatgcttggaagatattgacgacaaatggatgcatttctctgactaccttgcactgcctggggagacatatgtgaaaccatatatgcctcggtacccgatggcggcaacaactacggaggaagcacttgcgcatgcaccttctgatatggagcagcctagacgtgcagtggcttgccaatcaatagttgaaaggttggagcggttgctcaacctaaggatagtgactgaaggcacataa

SEQ ID NO: 41337 - DNA, 744 bp, Glycine max
  Peptide Sequence Number=SeqID_158115
atgacattttacaaatttgcagactggggcccattagttgatgttgttggttattgtttcttgagccttgcttcaaagtatcaacctcgggaagattttgtccaatggattaaaaaaggaccacctcctttatattttgggtttgggagcatgcctcttgaagatcctaaaggaacaacagatgttatattggaggcactaaaagatacagaacaacggggaattattgaccggggttggggcaatctagggaatttggcagaactttctgataatgttttccttctggaggaatgccctcacgattggctgtttcctcaatgttctgctgtggtgcatcatggtggagctggaaccacggctacaggattaaaagctgggtgtccgacaaccatagttccattctttggtgatcagttcttttggggagatagaatatatgagaaagaattgggaccagccccaatcccaatatctcagctcaatgtagagaatttatcaaatgccataagattcatgctccagccagaggtgaaatctcgagcaatggaaattgctaagttgattgagaatgaagatggtgttgccgctgcggttgatgcattccatcgccatctgcctgatgaactgccactcccaactccaactcctactccagtggaggaggaggaccacttgaatcctttgcagtggtttttcctccgacttggaaggttctgttgtgcaccttgtggtggtgtgtag

SEQ ID NO: 41338 - DNA, 624 bp, Glycine max
  Peptide Sequence Number=SeqID_158116
atgtcgtcgtcgatgatgtctatggcaagtggtccaattacatcatcaacctttggtcatcacgagatgatgaaccgggcatttggtccactacttcctcattcaatgcctattatgccctcttcttcttctttcactcctcttcctattccttcttcttcttcctcttcacaaacttgttactcttctttgaggcctcatcccttaggatcttactttcccacagtaccctttcatcacttcccttcttctacttcctcttccgggtttgatcaatatgacgtggcagcagctggggctggaccaagctccgataatgtcaccgttcgggttgttgatcctcctagaagacctcattctggaatatggtttatgttactagtctctccaaatcaagcgagagaaccattcttgtcacaaatacctaagaactaccttagaattaaggatggaaggatgacagttcggttgctattgaagtatctggttagcaaactcagactggaaagcgaatcagagagagatgaagaaaatgaacataggggattacataggagtgtccgaaaaggaaatggaactacgttctcatcaaaagtaccaaagtacattaaaatagaaacctag

SEQ ID NO: 41339 - DNA, 744 bp, Glycine max
  Peptide Sequence Number=SeqID_158117
atgtgtacagatgcagaggaacgtagagatgccccaaaaagcatcaacttccatgaggagtacaatagtgcattgcgaacaaaatcctatgttgatttcttcaataaagtccaattacttgtaaaccatccttccattgactacaaccataacaatttttcagaaattctccttgaaccttgccaagaaactatagcttccattgttgattcaacaaccctttcaaagataccagaactcagaaactttattgctcaggcactagccattaaggatggtgactatttggaaacttttgaactgatcatctttgagctaaactcattcaattactcaaataacccattttcaaaccttaaaagccatgacttcaagatcatcaatgataagcactcatcagtattgcaccatctaaagtcaatgagaaaaaaggtgggaaggaaaattaagcttatgaagtatttgaagaagacatctgaggtctgtgtcacagcagcttgtggcatagtagcaataacagccatgcaaaggggacttatattgaatagagactttgacacaatgggtagacttgtagttgtagctaggcttcatgataaaattgagcatagcagggcaatggtgcaattctgtttggacagaaaagaggacaaattctctttgcaggtggtgaaggaacttaagaaaagtgatgttgggttcatgaaacatgtggaagaacttgaagaacatgtgtgcttgtag

SEQ ID NO: 41340 - DNA, 630 bp, Glycine max
  Peptide Sequence Number=SeqID_158118
atgggtagtaatgagattgaacatttgtctgaagatgtgttagataggggttttgaatttgatagtcagcagaagaaagatctcaagcaaatggagatagagtctcagggtgagaagttttatggagcttcttctgaggaggacgaggatgtgaacaagtcattgccgcaagttgcttcttcatcaagaagaggtttggaacattgcatcacggcccctgttggaactgagaggaacccacttatagttgatgatgacatttttctttctagatcaacaacaggaaagtgggaattccctaggcaggacacaatattggacaggctgtctgagaaggtgaagcaactgattactaacctagtgaagatacaaaatgatggcactgttgaagttgatatagaaatgagtgcatctgttgctccagaattgttagagctccaatcttttgccaagtcaacaatgagagaaagtcttagttcagagtcaaaaaaatctgttccacggttacaaattgtcatacttgtggttggaactagaggcgacgtacaaccttttctggccattgcaaagagacttcaggcatgttttgatattttcattcaattcattttgatgcacatcagcacatga

SEQ ID NO: 41341 - DNA, 399 bp, Glycine max
  Peptide Sequence Number=SeqID_158119
atggaagaagttcttccatacaaggaaagaatttcttgtggaagaagttcttccgtaaaaaacttaaggaaaaagttcttccgtaagaaactcttacgaaagatttcttacggaagaacttcttctcaacacccaattggttgtgggtttttacttcctgcattcctatttgactttctacaccaccaaaaagcctcaaatggtcaaaaatacccccgaaccctagaacctcctcttccctgcaaattcctgcaccacccaagcaccccgaagtccatatggtttggaggttggggggagggcaaggtcgttgagtttgagggagtcattggaaatgacgatggagttatgggacttggaccaaaacgtgattctatcatgctaatttccgaatcttga

SEQ ID NO: 41342 - DNA, 1110 bp, Glycine max
  Peptide Sequence Number=SeqID_158120
atggccaacattttcctacacaattggggcaacacttgcaaggctatcctctgcctcttattcctaaccccaaccctttttattgcaaactctgcaaggatcctagatgaagtggaatcccaaccccaagccataggcattctaccagcacctggagctgtcaatccttcactcacaacaggtccagtcaccaccactttgccacctggccaaacacctgcaaccaccaccacatcacaggttggccctgccaccacttcggcaagtgggcaaacaccggcagccgccagcaccgtaaaccctggtggtactacagaagactctggagatgaagatgataatgaagtagagccaccagttccagataatgcagcaccagtgacaccaaaccctgtggcaaaagaagcatcattctctttcttcatgcatgacatccttggagggtcacgtccatcagcaagagtggttgcaggaatagtggccaacactgatgtgactggcctaccattctcgaagctcaacaacaacctcttcccaatcactggaggaatcccactggtaaaccccaagctcaacggcatcatcaccaacaacaatctcccaaaccttgtaggcctaagtggtgcacaatcctccactgtcttcaagaacagtggcaccagcaacactgtcactggcagcaacaaccagccatttgtctcagcaggtaacctccctgcaggattcaccatccagaagctcatgttcgggtccgtgaccgtcatcgatgaccagttgacagaagggcacgagcttgattctgctgtgattggaaaggcacaagggttctacttggcaagttcattggatggtactagccagaccattttgctgacagttttggtgcatggtggtgaacatgaacatcatgatttggtggatgacagtatcaatctctttgggattcataggacagcttcatcagaatctgaggtagcagtgattggtgggactggcaagtatgagaatgctagagggtatgcttcacttgagactcttctcaaggaggaccagcacaccacagatggggtggacaccatcctgcatttcaatgtctacctcactgagtag

SEQ ID NO: 41343 - DNA, 321 bp, Glycine max
  misc_feature (246)..(246): n is a, c, g, or t
  Peptide Sequence Number=SeqID_158121
atggatgaagatagcagtaattcttggataaggagggccaaattctcccacacagtgtgtcacagcattcagccaagggcacaacacagttctagtagtcagaaatcaaggcctgaagtggcttttgcttccaacaaggctcagaagaaagcaaaaatgaaaaagcagagatctttgtcccctttgcctcgaacctctctctttgagaccttcaaggaagctagatgtgagcagaaaaggttctcnacacctttccattgtattctatattttgaatcccacaatcttgttgacctcacgtattcacactttgttgtttaa

SEQ ID NO: 41344 - DNA, 582 bp, Glycine max
  Peptide Sequence Number=SeqID_158122
atgtcaacgcctaagagattccctggaaaggcttgcatttcttttacctgcactctctcccgcctcctttccccttccacctcctacctccacctctctcccctcacctcgcagctttacacaggaatcagccaagccccatggttcacctggaactccaccaccgccgccgaactcaccgccctcctccacagtctcggccgccactcccaatctgaatccctcattttcgacgccagttccaagttacagccatgccaatgtgacctcgttcttttctacggcaaactcatcgattcacactccaagcgaaactcccacaccgccttcgacgccgcttttggttacctccataaccttgttcgcacttcctcctcccttcacgtgaaacgcatggcctaccagtacatggtgagcggcttatgtttaatggatagaccctatgaggccgaggatttggttcttgggcttcaacctttgggcttcattgtaagggtgtggggtataagggttaggctgttggtgggtataaggattagggtcgcgagtgaaattggtgaaggtggttgtggtgtgtgctga

SEQ ID NO: 41345 - DNA, 156 bp, Glycine max
  Peptide Sequence Number=SeqID_158123
atggtgcacgtagcaattcccgagaaagaattgccaaatgcccaaatgtggctacattatttgatatatactaatgccactatgccagggacagaagtcaatcatatctgtcattatccgatcattaaggatgtctggaagtcattgatgacctaa

SEQ ID NO: 41346 - DNA, 516 bp, Glycine max
  Peptide Sequence Number=SeqID_158124
atgtcacatgacagatcaaggttcacttctctagaggcttgggaaaggtacacagacatagtggtgcctagaaagatacttttagagagaaatgtggtgatataccacactaagtttgatgatttcaaagaagagcttaagagaagaaattggcatgaagagttgaccagctttgaagaaggcagcattgatgttgcaattgtgagggagttctatgctaacctctatgatccagaggataaatcaccaaaacaggtgaaggtcagaggccatttagtgaagtttgacgaagacgctctcaacacattcttaaagactcctgtgatcattgaggagggggaaacactatctgcttattcgaggttcgcactcctgaggcctgatcctcaggaattggcagccaagctctatatcccagggaagggatttgagcttaatgttgatggcttgccattgaagatcctcataaagaacctgactaccattgctaagacttggagcgtgctttctttctaa

SEQ ID NO: 41347 - DNA, 420 bp, Glycine max
  Peptide Sequence Number=SeqID_158125
accggaagtggcgtataccgtgacttatcttccttcattggaagtggcgtctacccggacttatcgtccgtcaccggaagtggcgtctaccctgacgtatcttccttcacgggaagtggcgtcatccaaatctctgtaacctgtatcaaacgatccgctcctactcagacttatcaaggtaatccttgtggcgtctaccctgacttatcttccttcaccggaagtggcgtataccctgacttatcttccttcattggaagtggcgtctacccggacttatcttccttcaccggaagtggcgtctaccctgacttatcttccttcacgggaagtggcgtcatccaaatctctgtaacctgtatcaaacgattcgctcctactcaggttcacatcatctggtatcagagcttcagctcttga

SEQ ID NO: 41348 - DNA, 2604 bp, Glycine max
  Peptide Sequence Number=SeqID_158126
atggcagcagcgttccaagaaggtagcggcggtggccgcggcggcgacgaagacgcgaccatcgacgtgcacaccacgcgcggcactcccatccgctacctccccctcgaccacctctactccgccacctcaccctgccgcgtcaccgccagcggctcctccaacgtcatgtcgaagaaaatcaaagctcgcaaactcaccctaacgcataataataataataataataataatcattacaacaaccacgaacacaagaaaacgacctcgtcttcttcttcgtccctggcccttcctcccaagccccctctcctcttcgtctactcgcgccggcgcaagaggcattcccctgccgctgcgacgacggagaacgacgagagcgagaagaggttgctcaagaagaggaaaattgggagcaccgagttggagaggttgggtgtggatttgaatactgcgattggggatgttgacgggcccagattgagggaatgtagaaatcaatttgggaattctggtgctgctgggaatgctaagtatggttccttggagaatttgcccaaagtgttgcccgaatctcgcaatgtgaagaaatgggtcgggttgagttttgataatgctgatcccgaggcatttgttggattacgatgcaaggtttactggcccatggatttaaaagcatacattggctacgtcagaagttatgataaggaaactaagatacatcatgtcaagtacgacgatggggatgaggaaaatttaattattgcaaatgaaaatataagattccatgtttcccgcgatgagctgaaacatttaaaattgaattttgccaaagttcgtgacaataatgtctctgattataatgttgaagagatgcttgcattggctgcaagtttggatgattgtcaagacttcgagcctggggatatcatatgggccaagctaacaggccatgcaatgtggccagctgttgttctggatgaatcacttgctagcaactgtaagggtttaaagatgtttttgggaggaagctcagttcctgtccaattttttggcacccatgactttgcaagggttagactgcaacaggtgaaatcatttctcagtggacttcttactgatctacactcaaaatgcaagaaacatagttttattgaaggtttagaagaggctaaaagatatttaagtgaacagaagcttccattggagatgctagagttgcagaaaagatgtacagctgatggctgtaacaacgtaagtggagaggatggaggatgctcagattcaggtgatgattgtttaaatggcaaggggactttgatggctctggaaaccgttgaaaattttccatatgaagttggagacctccaaattctaagccttggaaaaatagttaaagattctgctttcagggatggaagattcatctggcctgaagggtacacagcagtgaggaagtttacttcagttacagaccctaaagtttctgctccttataagatggaggtgttgagagatccagaatccaaacttcgtcctctgtttagagtgacagttgaaggtggtgagcagttcaatggttatacaccatctgcttcctggaatgaggtatacgaaaagataaagaaaatggaaaaggatgcttctgaaggtactgttgctgaaggtggggaagaaaagggctacgaatctgggtctgatatgtttggtttctccaatcctaaagtacttaaacttatacagggattgtctaaatccaaaatctcttcaaagaactcaatttgcaagttaggttccagaagatgtaataataacttgcctcttggttataggcaagttcatattaactggtttgacctcgataagtgcaatgtgtgccacatggatgaggagtatgagaacaatctgtttctgcagtgtgacaaatgcagaatgatggtccatgctagatgctatggggaactggaacctgttaatggggtgctatggttatgcaacttatgtcgttcgggtgcccctcctccaccttgctgcttatgtccactgatagaattatatgtctttgggtatttaatggagtttcttctaggtggtgcaatgaagcctactacagatggccggtgggctcatttggcttgtgccatgtggatacctgaaacttgcttagctgatgtcaagagaatggagcctattgatggtatgagtagaatcagtaaggaccgctggaggttgttatgcagcatatgtggtgtgtcttatggtgcctgtatccaatgttcaaataattcttgtcgagtagcatatcatccactctgtgcacgtgctgctggtctctgtgttgagcttgagaatgaggacaggctgtatctactttctgttgatgatgatgaagatcagtgcatacgcttactttctttctgcaagaaacataggcaaccatctaatgaacattctgttgctgatgatcgtatagtccgagtttctggtctatgttcagactatgaaccaccgcctaatccgtctggttgtgctcgaagtgtgtttttagtgccatctggaaagggaaatagtagtgtgctaggagctgggtggcagagtagctga

SEQ ID NO: 41349 - DNA, 276 bp, Glycine max
  Peptide Sequence Number=SeqID_158127
atgggttttctaggtttgagaagtgaaattgaggatgaggtagatttgaagcaaactctcacctcacacaaaaacctagcaagactacccatcatatctcccaaaaccccatacccacgaaaatcaaaggagaaagaagtccacccaaacctgaaatttcgaagtcccacacgtagagacgcgcttcacgactccgaaaatgccctcctttcacgatttggggcagaaattatggccaaaggttggagctttgtttggagcttcaatggagaatga

SEQ ID NO: 41350 - DNA, 516 bp, Glycine max
  Peptide Sequence Number=SeqID_158128
atggaggatgtagtccctatggatagactgaaggataatggtgttctggaggaagtcccaaaggagagactaagcactatggataaaaaacctgggacctatgattccattatcgatttacatgaaggattctaccaggtggcctttagcaataaaaaagactacaattttgcactttttgaaggtccttggatggtggcggaccattacctcattgtccagagatggagaccattttttcttatgaatgcgaaaataacgaataaggtagcaatgtggatcaagatccaacatctccccattgagctttacaataatatcttcctcgataggataggcatgagtctcaaaaaattccttaaggtgaataggttgacatcaattcactctagaggaaaattcgtgagaatatgcatggagcaggaccttaagaaaccgcttgaaactcatatttatgtttgtgggttcaagcttaatctggagtatgaaggtcttcactctatatgtttttgttga

SEQ ID NO: 41351 - DNA, 366 bp, Glycine max
  Peptide Sequence Number=SeqID_158129
atgggtgaaggaatcacaatgacacatgtacctaggagcttacttgcatcagtcacattggaaactatttttctgtgtccaatggaaaacatggttgtttggttttgttctttgcgaaagaagcctgatgttcacataaaagccgcaattgacaggtgcaatgaagacaataaccatttctttcgaagagggttcgagtgtggatattacgtcatgcattggatgtggtgcatagttactggcggtttgaaggatgaatggaacaagtggttttgtgatggatcagagttagacatgaaggccatgacagatcttcgcaagaaatgggccacatactttttatctattagaaaaagtgcatgctaa

SEQ ID NO: 41352 - DNA, 1335 bp, Glycine max
  Peptide Sequence Number=SeqID_158130
atggagaaaaagaacaaggactttctaaaccgtttagaatgtgagcagagttcatctcttagagttaatggcatatgcttagagaatgttggaaggcgtcacaattgcaatgagtttaactttttacagttttcgattaagcttgcagacaagcaagctgctcttgaaaagatacaatgggaagcgatgacatccaacaagaaagtagataaactccaagatgaggtaggttccatgcaagtagatattacatcattcacattattactggaaggattgtcaaaaactgacactgctaaatacactgatgattatgacgtcaagccttatgatttcagtcacttgcctagtattccactatgtgggacgaaccccataattgttctaaagttctccatgcttgttcttgaaagttgtccatctcaaactatagacctctttctgtctggaaatattccaacagatatggtgagctcatatttgaagaagcattctccaaacatgcaagctaggtacttagagctcatgcttgcaatgaatgagaatgcagtatttagaaatttgcataatgaaatgagtatagcaagatacaatccagaggctttgctaaaacatctgccactagatgcattgtatgaagaatgtgcaatattgttggggaaaatgaaccaacatgatctggcattatctttgtatgttcataagcttaatgctctagaactggcattgtcttattgtgatcgggtctatgagtgtatgcatcaaccatcttcaaaaaattccaacaacatataccttgtacttctgcaaatttatttgaatcctcgaaggaccatagcaggttttgaaaacataattaaaaatctattatccccacagaataaaaccattccaaaacttactcctaccccatccataaaaagtagaggccaagggttaaagaaaattgttgcaatagagggtgcaaaggacacaaaagttagtttaagcagcactgacaatggcaggagtcatggtgatgcagatgagtataatgagggtggttctaccatcatgcttgatgaggtcgttgatttgttgagccataggtgggatagaattaatggagctcaggcccttaaacttttaccaaaagagacgaaattacagggggcatttgtagaattgaggctgttgtggagacttaaaaatctctcacttctgagtggatttattgtacatcatcacgactccgtaccatctagtacttgtactgtaggatgcaacatggcagagccaatgagccacacttttgcatattcagatacttctgttttgttagaatctaccttgtag

SEQ ID NO: 41353 - DNA, 201 bp, Glycine max
  Peptide Sequence Number=SeqID_158131
atgtgtagctcattgaggagacacgtgggccagggaggctgcgtcgtggccgacatgtgggcccagatatgtcgtcacgtcagcaaaagtttcctcgtgggtgaaccacaaggtcattcggttgtagggtgtgttgaaaaggaagaaaaagaaagagatactgaactcaggtctcaccacaaagggcaccattccaaataa

SEQ ID NO: 41354 - DNA, 240 bp, Glycine max
  Peptide Sequence Number=SeqID_158132
atggataaatttcttcacttaagctcgcgtttgaagattgtggttgttgcaacatttaatacttgcattaaatgcacgtactccttcatgctgaaaaaccactcttatcataggagaaattattctatagttcaggaccaccatgtcagttgtggtctcgaccaattaaagtgtgacatgtggacaacttggttgtacatactaatcgcttacatcctacatggtgggataacgacataa

SEQ ID NO: 41355 - DNA, 609 bp, Glycine max
  Peptide Sequence Number=SeqID_158133
atgaagaaacacgtcaaccgggtggaagatgattcccacactgaattgggaaaacaaatgcaagctctgacactgaagattgagacactcatgagagctcaagcccaagtccccatcactacaccttcattcccaacccatgatagatgtgggattgtgcataggccaagagaatacaatgttgatgacaagctagttgcaggcatggatgagatcaactttgttgggagagaaaacaattcttacaatcaataccccaagaatttcaatcaaggacaatgcttcaggcagagtcaagggatgaaaattgagattcctaccgatggcaatctagtgccaaacaaagagggtgagaaggagtatgagatgaacacagtggcaatgagggacaacgtgcaatggcagagaccaaccagtaccacatcaacagagatgaagaagcgacaatgcgatggcgtagtggcggagagtgacagagtggcaatgatgtggtggaggataggaatagagtgtggaccaagagagaaagagattaagagaatgaagaaggattctttgattcaagaggcactagagaattttaatctaaagggtcaacatcggttttga

SEQ ID NO: 41356 - DNA, 384 bp, Glycine max
  Peptide Sequence Number=SeqID_158134
atgactcaggcggtggaggtcctgaaccggtatgggacggatctggttggggagccgagagattctgattctgagtgtttggcgggttttgagtgttttctgaacattgtgagggcattgggaatgggatcgtgtatctcagaggttggagctggtggtaattcacctcctcttcttccttattcgcctgaatccaacatggatggtggaaagagaagaaggttgaggggttcctcttcgtttgatttcaaagtgcctgggaggatgttcttgaatggttcaagcgaggttgcatccatgtattgcaagcaaggaagaaaagggatcaaccaagatgctatgcttgtttgggaggttagccccttctctctcagcatccattga

SEQ ID NO: 41357 - DNA, 2961 bp, Glycine max
  Peptide Sequence Number=SeqID_158135
atggcgatgttgaagaacaacgaccaaatcccagcgaagctaccaatcttcgatgggaccaactatgagaggtggacagcgcaaatgaaggtggtattcagatatcaaggcgtgcttgatatcataagcaccggcatcacaccattagaaacgaaccccataaaggcatacagagcaacccaccgtgaacagatgaagaaagatgataaagtgatctttctgattcatcaatgcgtggattcaaatgtcctggagaaaatcattgactatgagacgaccaaagaaacatgggatgtgttgtctacaacttacgtcggtgacaagcaaaccaagaaggtgagattgatggcactccggcgtcaactgggtttgcttcagatggtatcaaacgaaacggtggcaaaatttgtaaataggttggtgattcttgcaaaccaaatgaagagttgtggtgaggtggtgaccgattcgatgaaggttgaaaaggtactcacgggcttaacaccaaactttgatcatattgtctctgcaattgaacaatcaaaggacctagaaatgttgaaattggaccaattactgggttctttggaagcacataagttaaagatgaagaatagagaaggtatcaagaaagaggagaaagatttcgagaaagccttatttgctaaaaatcagaagaaaggtggtggtgattcttggaagaataagaaagggaaaggcaagtggaagtataacaaacaagaaagtagtggttctaaaaatgagtgcagtaatcctaaagtgtctagaaagaggggtgaagaagcacaactcgcgcgtggctctgatgatgaagaagcagtgatgttaatggccattgttaacagtgaaacaggcattgaggaggaatggtggtatctggacactggctgctcaaaccatatgacaggacataaagattggttctgtgaaattgatgaaacattgaaaagaaacatcaaatttggtgatgacagtgatgtcctatatgttcctaacatggaaagcaatctgctaagcttgggacaattgctagagaaaggattctcaatgcatatggaaggtgaacacatggaagtagctgattctaatgggaaatgtgtcttgaaagttcctgtgtctaagaatagaacattcaaggtgggagtgagcaccattgagcaaaagtgcttgactgctcaaagcaatgacagtgtgtggaagtggcatagaagacttggacacttgaacttcaactgcctgaacgagttgcagaagaagaacatggttgtgggactacctttaattgaagtaccaaggcaagtgtgtggtagatgctgtgaaggaaaacaaccaaggaaggcttacaatgtagcagttccaaccagggctaaagagaagcttgcagtgattcactctgatcaatctggttgttcaatcaagatgcttagaactgatggtggaggagagtacacttcacttgaatttgagaatttctacaaggaagaaggaataattcatgaggtaatggctccatacactcctcaacacaatggaactgctgagagaaggaatagaatagtgcaaaatatggttagatgcatgctgagaaagaagcatcttccatatgatttttgggcaaaggcagtatccacagcttctcacatcttgaatagatgtcctacaaagaggcttgacagtttgacaccagaagaagcttggagtggactcaagcctagtgtgaaacacttcaaggtatttggcttactttgttacagacatgtgcctgagcaaaatagaagaaaactggactcaatggctcaaaccttgattttggtaggatatcacagtattgcttataaactgtttgatcccttgagcaagaaaattgtgataagttttgatgtaattgtggatgagacaaaggaatgggactggaacattggtatggaaagacaaaccaatgaaacagtagaagtggaactggaaggagaagaaatacaggatgaagttcaaattgacagtgagcaatatgtgaatgatgggccagatgtgattagggttgtacctttgagaaggtcactaagacagataactccaccagtgatgaacttagtgttgttagcagaagcagaaccaatttcacttgaagaggcactagctaggccacattggagaaaggccatggaagaggaactgagatcaattcagaaaaacaacacttgggaaatggtgagtttaccaagtaataagaaagccatagaagtgaagtgggttttcaaaaccaaagtcaagccatttggtgaaattgccaagtataaggcaaggctagttgcaaaaggtttcttgcaaaagcctggtcttgatttcaatgaatctgcttttctcaatggtccattagaagaagaagtatacacaaggcagccacctggctatgagaagataggcatggaagatagggtaatgaagctgaacaaagccctatatggcttaaagcaagctccacgagcctggaataagaggattgatggatttctgcaaatgcaaaagtttctggaatgcaccactgaacatgaagtgtacttgaaggactatggagtaactggtgtagtgatgctatgcttgtatgtggatgatcttcttgtcactggtgatagcaaacaggagattgacagatttaagaagaaaatgatggatgagtttgaaatgtctgatataggcagaatagcctatttcctaggtatggaatttgtgacaactaagagtgccatattccttcaccaaaagaaatatgcaactgatatattgaaaaggttcaatatacttgattgcaattctgctagtactccttgtgaaccaggagtaaagctatcaactgcaaaagaaaattctaagatagaaattgttggctacacagatgcaaattggagtggagatgttggtgatagaaaggagcacatctgg

SEQ ID NO: 41358 - DNA, 147 bp, Glycine max
  Peptide Sequence Number=SeqID_158136
atgtacagcttcagggggggaggaaagggtaatggccagggtggctctggagcaaatgggactataactgggaaggcttaccccaaagggttgtacggtacccttagtgatcctactatccaacttgagcaggattgcatccattag

SEQ ID NO: 41359 - DNA, 714 bp, Glycine max
  Peptide Sequence Number=SeqID_158137
atggtaacaataagtacctccaaattaattaatgttattaatgaagatagtgaccaaaactcagacaacacaactgagataggatcagtgtcagaaaagaatataaatccaattaattccaaacactggaaaacaccctccaaattatattatcaacgtccgactgcccctgacctactattagaggaaagaggtgaaaacaattttaagagttttagtgcaaacaacatctatgaatggaacatagatgcacaaacggagtataacatcatgaatacactccaacatatgaccatggtagccacggcttaccaaacctcccatgaatgttcagaagaaaccattatagatatcttagtggcaggattttctggacaactgaaaggatggtgggataattatctcactaacgaagaaaaactaaaaaagaagttaagaaaccttaacctagaacccgcaattgaagaacaaataaacaatttgcttatagaaacttcagaggaagaaacagaaacttcatcctccgtgccttccgatgaaaacctaaatctaattcaacaagatgaccaactatcatcaacagatgatgatgatgggcaaatcaatactctaacgagagaacaagatctcttgtttgaagcaatcaattccataactgacccccaggaaaagaaggttttcctggaaaaactcaagaaaagtgggatcctctag

SEQ ID NO: 41360 - DNA, 814 bp, Glycine max
  Peptide Sequence Number=SeqID_158138
tgatgctgatgaaggccctcagcgacgaaggcccacaacatctgcacgtaggcaatgggaagttacgcctattgctgaggatgttaagcatgtggatcatgctactaaggaggtccatgaacaacctcaagaggcacctgctgctgatgtagttagtgatgtggagggttttccagacaggcctcacaacacatcagttttgatggactatgttcatcatgtgactgtgatagtttggaatgaagaggaacgttttgagttgaagttgttctcccatggaaggaaggtagaaaaatttggcaggtcagctcctaagattgaaagcttagtggttgtcacaggattaagtcctctgatcgcatgttcgctggacaatggtgatcggggacttgtgtctacttttgcagagaggtggcataaggaaactagtagtttccatttgctggtaggaggggtgagtatcaccctggatgatatggcatcgttgctacatctgactattacaggcaccttcaatagctttgaggttcttcatgtgaacgatgtcgtgttcctcttagttgaattgcttgaagtgagttctgaagaggcaagagcagagacgatacaatgccatggggcatatgttcgtctatcctggctacgagacatatatcggagcaaatgtgacgtggcaaagtggactatggcagctccaacatatttgttgcatctactaggttgcacactatttgctaacaagagtgccacacacgtgcatgtggtgttcttggatgcatttcgtgacctaatgcaaagtggaagctacgcataa

SEQ ID NO: 41361 - DNA, 774 bp, Glycine max
  Peptide Sequence Number=SeqID_158139
atggctataccaagtaaaacaagttccccgagagttcgatactcggtattcacttaccgttttatactacttgcgcaatctgatgcacttgtcggccgtcgaacaatgttttgtatgcatagatctcctacaaataatttagttcctatggacttggaaattgaagccacgttaagaaggaacagagccgaaaggagaaggaaactattgcaagggtggagacaggagttaaatccttacaatcaatatgaagaagaaagaacccctgatcttgaaagtgtattttcagaattcatggcatatcatgctagctctaaagctaattataattcactacaaaatcaggagattcattttggcaagagctattctttagaagattatcaaggggaactagagttacaactctactatcaaaatgaagcaggaagaagttccaatctggatactttgttaatgcaattcaaggatacaattggatctattgaacgtgcatttaaaagtgttgaagctcaagagggaagccctgtaaatgagcatgatttagaagaagaagaggaggagaaagtgcaacaacgggagcagtgctcacaagtacacactcaacaagaaaataatctccaagttaacacatttcctcgtcaactgattgtcaaagaagaaaggcatgaagaccatgaggttccaatcattctgggacaaccctgtttgtcaattgctagttgtgtattaggcatgggtaagggtaaattggaactaagtgtagaggattag

SEQ ID NO: 41362 - DNA, 156 bp, Glycine max
  Peptide Sequence Number=SeqID_158140
atgacagttgtcgcgcaatgtagtagacaagctgccgccgacacagtggtggacagcgggtggtacagtggtagaaatagccggcaaggtttctcgaggcgcaatggcgggatagagaaatggacagtttcaagagacagggatttcgatgtttaa

SEQ ID NO: 41363 - DNA, 255 bp, Glycine max
  Peptide Sequence Number=SeqID_158141
atggcaatcgctacaatctgctccattctgctgttctggaattttttgagtttattcagaagtgacgaggaggatactgcttctgttccatgtaatctaaaaggacaccaacaacctaatatatccaatggagttgctgcaagctattcacagttaagtccaagatcactgattgattatgaggatgataaagattacaagccaccgccaaggaagcagccagaaacttctgaggaagatgatggagtctcttag

SEQ ID NO: 41364 - DNA, 285 bp, Glycine max
  Peptide Sequence Number=SeqID_158142
atgaagatgagcgacaacgatgaagacaagcttctccagagtgtcagcaagatgtcaatgctcccatttcctaaacctcaagttggttcttcttcttcatgttcccgttttcactctttctctctctttctttcaatctcaaaccacaactatgatcttttttcccggaataaagagcccttgactcttgagaagaaaatgcgtgtttccttgagtagtcgaaaggaagcaaaatgggatccaaaaagcttccaaaatggggaagccttgcctaatgggaattga

SEQ ID NO: 41365 - DNA, 375 bp, Glycine max
  Peptide Sequence Number=SeqID_158143
atggacaagcctccgtcgaggaagtactttgataaaatccggttcaatgaggatttactgaaggggtgtcactctctcatgaagtgggatgatatgtgccattacatgtctaacttaggccttggtcataaggttatcgagaaatcaaaggagaaggttctgttgaaggaaagctggtatgcaactaaccaattttcacttgaagttattttccataacacaatgaagcactacaagtgcttaaccaatgattcctcattggcttctgctatatatggaccctactatgctggccttgatactcttgagattgttgactctggcatgcctagaaggctaagatacgagttcttccaatcctctaaccaaagctag

SEQ ID NO: 41366 - DNA, 501 bp, Glycine max
  Peptide Sequence Number=SeqID_158144
atgaagagtgccatgatgctagatgggattttggtgctgttggagttcaatatgttgtcatcagcaactagatcatttctgccaaacccaattcctttgaacactgctcttgctcaacttggggttatcaagccaattttcaggcttccacatgtgcctctgcctgtggagaaaaggatggagcaaattggtagggaacattttgttggagaaaaagatgttcaagaagacagcgcgataggggccggtcttgtcgaagccggatgccgacttgccgtagtcggaggggtcgaagcaatagacggggaggacagagagggagtcgttgttagcggcagtgagacactcattgttgaggagacagaagtcgttgcagaaccaaacgagatagcgggattggtggatttgaaggaggttttggaaggaggaggagtggtggtggagagagaaaggtgtgtgagggatgaagcttgggttggggctttgagcttgcttggttga

SEQ ID NO: 41367 - DNA, 228 bp, Glycine max
  Peptide Sequence Number=SeqID_158145
atgtctgcatttgagcaagtttatacacaagtactgaacaaggtcatcgaagatgcacagagaaaagcaaacactcacactgttcttgagttcgatcgacgcgacacaggattcttagtcttggagacaataaagctgagagagcatgctcaccatgagtacaaaaaactacatacattctttgcatacagagcattgtttggaagattgcacaatgaagcgtattag

SEQ ID NO: 41368 - DNA, 1248 bp, Glycine max
  Peptide Sequence Number=SeqID_158146
atggcttaccgaaacggcgtcgctctggctcagaggggaagtgccgttaagttcgaacgcccaaaccatctcagaacaacggcgtcgcctaagccccgcctccctcactcgccgggatccgccgtccgccgctcccccgccgccgccagaagcggagacggagtgcctggaagagttcgagtggctgtaaggttgagacctcgaaatactgaagaaatggtggctgatgctgattttgccgactgggttgaattacagccagagcttaaaagactgaaacttcggagaaacaattgggattcagatacttatgagtttgatgaagtgcttactgaatttgcatcacaaaagcgtgtttatgaagttgtagccaagccagtaattgaggtctgttcaaatgataatattcctattgtggaagatccaaaaactggtgatgtgtctttgtctggagctactctagtggaaatcaaggatcagccaagtttcttggagttgcttagagtaggggaaactcatcgaattgctgccaacacaaagttgaatactgaatcttctcgtagtcacgctattctgatggtacatgttaagagatctgttgtggacagtgaagatgttgtttatactgaaaataatgatgtctctcacttgactaaaccttcaaaaccacttgttcaaaagagcaagttggttgtggtagatttggcaggatcagagcgtatccataaggctatgaaagttgagaatatgctgaaaataaaggaggagtttgattataaaagtttgtcttggaggcatgagaataaatttggaggtgaggttgagaggaaatttgcagatgcattagagggaggtatcaaggctttactaggagttgtaagatgtgatcaacctgatgttctttcacaagttgcacgaggaattgccaacttcgccaaatgcgagtctcgagcttctagtcaagggataaaaagtggtacatcatttttgatagaagacggtgcacttccatggatagtacagaatgctaacaatgaagctgcagcaatcaggcgtcacattgaacttgcactcttccacatggctcaacaagaagtgaatgcaaaagacatgatcagtggaggtgccctttgggagcttgtccggatttcaagggattgtatgcgagaggacataaggaatcttggtcgtcgaactctcacttctatcccgccattcaaatctgaattccggcgattacatatagac

SEQ ID NO: 41369 - DNA, 162 bp, Glycine max
  Peptide Sequence Number=SeqID_158147
atggataaggtggtggttgattgcacggtggagaaagttgtgcaagtggtggcacgacgggtggtggctcttataggcttagatttgtctaagcctagtttcaggctgaaaacaacacatttcaatttgatgagagtgaaaaacataccaaaaattttgtag

SEQ ID NO: 41370 - DNA, 915 bp, Glycine max
  Peptide Sequence Number=SeqID_158148
atggagattgatgagaatggcatacatataggactcctgttaaggggactattttgggttgttttgaggcaacttaaaagcgatgatcctgctccaactgttaaaaagcagccgcataatgatgctttgttggctcaggtaaacagtcttcggcaggaactgcaacttcttgctagagatagatcgatcactattgtaaatgcaagtggaacaggtggaagaaaatatataacagtgattgttattgttgtggtaggatatggatacgtttggtggaagggatggaagcttcctgatctgatgtttgcaacaaggcgtggtttgtctgatgcttgcacatctattggtaatcagatgggaaagctttatgaatcaattggggataccaaaaagaaattatctgcaagaatcaacggtctggataaaaatttagaagaatgtgctgccattactgaaagtaccagggaggatatatctgtaattcaacgtaaagcagatacgataagtgaagattcaaagtcttttcatgtcgcagtccatgttctggaatctaaaattaaagaaatagaagagaagcaggcatcttcatccagttcttccaggccagcccttgagccaccaccagtttcaccctcttccagttccagggggtcacagtcaggttccgctaggctatctcttgagccaccatcccttacaccatcatcaaggactgcatccttgccaccgacattgccaactgatccaccatctccatcgaattctggtggatctttccaggggccaaaagtagacaaaagcaatggatctagttctggcttgtttgggttgatatctggtgtctatggtccattgctgacaagaactcgcagtgcgacagatgcagtagtccaaaaaactcgttcggctagttaa

SEQ ID NO: 41371 - DNA, 483 bp, Glycine max
  Peptide Sequence Number=SeqID_158149
atggcgagagtgggtagaatgaagttgggttcacaaggcatggaggtgtctttgcagggacttgggtgcatgggcatgtctgcgttctatggtcctcccaagcctgaccccgatatgattgctctcatccaccacgctgttcaaactggtgtcacttttcttgacacttctgacgtctatggtcctcacaccaacgaactccttctaggaaaggctctgaagggaggggtgagagatgaggttgaattggctacaaagtttggaatcaacgttgctgaagggaagagagagatccgtggtgatccggcatatgtgagggctgcttgtgagggaagcttaaagagacttggcatcgattgcatagatctctattaccaacatcgtattgatactcgtgtgcctattgaaatcacggttccactccttatctatgcttttgttttgatttcagtcgttttcttttatgtggttggcactgtgtga

SEQ ID NO: 41372 - DNA, 1872 bp, Glycine max
  Peptide Sequence Number=SeqID_158150
atgactaggtacaagtctgacttgtgtaagccgtatctaggtcaattgactgacacatcctcttcgtttttcaggctgttgaacaaccactgcaacgacgtacaatgccctgtttgcggccgcaaccttcccggtgacaaccaccacatcaactctcatctcgatgcatgtctctctcaatcaacaccagcaacaaaacgaaagttctcccaacgcaccctccttcagttaaacttcaccctatccaattccaaacccaaatttcacaatctcactcacgacagtaacacttctcccgttccgccgccccagcacaacgagtctgaagaagaagaacaagtccctgaagctcacgagaccgatcttgattctacaattagtaccacttcctcatcttccttgccatcaaacaatggggtgcctggcatcacgcttgaaacattcattgttggccgtaaatacactgataatcccgaagaaatatgtgctggtactgccatctctcttttgagggaccctcaaaatgttaaggacctcaatgccattaaggttgtttctgtagatgctgtgtgctacaagtcattaggttttatcccccatgagctagcacaatgcctatcacctcttattgacaactatggccttggatttcagggacacgttacttctgttccaaaacattctcttgatattgttccaattcagattacgtgccacagaacatcagatggtgaaagcaaatatgctgacgagacctttaaatgcttatggaaaaatgctcaatgtgttgttgaatttgctagcaggagtcctccttcatctgtaaaatatttcaaacaatgtctcatctatggttttgattggacagagtcattcactttactctcaaatgactgtcagaggctttttatccagctacacactagaaaagagaatgaatacatacattctattgaagatgcaaatcaaccatgtgagagtaatgtgaatgatatcttgaatgtcctcagcgtctctgagttgcatgaaatttggtgcattttgcttaaaaagagtggcggtcaccagatgaagaagcagcatctgatttcatctattctttttactggtgctagcgtactatggccacaactatcaactatgattttggatagaactgttttctgtattaggatttcttcgaaagctgaatctcttatgtggcgtattgagagacttttcttcttaaatggagaacaggatctctcgtcctttctacttgttgatatgggaaaaatagtgtatccagcttacaactgcataatatcagaaccaattttctcaaatcgcaataatctgctctcttatgaagaggccattgaagttgcacaaattatggatgaagctcttgatgcaaacaaaactgacgtggtattaaggtgcataaagatagctgaatcctgtgtatctactgattttcccatccagtgctcaacttctgaatcagtatcttcaattcgtcgtgtatttacagcatcatgggtatactccaaagtggtcacagtagggatttccttccttgagcgggagcgcaggtacattgatgctattaacttactcaaatggctgctaaatgttttcacttgcgatgtaaaaagaggatattggacactgaggttatcggttgacttggagtacctgggctgcactaatgagagccttcaaatagctgaaaatgggttgctggatccatggatacgtgctggttcaagaatggcactgcaaaggcgggttcttcacctaggaaaacaaccaaggcactggaatgttcctagtttttctaggtctgcattgcggaagatccctgaggcaaattactttattgttttatga

SEQ ID NO: 41373 - DNA, 606 bp, Glycine max
  Peptide Sequence Number=SeqID_158151
atggccatctcattgtggctggtgatgattccggtttttgttcaaggaagaccattgaattctgaattgggagaaaagaataggtactacaatgaagaggggaagcaatgtggagtggaagaacttgctttgcattactatgcaagggatggaggtggatggctaggtgtccatgcagagagtggcatatggttaaccatttttgggcttcttatgtgggatgtcatatatgctgatgtgccaaatgtcttctatactagatttcagcaaatatgtgatggcatggctgaggagtttcttattaagtcatgggaaacacatatcggaacagcatgtagaggagttaattgggactgccatcctttagatgagcttcatgctattgttacttgtgttgggggaatttgtttggcatctctctgcaaacttctggctcaagactaccggagctggtctagtggaatgccagatttgctgctatggcgtttccatggagaatacagcggtgaagccaagcttgttgaagtgaaaggccccaaggaccgactctctgagcagcagagagcatggctattgctgcttatggatagtggatttacgattgag

SEQ ID NO: 41374 - DNA, 549 bp, Glycine max
  Peptide Sequence Number=SeqID_158152
atgaagaaggttgataggtttctcaacagtgacattttgattgaaattctgtctcatgttcctgctaaggatttgctgagtttgaagcttgttagcaaggagtggcatcgcttgatttcgagccgttgcttcatggaagcacaagtgcaaagaaccaaagaggaggcattaacagggttcattttccaggagaagttcatgtggtgcaatgaggacatcaaaaccattagctacatttctgtggaagagaacaccaaaggaggagggggttccaaggtgaagcaaaaggtttttgattttctccctgaagatgttgttatgatggcatcttgcaagggtttggtgtgtagcagaagctgttttccttctgaggaaccctttatatatgtttgtaatccttcaaataaggagtgggttaagttggagtggccttggcctattactcactatgactgtcttagaagtatgacaatagcattggctttcgattatgacccttcaaagggttttgttgaaaaattcaagttggtgagagttaagctagttgag

SEQ ID NO: 41375 - DNA, 495 bp, Glycine max
  Peptide Sequence Number=SeqID_158153
atgcattggctcaatggcgaccgagtcctcaccttcaacgtccagaatgagctatcttggttggttcctgcaccggttccagcctcggagttcatggcagttcctgaagcctgtattggggaatctgaagggaggctcagttatgtgtttgtgtcagagcagggtgttcatgtttggtgtcttgaggattattatgactataaatgggcaattgtgtattgcaagcctctggaggagattgaaggagaatggcctcagttctttatgaatttgaggagccatgtgctggagagggtgaatggtccatgggtgaatcctctagctttcaaagatgggatcttgctaatgaaggtgtgtgtgagtctgtacttgtttgatgttaagaacaacagcatgactgaggtttgctccattcaagacctgaaatcacagtgcatgctcaatcctactgtaattgcccattcactgagcttggttcatttaagtcctgcatga

SEQ ID NO: 41376 - DNA, 2462 bp, Glycine max
  Peptide Sequence Number=SeqID_158154
atggttagttgcatcactcattcaatcctattcactctcacacacttcgcgacatcaaatgcgaaatcttctgcgacgaggtccccaaatcctccgagacccaactcgttcgggcatagtggggaccactatgactcgctattctcgtctatagtcatgttatgccctctcaaaacccgtcacagagtaccgttgcaactatcattcagactttgttccaaattcttccacgcactcaaacatgaccaccaccagttcgactttattccccacccaaatgctgcctcagttaaccattccatgctcaactgtttgcacagccgccttccctttcaagctctcaccgcattcaagaaccatttccagttgcattctcttgaaaatgttgatgaggttaccgttgccttgtccctcaaggcatgtcagggagagtcaaaactcgggtgtcaaatccacggatttgcggtatgtagtgggtttgtgtcgtttgtcacggtgtcaaattcgctcatgaaaatgtactgcaagtctgggaattttgggaaggctttgattgtgtttgagaatttgagtcatcctgacatagtgtcttggaatactgtgctttcggggtttgaggagagtgtggatgctttgaattttgcacggtctatgcattattgtgggatagcttttgatccggtgacatatacttctgctcttgcattttgttggggtgatcatgggtttttatttgggtggcaattgcattctcttgtggttaagtgtggacttggttgtgaagtttttatagggaatgcacttgtaactatgtattcaaggtgggggatgttggatgaggctaggagagtgtttgatgaaatgcctgaaagagatttggtttcgtggaatgcaatgatttcagggtatgctcaagagggcaaatgttatgggttagaagcagttttattgtttgtcaacatggtaagacatggtatgttaattgatcatgtttcacttacaggtgcagtttctgcttgtggtcatatgaaaaacttagagcttgggaggcagatacatggtttgacccagaaagtgggatatggaacacatgtttcagtttgcaatgttttgatgtcaacttattcaaaatgtgaggtccctaaagatgcaaaagctgtttttgagagcattagtaatcggaatgtagtgtcttggacgacaatgatttctattgacgaagaagatgcagtgtctctcttcaatgccatgagagttaatggcgtgtatccaaatgatgttacatttataggattaatacatgctgtaacaatcaggaatttagtgacagaaggtctaacgattcatgggctatgcataaaaagctgctttttgtcggaacaaactgtctccaacagcttcattaccatgtatgccaagtttgagtgcattcaagaatcaaccaagatttttgaggagcttaactgtcgagaaacagtatcatggaatgcattaatttcagggtatgctcaaaatggctcatataaagaagctttgctcacatatttgtctgcagttaaggagataaagcccaatcaatacacatttggtagtgttttaaatgctattgctgcggctgaggatatatcattgaaccatgggaaaagttgccattctcacttgctcaaacttggtttaggcactgatccaattgtttcaggggctctgcttgacatgtatggcaagcgtggtgacataattgagtctcaaagagtgttcaatgagacacttgaacgaacccagtttgcttggacagccataatatctgcctatgcccgccatggagactttgagtcagtgatgagtttgtatacagaaatggagagggaaggaatcaatcctgactccatcactttcctttctgttttggctgcatgttgtagaaagggcatggttgatgccggccatagagtctttgactctatggtgaagaaacattcaattgagccaacctctgagcattattctattatggtggacatgttgggccgtgttggacgactagatgaggcagaagagttgatgcaccagattccaggagggcctggattgtcagtgttgcaaagtttgcttgggtcttgtagattacatgggaatatggagatggctgagaaggttgttggtagattgatagaaatggatcctgcaagttcaggtccatatgtgttaatggcaaacttgtatgctgagaaaggaaagtgggagaaagttgctgaagtgcgaagagggatgagagggaggggagtaaagaaggaagtcggatttagttgggtggatgtttctaatgttgattccttatatttgcatggtttctcctctggggataagtcacatccagagtctgagaatatttgtaaaattgccgagtttctgggactgcaaatgaaaattttgaaagagaacagagaaagggaaggagagtg

SEQ ID NO: 41377 - DNA, 144 bp, Glycine max
  Peptide Sequence Number=SeqID_158155
atgccgctatcactgtcggaatacacacgtgagcccgtaagagatgagtttatcgcaattgaggtaaagtgtataagattcatgaggtgtgatagcatgttaaattgggattataccattgtgattgagactgagtgtatgtga

SEQ ID NO: 41378 - DNA, 1837 bp, Glycine max
  Peptide Sequence Number=SeqID_158156
tggggaccactatgactcgctattctcgtctatagtcatgctatgccctcttaaaacccttcacagagtaccgttgcaactatcattcagacttggttccaaattctttcacgcactcaaacatgaccaccacctgttcgacattattccccacccaaatgctgcctcagttaaccattccatgctcaactgtttgcacagccgccttccctttcaagctctcaccgcattcaagaaccatttccagttgcattctcttgaaaatgttgatgaggttaccgttgccttgtccctcaaggcatgtcagggagagtcaaaactcgggtgtcaaatccacggatttgcggctttgattgtgtttgagaatttgagtcatcctgacatagtgtcttggaatactgtgctttcagggtttgaggagagtgtggatgctttgaattttgcacgttctatgcattttcgtgggatagcttttgatctggtgacatatacttctgctcttgcattttgttggggtgatcatggatttttatttgggtggcaattgcattctcttgtggttaagtgtggatttggttgtgaagtttttatagggaatgcacttgtaactatgtattcaaggcgggggatgttggatgaggttaggagagtgtttgctgaaatgcctgaaagagatttggtttcgtggaatgcgatgattttagggtatgctcaagagggcaaatgttatgggttggaagcagttttattgtttgtcaacatggtaagacatggtatgttaattgatcatgtttcacttacaggtgcagtttctgcttgtggtcatatgaacaacttagagcttgggaggcagatacatggtttgacccagaaagtgggatatggaacacatgtttcagtttgcaatgttttgatgtcaacttattcaaaatgtgaggtccctaaagatgccaaagctgtttttgagtgcattagtaatcggaatgtagtgtcttggacgacaatgatttctattcaagaagaagatgcagtgtctctctttaatgcaatgagaattaatggggctctgcttgacatgtgtggcaagcgtggcgacataattgagtctcaaagagtgttcaatgagacacctgaacgaacccagtttgctaggacagccataatatctccctatgcccgccatggagtctttgagtcagtgatgagtttgtatacagaaatggagagggaaggaatcaatcctgcctccatcactttcctttctgttttggctgcatgttgtagaaagggcatgattgatgtcggtcatagagtctttgactctatggtgaagaaacattcaattgagccaacctctgagcattattctattatggtggacatgttaggccgtgtaggacgactagatgaggcagaagagttgatgcaccagattccaggagggcctggattgtcagtgttgcaaagtttgcttgggtcttgtagattacatgggaatatggagatggctgagaaggttgttggtagattgatagaaatggatcctgcaagttcaggtccatatgtgttaatggcaaacttgtatgctgagaaaggaaagtgggagaaagttgctgaagtgcgaagagggatgagagggaggggagtaaagaaggaagttggatttagttgggtggatgtttctaatgttgattccttatatttgcatggtttctcctctggggataagtcacatccagagtctgagaatatttgtaaaattgccgagtttctgggactgcaaatgaaaattttgaaagagaacagagaaacggaaggagagtggtatcatgagtaa

SEQ ID NO: 41379 - DNA, 327 bp, Glycine max
  Peptide Sequence Number=SeqID_158157
atgcttttttttttccccttttcttctcttccctctctcctgaccttccttcttcctttcatcttcttttttttccctgccactccccctcccctccaccttcttccttctcctcccttcctccttcaccctgcgcagccctccgccgcgaccgtctgcgtccctcagccgcgactattcgcagtcacctccaaatatgttagagatcttcagggggttgttttgttttggggagtggggaagggattaattaaaggtgtttgcggtggggtttatagtcctcgtgagctgagcaggaaaaaagcaagagtgggaggagattattag

SEQ ID NO: 41380 - DNA, 900 bp, Glycine max
  Peptide Sequence Number=SeqID_158158
atggcacgttctccaaacaagataaagaacatcgatggctcaaaagaaactcttaaacttgctgtgaggatcactgatctatggtttattgggacgcctaacaaatctgagcaagctgagatgatttattacatattgttcaggccattgtgttgtaactttaatggaatccagggtgatgagatccatgttgtttgtaaacaagaccaactgaagtcttggaagatggacttgaaggaaaattgtacttatgtcatgcacaattttaaagtgctaaaaaacaacggtcagtacagagtctgtgatcaccaatttaaattggtgtttattggggttactgttgtaaggaagtgtgttctagacgacctccctttcagaaaatacaggtttgctggatttgcgaatgttgtggctagccagtttgaacctggcctattggttgacgttattggtgttgtggaggaggttgtctttggccatgtttcaggaaaaggtagaagggtagtctttaaactaaaggacttgagccagcaattactatcttgcactttgtgggatgattattgcttgcagtttttaaagttcttagatgattatgaaggtgatggtccaattacagttctattgacccatggtagaataaaggaagctcagggatcttatcccccatcggtcagcaattttttcaaggtttcaaagttaattattaaccaaccggtgatggagattcaagaattcaatgaatggcttgcggagttgggcattgaggcccggtcaggttttaaatcccatggtgaagggagtacacaactttcaggttctatccaattatcatcaaaggaaccattctttggaaagactgaggcaaagactattgatgacattaacaccatctctgaa

SEQ ID NO: 41381 - DNA, 429 bp, Glycine max
  Peptide Sequence Number=SeqID_158159
atgtcattgcctagcgttgttcatgtgtcctccaccttcgagtctggagccccgcgaatgtcattgcctagtgctgttcatgtgtcctccaccttcgacactgttcatgtgtcctccaccttcgagtctggagccccgcgaatgtcattgcatagcgctgttcatgtgtcctccaccttcgagtttggagctatgcttcatgattgcctaagtgtggaccctctatctggagccccgcggatgtctttgcctagcgctgttccccaattcaccattctccacattttctcggatccccatgaatgtcattgcctggcgctgatcatgcatcctccacccaaagagtttggagctatgcttcatgattgcctaagtgtggaccctctagtgcaatcctccattctcctcttttttccgagccctaagaat

SEQ ID NO: 41382 - DNA, 207 bp, Glycine max
  Peptide Sequence Number=SeqID_158160
atgacgttgctatttagcaacattctgcccagtgaccacaatgccaatctccctctacagatgtatcggttgggatcgcgcccacaagacgcccagtgggtccgaagaagtctaacagggccctggggtttccagctctggttacgggcctctgtcagtcctacagggtgcctgtttcccgagcgaggtcatgccatcgtgacatag

SEQ ID NO: 41383 - DNA, 216 bp, Glycine max
  Peptide Sequence Number=SeqID_158161
atgaaaggctctgagctcagagtggagggacctagaagaacaggagctgctagtggtgaaggaagagcagaagtagatggagctgatgtagggggagtaggggcagctgaagaagatggggccttagatcttctatccctggatttttgggtccctggaaaagtcactgaaggccttgcacaaggcagtgatgagggctggaaatccaagccttga

SEQ ID NO: 41384 - DNA, 252 bp, Glycine max
  Peptide Sequence Number=SeqID_158162
atgagcattggatgccttaaaagtcttaaggctgaagttgagaaccaatgtggcaagcaaataaaaatagtgagatcagatagaggtggagatactatggcaggtatactagataaacaagcacctggtcctttgcaaagttccttcaagacatggattgttgcccaatacactatgcctggttctccaatcagaatggtgtggcagaagaaggaaccaaacattattagacatggtacggagtatgcttag

SEQ ID NO: 41385 - DNA, 396 bp, Glycine max
  Peptide Sequence Number=SeqID_158163
atggagatgaattcagatcctagtgttattatgtctgaggcagaatatgaagaagatactttctatgctgatattaggaggcagattttgctattgacatctgaagacaacgaagatttactagaaacaagaagtttcagccccattaatgtcactaatggtggttcaaacgggtcagtttacagctttaactgtgcatctccacctgcaagcaatttttgtttgtgggaaagacacagttctggttcaccacccctttggctagtgaacttgtggaagaatggtaaaggtactggggtgttcattccacaagtggcatgcaagaaaaaccaaagaccaggaagaataaacaatagcaggaaaaaaatctataagccagtggtaaataaggattga

SEQ ID NO: 41386 - DNA, 1419 bp, Glycine max
  Peptide Sequence Number=SeqID_158164
atgcaaagcttcaacacaacaaccgaatcagaatcaatttcaccactctattgccattctcccttctttcaccgagtttccctgtttttctctggggtgtcaaacaggggaaatgacaccagccgaaatccatcgcgtttctcggatcttcagcattcttttcgacaacacgatgccgttgatttaagctcaagttctgtgtttggtggaaagtcgagcaatgtggctgttgttgcaagcaacttacagtgtgggacattcaacacggtattagtcctctctctctctttttcctttttagaatttggttcgaccgagcagggacctatgtttcagagaggaacaactgtgtccatggccacggggaaccagcatgttgagaactgggcagatgatagccaccccactgaagatacttgcactgatatagacaccgatgataaaaatcaatgtttctcaactgtgtcttggtgccatggagttggggacggggcacttgtagttgtggactctcatgatcaaagtaagactaaggttaaagctgaagaccagaagactgttcgtaggctagctcagaatcgggaggctgcgaagaagagtcggttgaggaaaaaggcatatgtgcaacaattggagaacagtcgagttaggcttgcgcaattagagcaagaacttcaacgggcacgtcagcagggtgcatttattgcaactggaatcccgggggatcgcggtcattctagtgttgcaaatggtgctttagcatttgacatggactatgcccgttgggttgatgagcatcaacggttgatcattgatataagatcagctataaattctcaaatgggtgagaatgaactgcaccttcttgtagatggagccatggcacattatgatgaattatttaggttgaagagcataggggcaaaggttgatgtatttcacatactttctgggatgtggaagacaccagcagaaagatgcttcatatggctcggtggatttcgttcatctgaacttctcaagatagttagaaaccagcttgagccgttaaccgaacagcagttgatgggcatttacaatctgcagcagtcttcccagcaggcagaggatgcattatcacaaggcatggaagcattgcagcagtctctttcagagacactttcgtcctcctctctagggccctctggttctgaaaatgttgctgagtacatgggccaaatggcaattgcattgggcaagcttgccacactagagaatttccttcatcaggctgacctattgaggcaacaaactctgcaacagatgcgtcgaattttgaccacgtgccaagctgctcgtgctctccttgtgataaatgattacgttacacggcttagagctcttaattcattatggttagcgtgtccaagagagtactag

SEQ ID NO: 41387 - DNA, 372 bp, Glycine max
  Peptide Sequence Number=SeqID_158165
atgataacaaacaaggttatatctcagtctaaaaatccagacacgctggcccacagaaaccgacccgttaatctggtgcaaccaattacaagatctacaaacgaattagaaaaaagagtagaaactaaccgcagctgcaaaaaaagttttgtcgccgatctcagagagaatggtcatggccagcgacttggtgaaaccctaataaaacatcaatacaaaaaaggggggattgaaaagcaaatccaaaatcaagaaagtaaatctttaatgaggacgaaaggttccacacctgaacgattgagctcatgttggctgggcgaagaagaaggactgagagagagagagagagagctaaaagctaataatatgtga

SEQ ID NO: 41388 - DNA, 681 bp, Glycine max
  Peptide Sequence Number=SeqID_158166
atgtcggaggccatgtttggtggaatgaatactggctatgcgacacccaagacgcctagtcttatcaggttgcttatcggctttgatttttttcctattcttcctccttttgagcttcataatcccctttatctaggtgatgaccattctctctgttcttgttggctgggctgctccaaatctggtgagcattctttgttgctggtctcgcctcacagttctcctccttatttgtttattcttatagatacttgggttgctatccttccatcaaataacatgctgtatgcattgagattagatatttggcatgataaagattggaaggctagcaatggagctacaaaaaatagcaataaggatgatgatgccacaaaaaagcataaacggtcatttttatctcagtttttttctcctatctttttacaggcattttctatcaccttttttggtgaatggggtgacaagagccagttggctaccataggtttggctgcagatgagaacccatttggtgtggttcttggagggattctgggacaagcattgtgcactgctgctgctgttgttggaggaaagagtttagcttctcagatatctgaaaaaattgttgcactctcaggtggaattcttttcattgtttttggaattcagtcattcctctctccagttgaatcatga

SEQ ID NO: 41389 - DNA, 249 bp, Glycine max
  Peptide Sequence Number=SeqID_158167
atggctgggaaggaagagaatcgaatatttgttggaggtttatcttgggaagttacggagcgtcaactcgagcatgcctttgctcgttacggcaaaattctcgaatgccagatgttttaccagaataatttcttcatggctgaagctcattttcaattttctgataaaatgatagcttgtggtaactttagagctcgagctggagatcattgtggtttagatatgtggaatttggtgcaaggaaggtag

SEQ ID NO: 41390 - DNA, 264 bp, Glycine max
  Peptide Sequence Number=SeqID_158168
atgacccctactcatgatgccctgctatattacaacgggaggtggaatttgccacgccaaaatgagtttgttggttactcgttcataggaaaaaatccaaaaaagtttggcattccttccggatgtgtcatcaatgaactgaaggacttgatcaagcaagttgcacctcatgggattcccccttatgatattcatcaatcacaaacggtaatggaaatggaagatgatgtgtctcggtcgcaacatgattcaatgcaaaattag

SEQ ID NO: 41391 - DNA, 212 bp, Glycine max
  Peptide Sequence Number=SeqID_158169
gggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 41392 - DNA, 198 bp, Glycine max
  Peptide Sequence Number=SeqID_158170
atgatcacttctttctcttcagaaggtaatgatgaggaggatcaccatgagcactggaatggatctatgagtagaagtcagtcaaaacatcctaatcaacaagcttcaccacttccgactaaacttccagctggagctcatataccctcttgtgcttggcctggaatgatgcccattgctgattgcatgaacaaatga

SEQ ID NO: 41393 - DNA, 210 bp, Glycine max
  Peptide Sequence Number=SeqID_158171
atgggaaattcagctaaagttgtgatacaacaagacatgaagggaagaaggcataaatatgggtttaacaacaatgaacgtgagaaggcacagaagaaaagggtggtggatgatgaaactgccgacaaacatcagctagatgaacaccaagagcggctacgcaagaagtttgcacttgaggagggaaggatatttgcagctaatgaacaa

SEQ ID NO: 41394 - DNA, 912 bp, Glycine max
  Peptide Sequence Number=SeqID_158172
atggcaatcaggggtgttgatggatggcgagacatgaagagtctgaccgtcaacgtcatcaccgggaggtggttcgtggtgttcgcctcctttctaatcatggcagccgccggagccacctacatgttcggtctctattccagcgacatcaaaaccaccctcggatacgaccaatccactctgaacctgctcagtttcttcaaggacttgggtagcaacgttggcatcctctcaggcctaatcaatgagctaactccaccctgggttgttctggctattggtgccatcctcaacttctttggctacttcatgatatggctatccgtcactaaaaaaatagcgaaacccaaagtgtggcagatgtgtctctacatctgcataggtgctaactctcagtccttcgccaacaccggttcccttgttacgtgtgtcaagaactttccagaaagccgtggcgctgtgttgggcatcctcaaaggctacgtgggtcttagcggtgcaatcatcacgcaactctaccatgctatttactatgacgacacaaggtctttgattttactcattggttggctccctgcagctatttcctttgctttccttcgaaccattcgctacatgaagcctgttaggaagcctaatgagctcaagaacaaagtcgacttcactcagagtgagtttggtgtcagcgctgctattatgctcttcttgctcttcctcccacttactattgtttctgtagaagaatataaggtctggctgagtaaaaggctcgctttggttgacccctccccggtgaaaatagtaaccgatcagtttccgatgacacaaagtggtgggaaaatgtctttagcccaccagcaagaggtgaggactatacaatacttcaggcgctattcagcgtcgacatgttaa

SEQ ID NO: 41395 - DNA, 141 bp, Glycine max
  Peptide Sequence Number=SeqID_158173
atggacgaaggcgccttcgaagaagttccaagcggtgtgcaagagtatgatatcggcgccagtgctgtcggcgttgttgacgatggaaatctggtcggcatgatcgagattgatgaggaagtcctcgtcactaatttatag

SEQ ID NO: 41396 - DNA, 1370 bp, Glycine max
  Peptide Sequence Number=SeqID_158174
gcgctaactctcagacttttgccaacactggttcccttgtcacttgcatcaagaacttcccagaaagaaatggggttgtgttagggatcctcaaaggttacctcggtcttagcggtgcaatcatcacgcaactctactctgctatttactatgatgacaccagggcattgattttgctcatagcttggctccctgctgctatttccttcgcttccctacgaaccgttcgctacatgaagcccgttaggcagcataatgagctcaatgttttctacaggtttctctatatctctcttggccttgctgggtttcttttgttcatgatcactatacagaaaagggtcaacttcactcagagtgagttcggtgtcagcgctgctattgtgctctttctgctcctcctcccactttctgttgtttctatagaagaatataaggtctggcagagtaaaaggcttgctttggttgaccccaccccggtgaaaatagtaaccgatgagggtgaaaaggtcatgaaaccgattgaggcaacaaatggttgcaaaaattcagtttcttccaagtggtgggaaaatgtgtttagtccaccagaaagaggtgaggactatacaatacttcaggcgctattcagcctcgacatgttgatactattcatatgtagcatctgtggtattgggggcacgttgaccgcaatagataacctgggtcagataggaaagtcgcttagatacccaaagaaaagcataagcactttcgtgtccctagtaagcatttggaattatctgggaagggttttctctgggtttgtttctgaacattatctacaaaagtacaagttccctcgtcctcttatgcttactttgactctgctcttgtcatgtgttggtcaccttctgattgcgtttgatgtgccgaatggcctttacgtggcttcggtgattattgggttttgttttggcgcacagtggcctttactttttgccattatatccgagctttttggacttaaatattatgcgactttgtacaattttggaagcgcagctagtccactaggactatatgttcttaatgtgaagatgactgggtatctgtatgacaaagaagccaagaagcaacttgcagcattggggcttaaaagaattgaaggacaggaattgaattgtgttggggtccattgcttcaagttatctttcattattatcacagctgcaactttctttggtgccattgtttcactcatcttggtggctaggacaagaaccttttacaaaagtgacatatacaagagatacaggaatgcagccacggagtcagaaactgaaatggctgagaaagattccaaacatgtggtgccagctcagaagtag

SEQ ID NO: 41397 - DNA, 413 bp, Glycine max
  Peptide Sequence Number=SeqID_158175
atggcaatcaggggtgttgatggatggcgagacatgaagagtctggctgtccaagtcatcacagggcggtggttcgtggtttttgcctcctttctaatcatggcagccgctggagccacctacatgttcggtctctattccagcgatatcaaaaccacccttggctacgaccaaaccactctgaatctccttagtttcttcaaggacttgggcaccaacgttggggtcatctcgggcctaatcaacgagctggctccaccctgggtggtcctagccattggtgccgtccttaacttctttggctacttcatgatatggctatccgtcacccaaagaatagccaaacccaaagtgtggcagatgtgtctctacatctgcataggcgctaactctcagacttttgccaacactgg

SEQ ID NO: 41398 - DNA, 537 bp, Glycine max
  Peptide Sequence Number=SeqID_158176
atgcattcccctaagcgatggttgaaggatgccaagagttcttttttgacttgttttgttccatctgaaattgatcctgacatgatgaaaattggtcattttggggatctatcaggttgttataacaaactgtgtgaactaggtttaaaagatgttcataacttcaagtttgtaaaggacgaattactgaagttgattgaaagtttgcagaaatgcctacatttgggtggtgatcttgttgggcatcctagtagtatgacaaatgatatgaagaatcctaatgtggttaagacaaaaggtgcattgcgaaagaagaaacagaaaaagactcggcaatgttccaactgtgatgggattggacactatatggaagacgacctaagttgtggtgaagattttaacttcaatgatcctttttttaataacactgaaggggctagtgtaatttttagtcaagatgcagcactagtcgatcgtaatgagacgcctaatgcagtgcctaaaaatgtagataaagatacaaaaaaacaaaagtag

SEQ ID NO: 41399 - DNA, 1755 bp, Glycine max
  Peptide Sequence Number=SeqID_158177
atggtggacacgaatgggctcatggtccaagtcatcaccggaaggtggttcgtggtgttcgcctcctttctaatcatggccgccgccggcgccacctacatgttcagcctctactccggagacatcaaatccgccctggcctacgaccaaaccaccttaaacctccttagtttcttcaaagacttgggtggcaatgtcggcgtcctctcgggcctcatcaacgagatcactcccccgtgggtggtcctcgccatgggttccgtcctcaacttctttggctacttcatgatatggctggcggtgacaaaaaaaatacccaagccgcacgtgtggcacatgtgcctctacatctgcataggctcgaattctcagtccttcgccaacaccggttcccttgtgacttgcgtgaagaacttcccagaaagccgtggggttgtgctgggcatcctcaaaggctacgttggtctcagtggagccatcattacacaactctactttgctttttactacgacgattcaaggtccttgattttgctcatagggtggctcccagctgctatttccttccttttccttcgaaccattcgctacatgaaacccgttcgacagcccaatgagctaagtgttttctacaagtttttgtatatctcacttggccttgctgggtttcttttggtcatgatcatagttcagaagcaagtgcatttctcacaaagtgagtatggtgtcagtgctggggttgtgctcttcttactatttcttcctcttgctgttgtgtttgttgaacaatataagatcagagagagtcaaaagctagcattcattgacccctccccggtcaagatagtagctgaaggagagtctgcaaatggtaatacctctaacacgccaatttcaacagagattgaagaaactagatggtggcaaaaagtgttaagtccaccgcctcgaggtgaggactatactatacttcaagccctattcagcttagatatgatactgctattcttcgctggcacatgtggtgttgggggaactttaaccgcaattgataaccttggtcagattggtacatcgctagggtaccccaaggctagcataagcacgtttgtgtcgttagtgagcatttggaattatctgggacgggttttttctgggtttgtttctgaacactttctacaaaagtacaagttccctcgaccactgatgctcacgctaaccctcctcttatcctgtgccggtcaccttctgatagccttcgatgtgcccaacggactctacgtggcatcggtgatcatagggttctgcttcggcgcgcaatggcccttggtgttcgccataatctcggagctgttcgggctcaagtactattcaacgttgtacaactttggaggtgcagcgagcccgattgggctttatgtgcttaacgtgagggtaactgggcacttgtatgacaaagaagctctgaagcaattggcagtggcggggataccaagaaatgatgccaaagaattgacttgtattgggtccagttgttttaagttgtccttcattattatcactgcagcaaccttttttggggccttaatttcactgattttggtggctaggacaattaagttttacaaaggggatatatacaagaggtaccgggagcaagccgaggaagccaccactgctgccactgagatggcggtggtccaaaaccgcggccagaaattagaacaagaagctaacaaagttattggcacgtaa

SEQ ID NO: 41400 - DNA, 5256 bp, Glycine max
  Peptide Sequence Number=SeqID_158178
atgacgaacaagggcaaaggaaaaggcaaggaggtcgccggaaaaggttctgccggcaagcgcaagggcgtcttccaggatgacaagaccggtagtggctgcaagagaaacaaccgaagtgtccttcagttcttcgaagacgccgctgacgttgaagagagcgatttcagtgatttcagcgacgacgacgacagcgatttcgatttttctgatgacgaattaaatgccgcgccaagaaggatggacatgccagataagggccagagtagcctcccacgtgtcgtccctaaagaggaaatgttggatgaagaagagtgggacagaattttggaggagcgctacaaagatccatctaggtttatcagattttctgatgagtttggtgatgataaagggatggacccaagttccatacacgagggtgtcgatgaattaacgccaagcatttggaaagtcaaatgcactgttggccgggagaggctttcagctctttgtctgatgcagaagtttgctgacttgtattcattgggtactaaattaaagataaaatctgcattttctgtagatcatatgaaaggatttgtgtacatcgaagccgagaaacagtatgatataaatgaggcatgccaagggattcccggaatatatgttactcgagtggcacctgtaccaaatagtgaggtttataatctgttctctgttagaagtagaacccctgaaatttctgagggcatgtgggctcgaataaaaggtggtaactacaagggggatctggcacaggttgtgtctgtgaacaatacccggaaaaaagttacagtgaagcttattccaagaattgatctacaagccttggctgccaaatttgtaatgagacctggtgggggatatagtcgccaaaaaatggctgtaccggctccaagattaatcagctcaagtgaacttgaggagttccgaccactcatccaaatcaaacgtgaccgtgatactggcaaggtttttgaggttcttgatggtttgatgctcaaggatgggtatgtatacaagaaaatatctccagattcattaagtttatggggtgttgtgccaacagaagatgaactgttgaagtttgggccttctgaaaacaatgaatcaaatgatttagagtggctctctcagctttatggtgacaagaagaaaaaacgggttataagacctgagaagggaggtggtgggaaaggagagagttcatcaggttctggtgtgggaaatggttttgaactttatgatttagtatgttttggtaagaaggactttggtgtaatagtaggcatggataaagatgatatctacaagattctaaaagagggttcagatggacctgatgctgtaactgttgatcgacatgaaattaagagtgggctatttgatttgaaacttactgccctagatcagcacagtaagactatattggttaatgatactgtcagggtgcttgagggtccaactaagggtaaacaaggcattgttaaacacatttatagagggattgtctttttatatgatggaaatgaggaagaaaatggaggttacttaacttgtaaatctaataagtgtgagaaggtcaagcttgctgttggtgattgcagtggaaaggatagtgaaccgggtcctttagtctttgaagaccaaccatcatcaccaagatctcccttgtcaccaaaaaaaccatggcaagcaagagaaaataaccgtgaatttaaccgtggggacaacaacaacatgtttactattggtcagacgttgagaattaggataggtcctttgaagggatacatttgccgagtcattgccttgcgtcgtgctgatgttactgtgaaactagattctcagcagaaggttcttacagttaaatgtgagcatctttctgaggttcaggggaagagtactgccatttcatcaagtggtgatccagattcaagttcatctaagccatttgatatgctgggtactgaaggcagctctggaggttggctgaatggagtgggaacgtccactggggctggtggatggaatgctggaggggcatcatccactgggggtagtggatggaatgctggaggggcatcatcaactgggggtggtggatggaatgctggaggggcatcatcaactgggggtggtggatggaatgttggaggggcgtcatcaactgggggtggtggatggaatgctggaggggcgtcatccactgggggtggtggatggaatgctggagggccgtcatctaaaagggatgcagggtctaatcattctgctccaagcttattgaatacagaatctacctcaaatccattcagttccaagggtgcagaagattctgcttgggaaactaaaagtaattctaataagacctcctcatggggtgctgcagtggataagactggaattgcttctgatgcagatcagtctggtggctggggaagtggtggagggagctggggtcaggcagagcataaaactggaagtgtgggtgatggcaatcagaatagcaattggaatacaaccaaggcttctgaaggggagtcttctggttggaacagtatccaaaagtcaaatgaaacttcatcagctggatggggtggtggcaatgggtttaaaagtggatcagatgaaggaaacttgaattctacttggagtggctggaagtctggatcaagtggagtcaaacaagctgggaacactgctggtacttcagatattgatgctaatcaggatgctgggtggaaaaacaaaccaaataaggatgggagtgagtcatctggttgggaaacaaaaaacaattggaatgctccagtctcttcatcaaatgataaagtggaaaaaggtaatgatcaaggtaggtggaatgcaggaaaagcttcaggtggtttggctgcagatttcagtcaagcttctggttggaaaggggggctgagtgagcacacccaagaaggttctaattggggcgacaagaaatttggttcatgcgatgtatctggtgattccagtggaaatcagggtagtaatggttggggtcagaaaagcaattggaactctggatctaggagtgggaatgagaaccagaattctcactggagttctgggcgtaatgagcctggaaatcaagattccaacttggacaagaaaagcaattggaactctggaaacagtggaaacctggcttccgatccaaaaagtagcaattggaattctggatctggtaattccaatgaaaattccaactggggaaccaatgtcaataacaaatcttcatggggtactggaaatgaaaacaagaattccagctggagttctgggcatagtgatcctggaaatcaagatgccaatcagggcaagaaaagcaattggaactctgggaacagtggtaaccagccttctgatcctaatagcaattggaactctaacaaatcctcttggagtgctgggaacgaaaacaagaaatctaattggagttctggggatcctggaaatacagattctaactggggcaacaaaaataattgcatttctggatctggtgatgctaatcaaaacacgtcttggagaagcaatagcagctggaacactgcaaatgcctcaagcgatgatggtaatgaaggttcaaatgaaaattctgatggagtaggtggtgggaactggagaggtggttaccggggtagaggtggctccgacagagggggttttagaggtagaggttttcggggtagaggagagcgtggcggtttcggtggacgaggggagcatggaggctttggtggccgaggggaacgaggaggctttggtggtagaggtagatcagacagggaaggttttggtggtaggtggggatcagaaggaggacgtggaggccgaggcaggggaaggaacgatcaatctggtggttggaacaacagaagggattctggtgaggatgggccctctgactggaagaagggggcagataatggtggatggaagaatagtaatggatctcaggcttggaaccaggatactggtgacaaggataggcagagctggagccagggaaatgcagataaggagcatcctagctggaaccaaggaagtggaagaaatcagagctggagttcagcaagtggagctaatgataatggatctcaggcttggaaccaggggaatgcagataaggagcatccaagctggaaccaagctggaaataagcagagctggagttcagcaagtggtggaggtaacaataattggaacaacaatgggtcatcgcagactgcagaggctagctggaaaaaatctacaactgaagggaccaatatccagggtggtgggtggaacaagggatctagttcaaacactacttctaaggactggggtcaatcaagtgctgcagacaagggtcaagcatctagttggaaagaagcagcagatggtgcatcaggttcatggggcaagaaaaatgacgggggtgacaaaggtggatgggtgctaagaatatcttttatttatgttggaatggaaatagtcataaaattgcaggaacagtcgacaatgcttgtgtatgaaatccttttgcgtcacattgtgtcccccgagactgacataaagactttcaagcgctacattgaccatatctttgtcttgaagctcattgagttatttgattccaaggaccagcccgagcgcgagtatttgaaaatcattcttcaccgcatttatggcaagtccatgctgcacaggcccttcataaggacagccatcaacaatgtgctctatgggtttatacttgaaacgcagaggcataatggtattgccgaattgctggagattctgggaagtattatcaatggttttgcattgccaatgaaagagaagcacaagctgctggctaatcctgtgatcaaggggatgctgaagtactggcctgtcacgaattgccataaggaagtgctttttcttggagaattggaagaggttattgaggcaattcaatatcctgagtttataaggttgctgaacgagcacttgtggaacaatgagcagattataagtatagtagcccagaatcgaaattttatattgccagtaatctttgaagctttggaaaataacatgaaaagccattggaaccgagcagtgcattggctaacggccaatttggaagagaagagggagttaacagtgaagaaattggaagcagtggctgcacaagccgtgagggatgatatggttttggttaactaa

SEQ ID NO: 41401 - DNA, 252 bp, Glycine max
  Peptide Sequence Number=SeqID_158179
atgccattgcaggataggattgcatcaataaacagccctatggtgaatattttgactcacacagctgagagggagctggaacatgcgacaaagcagattgcaaatctggaaaaggagcgtgtcaagttaaagaaagaaagagataagaaagaagatcagctcaaatccatatcttccaggaatgaagaagaaaatgcttgtactaagtgttcaaagtcagagttcagacacgtaggttacgtaaagctatga

SEQ ID NO: 41402 - DNA, 960 bp, Glycine max
  Peptide Sequence Number=SeqID_158180
atggagctctttgagtcttcagttgagagtattgattcccatttcgccaaagtcgagtatcagtaccagctggtcccgatcttagctaagaaggattttgctttggcggaatctctatatgaaacggcgcttgttatgaatcggagcgagacgctcggaaagcgagccgtcgcggatgttgtggcgcactgcttggcgctcatgtcgcgtactctccgtcctctgatgaagcacggccgtgtcgcaaagtcagatctggagaggttatataggctctgcgacgctattccctgtccatcgactagggtgaacatctacacagatcttgccactaagttttggtgtgagcgacgcgtcgacgaatgcaaatcaattgttagagagaaaattcgcccgctcatcagtgcgagtgaatttggcaatgaagctgatcgtgcggctttgatatatctgtctgcgccagccttgtacgttgcccatgcggtcacagctcttaacgacttcggaaagctatcgcctcaacagaggacttctgcgttctaccgcgtcggaaaaatgatacttattcggaagagttctggggaacctaaccaggacctggatgaagcacgaattgtccccgatcatgaggaccttttggacgttcttgcgctgctggaaaacataaatgacgactgggttatttgggcgctcttgagggctgcatgtcgagccatttcatcaaaagaaaatagagcgcgtttgacaggacagcaaaagcgcgacttcgcgataaaggcgcaagagctatcgcagaggaaacttccggaccagaaaaatattaagcatgacgggtatctgattgtgtgtcttgcgcagactatgcgtatacttgaatcaaagaaacaggaatgggacgctttgattgatcgtgctcggacagtcgaaaacatggctgatcgagcgtatgttcttgtggag

SEQ ID NO: 41403 - DNA, 360 bp, Glycine max
  Peptide Sequence Number=SeqID_158181
atggataatcacttgggtatatccgcctaccacttgacgcatgggtcaagatcaacagatgttgtgagaccaaaagagtctcaaccggaagaagctgacatctccggaaagggcacacacgaccaaattggtctgcgcttgtcaatcagacttggggtctccaaattacgaggtgcaaataaccgtaaggcgtctccgcatgctaccgaacttgtcgcaacatgcccttttgtgggcgtgcgaggcgaggctcacgggtgcgctttccaaaggaggaaagatgcgcggagtcgccaccaacgtttatttgtggaaaatgtcggaaaaaccgaaggaaaccggtcaaaacgaaaattctaa

SEQ ID NO: 41404 - DNA, 690 bp, Glycine max
  Peptide Sequence Number=SeqID_158182
atggcgcctcctctcacttcttctcctttgtcttccgctgcatctccatggagaaacaccataactaaacgtgccctaaggcatctctatcgcaccagatccaaatctagaacgacgggtgatcaagaggagacacaggaacagatgaaagctgacatgtcggctttgatagaacaaatggcttccatgatggaggccatgttaggaatgagacaactcatggagaaaaacgtggccaccgctgctgctgttagttcggctgccgaagaacacccaactctcctagctaccgcacaccatcctcccccaaacgcggtaggacgagaaaggagcacgctggggcacaacagaaacccccatttgggatacaaccgggtggcttacccttatggattaccgcctaattacacgccgccagtcatgcatgatgacgcgggtcatgtcacttcccccatccttgaaggggagcctcctcgacagcccgacgaggtccatgaagatcatcgagagtatgcccaaggggatgtcgatttctacacccctgatccccgtcaaggggccggcacccaacacattgcctcagcacaacctcacagcacaaccaatattcttgtccacagaaggaccacccccggcggcggaagaaagaagaaaactcgatctcctcgaggagagattgagagctgttga

SEQ ID NO: 41405 - DNA, 496 bp, Glycine max
  Peptide Sequence Number=SeqID_158183
atggggggttatgtggtggcggccagcttcttcaccctcggtctggccagctggcaggtgctgctgtgtctgctggtgggaatttgcatcgtgcagctgtgcgctaacctggtggcaaagccgagccagatggccggtgtgccttatgcggtgatttcgcgtcaggcatttggcgtgttcggggccaacatcccggcggtgattcgcgggctgatcgccttcgcctggtacggcattcagacctatctggcggcgaatgcgctgatgctggtgctgctgaagttctacccgtcgttaagcagcatgacgcagagcagctggctcggcctgtcgcagcttggctggtgctgtttcggcgtcatgtggctgctgcaggcgatggtgttctggcacggcatgagcgcgattaaacgctttattgatatcgccggtccggcggtctacgtggtgatggtggcgctggcgggctggattgtatacaaaaccggttttgacg

SEQ ID NO: 41406 - DNA, 389 bp, Glycine max
  Peptide Sequence Number=SeqID_158184
gtatctccgcgtatcatgggtgcagaatgaccaaacttggtctctgcgtgccatcggacacgactgtgtctgaatggcaaaggggtgcggataaccgtaaggtatctccgcgtatctccgcgtatcatgggtgcagaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaagggtgcggataaccgtaaggtatctctgcgtgtcatcgggcccgccgcctctggatga

SEQ ID NO: 41407 - DNA, 162 bp, Glycine max
  Peptide Sequence Number=SeqID_158185
atgccaggtgccaacttgttggcaatgggttcctcatcagattctacttcttctaggtcaatgaggtcacctggagcagagggtgaaccaggagatgaagtatcttttggtgaggtagccatggagaagcagagcctttggagtggtttcgtgaatctctga

SEQ ID NO: 41408 - DNA, 204 bp, Glycine max
  Peptide Sequence Number=SeqID_158186
atgactcattcacagcaacacgatgccccaattgcaacacctaacgccccattaggtatgcaatggaatgtacctggagcaataccttatatgggtgacttattaggtgttgatttgcgtcaccgattttctgttgaggtggacgaagtagaagcggggagacatcggggtagaagaaatccgaatcatcaagcgcgaagatga

SEQ ID NO: 41409 - DNA, 465 bp, Glycine max
  Peptide Sequence Number=SeqID_158187
atgtcttcaaggaaaagaaagagcgtcggtttaaggcccactactcaatatgatacacagagattccattcctttgaggcctggaccagatatactgacaatgtgttgggaagacacatgttagctgagaagaaaatggaaatctatcacacagagctggatgaattcaagggcgagctggagaggtgtaactttcacaagcgcctcaccaacttagttgattgtagcattgacctcgcattggtgaaggagttctacaccgacctctacagtcccaaggggccttcacctaaacaagtcagaatccagggtcacttaataaggattgatgcagacagcctcaatgcctttctagaaacacctgtggtgcttgctgagggtgaatctttgcccgcctactcaagatactacaagatgcctactgacattagagaaattgaggttgcactgtgcatacccggatga

SEQ ID NO: 41410 - DNA, 276 bp, Glycine max
  Peptide Sequence Number=SeqID_158188
atgcgggggtccggggaatttgtccccttcttagatacgacgtctaggggtagcgaaatgccccaacgcacgtttttaagaaggcgacacggaccctccgttggtttgtttacagtagggatcaagacagaacccatatgcaatgcctatgcaaaagacacaatgcgggaatgtgcacaaggtatcatcccctttgaagaacacattgtagcagtagggactactagcaacaataggttttcaaagagaaaagctctagatgagggttcactgtaa

SEQ ID NO: 41411 - DNA, 183 bp, Glycine max
  Peptide Sequence Number=SeqID_158189
atgtgggtgcaagccattggtctgtttgctcaagcgacctgtgctcctgagtttggacttccaataccgttcaatcagagattactcgtcttgcacgttggtggggagagaagtgagttatcaagaataggatgttggataaatggcctcagttaccttaagaaaaaaagggggttgaattaa

SEQ ID NO: 41412 - DNA, 462 bp, Glycine max
  Peptide Sequence Number=SeqID_158190
atggcaggacgtggtagggatcagaactgtgatgtcctcgaccgcatcacagatgtgctggaaactctggtacaggaatgtgatgtggagccggcggagtatcagggactcatggctttccgtaagaaccacccgccaaagttcagtggagacgccacagatggcccagacgtgggcgctttaattggtccatggtctttggcacttgcttttggccgtgatcataggtcatacgagacaagaaatagagtaactgtggccaagtgtactagggggctgtcacctggtagggaacacctttgggctcccaggctgatcacctatgggaggagggctgttacgtgcacaatcgggtggtctcgaaaaactcagcacaattccctaagtgagagtgtcgtgtggacacgcttaggctatttcctgagatttggttgttgttggtacgtaccacgttgcatctga

SEQ ID NO: 41413 - DNA, 333 bp, Glycine max
  Peptide Sequence Number=SeqID_158191
atgacattgaccatcccgcaacttttcatcaagccgttgcaggtgtcatgggatgctagtgtgtttgaggtgtataatgataacttcccattatacgtaaagcatgaagatcttgctgaaatagctcacggtggtcaatgtataagcatctctgttatacagttttggattcttgcacattggcaaatggttgtcattttgcctgaggacaatgttgtcatctggttatgttccttgcacaattggcccaataactacttgaaaggaattattaacagggattcagtgacagtcaaggaagtaaatccatggatgttgctagatggatcgtag

SEQ ID NO: 41414 - DNA, 657 bp, Glycine max
  misc_feature (615)..(615): n is a, c, g, or t
  Peptide Sequence Number=SeqID_158192
atggctattgatgtacaaaccaaacgatttcatgacgcagatggtagggaaggtataatcttagggtatcctgacctcgtcagagacactggcacagaagtcagtcattggactaacctccactgggatggcttccagatcaccgccctcaaatgtcaatactcaagtataagacatttgcgaatccaaccggattcatttgacaaactggtttatcttaataaacaccaaaactcgcctaaacgactgaatgtcgcatcagtcgtgggggggcacctagttaaccaaaccaaacaaataggactccatgtgtcgtggagtgaggttaaacaaccaaatgttgagatagaagacccagatctctccggatctgtatctcgctaccgattgttcgcctcatggacagtcggcaccatttctggcaatccgaccgcaaagggtgattcatcccttacaccaactgggtgtaaaaccccagtcgatgccaccccctttcttattattagtcgaccccatggcagcaagaaaaaaaaggcgatcttgtgctatactccggtgatctctttcctaccgaggcacgcaaacccccatcgtgtcccagatcacattccgtanatcgaaaggggaagcctactcatccatcagctcctctcgtag

SEQ ID NO: 41415 - DNA, 483 bp, Glycine max
  Peptide Sequence Number=SeqID_158193
atggtgagtctcatggacagaaacattcttgactctctgttcttaaacattcactttcatggacttgacatgaaagaaggatcaattccaacagccttaatatatatgatccaatacaaggtcatgaacacttgtgcgtcaagagtccttctaaaatcacaaagaggagagacaactttgattatcactgatatgacaaaggctaatgtttctctccctagaaccataaaatgggacgacgtaactcttcctgaaaaatgggtcatggacaaggcaacattgtcagtccccagacccactccaactatagaacaaattaagaaagataattccggtaaggttgaaataaccttcaataggagaaactctttatcatctagaataaaagcctcaagatccgaaaatgaatcggcaaaaaggtctttctcagtaagaacccggtcaattccagtagggttatctagatctgagtcacaaaactag

SEQ ID NO: 41416 - DNA, 474 bp, Glycine max
  Peptide Sequence Number=SeqID_158194
atggtttgtaatgaaaatgctgatatgactggtcaattgtttactggttcattcacttttgaatgtcgtatcatgcactacattttgtgtcgtatcttgcttccccgttcaacaaatattgctcaagcttctgagaaggatttgattttgttgtgggcccttcaaaccggttgtcaaattgattgggcccatctagtttgctaccatatgcataaggcattacgggcaaatgcacctcttccatatccccaacttgtcactatttttctccaacattttaacgttcctctagatgataaaccctttcttaaggttaaatgctcttttgccattggagctactgctgttgcatcttttggatatcgaaaggatatggatggtgatcgtttttatgctatggattcacgtatcacgagtcttgaggatgatatgagctttatccttcgatgctttgatcctccagcaaatccatag

SEQ ID NO: 41417 - DNA, 228 bp, Glycine max
  Peptide Sequence Number=SeqID_158195
atgcatgtatgtgtacattatggaaaaatactgccaacaccttatgttgggggaaatgtcttaaaaattatgaacaggccttgcttaaggggaatagaagagaagactgccaagttgaaaggaagtgagaaggctctagttgcacggcatgaagctaggtatgctgtagtaggtactgcagtagcaaaccttcttgctggacagccacatgttgtgatatgtggatga

SEQ ID NO: 41418 - DNA, 204 bp, Glycine max
  Peptide Sequence Number=SeqID_158196
atggcgtatccaatcatatttcttcctcattccgctgccattaaacttcaagatgcatgggactccattgatgaagaagatctaagtcctacaagctccacaaggagctacatcatgtggtatcaagagcatcttcgtctagtttcctacatgatgcctatgatgaagttgagttgtggtgctgagttgtggctggatttgtga

SEQ ID NO: 41419 - DNA, 732 bp, Glycine max
  Peptide Sequence Number=SeqID_158197
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtctgctccaccatgaaacccccagatgtccaagaggatcacatatttctgaaggcttttcctcagtcattagagggagtggcaaaggactggttgtattaccttgctccaaggtccatcacgagctgggatgaccttaagagagtattcttagaaaaagtttttccctgcttccaggaccacaaccatcaggaaagatatctcagtaatatggagagaagtatgatagatgctgccagtggtggagcccttggagacatgactcctgctgaagccagaaatttagttgagaagatggcttccaactcccagcagtttagcgccagaaatgatgctatagtcattagaggagtgcatgagatagctacaaactcagctgcctcatctgaaactaagaagcttgaaggcaaactggatgcattggttaacttggtaacccaggtggccttgaaccataaatttgtacctgttgcaagggtctgtggattgtgctcctttactgaccaccatacagacctttgcccttccatgcagtaa

SEQ ID NO: 41420 - DNA, 760 bp, Glycine max
  Peptide Sequence Number=SeqID_158198
tgctgtttgactataacgtcaacgcccaaacgcaaaaacatcagaagggcggcagcagttacagcttgagcggcaacggcacgggcggcgccaacctgggcgccaggcgtctgcgcgcggactggcaggccaacctcaaccatcagaccggttcttctcagccgaccgacaaacagttcgactggagccgctattacgcctaccgggcgatcccggcgctgcgttcgcggctgacgatgggtgaggattacctgaactcagacattttcgacagcctgcgctttaccggcgtcagtctgcgatccgacgacagcatgttgccgcccaacctgcgcggctatgcgccggaagtgaccggcgtggcgaaaaccaacgccaaggtggtggtcagccagcaggggcgcgtgctgtatgaaacgcaggtggcggcggggccgttccgcattcaggacatcaacgatgcggtttccggcgagctggacgtgcgcgtcgaagagcaggacggcagcgtgcaggagttcaagatgaacaccgccaacatcccttatctgacgcggccgggtacggtgcgttacaagctggcgacgggcaagccgtcggagtgggggcaccatctgcgcgggccgatgttcggcaccggcgagttctcctgggggatcagcaacggctggtcgctgtacggcgggggcatcgccggcggcgattacaacgcgctgtcgctggggatcgggcgcgatctgatggcgctgggggcgttgtc

SEQ ID NO: 41421 - DNA, 1938 bp, Glycine max
  Peptide Sequence Number=SeqID_158199
atggaggatatatcgaaatacgcgcacagtcctgcacacgtggcagtggcgaggcgcgaccacgccgcgttgcgccgtctcgtatccaccatccctcggctggcgaaagccggcgaggtcaacacagaagccgaatctctcgccgcggagctcaaagccgacgaggtttcggcggtgatcgaccggcgcgacgttccgggaagagaaacccctctccacctcgcggtgcgcctcagggaccccgtctccgccgagattctaatgtgcggcggcgccgactggagcctccagaacgagcatggctggagcgcgctccaggaagccgtgtgcacccgagaggaagccatcgccgtcatcatcgcgcgccactaccagcctctggcgtgggcgaaatggtgccgcaggctcccccgcattgtcgcctccgccgcacgaatccgcgacttctacatggagatttctttccatttcgagagctccgtcattcccttcattggtcgcattgcgccttccgacacttaccgcatttggaagcgcggctctaacctccgcgccgacatgacccttgccggattcgacggcttccgcatacagcgttcggaccaaacttttttgttcctcggagagggttatgcctccgagaatgggaatttgaacttcccaccgggttctttgcttgcgcttgctcataaggagaaggaggttacgaatgctttggagggagctggtactcagccgactgaagctgaggttaatcatgaggtttctttgatgtctcagactaatatgtataggcctgggattgatgttactcaggcggagcttgttccgcatttgaattggcggcggcaggagaagacggagatggtggggaattggaaggctatggtttatgacatgcttcatgtgatggtgagtgtgaagtcgaggagggttcccggggcgatgaccgatgaggagcttttcgctgtggatgatggggagagtatggtgaatcgagagaacaatgatgagtatgatgatgtgttgactgctgaggagaagatgcagttggattccgcgcttcggatggggaattctgatggtatttgtcaggatggggagcctgggtttgatgggcatgagaatggttcagcggcttcgaattgtgaagccaatggtggtggggttaaagagaagaagggatggtttggttggaacaagaaaaacatcaagggtggtgacgagcctggggatttgaagactgccaagaagttttcgggtgatcagcagaagccgcaacctgagtttgtgaaggaagatcctggggaaacaaagaagggaaaggataaaaaccttagaaggaaaaagaagaaaggaggaattaatgagtctaagaatgagagtgagtacaagaagggcttgagacctgttttgtggttgacaccggactttcctttgagaacagatgagcttttgcctctgcttgacatcttagcaaacaaggttaaggctattaggagactcagagaacttttgacaactaaacttcctcttggaacctttcctgttaaggtagctatccctatagtccctaccataagggtccttgtcacttttacaaaatttgaagagcttcagccagcagaggagttttcaactccactctccagcccagcatacttccaggatgctaaatccaaggaatcggaaggatctacgtcatggatttcatggatgaaaggaagtcatggtacacagtccattgactctgatagtcatagatttaaggatgaaatcgaccctttcaatatacctttggactacaaatgggtagatgccaatgagaggaaacgccgtatgaaggcaaagagagccaaaaatatgaaacataagaagcagactgctaaaggaggagatggagtgcaactagggagtgaagatgtggaagaatactaa

SEQ ID NO: 41422 - DNA, 3189 bp, Glycine max
  Peptide Sequence Number=SeqID_158200
atggagtcgatcgcgacgtcggagactgtgacctgcaacactggcagggaagaggaggtgctagggttgagggcaagcacacatcgcgttgtcgctaccaagagccaacgacaccgagaccactgtaaccaccacaatggcgacatcgaaggaagccaactagggcaacgacaatggggaagtaaatggaactgcaacaacgacgacgacgcaaaaccacctagagggtcgaagtcgaagggatcaccacccatgatttccgttcgcgttgctcttctcgccgacacccatggtttggggttagggcggtgcccgaagaggaggggtggcgagggtttgaagggggtgggagccatcagttttccaattaagaagaggggaaggaagagaaaaaggttaaaggttgaagcgaagatgaggattatgattaagggcggtgtttggaaaaacaccgaagatgaaatcctgaaagcggctgttatgaaatatggtaagaaccagtgggctcgaatctcttcgctccttgttcgcaaatctgccaagcaatgcaaagctcgctggtatgagtggctcgatccctccataaaaaagactgagtggacgagagaagaggatgagaagctacttcatcttgctaagcttatgcccactcaatggaggacaattgctccaattgttggccgtaccccttcccagtgtcttgagcggtacgagaagctccttgatgcagcctgtgtgaaggatgagaactatgagcccggtgatgatcctcggaaattgcgtcctggggagattgatccaaaccctgagtcaaaacctgcacgcccagatcctgttgatatggatgaagatgaaaaggagatgctttctgaagcacgagcccggttggccaacacaaaaggaaagaaagcaaaaaggaaagctagggagaaacagcttgaggaagccaggaggcttgcttctttacaaaagaagagagaattgaaggctgctggaattgatattaggcagcggaagagaaaaaggaaaggaatagattacaatgcagaaattccatttgaaaaaaggcctcctccagggttttttgatgttacagatgaagatagaccagtggaacagccccagttccctactacaattgaagaacttgaagggaaaaggagggttgatgttgaggcacaattaagaaagcaggacattgcaaaaaataaaattgcacaaaggcaagatgccccatctgccatattgcatgccaacaagctgaatgacccagaaacagtaagaaagaggtcaaaattgatgcttccaccccctcagatttcagatcaggaattggatgaaattgccaagttgggttatgctagtgaccttgcaggaagtcaggaacttgctgaaggtagtggtgcaacacgggctcttctggctgattatgcacagacacctggccaaggaatgactccgttgcgaacccctcaaagaacaccggctggtaaaggtgatgctatcatgatggaagctgaaaatctggccaggctgagagagtctcaaacaccattgttaggaggagagaacccggagttgcatccttcagattttaatggcgtcactcctaagaaaaaagagattcagactccaaatccaatgctgactccttctgcaactcctggaggtgcaggtctcactcctagaattggcatgacaccaacaagagatggtttttcttttagcatgacaccaaagggaactcctcttagggatgcactacatattaatgaggacatgaatatgcatgacagcactaaacttgagctacagagacaggctgatatgagaagaagtttgcgttctggtttaggaagccttccacagcccaaaaatgagtaccagatagtgatgcaacctgttccagaagacgccgaagagcctgaggagaagattgaagaggacatgtctgatagaatagctagagaaaaagcggaagaagaggcaaggcagcaggcattgcttagaaagcgatcaaaagtccttcaacgggaacttcctaggcctcctacagcatcattggagcttataagaaattccttgatgagaactgacgtggacaagagttcctttgttccaccaacctctattgagcaagctgacgagatgattagacgggagcttctaagtttactggagcatgacaatgctaagtatccacttgatgagaaagtgattaaggagaagaagaaaggagccaagcgtgctgtaaatgggtctgctgtccctgtgatagaagattttgaggaagatgaaatgaaagaggctgataagttgataaaggaagaggccctgtatctttgtgcagcaatgggtcatgaagatgaacccctcgatgaatttattgaagcacacagaacctgtctcaatgatcttatgtactttcctacccgtaatgcatatggtctctctagtgttgctggaaacatggaaaagctaacagctttgcagaatgagtttgagaatgtgagaagcaaattggatgatgataaggagaagacggtacggcttgagaagaaggtgatggttctcacacaaggctatgagtctaactatggttggttgacattagttaggcattttttcttcacggcttccgcttctaacaatcctcctcctcctcctccaccaccgccgatgaacaatgcagttccggtgaatgcagatgctgctatgccggttgctgccacttcatcttgcacatctggcattgccttcactacctgctcacaaatccacaaattccaccgtgatatgcatctctggcggatcgcaatgctggaaatgtctcatctgagtttctgctttgggaacaacaggatcaactctttctatcgtggcttcaatccacaatttctagcgaagttcttcctagacccatcggttaccttgattgattcgctttcatctatcggagaatttgttccggcttatgaacatgttgatatcattcttgatggactaccgtatgaatttgagtcactggttacgcttattagttgtaggtttgagcctctcacaatcgatgaagtcaaaactcttcttcttgctcaggagactcacgttgaaaagtcttgcaagaaagcaattgcttccatcaatctcattgaaatttctcaacctaattttaaccccaattcctcgtag

SEQ ID NO: 41423 - DNA, 573 bp, Glycine max
  Peptide Sequence Number=SeqID_158201
atggatttggtttcggaatcaacaaacgctgtttcaaaccccagcagcaggtacaagatggagacgccaaccacgaatccaacgacggcggcggtgtcgtctccgtcttcgggaagcaacaatagcgggagcactactactccgagccgctacgagaaccaaaagcgaagggactggaacaccttctgccagtacttgaggaaccaccgtcccccactctccttgtccctttgcagcggcgcgcacgtgctggaattcctccactacctcgaccagttcgggaagactaaggttcacaaccacccatgcccgttcttcggtctccccaacccacctgccccgtgtccctgcccgctccgacaggcctggggcagcctcgacgccctcatcggccgcctccgcgcggcctacgaggagaacggcggccgcccggagaccaatccattcggcgcacgcgccgtcaggacttacctgcgcgatgttcgcgattttcaggcaaaggcgagaggtgttagctatgagaagaagaggaagaggccaaagcccaaggtcactcatcccactcctacttaa

SEQ ID NO: 41424 - DNA, 204 bp, Glycine max
  Peptide Sequence Number=SeqID_158202
atggaatccgccttccctaattccgatgttgttgagcgacggctggtagtgaaaggaactgacgatcttggcttagatggctttgctcctggggaacatcatttatcgatagtcaagccattcatatcgtgtggccccttcagagaggtcatagagatcaaggaaaacctcccccacaaactttgctacgcccttaactcttga

SEQ ID NO: 41425 - DNA, 228 bp, Glycine max
  Peptide Sequence Number=SeqID_158203
atgaagagggagatgcttgactcaactggaaatgacgggtcgacaactccgaatcacaagctatttactattgtattgtattacacggtaacgggcgtagcaaagtttgtgggggaggttttccttgatctctatgacctctctgaaggggccacacgatatgaatggctgcttaaggaagaggcccaaagcaagcaaaggaaggcttctttcttcccaagacactga

SEQ ID NO: 41426 - DNA, 570 bp, Glycine max
  Peptide Sequence Number=SeqID_158204
atgacgacaccaccgtcttcctcctcagcttcgcactcgcaattcgcctattcaaacccttcctcctcctcctacttccccgttccctttcaccttcagcaacccgcaaccactcactacgctgcgccctacgtcgccgccccctccgtgcaaatccccgctcctcccgtcgtcggccccattgctcccgcgccggttcccggcgtgtactccgccgtgccgcaatatcaggcacagcagttatttgagagggatgcgcagataataacgccggaggctcttgagaatgttaaggcagcgattgcgagcagcgacgtggaacacaaaactgatgccaaaaagaaagcggttcctcgcaaagctgctggccaagcttgggaggatcctatccttgcggagtggccagaagatgattatcggctcttctgtggggatcttggtaacgaggtgaatgatgatgttctctcaaaagcattttcacggtttccttcctttaacttggcacgagtgtccgctttgttgttgctccttattcacaaatcaagggcaattgaaattatatgccggtga

SEQ ID NO: 41427 - DNA, 520 bp, Glycine max
  Peptide Sequence Number=SeqID_158205
atgggacatatagctactctgcaacataatattttcagcttccattctttgaatggtctgcatatttgtaacaaacaagagagctgtattttgggtgcttgttctgctttggatcatagtttaagaaaaaaaacacctaccctacaccgaatttgttttggtgactacttttctacaactaaatattctattccatggaaaggattgcggtgtagaagttttcagcgaagtgttttaattgatagagctaatgaagttgaccatgaagattggtgctttggaagtgattatgttggtgaaaggagaaattccagggaactattggattcaaagaagtctgtaaactctccaactttgtcaccagaggcaccgtttgttcaaaacgatgaaatgaccaacaatgaaattcttcagaggctctgcagtcgtggaaagttaacagttgcggcaaggttgattgatgtcatggcacggaaaagtcaaataccccatttcccttcttgcacaaatttgatccgag

SEQ ID NO: 41428 - DNA, 1731 bp, Glycine max
  Peptide Sequence Number=SeqID_158206
atggcgacagtttcaagcgaattcctgtcgcattgcctcccacttggtaccaactcgaagcgcgcgtggcttccaaatccaagcaacaccgtgatcacctgcagaatcccacttctaaatgaagacaaccccagcaagcgaagactgaacaacaacaacaacaacaagggacacacgagggtcacttcctccgacacaagaccccaacaacaacattacgattttcgagacacccatcacatgaaagccctcaacaggctttgcaaaacgggcaagtacaccgaagccctctattttcttgagcaaatggtgaagaggggttacaagcccgatgtcattctctgcaccaaactcatcaagggcttgttcacttccaagagaacagagaaagcggtgcgggtcatggagattctggaacagtacggtgaccctgattcttttgcttacaatgcagtgataagcgggttctgcaggagcgataggtttgatgctgccaatagggtgattctgagaatgaagtatcgaggcttctcccctgatgttgttacctacaacattctcattgggagtctttgtgcaagggggaagcttgatttggctttgaaggttatggatcagttgctggaagataattgcaaccctactgtgattacttatactatcttgatagaagcgactattatacacggcagcattgatgatgcaatgaggcttctggatgagatgatgtcaagagggcttcagcctgacatgtacacttacaatgtcattgtgaggggcatgtgcaaacgcgggttggtggatcgagcgtttgagtttgtttccaatttgaacacgacgccaagcttgaacctctacaacttgctgctcaagggtcttttgaatgagggcagatgggaagctggggagaggttgatgtccgatatgattgtgaagggttgcgagccgaacattgtgacctacagtgttttgattagttcgctgtgtcgcgatgggaaagctggggaggctgtggatgtgttgagggttatgaaggagaaggggttgaaccctgatgcttattgctatgatccgttgatttctgctttctgcaaagaggggaaagttgatttggctatagggttcgtggacgatatgatatctgctgggtggttgccggatattgtcaactacaacacaatcatggggtctttgtgtaagaagggaagagctgatgaggcattgaacatcttcaagaagcttgaggaagtgggttgtccgccaaatgcaagttcttataacacaatgttcggtgcgctgtggagtagtggggacaaaattagagcattgacgatgattttggagatgttgagcaacggtgttgatcctgataggatcacgtataattcactgatatcaagtttgtgcagagatggaatggtggatgaggccattgggttgttggtggacatggaaaggaccgagtggcaacctacggttattagttacaacattgttcttcttggattgtgcaaagcacacagaatcgtagatgccattgaggtgctggctgtcatggttgacaatggatgtcagccaaatgaaactacttacacgttgttggtggaaggggttggttatgctggatggcgaagttatgcagtggagctagctaaatcccttgttagtatgaatgctatttctcaagatttattcagacgtttacagaaacaaaaccatttccgtgcctga

SEQ ID NO: 41429 - DNA, 1158 bp, Glycine max
  Peptide Sequence Number=SeqID_158207
atggttattggtggcctgtgtaaaaatggtcgtttaagatctgctcttgatctggtagaagatatgagcttgagtggttgctcccccgatgcgattacttataattcaataattcgctgtctatttgacaaggggaattttaaccaggctgttaatttctggagggaccaattgagaaaaggttgccctccttatctcattacctatacagtgcttattgagctggtctgcaaatattgtggggctgctcgagcccttgaagtactggaagatatggctatggaaggctgttatcctgatatcgttacatataactctcttgtaaatttgacttctaaacaagggaaatatgaggatactgctttggttatactaaatcttctatcccatggaatgcagcccaatgccgtgacatacaatactctcatccactctctaattaaccatggatattgggatgaagttgatgatattttgaagattatgaatgaaacttccagtcctcctacacatgttacgtacaatattctgctaaatggtttatgtaaatctggacttttggatcgtgccataagcttctacagcacaatggttactgagaactgttcaccggacattataacgtacaatactcttctaagtggtttgtgcaaggaggggtttatagatgagggcatccagttacttaacctattggtaggtactagctgttctcctgggttggtcacctataatattgtaattgatgggttggctagattgggatctatggagtcagcaaaagaattgtatgatgaaatggtggacaaaggaatcattcctgatgaaattactcacagtagtttgacttgggggttttgtcgggcagaccaacttgaggaagctacagagctactaaaggagatgtctatgaaagaacaaaggattaaaaatactgcttatagatgtgtaatccttggattatgcagacaaaagaaggttgatattgcaattcaagttctagatttgatggtgaaaggtcaatgcaatccagatgagagaatatattctgctttaattaaagctgttgctgatgggggtatgctaaaagaggctaatgatttgcatcaaacgttgatcaaatggaagattctgaaaaaagaaatcatgttgaattag

SEQ ID NO: 41430 - DNA, 496 bp, Glycine max
  Peptide Sequence Number=SeqID_158208
atgcagcatgctgatgaagaagaagacatcaacaaggttttgaggtacttctcttatgagcatttttatgttatatactgcaaattttgggagctggatacagatcacgatttctttatagacaaagagaatcttatcagatatggtaaccatgcgcttacctatcgaattgttgatagaatattttctcaggtcccaagaaagtttaccagtaaggttgagggaaagatgggatatgaagattttgtttacttcatactgtcagaagaggataaatcatctgaacctagtcttgagtactggttcaagtgcatagatttggatggaaatggagttctgacaaggaatgaactgcaatttttttatgaggaacaattgcatcggatggagtgcatggcccaagagcctgtgctttttgaggacatattgtgtcagataattgacatgattaaacctgaggatgagagtgttataactctgcatgacctgaaaggcg

SEQ ID NO: 41431 - DNA, 502 bp, Glycine max
  Peptide Sequence Number=SeqID_158209
atgacaggtttatttattgtactaacttgccttgctttttttcctcccttgtgtttcgctctggaatttcaagctgttattaaaaccagaacaatctttatgcctacagaccaacaagcaaaaatttataaccaaattattcaggctgtcaataaaaatgaaggtggaatgtttttcttatatggatatgaaggaacaggaaaaacatttatttggaagacacttgcagcctcattgagagctgacaataaaatagttattatgactgcttctagcagcatagcttctttgttattgcctagaggaaaaatagcacattcaaaattaaaaattcctgttccgatatttgaagactcgacatgcaatattcatcaaggatcacaattggctgaattattgaatgaagcaagtcttatcagctgggatgaagcccccatggctcacaaattctgttttgaagcacttgatcgaagtctaagagatgttattaaggcgaaatcaa

SEQ ID NO: 41432 - DNA, 351 bp, Glycine max
  Peptide Sequence Number=SeqID_158210
atggtgtggtgtctccaatcacctttcctccttcttcattccgctgtcattgatcttcaagaagcaaaggactctattgatgaagaagatccaaggcctacaagctccacatggagctacatcaaaggacaacctttaatggttaaggaggagtgtaaggaggtaagtgtcttcttcaagaggttagctaagaaggaaagtcattttgtaataaagacaaacattaaagaaacataccttcttagacaacctccacatcttgtcctttgtaaaaagacacttgtcagcactgccacacctcttcggcttgaggttattcctcatgtaaatgagttattggatgaaggtttg

SEQ ID NO: 41433 - DNA, 756 bp, Glycine max
  Peptide Sequence Number=SeqID_158211
atggatacgtgtagtcccaaactgctgtcttccttatttcctgaagcttacgatattcagcttttggcagctagtgccttggaggaaagaaacaaatttcaaaacaaattgctaccggagacaatatctaacggcaccaatatttgggatattctacttctagaagcaatctccgcagaaccgagcacgtccaattcaacccgatccaaccagctcaccgtggcggctgtggcagaggctcctaatagtaaaaagcctccgccgaagcaaacctcgaccaaggaccgacacacgaaggtggatgggcgcgagcaacgtatccgaatgtcggccctctacgccacctgcatcttccagctcacccacgagctaggccacaagttggacggtgaaaccatcgagtggctcctccagcaggtggagcttgatgtgatcgccaccactgacaccggcaccatcgccgccaacttcacctccctaaacatctccctacgcagtttcggctccttcatgtccgtcccctcccagcttcgatcgtcctacttcaaccttaatttctccctccaacaacatcaacatagaaccttcttccccggcatagccttttcctctaacaataccaacaacaacacatcaacacttctcaatttccaatccaacacccttaacaccaccatgctgcagcagcaggccaagccgaagcttagcgacgacggtgtgccgctttccttagacatttcagacaccattgtctaa

SEQ ID NO: 41434 - DNA, 660 bp, Glycine max
  Peptide Sequence Number=SeqID_158212
gaacgtcctgatttgaagttagtgtcacatgggaggaaggtgacactgattgggaggccagtgcctgagattgaaggcctggtggttgccacaggattaagtccactgatagattgttcagttattactggcgatcctggacttatatccgcatttgtggagaggtggcacagtgagactagcaccttccaccttcttgtaggagagctgatgatcacattggatgatgtgtcgtcaatcctacattttcccatcactgacgccttgcacaatttccacgctctttctacggaggaggccagatttttgccgacgaagttgctggaagtgtctgccgaggaggccagagccgagacagcactcacacgtggagcatatgtacgattaggatgggttcaagacatttatgagacgagatgtcaggcccggcggtggattgtcgcagctcgtgcttatctgctgcaccttgtcgattgcactctttttgctaataagagtgcaacatacgtgcatgtggtttaccttgacactttccgggacctcgctcatagtggtggttacgcttggggagttgccgcgctggttcatatctatgaccagttagatgaggcttgtaggaccaccacccgacagcttgcggggtacttgacgctacttcag

SEQ ID NO: 41435 - DNA, 539 bp, Glycine max
  Peptide Sequence Number=SeqID_158213
agggtgagactttacccacatactccagatactgcaggttgcccacagattacagagagattgaggctaccttatgcataccaggtcaagggttcatcttgaacactgagggccatcccgggaagattctcaggaaggatttgactactcttgctcaggtgtggagtgttctctcatactccaacctggcccccacatcatatacctctgatctgacagtggacagagctaggatgatctttggcctagtctctcgcatggacatgaacataggagctcttatttctggccatatgacttctatagcccagtctaacacttctagacttgggtttcctgctctgatcaccacactatgtagagcgagaggggttgtctctgacagccttacttttgagcgactaagcctggtcattaacttggcatacatcaagaagaactgtggaatcccgaggatctatcagtttccatccgaggggctaggagggcgaaggcgaggccagctgagcttccttcaacttctgcagctcctactctag

SEQ ID NO: 41436 - DNA, 204 bp, Glycine max
  Peptide Sequence Number=SeqID_158214
atggttggtaacaacgtttctcacgctaataacaaaacgaagcgtcgttttgaaattaacttattggagaagaagttttaccttccggagcaagataagcacgtaacactgaaagtatcagctcatggattgagagtgattaacaagattggaatcgaagaagctcttgaaagagctgtaagaaacggattgattaaaaagtaa

SEQ ID NO: 41437 - DNA, 217 bp, Glycine max
  Peptide Sequence Number=SeqID_158215
gatgtcctggacatcgtatccgacatcgtggatcctgcacaatctgttaaagatataacagatttatgtgtccagtattttcgggcaggatgtcctggacattgtatccgacatcaatcatcatcatctgattctgtctcttctgttgcatcttcttcttcctcagcagctttccctgatgtcgagacaatgtctgggacatgtgtcccctcaaaca

SEQ ID NO: 41438 - DNA, 872 bp, Glycine max
  Peptide Sequence Number=SeqID_158216
gatgcacactccctcactataatgaaccatccttgctcaacttctcatctctgcaaactctccatctttccttcactagttattcccctgccatttcttttgtccccaagtggatattcaaattgaagaaacttgtttctcttcaattatggagtaataaattccaaggttcgattccttgtggtatccgaaacctcacacttcttcaaaatcttgacttgtctggaaattcattctcatcttctatacctgattgcttatacggtcttcatcgtctcaagtctttggaaattcattccagcaacttgcatgggactatttctgatgccctgggaaatttgacttctcttgttgaacttgatttgtcatacaatcaacttgaaggaaccattccaacttctttgggaaatttgacttctcttgttgcactttatttgaaatataatcaacttgaaggaacaattccgacttttttgggaaatctccgcaactcaagggagatagatttaacaattctcaatctctctattaataaattcagtggaaatccatttgaaagtcttggatcactctctaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaaccaacttcaatatgttggactatctaacacggggattttagattctattcccacttggttctgggaagcacattctcag

SEQ ID NO: 41439 - DNA, 873 bp, Glycine max
  Peptide Sequence Number=SeqID_158217
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgagctattgttggttctcgctttcaacaacaacaattatttctcacacgcacattccttttatcctggttgtgaagaacaagctcttgatttcgaaccacaacttttgcatacaaatattgataaggaaatgtgtaaattcataaatctacaacatgaacggttgaagaatgaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41440 - DNA, 186 bp, Glycine max
  Peptide Sequence Number=SeqID_158218
atgactcgaacgcaacatgtgcatatcgtgggggagccctggggcattccattgagcactgattttcaagtgcaagccattggtcagtttgctcaagcgacctgtgctcctgagtttggacttccaagaccgttcaatcagagattactcgtcttgcacgttggtggggttgccgtaaaacaatga

SEQ ID NO: 41441 - DNA, 213 bp, Glycine max
  Peptide Sequence Number=SeqID_158219
atgtcattgcctagtgctattcatgtgttctccattatcaagtgcgaagcttctggtgactgggaagcatgttattctgttgttttccagatcggttccttcgccaaaagaaaaaaagaagaagtagagatgagagtcgtcatcacggaaagggcaggacggacgaaatcagtgtcctatctttgctttcctgttatctctgatgagaggtaa

SEQ ID NO: 41442 - DNA, 324 bp, Glycine max
  Peptide Sequence Number=SeqID_158220
atgacaagcagagaccaagtttgggtcattctgccacccttgtatcatccagaaggcggtgggcccgatgatacgcggagataccttacggttattcgcacccttttgtcatccagaggcggcgggcccgatgacaagcagagaccaaaggctgacatagtcttctgcaccttttgttcctccgggaacaacaagtcatttacatgcggaaatttcatggtcgcccgcgactctcgtcaaccgagaggagcgaaattagtgtcatacactgattttcggggacctttgcttgatgacatgcgaccattctttggtccttgtgag

SEQ ID NO: 41443 - DNA, 255 bp, Glycine max
  Peptide Sequence Number=SeqID_158221
atggcggaaatcaaaaggaagtactgttacgcaatcccaaccaggcccacttgggccttccaggatgttcctccagaaggcggttgcttctggaggaagcaacctagcttgcctgggcgagctaggtggcaagctcctcccctattttccaagccgaggcgcttccgtaacatttccgtgtgtgattttgcgaagattttcaaccgttcttcgacgttcttcgttcgttcttcgtcgttcttcggtcttcaaccg

SEQ ID NO: 41444 - DNA, 339 bp, Glycine max
  Peptide Sequence Number=SeqID_158222
atggaagggttagtggacctagcagcgattgacgctttcctcgcctttcatcatggcaaggaaagcccgatcgtcgccattttggccatgtatgacacgttcgaccggggatgtgaaaagagcagcgcaagaattgtttgttgtgcactggctctctatgtgtggctgtggctgagagtccggacacaaggattggattggctcccaaatctaaagactgtgagagacgatgaggttaaagcttcggaagaaagtgatgaggtacaagccctaaaggcagagcttgaaagagcccgagtagtcaaagagaagttcaagtccatagccatcaaagtctga

SEQ ID NO: 41445 - DNA, 447 bp, Glycine max
  Peptide Sequence Number=SeqID_158223
atggcaagagctggtgacaatggtggtgtatatcatcaactggacgaatctcagcgcttatttctggacgcgtggactacacaaatgcaacgtttgttgaaccgtaacaaagaagagccctacagacgaatagtcaaatcttcctcgtttactcttaaacctctatcccctagagaagtgaatttaaagatgtcttttccaaggagattcctcatggactgccaccttcaagaagcttcattgcctaacaagccaacttacaacagcaagccccaagagactcagcataaggatgcacaggtcaaagttgagtatgtgaaaagattgtatgaccaagtgaaggccaaatacagtctaaaggcccaagtggagaaggacgaaggcccaagtggagaaggacaaagcccccgagtggagaaggatgaaggcccaagtggagaaggatga

SEQ ID NO: 41446 - DNA, 1014 bp, Glycine max
  Peptide Sequence Number=SeqID_158224
atggcttccattggcaaaaagcagcacattttagctcttgtgctccttctctcaatctgcacttcccaagtaatgtcccgctacctccatgaggcatccatgtccgaaagacatgagcagtggatgaaaaaatatggaaaagtatataaggatgctgctgagaagcaaaaacgtttactgatattcaaggacaatgttgaattcattgaatccttcaatgctgccgggaacaaaccttacaagcttggcatcaatcaccttgctgaccaaacaaatgaggaatttgtggcttcccataatggatacaaacacaaggcatcacattcacaaacaccattcaagtatgaaaacgttactggtgttcctaatgcagtggattggagggaaaatggagctgtcacagcagtcaaggaccaaggccaatgtggtagctgctgggcattttcaacggttgcggcaacagaaggtatctaccaaataactacaagtatgttaatgtccctttcagagcaagagttagtggattgcgacagcgtggatcatggttgtgatggaggttacatggaaggtgggtttgagttcattataaaaaatggtggaatcagcagtgaggcaaactacccctacacagcagttgatggaacttgtgacgcaaacaaagaggcttctcctgcagctcaaataaagggatatgaaacagtgcctgctaacagtgaggatgcactgcagaaagctgttgcaaaccaacccgtgtcagttaccattgatgccggaggatccgctttccagttctactcaagtggggttttcacaggacaatgtgggactcaactagaccatggcgttacagcagttggttatggtagcactgatgatggcactcagtattggatagtgaagaattcatggggcacacaatggggtgaagaaggttacataagaatgcaacgaggcacagatgcccaagaaggcctatgtggcattgccatggatgcctcgtacccaactgcttag

SEQ ID NO: 41447 - DNA, 336 bp, Glycine max
  Peptide Sequence Number=SeqID_158225
atgtcgaagaacagggtcttgaaagagcataacaacactttcttacattggtttaaagatacaatctttgttgatgataatgcttctaaaacgttaagaaagctagcagatgggcctaaaagaaatgttataacttggcaaggatacgatataagcaagtattccttttacacaaaagcacaagacgagaaaagtacaatgcaaaatagtagggttaccctaagggttgaatcacaacacttcgctagtgtacatgatgacaatcccagtgtagctttcatcccttactttggtttcattgaagaaatttgggagcttaactatgtcaaatttact

SEQ ID NO: 41448 - DNA, 159 bp, Glycine max
  Peptide Sequence Number=SeqID_158226
atgataacaagcactgatgatggcactcagtattggatagtgaagaattcatggggcacacaatggggtgaagaaggatacataagaatgcaaggaggcacagatgcccaagaaggcctatgtggcaattccatggatgccccgtacccaactgcttag

SEQ ID NO: 41449 - DNA, 360 bp, Glycine max
  Peptide Sequence Number=SeqID_158227
atggaattagtaaagactcaagtcccacaagctgggatgcttaagtcacatggatgctgggtacatgctttgagaggttctgatatccaaaagggcacccgtgttgtttccagattcattgataagagaagcacaaatagaaaaaccatttccgatctcgatttctcatcaccgcccgcattcgacaacttccacaccgacaaatccttcctcttcgtccttgctcaggttgaatctatcacagtggcatggttgggtgttgttcgcggtggagccggtgtgaggttagagagagatggtggtggggattttgtgatggtgttcgatttcaccagcgaccggaagctgagtaccgactag

SEQ ID NO: 41450 - DNA, 393 bp, Glycine max
  Peptide Sequence Number=SeqID_158228
atggtcagaaggctctttttgaagcaatacatagctctgctcacgaccctaattattcagcccgctatatgggctttgattggcacaagaaagaagctggcttccatcttcaagttcagaaacttacagaggctacattggtggttaaccaatcagttgctgaatgaaaaggcagttttgagcctaaaaggggagctagagtttagaacaaaaaatatatattatggaaagccatttgagttctttagccaaggaggatattcaacatttaacatcggtgctgacgtaagcactgatgttgaaacaacatgcaacattggcaccgatgttgaaacacatatttattacatcgtgccagttactatgtcatgcgtgacgtcaccaccgatgtag

SEQ ID NO: 41451 - DNA, 607 bp, Glycine max
  Peptide Sequence Number=SeqID_158229
atgttgttgcagtatcaccgtgccgtaggctaccccgttgtggttgtcagctgtgtcgtgagaggagtgggtcgcgtcaacgacgccagcactggaaaatccttttacggccccggcggcccctatgccatgttcgccggcaaagacaccagcagagccctggcgaagatgagcaagaacgacgacgacatccccccctccctcgacgacctctctgataaggcgatagacgttctcaatgactgggagaacaaattccaagctaagtacctgggaatcagttatgctaaccttgccccccctgtgtatgttgttcttggaagctcaatggatcttgcagtaggacatgtttctattgcttccctagtgctgggatccatgctcacagaggaagtgtctcccagtgaacaacctcatcattttcttcaattaggtttaacttcaacattctttgctgggatctttcaagccgctcttggaattctaagtgttacacattcaagaactgagcttgatggaagttctgagactgagatgatggtttatcctccattcgaattctcagatgtttcccctccttccattattaccgagggaacccatggag

SEQ ID NO: 41452 - DNA, 138 bp, Glycine max
  Peptide Sequence Number=SeqID_158230
atggaaatacaagtattggggcacaagggagtattttatatattacttacaggtaaagaaaagaaggttttactttgctttgacgttgttgttgacaattggcgttcattggcaggatcaggtagctatgctgagtga

SEQ ID NO: 41453 - DNA, 279 bp, Glycine max
  Peptide Sequence Number=SeqID_158231
atgttgaagtccgacacaagctttcgggtggagacggtggcaaagtcgatggcttctagctggaatagccacacgacggagaaaatagagggtaacaagctgagtggttttttgaggtttcactggaggagaggggaatgggggcggaggacgaatgtggagttgggagtggtggtggcaccagggagaaggtggagaaagtgtaatgggaagaggagagaagaggaacagctagcgagtggggagaggaacagacgtcagttgggatttgcactttaa

SEQ ID NO: 41454 - DNA, 303 bp, Glycine max
  Peptide Sequence Number=SeqID_158232
atgtgtggtcctctgaaggtgagagcatgtagccctctgaaggtgaggacgtgtggtcctctgaaggtgaggacgtatagccctctgatggcgaggacgtgtagtcctctgaaggtgagggtgtgcagccctcttaaggtgaggacgtgtagtcctctgaaggcgagggcgtgtagtcctctaagggtgaggattgactatccttctgaaagaagtgataattcatgcaaccttatcctatcttttgcaaatctctccgggaactccctcagagtgtatgttctgtttgatttagtcacttga

SEQ ID NO: 41455 - DNA, 153 bp, Glycine max
  Peptide Sequence Number=SeqID_158233
atggatacctcagaaccctacactggggcaatgaggggcaccgtgcatgagcctcaagttcccaactacaaggtcgtgacgaaagataacaattggtacctcaaagccttacactggggcaatgaaggggcatcgtgcatgagcctcaagtga

SEQ ID NO: 41456 - DNA, 222 bp, Glycine max
  Peptide Sequence Number=SeqID_158234
atgggtgccaaatacctcgaagtggtcaaacgagggtcgtatcccaacaacggatggtccccagacgaaattaggattatgttaaggaagtggttgatggacagagatacacttgggtatagtaggtggagaggttcggagaacctaggggaattagtgaatggtaactatccagcatttggtggcgtgggtaactcacaggcctcactctactcctcctga

SEQ ID NO: 41457 - DNA, 507 bp, Glycine max
  Peptide Sequence Number=SeqID_158235
atgaccgattacatcagaaatattgttaataatcagacggaaaatgcgccggtaaccctgatccgcggtgcaaccatactgagtatggatgagaatgttggtaaccatgaacgtggcgatattcttgtcacaggttcaaccatcaccgcaatcggcaaggacctgaacgccgagggtgctcacgtcattgatgccacaaatatgattgccatgccggggatggtcgattctcatcgtcacgcttgggaaggtcagctgcgccgcatcaaccccaacgccacctgtctggacgactacagcaatgccacgcatttctcgttcgcgaaatattaccggcctgccgatatctatgttggcaacctgctgacggcgctgggcgcgattgatgcgggtatcactaccatgatcgataactcgcacaacagccgtaccgcagcgcattcagacgccgccgttgaagccctgcttgatgccggtattcgcgctattcatgcgtccggtgcgccg

SEQ ID NO: 41458 - DNA, 963 bp, Glycine max
  Peptide Sequence Number=SeqID_158236
atgtctcgcaggttgtctgaggcctactcatcagtgaaacatgagaagtggatggcacagtatggtaaggtttacaaggatgctgccgagaaggaaaaacgtttccaaatatttaaaaacaatgtgcacttcattgagtctttccatgctgctggggacaaacctttcaaccttagcattaaccaatttgctgaccttcataatgaagaatttaaggctttactaattaatggtcagaagaaggaacataacgtgcggacagcaacagcaacagaagcatcgttcaagtatgacagtgtgactaggattccttctagcttggactggaggaaaagaggtgctgttactccaatcaaggaccaaggaacatgtcgaagttgttgggcattttcaactgtggctacaattgagggtctccatcaaataactaaaggtgaattagtgtctctatcagagcaagaactagttgattgtgttaaaggtgacagcgaaggatgctatggtggatatgtggaagatgcctttgaattcattgccaagaaaggtggagtagcaagtgaaacacactacccctacaaaggagttaacaagacttgcaaggttaagaaggaaactcatggtgtagtccagattaaagggtatgagcaagttccttcaaatagtgaaaaggctctcctaaaagctgtggcacatcaaccagtgtcagcttatgttgaagctggaggatatgctttccaattttactcaagtgggatttttacaggaaagtgtggaactgatatagatcattctgttaccgtagttggttatggaaaagctcgtggtggcaataaatattggctggtaaagaattcatggggcactgaatggggtgagaaagggtatataaggatgaagagagatatacgtgccaaggaaggtttatgtggaattgctacgggtgccttatatccaactgcttga

SEQ ID NO: 41459 - DNA, 723 bp, Glycine max
  Peptide Sequence Number=SeqID_158237
atggcttcccataaaggatacaaaggttcacattggcaagggttgagaataacaacacaaacaccattcaagtatgaaaacgttactgatattccttgggcagtggattggaggcagaaaggtgatgctacttcaatcaaggaccaaggccaatgtgcagttgctgcaacagaaggtatctaccaaataactacaggaaacctagtatccctctcagagcaagagttagtggattgtgatagtgtagatcatggatgtgatggaggtctcatggaacatgggtttgaattcattataaaaaatggcggaatcagcagtgaggcaaactacccctacacagctgttaatggaacttgtgacactaacaaagaggcttctcctggagctcaaataaagggctatgaaacagtacctgttaattgtgaggaggaactacagaaagcagttgcaaaccaaccggtgtcggtttccattgatgctggaggatctgctttccaattttactcaagtggagttttcacaggacaatgtgggactcaactagaccatggtgttactgctgttggttatggtagcactgatgatggtattcagtattggatagtgaagaattcatggggcacacaatggggtgaagaaggatacataagaatgctacgaggcatagatgcccaagaaggcctgtgcggcattgccatggatgcctcgtacccaactgcttga

SEQ ID NO: 41460 - DNA, 231 bp, Glycine max
  Peptide Sequence Number=SeqID_158238
atggtggctcaggcctcaggcaacaaaccttacaagcttagcatcaatcacctagctgaccaaactaatgaggaatacaaaggttcacattggcaagggttgagaataacaacacaaacaccattcaagtatgaaaacgttactgatattccttgggcagtggattggaggcagaaaggtgatgttacttcaatcaaggagtaccatcatcagtgctaccatgaccaataa

SEQ ID NO: 41461 - DNA, 423 bp, Glycine max
  Peptide Sequence Number=SeqID_158239
atggggtgtacccatgggcccgaaatctaccctaaggctcatgagaaccctagggccttctcttgcatctttggcccaatcttcttggagtcttctatccaatgcccttggggggtaggattgcatcacaaccccgacctaaagcatgtagttgtttgtaataatctgttaaaagtgaaaaccaaaagcactcaatgctctacaattaaacaacttgattttgttttttccgaccccaaatctaccacaagtaagaagattctggaagaggtggtccttatacccagagtggcaatggcgaaggaagaaaggttgtcgtccccaacaatggaggcaagaaagcatgtcatcgctgataatggaagcaatggggcagggttcgtgagagagaaccactatgggccacgagagagacgactctga

SEQ ID NO: 41462 - DNA, 294 bp, Glycine max
  Peptide Sequence Number=SeqID_158240
atggacgcctggatttatttattctgcgaagtgatcttgggtcacagaggtgctccagtggcttctgtttctatcagcagtccctcctgttcagcgactgacggggtggtggggaatggcaaaagcaccaccggacataaaggtgcaacaggaggacttcccaggaggtcacccatcctagtactactgtcgcccaagcacggttacagggggagttccgatgggctccggggcattagtgctggtatgatggcacatgataagtattgcacaatcaattactatattccttga

SEQ ID NO: 41463 - DNA, 315 bp, Glycine max
  Peptide Sequence Number=SeqID_158241
atggtgctcatatttaacgacgatccaacggtgaatcattctgagatcgtcatttttatgagacagattaaacaagtaaataacacaagagaattgttaacccagttcggtgcaacctcacctacatctgggggctaccaagccagggaggaaatccactataatagtgataacatcaaggtggctcacaaaacactcaagtcccaaaactcacaaaataactcttcaatctcggacttggtaatcaaacccgtgcagccttcatgtttatatagcagtgtgcgtatctgggctgcaactacttgtgctggatga

SEQ ID NO: 41464 - DNA, 535 bp, Glycine max
  Peptide Sequence Number=SeqID_158242
attaccttctcaatctgtccaaaatcccaaaaatgtgagtgccattacattgagatcgggaaagcagtgtcaagaacctcaaccagcaaatgaacctgcccaacctcactctactccagaaaaagatgatgacaaaaatttaaagaagaagcagtatatccctcttccattccctccaagagctatttacaacaaaaaaatggaagaggcagagaaggagatcttggaaacatttaggaaagtagaggagctgtgcactaataagcggaagcttaatggaagtgaaagaattagtatgggcagaaatgtctccgcattgattggtcctttccagccaactgatgtggtaattcatttagctaatagaagtgttgcctatcctgctggtttcatagaggatgtcttagttaaagttggtgaattgattttccctgttgatttttatattttaaatatggaggagggattttctaaaggatcagtttccatcattctaggcaaaccttttatgaaaactgctagaactaagatagat

SEQ ID NO: 41465 - DNA, 636 bp, Glycine max
  Peptide Sequence Number=SeqID_158243
atgaagatgaaagccaacaaaacaagaaatgaattgaaagtctcggattcgaaaacttaccggttgaagaacgaagaacgacgaaaaatcttcacggaatcacccacggaaacgtcttggaagcgttacggaggcacctcggcttggattttcttcacggaaacacaaaaaagtcgtgaagcttgccgcccagctcgcccaggcgcgctctgctcgccatggcgagtaggtggcttcctcaggaagtttcctaaggcacccccattttacaaaggttacaagaattttacggaagccccaaaagccatttttcaacaaaacgtgggaggaggttgccgcccaactcgcctaggcaagctaggtttgaaaattgctattcacacccccagcttgataagttcaacacccatttttgtgttttttggttgttttcctttcgaaacttcacggaactttacggattccacgacaatgggtgttaaacattttgaagtggtcaaacgaaggtcgcatgccgacaaacaatggtccccgaacgaaattaggcgtataaacaaaggacgtcgagtcctacgaagcacaggggaaaaagatattgaagtttttgaggtgaagacattgtcgtctttgaaatga

SEQ ID NO: 41466 - DNA, 312 bp, Glycine max
  Peptide Sequence Number=SeqID_158244
atgtgtctatcggggaaggagagaaacactgggtccaacaaagataggagagaatcactcaaagtgtatcaatctcacacagtgcgtggcgagaaagtcgctagtgcacaggattttgtcggcaatcaaagggagagaaccactttaggtcgtggattgacattctcaccctgggtcaaggtttatgataagttgggattttggttcaaggcttgtagaacggctggtcatgatatatgtcagggtttggccagcggttcggggataaagggaatgtcctacattatttccatgatacacatgcaacaatga

SEQ ID NO: 41467 - DNA, 333 bp, Glycine max
  Peptide Sequence Number=SeqID_158245
atggtcattcccaagttcaaggtgccagactttgacgagtacaaggggactacttgccccaagaaccatctaaagatgtattgtcggaagatgagggcatacgcaaaagatgaggaactactaatacatttcttccaagaaagtcttactggggtagctgttaccaggtggagggatctggcaactcaagtagcgcccccaataatagagaaagagattatcacaataatagtaggcacgttaccggtgttctactatgaaaaatggtgggttacacaccttcaagttttacagatttggtcttcgccagcgaaaggatcgaagtgggtctga

SEQ ID NO: 41468 - DNA, 195 bp, Glycine max
  Peptide Sequence Number=SeqID_158246
atggtgtttttcgtaagctacacgaaagcaaaggctgaaaacgctcaagtgagaaatagtctcggacacggaaacgtcgtgcacactctagacatcatctcaaagatcccaatgattttttccggtaacattgagctgcttaaagccaattgtcgtgcgatctgtaaggtttcgcaatgttttggaaggaaataa

SEQ ID NO: 41469 - DNA, 1113 bp, Glycine max
  Peptide Sequence Number=SeqID_158247
gtcctgcgaggcctgctcgccgatgagggcgcggcgcgcgtcgttgtactcgtcggacagcagttgcgccagcggcacgtcgacgaaggcgggatcgccgtagtaggcctcgcggtcggcgaaggccagcttcatggcttcggtgacgcggtgcacgaactcggcgctggtcgggccgacgccggccaggtccatgtccttgagcagcgccagggtctgcaggaataccggcccctggctccaggcgcccgccttggccacggtgtagccgtggtagtcataggtggcgggctggtcgtagctggccgaccagccggccaggtcgtcggcggtgatcacgccgcgatggcgctggccgctttcgtccatgacctcgttgccgcgcgcgaatctgtcgatggcctcggccacgaagccgcggtagaaggcgtcgcgggccgcctcgatctggcgctcgcggtcggcgccggcctgttccgcttcccgcagcacgcgggtccaggtggcggccagcgccgggttgcggaacagcttgcgggcctcgggcacgttgccgccgggcaggtagacctgcgcggtggtgggccagtgggcctggaagaagtccttcaggccggcgatggtgttggagatacgcggcatcagcgcgtggccgtgttcggcgtaatagatggcgggttccagcacgtcgcgcacgcgcatggtgccgtggtcgcgcagcaattgcatccaggcgtcgaaggcgccgggaatcacggtggccagcaggccgttgccggggatcagcttgagactttcggcgcggtagcgctcgagcgtggcggcggcgggcgtggtgccctggccgcacagcacttcgacgcggccggtgcgggcggaatggaacaccgccggcacttcgccggccgggccgaccaggtggggctcgaccacctgcagcacgaatgcggaggcgacacaggcgtcgaacgcgttgccgccgcgctcgagcagcgacatgccggccgagctggccagccaatgggtggaggtcacgacaccgaaggtgccgaggatttccgggcgagtcgtaaacatggtgcgatcctgttgcggacggcgcacggccggtga

SEQ ID NO: 41470 - DNA, 207 bp, Glycine max
  Peptide Sequence Number=SeqID_158248
atggaaagttattacaactataggaaacaaatggaggagaatgaagtcacaccaattattttgggacaactcttcctcaacacaagaggaacattgattgatgtcaaggaagggaaattgacttggtggctaggtgatgaggaagaagtatttaaggccactaacaagataatagtcattttctcctcaaatatccataagccctaa

SEQ ID NO: 41471 - DNA, 369 bp, Glycine max
  Peptide Sequence Number=SeqID_158249
atgaaggaggtggtattagtggtggcggtggtgacaataatgttggtggcaacggtggtgggggatggtggttgtggtgacgggggtggtaattgtagtggtggtgatggaggtgttattgttggtagtaatggtggtggcaacaatgacagtgtcgatgacactaatggtggtggtggtaacaatgtcggtggtgatatgtggcagagcgatggtggtagcaacgttggtgatgttggtttcgatgatggtggtgatagtggtgctagtggtggtagtgaccaagatgatataggtgatggtcgcggtgacaatggaaatggtggtgataccggttatgacagcacaaagtgtcattatcaaatgtga

SEQ ID NO: 41472 - DNA, 510 bp, Glycine max
  Peptide Sequence Number=SeqID_158250
atgggattgggtcaggtgccttcgctcaaaaagaggttctatcaagtcaagatcaagagcctaggagtcgccagtctaaaagagttaggacagttgatggggcagctccagcgacaagcctttcacaaagtttatggtatgatttgggacctaaccatggcagaggtctccagggaggccatcgcctccctcgcccaatattatgaccagcctttgaggtgcttcacctttgggaacttccagttaacacccacagtggaagagtttgaagagatcctaggatgccctctgggaggaaggaaacttcaaaatctcgacacaggaattggaccgcgggaagcaagtcgaaaatggggtggttgggataccaaggaaatgtttggaagcaaaggcgagagtcttggcaagtcaagacgaatgggccccgttcatggacatcctggcactccggatcttcggggtggtcctctttccaaatgtggatggattggtggaccgggcagcaattga

SEQ ID NO: 41473 - DNA, 516 bp, Glycine max
  Peptide Sequence Number=SeqID_158251
atggtgcttcaacgcttctgctctaataggatagaaatgagaatctcaggtcatggtgacttgcactgggatcctttaaaccatctgcttccctatgattcttatggtggatatatggtggcatttgcggggaggaaatatgctgcacgttcccctctcgcatttgttgcaaacagcacatataccgtaacaagttttacactggtgctagagtttcagaggggtaggctgcagaacttttactggaagagagacggttgttcttcgtgcaaggaaaaatcgaacttcatatgcctcaacaaacaagattgtgcaatcagaacatcatcttgcaagggcagaggaggtgcagtagattgtagtcttggaattcagcttgcattttctggtacagacaggcatctcagagtgcttaattcatggtttgaagtggaaaacctgcggcagtactctctctatggcttgtactcaaatctaagggactctctcactggccagtataacaaattcttttaa

SEQ ID NO: 41474 - DNA, 339 bp, Glycine max
  Peptide Sequence Number=SeqID_158252
atggagttagagaaacccgatgtcaaaactgcctttctccatggaagactaaaggaagacattatgatgcaacaacctaaaggttttgaggtggaaggaaaggaaaattttgtttgtagattgaagagaagttccaatgactcatgtgtttatcatagcaaggtgaaggatggttcccacatcaatcttctgttctatgtggacgacatgcttatagcatctcaaaaattgttggcaattcagaagttgaagtcaatactcagtagtgaatttgagatgaaggacatgagagtttctaaaaagattatgggcatggagattaagagtgatcgagtctaa

SEQ ID NO: 41475 - DNA, 219 bp, Glycine max
  Peptide Sequence Number=SeqID_158253
atggttaatcctgaaaaggaacattggcaagctatgaaagatatattcagatttggatgcaatgagatttgtgattgggtacgtgttcacgattggaaactctcttatcatttcaaagacaacacttcagcccacaatgactttatccactacataggcagggtacatggctctggcagaagcaacaaaggaagggatctagctaaagggttagattag

SEQ ID NO: 41476 - DNA, 579 bp, Glycine max
  Peptide Sequence Number=SeqID_158254
atgtcctcatgggtaacgatgttcctactaagtatgtcggttgaaggtggagttatacaaattagagggaaagagaagtatgtggtaatgcaaggaaccaaacaagaaaatttgtacatccatcatgggtccagtgtgataggttttgtctctaatgtttcacaatctagtagccatatgtccaatgataattccctatggcatatgcgtcatggccacatgttatctcgtgagacagtcggtataacatgttatcatatgaatcgctcaccatccattgctatagactttaagacccctgttgatgtatggtctaacaagcttgttgaatactcaatgctaaatgtgtttggatgttcgacatactatcatgtagcaaaagacattgattcattcaaaccttccatttatcaagaagcaatttcttgttctaaagttgaggagtggacaaagggtatgattgaagaaatggaatcccttcagaagaaccagacatgggatttagttcatctacttgaaggcaaaacgagtaatgaggtgcaagtggatcttcaagaagaaatttggatcatccattga

SEQ ID NO: 41477 - DNA, 630 bp, Glycine max
  Peptide Sequence Number=SeqID_158255
atggaagaatccactcacttgaaatccaatatggagtgcattgaagaagaaattgccaaattagcttccaatcaacttcacatcactacctatcttgacgaaatcatccaatgcatcacagttctagagactagccaacaacaatctccctcaccttcatcctcctctgcaaacccataccctattagcccttcatcccatcttcctcgcatgaagctcgaagccccaagatttgatggatccgatcctttggggtggatcttcaaaatcaatcaattcttcaagtaccacactacccctaaacctgaatgcctcgttatcgcctcattctccatgaagggtcttgcactcgcttggttcatgtggatgacgaggaatgaccaaatttcttcttggtcagtccaagcccttcaacccttgaccttggttcaagcggctgggttggcaagacttcaggaggagaaaatagcggaacatcaacattccttccatggtcgaatgcactctggacctggacctggaccttcatcttctttcaccgccatctttacctctattaccttcaccaacgaaaccgcctcacctacctgtcaagcgcttatctctcgtggagatggcgattcgatgtga

SEQ ID NO: 41478 - DNA, 219 bp, Glycine max
  Peptide Sequence Number=SeqID_158256
atgaaggcagcaatgaaggttgcgatgagtaatgatggtagcaatgaaggctgcgataggtcaccaaacttgtctcataaaaatgacgatctcggactcattcaccgttggattgtcgtgaaatttaaacagcatgtttgcaacccatttccgagcattctaaccgttgggaatttcgatatcatgtctgatctaagagaaatacctctcgtattgtag

SEQ ID NO: 41479 - DNA, 294 bp, Glycine max
  Peptide Sequence Number=SeqID_158257
atgcttcgcgtgacactaaagttgaaccacatagttaccaccatagttaccaagaggagggtgtgcatattgtattctatagcaagaggtagcaaagtgattgaatcaatggccaccaataacatgtcccaaaagccaatactgctatcaaacctcgcttccactgtgaaacaagttccctctaatttcatcaagtccctcgatgatcgttcaactcttcaagatttccaattacgggtgagaataggtcaggccaagtcaggctttgaaagacctgagtctagcctacgatga

SEQ ID NO: 41480 - DNA, 777 bp, Glycine max
  Peptide Sequence Number=SeqID_158258
atgacgatgctttccaagatatcatcatcactgttactatcactatcctccaaacccaaacccaaacccatttgcaacccctttctgctttctcgttcagccgccacaaaacatcagaagaataaaaaggagaacgcaaaagcagcgttggcgaaggagaagcgcagaacccgttccgataagcagttcaacagagacgcaataatcgagcgttgcagaataaacgacattgacaccgacaccaagttctctcacgttcccgttatgctgggcgaggtcttggacgtcttttccaactccacactaacctccttcgtcgattgcactctgggcgccgcgggtcactccaccgccgttattaggggccatccagagttgaagtatttggtggggatggacgtggactctctagcacacgacatcgcccagcctcgtcttgatgccgttttgaacgctggtgtcaaagcgattaccgttttgaggaattttagagacgtcaagtctgtgcttagagaaatcgctgagctacacttgttgggggttgacgccatcttaatggacttgggaatgtcatctatgcaggttcattccacaactttgtacgtgtaccctttctttacttacttgcatgctcatgttcccaactctgttttgaagcatatagcatcacatctccaaacatacagagatgcatcaaacccctgcttttttgtcttatgccctttccatgctctaaatttaaaagcatcctcgacagcttccacatatcatatttga

SEQ ID NO: 41481 - DNA, 918 bp, Glycine max
  Peptide Sequence Number=SeqID_158259
atgggatttggtctgcccgccgcgctgggcgttaagctggcgctgccgaatgaaaccgtcgtctgcgtgaccggagatggcagtatccagatgaacattcaggagctgtcgactgcgctgcaatatgaactgccggttctcgtgctgaacctgaataacggctacctcggcatggtgaagcagtggcaagatatgatctattctggccgtcactcacagtcatacatgaaatcgctaccggattttgttcgtcttgctgaagcatacggccatgttggcatgcgtgtgactgagccggctgagctggaaacgaagcttgcagaagcgcttgaacacgttaaaaacaaccgcctcgtctttatggatgtcattgttgatggcaccgagcaccgcggctataacattgaaagcctgactgtcgccccgacggatgacccaacgctgtcgcgtatgacgatccagaccgtcggcgacgcgaaagtccttgagcaaattgaaaaacagctgcataaactggtcgacgtactgcgcgtgagcgagctggggcagggggcctacgttgaacgtgaggtcatgctggtgaaaattcaggccagtggctacgggcgtgaagaagtcaaacgcaatgcggatattttccgcggacagattatcgacgtcacgccttctctttatacggtgcagttggtggggacgagcgacaagctggatgctttcctggcatctgtgcgggatgtagccaaaattgttgaggtggcgagatcggccgacaacgcagataaaagcggggcaattgtgaaactggatgaaatcgcccggctagccggcgtgtcacgaacaacggccagctatgtgattaacggtaaagcaaaacagtaccgtgtcagcgataagaccgttgaaaaagttatggcggtg

SEQ ID NO: 41482 - DNA, 375 bp, Glycine max
  Peptide Sequence Number=SeqID_158260
atgtgcaaaattagtcatggctacagccaggacgacgttcctaaatggaaaactccacacgactccgaaatttcaaaaaacactattgacaacaacgaagtaaatactaacgtaatagttcaaacgacatgtatgcacaaaacaaaagtcaatcaaaacgaaagaaacgttagtcccttagttaaaacaaaagatagcatacaaatgataaatgatggaacatacgaatttggggatcccacggtcatgtggctccgcatgcccccggactcttgggtcacggtaacaaaaagtggggtggtcgacaaaagcagggcttttgctcctacgtatcctcaatttgtgatgaggaactcagacctacgtagttcttga

SEQ ID NO: 41483 - DNA, 453 bp, Glycine max
  Peptide Sequence Number=SeqID_158261
cgtggaagggatgaagattaccgaactggaagaaaacaggcaagggatgaggatgaacatagagaaagaaaattcagaaggaatgaggatgatcgggaaggaagaaagttcagaagggacgatgatgtttatggagaaagaaagaacttaagggatggggatgtgcatggagaacgaaagaacttaagggagaatgatgatagggaaagaaagcattcgaaggatgaagatggccgtggagaaagaaagcacagaagggatgatgatgatgatgatggttatgaaagaaagcagcgcagaagggatgatgatgatcctgaagaaagaaagcagcacagcagggatgatgatggtcgtggagatagaaagcacagaagggaggaggaagagcgcggaaacaaaggttatgagagggaaagccgtggagattactccaagagaggcagatactaa

SEQ ID NO: 41484 - DNA, 225 bp, Glycine max
  Peptide Sequence Number=SeqID_158262
atggaaatttctccagatatcagggtaaatttactcaagaactttggatcattcatgagaaaccaaatgacttggggtggtgctggtgccgaatcatttttagaagttgatgttaagttgaatctcacacttgagatctacacacaaccatttaccatgatgcctacttcagccgttgagggtcctggaaatatgttatgcactccacatggtcaagttctctga

SEQ ID NO: 41485 - DNA, 306 bp, Glycine max
  Peptide Sequence Number=SeqID_158263
atggcaacccgggtgtttcaagctctgagaatcgctgttaatgatgatctagaggacagaattgtgaaacagacatttcttaacataatcaaagggagggaagatgtggaagaaagggagagcctcaacagtgttttgaggaacactagtgatgaaatcaaagaaaaagaagcatggataaagcaagtgatatatggatcaaatggaacaattctcacaaaaagaccaatcacgccatcaggagaagaagaaaaattgaaccgccgaagtagaagtgcaaagctcagggttattcagaagcactga

SEQ ID NO: 41486 - DNA, 408 bp, Glycine max
  Peptide Sequence Number=SeqID_158264
atgacccaagagctggtagcccgcagagacacctttcggttatccgcacctcgtcattcagtgtccccaagtgtgattgatgagcagaggccaatgtggtcatctgcgccttttccggagatgatacgtaggagcaaaagcctcgcttttgtcgaccgcgccgctttctgttaccatgacccaagagctggtagcccgcggagacaccttacggttatccgcacccttttgtcatccagaggcggcgggcccgatgacaagcagagaccaggttttgatgaggacataaccaagggcaaggaccatgaagcacttgaaggtcccatgaccagaggcagacttaaacaagcccaacacgtcatagagacaaggctggtcatttgtatagctgccattgatgatgattga

SEQ ID NO: 41487 - DNA, 798 bp, Glycine max
  Peptide Sequence Number=SeqID_158265
atggttcttcctcacttcaaacattctagattcaaagatgaccaacattgcagtcaccgtatagctgaagtgctagatctagatggtaaaatttcaccagctcaaatttccaatatgttaaaaaggttaggactagtagttgcacctaggagaaagatgtgtgatgctgatgctaaaggacctttgtctactagccctaatctgttagacggtgacaaaataacaggagctaccaatcataaatccgtgaatttggagggaagcctgttggttcagcacctgcaaaataaaaaaagagtccaggctttcaataaagatcaggaagctctaatcaaagttctatatgagcaattcaaggactacagaagatgtagttacatgatagccaatgcactggataaggatggtaaattcactactgcccaagtctctcgaaaacttaagcagcttggtttgtctcttcctctgaagagttctggaggaaaaatgcacccaaagggtgcagatctcatggatcgttcaaatgaaaggatggatgaatctgatgatgagacattggtatcactggtaaaaaggaagaaaatggagagtggcaaattatcaaggggacagttacatgggcaaaccagtcaggataaattatcaaaaggcgattctgatgatgaaatgctcagctttgttctcaagaaaaaaataaatagcaaagtatcaactgaacaattacttgaacccattaatgtggattcatcgtcaagagatgattctgattatgaaatgctcagctctgctctcaagtaa

SEQ ID NO: 41488 - DNA, 366 bp, Glycine max
  Peptide Sequence Number=SeqID_158266
atgggtgacgattctttcaatggaggcataacagaggtttcggaaggaaagatgctaaagaaaatgaaaaagcaacccctcttgtttgtggaactccttttctggaagactcggagggaatgccattacgtcaatgctgaatatttgttgagcgagcttgaagaaattggttcatccccagaaaatttgaagaaagaaagtgccaattggaataaaactcagggagatgaagaaattggttcatccccagcaaaggtgtggacacaggatatcaaaaagacaagcttgatgatgttattaaaggcattgcacctacctctggcagtaacagtgacaaagatgatcataagtacgtttacaacttga

SEQ ID NO: 41489 - DNA, 348 bp, Glycine max
  Peptide Sequence Number=SeqID_158267
atgggggcagtgtcttattttattggattgagagactacttagaagcactgacaagatatgaaggagtgaaggaattccatttcgagaagttgctccatcatggtcagaatgtgaaatctgggaggaggcattcatcacaacatgttctaacattcactagggacaaagcaatttcaggagggtggacctgggatgatcacaactgttatccagatttagtggaaatcattcacaaggttgtaaagctgatggataatcttcagtctcgaggagcattgaggagatatactaaagccattaatgagccttcactagtagctcaacatttttggagagttagtccttga

SEQ ID NO: 41490 - DNA, 658 bp, Glycine max
  Peptide Sequence Number=SeqID_158268
aggatttcacgtcctcaccttcagagggttacacaccctcatctgcagaggactctgcgtcctccccttgagagggctacacgccattgccttcagagggttacacagcctcatcttcagaggactatacgtcctccccttgagaggactacatgtcctcgctttcggagggctacacgccctcgcctttagaggactacatgtcctcgccatcagaggactacacgtcctcgccttcagaggacttcacgtcctcaccttccgagggttacacaccctcatctgcagaggactatgcgtccgccccttgagagggctacacgccctcgccttcagagggttacacaccctcatcttcagaggactatacgtcctccccttgagaggacaacacgtcatcgctttcatagggctacacgccctcgcctttagaggactacacgtcctcgcctttagaggacttcacatcctcaccttcagagggttgcacaccctcatcttcagaggacttcacgtcctcacctttagagggttacacaccctcatttgcagaggactatgcgtcctcccctttagagggatacacaccctcgcctttagtgggctacacgccctcgcctttagaggactgcatgccctcaccttcagaggactatag

SEQ ID NO: 41491 - DNA, 372 bp, Glycine max
  Peptide Sequence Number=SeqID_158269
atggcaatatggcaacccactgttcagatgcttgttaatgatttgatgtgcaaagtcttgccgattgcattgaaaaagaggaatgattgtgaggaactggccattacaactgttgttagtggtaatttggaggaattaaatgcacatgagaccgtcaatgaggaaagagtgagtaaaattcttgatgtgcatgttcatgttgagacttatgttcctcctacatttggtatttggggaaatggtgtacatttggctgtggtgggctatgggaggaatgttgtagctgctaaatattcagattgggtaagaaattctctttctgttctacctccagcctgcatgtgttgcctgatgacttggcttctcagatga

SEQ ID NO: 41492 - DNA, 305 bp, Glycine max
  Peptide Sequence Number=SeqID_158270
tttctatccgaggggctaggaaggcgagggcgaggccaactgattttccttccacatttgcagctcctactctagcatccacttcagcagctcctttagtcctagctcagattgattctcagcgctttgaagccatgctccagagcattcatcagggacaaatcattttacttcagagtttacaggtggtggcgcctccaggatccatgctttccattgagcagtttttggagagggtagcctggcctggggcccaaccttctcttcatagggaagatgaaggtcccacaacccaggaaccttga

SEQ ID NO: 41493 - DNA, 246 bp, Glycine max
  Peptide Sequence Number=SeqID_158271
atgagtgacaatggtgaagaagctggagaaaattgtccagttcctcatttgaatgaaaggattctttcatcattatcaaggagatcagtagttgcccatccttggcatgatctagaaattggacctgaggctcctcagattttcaattgtgttgtggagatcactaaaggaagcaaggttatgtatgaacttgaccaaaagattggattgattaaggtagaagcaaacaaaattggggaaggttaa

SEQ ID NO: 41494 - DNA, 414 bp, Glycine max
  Peptide Sequence Number=SeqID_158272
atgtaccctccactagaactgatccacaagagatgtagcctctcttgttctcagtcaacaacccaagtagatgtaccctctacttgtaccacaaaggatgtaccctccaatgtgttaagacaaagttctcaggcgggaaaaatcaaaagaatcctcagactgtgtcgttttgaattctttgacaagggagaagggagacacaaaagaattcaggcagttagtcctgcgttcttttggaaaagggagaagagagacacaaaaagaattcaagtgaaaaatttggaagggttttggcaaaagaagaagaagaagaagttcaaagagattcagaaatcaattggaaaaaagttgttgaaatgcaagtcaaggtcttgcttttatagactcttcatgtctggtcaaaagaaccattag

SEQ ID NO: 41495 - DNA, 651 bp, Glycine max
  Peptide Sequence Number=SeqID_158273
atggggtggttgggataccaaggaactgcttggagaaggcaaaagctttggcggatcaaggggccgatcgatgcctttcttgcttatcatcacagtaaggagagcctggtcatcgctgttttggccaatgaatatgatacgttcaacctgagatgcgagaagagcattgcaaggattgtctattgtacgccggctctttatgtgtggttggtctcccacattttttgtcatgaaggattcccaaacatccccttgataggaacaaggggttgtattaattataatcccatgctggccataagacaactaggctaccctatgagaggtgcaccattggaggagatcatcgcgcctttcgtcgcacgaggtttcaatgaagccaatgtgaggatacttcagagaatccataaagcatggaatacagtggaaaggaaagataaggagcttaggggaagtagcaatggcgtcatcagcggctatcacaagtggttgaggtttaggaggcaagggataacttggctcccaaagcttaaaggcccaagtgggaaagaagctgaagtccttgaggaaagtgaagaagtgcaagctttgaaagcggagctcgaaagaatgataatggtcaaggagaagctaaagacgacagtcactagg

SEQ ID NO: 41496 - DNA, 297 bp, Glycine max
  Peptide Sequence Number=SeqID_158274
atggctacaccacccagctcccctcctcctccttctccgactgattcaacatcacattccccttctaccataaagaggacaagaaaagtgacccggctgagatcaatggctactagaccagttaggacaaagagaccccgggtccatgtggatcctgcaactgggaaaaccgacgccgataaggacggtgtcgatgacactgtatgcaaaaagtacgacattagcaaggagaagtggacccaattttgtcagagccacagagacccttcatgggaggatgtgcgaaagaaggcatag

SEQ ID NO: 41497 - DNA, 249 bp, Glycine max
  Peptide Sequence Number=SeqID_158275
atgacttatcctgatgtttattgggctgaattggacttttctgcttatgtatttcctactttgtctcctgtcttgatgtttgcacaattacttgaggatttacctgtgcctcaggtgttgttcagacagctttgtatgcagatttcttctactattatttcatcagagcgtggtttggatgatgttagttttgagagtgaagggacaaggctaactcctctccctgttcatgaggggtttgtagtgtaa

SEQ ID NO: 41498 - DNA, 378 bp, Glycine max
  Peptide Sequence Number=SeqID_158276
atgacgaaatgcactacatgttgccagtgttcctgtttccccaatagcaatagcgaaatgaagcttcacaaagtcaacgaaggttgggttgaaagtttcaacggcgttgcagacacaatttcattgcctgactgcttaatatatatccatctcgtcgatatttttcttcaaatattcataatgaacccgccggaggagccatgcaaggaacaggggggctccacgatgctaatggagaccagccatgcaaggaacaggaggaaccatagcagaaccatagcaggaggagccgttgcaaggaggagctcgacgatgctgttggagaccagccgctgcagaaccagcaggttacagaagaacctaagcgaattcgcatag

SEQ ID NO: 41499 - DNA, 645 bp, Glycine max
  Peptide Sequence Number=SeqID_158277
atgtctaatttgtgtttgcaaaaggaggaggaatgcggcgctaatgctggctcggatttcagttcaggccgtcacgggagtatcatgccccctgaatccacaaccataattttgaatgatataatgacggctttgagacaaccaaatattggcatacttgggatgtatggatcgagtaatgcgaacacggaaaatgcagtggagaaagtcaccagaagagttgagagggacggattgtttaatgtggttgtgaagacatgcgtgatgaaaaagtcagatttgaaaaaaattcaaggagaacttgggaacgcattgggtctacaactccatcagaaaactctagtggaaagagctacccgtttgtgtgagaggattaagatggaggacaacatccttatcatccttcatgatcttcaagctcaaatcaacttggccaagattggaataccctttgggaatgaccacaagggttgtaaaatcttgttagtagctaagaataaagaggtgttgtcccacaaaatgaaaacccaaatagaatttgctgtggacgaggagccgtcaagttctggtctaacgaggagccatcaagttcaaactcgtggagtaattgtatggatcaaaaggtggtggtgtcctgtccagtga

SEQ ID NO: 41500 - DNA, 189 bp, Glycine max
  Peptide Sequence Number=SeqID_158278
atgcagtggaattgtggaattaagcttcaagagtcaacggcgttgcattataaaaacgtaaaaggagcaaggaagggagagaagcaagcaaacaaaactgatcgatcaaatagcagctgccagaaaacacaatttcattgcctgcctcatataatagatgatgaagatgatgaacccgtgggtaactag

SEQ ID NO: 41501 - DNA, 246 bp, Glycine max
  Peptide Sequence Number=SeqID_158279
atgggagctattgtttccattgcccgaaagctatgtctcatctttcgcaccaaatgcagaatggacgaatgggaagaagagcctctggagtcacaattacggagtagaagttatgcgtggtctttcagtggtcgtgaggtctctaaatccacgatctcaattgtgaataaaatcatgagagttcaggcaaaaccaaacattttcacacttggggtgtatgaatcattaatgcgagaaagcgcatag

SEQ ID NO: 41502 - DNA, 171 bp, Glycine max
  Peptide Sequence Number=SeqID_158280
atgatggaaatcaaacataggaaattttgtttggcggaggaatattttgaggaggaggacgagaatgctgaaaagatgggtcatgtcaccggcgagcctgaagatgttcatggtttttgccctagcgagacacacagagaaaacgttcaaaagcggaaagaggggacgtaa

SEQ ID NO: 41503 - DNA, 846 bp, Glycine max
  Peptide Sequence Number=SeqID_158281
atgaagcaaactctcttgttctcactcctactacttgcccccgttttctcaatcaccactttagctcaatcaccagctgcagcccctaaggccccagcaaaacctgcccccgctacaccggctccagtgccggcaaaaccattagtcccttcattaccccagtcaccctcttcaggtgctgattcttctggcagccaagacattgtgaagatcctaaggaaggccaagtcattcaacactctaatccggttgctgaaaaccacccaaatcatcaaccaagtgaatgcacagcttgtgacctcgaaaaacggaggcttaaccatccttgcaccagatgatggtgcattttcagagctcaaagcaggttactttaactcccttggagataggcaacaaaaagcactgatacagtatcatgttcttcccgtttatgtgtccagctccaactttgatgctctgagcaaccctgtgctgacattggccagtgacagccccacagggtatcagctaaacgtgacagcatatggtaacagtgtgaacatatcaactggggtggtgaatgccacactcacaggcattgtgtacactgataagacacttgccatatatcatgtggacagggtgctcattcctttggacttctctaagcctaagcctatagctccagcaccagctgtggccaaggctcctaaagctgataaggagaactcttcagcagaagatgaggatcagtctcaggcagccaaggacagctctggtgcaacaagttttgttagcattcatggaacaacgttggtgtcctttggagtcgctctgcttgcagcaacagctacaatgtcattttga

SEQ ID NO: 41504 - DNA, 948 bp, Glycine max
  Peptide Sequence Number=SeqID_158282
atgatgatcatgcaagaaacacaatctcttattattcccaccacaattctaatactagcactattctacaccacttcagcccaactctcacccattcaaccccccaaaacatcaccctcaccaccactatcccaaccctccccgccatctccggcacttccctcgccgccggcgaccgcgccggcgccaggattcaacactgtccctcttgtcccagtaaccccaagtggggcccccacacccaccaccatcatcccgaagggccccaccattgacatagtccaaatcctaagaaaagccaaaaggttctccgtcctcattcgcctcttaaaaaccacacaactcatcaaccaacttaactcacagctcgtaacttcaagctcaggagggttaaccctctttgcacccgaagacagtgccttctccaaactcaaagcagggttcctcaactctctcactgatagacagaaggtggagctcttacagttccacactctctcttcctgcatttcaatctcaaactttgataccctcacgaacccggttcaaacgcaggccggtgatgaccctcagaggctgcaactaaacgtcaccacttacagcggtagccaggtcagcatggccacgggcgccgtcaacgcctccgtcaccggaaccgtttactccgacaacaagttggccatataccaggtggacaaggtgcttctccctcttgacctagtgctgccaagcaaggcgccggctccggcaccggcgttagcgaaaaaggggttgccgaaggctgataaagggaattccacggcggcggacgatggagctaccggcggtgatgatgacagcgacgggaaggccttgcaggcgggtgtttctgctggttgttcgatgaagtgggtgaataatgttgttgttattggggtagtgggtttggttggtggagttttgatgtaa

SEQ ID NO: 41505 - DNA, 735 bp, Glycine max
  Peptide Sequence Number=SeqID_158283
atggcttcggctgctatcttctcgtcgctacggcggcgccggtcgccgtcgctggaggcgtttctggcgccggtcgacctctccgacgtggcgttgctggggactctcatctccgtcgccggcgacatcgcgtcctgcttctccggccaccggttccccttccagcgccggaactcgcgtgccctcatcggaaaagttgagattttccggtcaatgttagggtgtctgagagactccgccaccgccggagctcttcccccgacggcggtgctgtgcttaaaggagctctatctgcttctatatcggtcaaagattcttcttgattactgtgcccaatcgagcaagttgtggcttctgcttcagaatcattgtgtttctggtcacttccacgatttgagccaagaattttcgacccttttggatgtttttcccgttggggaagttggcctcagtgatgatgttagggaacagattgagttgttgcagagacagtccaagagggctaagttgttcatagataataaagatgatgttcttaggataaggttattttggtttcttgatgagtttgagagtgggagggttcctgattctaaggacttgagatgtttctttgtggataaattgaggattcttgatggtaagagttgtagggtggaggttgaagccttggaggagcagattgtgaaccatgagggtgatgttgagcctacagttgctgtgcttaatgggatg

SEQ ID NO: 41506 - DNA, 1275 bp, Glycine max
  Peptide Sequence Number=SeqID_158284
atggatgatgcacagggtagttcaaattctctgccccctttcctggcaaagacttatgagatggtggatgatccttccacggattcggttgtttcgtggagtgtcactagcaagagtttcattgtatggaatcccccagaatttgccagggatttgctgcctagattctttaagcacaacaacttctcaagtttcatcaggcagctgaacacatatgtaagcaaatttgatcttgatcttgttgatggatttaaaaaagttgacccagaacaatgggaatttgccaatgatgactttgtcagagggcaacctcatcttatgaagaacatccatagacggaagcctgttcatagccattctttgcagaatctccaagcacaaggcccgctaggggaatcagaaaggcagagttttactgatgaaatagagaagcttaagcatgataaagagcaacttctcgtggaattacagaaataccagcatgagtggcaggcatatgagatacaaatacattgctcaaaagatcggttggaaaagttggaacagaatcaacaaaggatggtttcttctgtttctcatgtattgcagaaacctgtgatttctgtaaatatcttgcctctgacagaaaccctggatagaaaacgaaggttgccaagaagtggccacttttatgatgaagatggcgttgaagatgccattgaaacttgccaaatgttaccaagagaaaatgcagaccataccactgtcttgacattaaatgtggagcgactggatcagcttgaatcatccatggcgttttgggaggctattgtacatgatattggtgacaccttcgttcaaattcagtcaagtatggatttggatgaatctacaagttgtgctgatagtccatctttatcttgtgcgcaattagatgttgaagttcggcataagtcaccgggaattgacatgaactctgagccaactacagctgctgttcctgagcctgttgcatcaaaagaacaacctgcgggaaccactgttgcagcaactggtgttaatgatgtattctgggagcagttcttgacagaggatcctggtgcatcagaaacacgggaagtgcagtcagaaagaaaggattatgaaggcagaaagaatgaaggaaaacccagcgaccttaacaaattttggtggaacaaacggaatgcaaataatcttccagaacagatggggcatggtggttctgatgctgttgtggacattaactcaaccacaacaatgtcatccacaatttga

SEQ ID NO: 41507 - DNA, 1350 bp, Glycine max
  Peptide Sequence Number=SeqID_158285
atgcaaaagaagggggggaagaggttgattacactggaaattgctgaaacgtttttgactgttcctaaggagttctgttgtcctatatcattggatttgatgtgtgatcctgtgataatttcaacaggtcaaacttatgataggaggtctatatggaggtggatggaggaagggcattgtacttgtccaaaaacggggctattggtttctcataataggcttgttcctaatcgtgctcttaggaatttgattatgcagtggtgcagtgcacatggagtaccctatgatccacctgagggggttgatgcatctgttgagatgtttttatcagcttgtccctccaaagcttccctggaagctaaccaagggacggccacgcttctcattcagcagcttgcggatgggtcacatgctgcaaagactgtggctgctagggagataagattgctggccaaaactggaaaggaaaaccgtgccttcattgcgcaagctggggccattcctcatcttaggaacttactttcctctcctagtgctgttgcacaggagaattctgtgactgcactgctcaacctatccatttttgaaagaaataaaagcatgatcatggaggaggaagggtgtttgggatcaatagttgaggtgttgcgattcgggcacaccacagaggcaagggagaatgctgcggcaacattgttcagcctctctgctgtccatgattataagaaacgaattgcggataatgtgggagctgttgaagcattggcttggttgttgcaaaagggtactcaaagaggaaagaaggatgctgtcacagcattgtttaatctctccactcacactgagaattgtttgagaatgatagaggcaggggccgtgaaagctatggttgtggctttggggaatgaagtagttgctgaggaagcagctggtgccttggtcttgattgttcggcagccagttggtgccatggcggtggtgagggaggaagcagcgataaccggattgataggaatgatgcgttgtggaacgccgagaggtaaagagaatgcagttgcagcattgttggagctgtgcaggagtggaggtgcggctgctactcaaagagtggttagggtgccggctctggccggattgcttcaaaccttgctctttacaggtacaaagagggcaagaagaaaggcagcctcacttgctagagtgtttcagagacgtgaaaatgcatctctacattatgctggattaggtgtaggttatgcatttgctagcgattcagcttcaaccaggaatactgcaacctttgtgagtgatgtttcacttccaatgtccatttctgtttctgttttatag

SEQ ID NO: 41508 - DNA, 306 bp, Glycine max
  Peptide Sequence Number=SeqID_158286
atggacctctgcgacaaggttggcagtgacaaaggatgtacgcaacgtgagggggaggcgctccgcaacaagggtggagcgaagggacctcacgcaatgatgaaggaggagcaaaggggacctcgcacgaggatgaaggaggtggcagtgttgcggcacgtcaaaggttggagcgaagggcgatggcgatggcaaggaggtggcggtgttgcagcgggacggaggtggcgtatcggagttggtgaggaggaggtggggaaggtaatgaccttacggattgcgaatttgtttgaaggattcatatag

SEQ ID NO: 41509 - DNA, 276 bp, Glycine max
  Peptide Sequence Number=SeqID_158287
atgaagatgaaagcaagcaaaacaagaaatgaattgaaagtctcggattcaaactcttaccggttgaagaacgaaaaacggaccaagaaaagtgaagaatggaggaaaatcttcacagatttgctcacggaaacatctcggaagcgttacggaagcacttcgactcgatttttcttcacggaaacgtggtttttacccaaaatagccgaaatgcatagcctagggggaaaaagggaggtgcttgccgcccagaggcttcttgaggaagatttctaa

SEQ ID NO: 41510 - DNA, 153 bp, Glycine max
  Peptide Sequence Number=SeqID_158288
atggactcaggaaggttccaagttagtgtaccaggtagcagtcaccccaggcaagtagtccccttgttctcgtcaaagttcgacactttgaacttgggaggggtgatgatattgggtactagaaacaactcttctaggttagctaaggcataa

SEQ ID NO: 41511 - DNA, 255 bp, Glycine max
  Peptide Sequence Number=SeqID_158289
atgaccccttcacagcaatatcatggcccaattccaacacctaatgccccgttaggaacacaatggaatgtaccgggacaaatacctaatacgggtgacttattcggtgttgatttgcggcacgcattttctgcggaggctgacgaagaagaagcggggaggcatcggggcagaagaaatcctgatcgccaagcacgacgatgggatcgaccatgtggcacatcctcacgacatcacggacaccaaaatgaatga

SEQ ID NO: 41512 - DNA, 273 bp, Glycine max
  Peptide Sequence Number=SeqID_158290
atggagcttgtgtttccgcaacaccaccgaacgattgctggcttgcagaagtatcagtgtgatgaccctgaaaaggatattgatacatctgggtcggatactcagcaaatgtttgtggcgtgtaatacattccatggccacgctccgccatttgttgagaatattcttccgcttcaacaatgtcccttcttctgtctatcccctgagtttcaatacttgactgaagcatgtgaaactgttgtgcaggaaattgacgctctgatgcgggaccat

SEQ ID NO: 41513 - DNA, 348 bp, Glycine max
  Peptide Sequence Number=SeqID_158291
atgtaccctccacttgaactgatccacaagagatgtaccctctcttgttctcagtataacaatccccaagtagatgtaccctctacttgtaccacaaaggatgtaccctccaatgtgttaagacaaagttctcaggcggttagtccgttgaaactttgtgaaggggaaacaaaagatatctcaggcgaacaaggtttagaaaccagaaaactcataaagcttttggcaaaggaagaagaagaagaagaagttcaaaaagatgttcaaagagattcaaaggttgtaaaagaatatgtgaaaagttattttcaagtacataaaatgcaagtcaaggtcttgcatttatag

SEQ ID NO: 41514 - DNA, 388 bp, Glycine max
  Peptide Sequence Number=SeqID_158292
aattccaagctcatttggagcacaaaatttcgtgctcttctctccctctcccttcattcatctccttcttcctccaagctcttatccatggtctcctatggtggtgagcttcttctagactcatctttccctttgaagtggcgtctcctctctctctctccctttctccattctaactgccattcatcttccaagaagcaaaggaatcccttgatgaagaagatcctaagccttcaagctccaatggagcttgcatcaggtatcatcactcaagataataatattgtgacggcgaggctcacaggtgcactttccaaaggaggaaatatgcgcggagtcgccaccaacgtttatttgtggaaaacgtcgggaaaactgaaggaaaccg

SEQ ID NO: 41515 - DNA, 687 bp, Glycine max
  Peptide Sequence Number=SeqID_158293
atgggaaggccacgcattcggttgtgttttggtcgcgccacgcctcgtgttcgagccttttctgcatcttcttttcgatccaagtccccttcctcctcctctgcctcaatcaaatgtgaaaacaggactgagttttcaagcaacggaggccacgaagctggcagagacaacaggggtgaaacgggaaataagatactggtggttgttgattctagctttgaagctaaaggggctcttgaatgggcactctctcacactgttcagacccaggacactgttgttcttgttcatgtagccagacccacaagggaaggaactgaatctggttcgaagtttaatgtgaagacttatcaacttctccttgacatgaaaagcatgtgcgagatgaagaaacccggggtggtagtgaatgtggtgatgcttgaaggagaggaaaagggtgttgcaatagtgcaagaggcaaagaaacagagggtgtcattattggtagtgggacaaagaaaacaatccatcttggggtgcatcatgcggaggtgggtacgaagaaggggaacaagacctgggattgttgagtattgtatacagaactctccttgcatgaccattgcggtgaggaggaagaataagaaacatggaggctacttgattaccaccaaacgccataaaaacttttggcttttggcttaa

SEQ ID NO: 41516 - DNA, 317 bp, Glycine max
  Peptide Sequence Number=SeqID_158294
gaaaactgggttatagaacacgaaaagctcaaggctagggtggaggtactacagcgaaatcaaaggaattttatgggagaagatctggacagcttaaatcttagaggacttcagagtttggaacaacaacttgattctgctctcaaactcattagatcacgaaaggataagtcactccgggaacacaacaacttgctctccaagaagataaaggataaagagaaggagctggccccacaagagcaagatggactgcaaaataacatggatgtgacctctgtccttgtaactcaaccaccggagtccctgacaattgg

SEQ ID NO: 41517 - DNA, 114 bp, Glycine max
  Peptide Sequence Number=SeqID_158295
atgggagtgaatcccaccttgcaaattgggtacaaccagactaatccacatgatgcaaacgttggagcttcatccttaagtatgcatggattcgcctctgagtggatgctttga

SEQ ID NO: 41518 - DNA, 861 bp, Glycine max
  Peptide Sequence Number=SeqID_158296
atggacaacctgaaaagcaaagctgaagatattgggaatatggctgggatttccatagataagcaacaacaactcttagaaggacaatccacagcgcttgaggaactaaactcattgactgagtttcaatccaaagcactagaagagagcaggaaaacccgacaatattttgctgaatatgggcatagacaacatgaagaacttattcagcgtcaacaacaaattcaaggatttcatgatcgtttaatggaaaactcaagggaaatattgtcttctcaggaatcttttgaatcaaagcaggcttccatgtttgttgtttttgacaggatttttgctttgcaaaataccttgttacttgaatcaagaatgatcaaagctttcttcgtttattccattttaatctttgtcatcttcatgttgacaagtacaaagcaaacatacaatatcaggccattcctatatattgatctatatgttattctctttgtggaagtactcattatccgtttaacaagtgataacattgagcaccaaagctcgataataaacattgccagattatttttcatggtagcagctttaattcaacttctacatgccattttcacttacaagaattatgagaccttgaaccatcaaatgctgctaactctgataaacaaggttaacagcatgcaaaaagaaaaggagttgccatgggacttgtatactgattatgagggttggtcggaatggatagatgccgatttacccgatgatgtgaattgccttgatgatcctgaccatatacaagaagttgcagagaatccaatcacagttacaaaaaattacaatctacgcaatcgcaatctttttcattga

SEQ ID NO: 41519 - DNA, 330 bp, Glycine max
  Peptide Sequence Number=SeqID_158297
atgatgaaaacactggagaagtaccagaagtacagctacagtgcactggagaccacccgtccaattaatgactctcagaactatcaggaatatttgagattaaaagcaagggtagaagttttgcaatgttctcaaaggaacctacttggggaagatcttgcccaaatgaatacaaatgagctagagcagcttgagaatcaactggagacagcactgaagaatattaggtcaacaaagactcaattcatgcttgaccaactttctgatcttcatcaccgggaaacattgcttattgaaaccaataatgtgttaaggagtaaggtgatctga

SEQ ID NO: 41520 - DNA, 285 bp, Glycine max
  Peptide Sequence Number=SeqID_158298
atgggaagagggagagttgaactgaagaggatagagaacaaaattaacaggcaagtcacatttgccaaaaggagaaatgggttgctcaagaaggcttatgagctctcagtactttgcgatgctgaggttgccctcatcatcttctccaaccgtggcaagctttatgagttcagcagcacctcaagatgttgttttgaaaaagctttgctgcttcttctatttcagatgggacacacataccctcccggactagggcaagatcatttctggaatagaagagtgtaa

SEQ ID NO: 41521 - DNA, 468 bp, Glycine max
  Peptide Sequence Number=SeqID_158299
atgatcttcatgaaggatgacatagagaagttggtatctaagttagtagacaaggtttgtgctccggaggaagatatagatgctctcataatactcacaagtactgtgtcacagataaaacctgggtttgatccaaccaaaggtctaagaccagagttctattttgatggtgatgatgcatatcctgaacatgatgaattgtctagcataaagaatcaacttctacagggttattccccgatgattcatatccatcaggacctccattatttatggagacaccaagaccatgttctcatcttgcttagattgagttcccaaattttgatgagaggcaaagttggagttgttaatatgccaagatatgatcctattgccaaggaagctaaacaattgattgaggcagaagggtctttcactcttcagaagttggagacattcaagtcgcggaaccgttggaagaaatga

SEQ ID NO: 41522 - DNA, 420 bp, Glycine max
  Peptide Sequence Number=SeqID_158300
atggaggacgtggtggtccacattgtcctcgttgtaactattgcaaccattatgtccatgttgaagtcgaatgtcacaccaaaccaagagaatagtcaaacaagttgcctccccttccccaactgcaaattgtatcgggcaacgattggagtaggacatgagtctggaggatcataccactcaactgcctccctagaacttgctcatcaacgcctcaacaaccctagtctaggcaatctatgccttttggttcctagtctttctacagttacatctcttcaatgtgagtcatgtctaaagaagtcttccgtgtcttggcccgtgactcgatcctacgctaagattcataacaatagtcccctggctgttcagcctggtgttctgctattgactattggctcccaaaagggtttcccttaa

SEQ ID NO: 41523 - DNA, 315 bp, Glycine max
  Peptide Sequence Number=SeqID_158301
atggaaatgcagacctaccttggtaagcttgaacgtttaattgctgattataacactctcatgccctttacgagtgacacaaagacatttaataagaagcacatccagttctttatggtccttgtccttgctgtcgattgttgcaacaagacttgcgatcaagcgaagtcaatgaatgtggctcaagttgccttccctgcccaggctgcagttgcctctcctgccttggttgcagatgttactatttcttctgctgggtacattcagcttcgagcagcccaacatcctgcattacctgttactgctatggcttag

SEQ ID NO: 41524 - DNA, 366 bp, Glycine max
  Peptide Sequence Number=SeqID_158302
gttacaggatgtacaatttgtggtggagctcatgaatctggatgttgtatccctaatgaagagcaaattgcacatgaagtcaattatatggggaatcagcccagaggtaatttcaatacaagtggatttccaggatttcagaataacaaacagtatcaacaacagagacaatggaaaaatcaccctggtaaccaattcaatagagaccagggtggttcatctacaaggccacagcaacagatgccaagtctctatgaccgaaccatgaagctggaagagactctagctcaattaatgcaagtgtcaatgtctaaccaaaagagcactaagtctgcaatcaagaatctggaagtccaagtgggctag

SEQ ID NO: 41525 - DNA, 159 bp, Glycine max
  Peptide Sequence Number=SeqID_158303
gcggccaaccaccgagggcaggtgcagatacacgagtgtctctaccagctcagccctagtcaacagggccagggtttcgctccttttgcgtgccctactccagatcagtttaggactgaggtcgcatggcccggagattggcccgaggcccaggcgtag

SEQ ID NO: 41526 - DNA, 1521 bp, Glycine max
  Peptide Sequence Number=SeqID_158304
atggcaactggtcctgctgattcttatactgaaaccaaatgtggtgtttgtcatgccgggacagatgaacatcttctactactttgtgatctttgtgatactgcttcacacacatactgtgttggcctgggctatactgttcctgaaggtgattggttttgtcacgattgtgctatttcccggaagatcaatatcaaggaagactcggaccaacaaaatgttgtgccaacagctgagcccagagtaaccgtcgatatctttgatattgtgagggaaacaggcagccaggtggttcagagaccaagggcatctcctttacaacagaacctttcatctccttccgttattcctttacctgataggttaagttacttaagtagattaaaaggaaaaagacctgtcacagggttctgtcatatgcagcggaatgtaaaggcttttcgtgaaaattggaatgctttgagaagtggttcattacagttccgttgcaattcatctcaacctggaagcacagttagtcaaaaacaagattctagttccttatcacatcacaaattggatgatttgcattctatggcttccacaagccttcaacaatcgactgtccaaggtggtccttctaataaaatgttgaatgagagagtctttaaagatgctgacaaggcatggaaaatgatggacagggcaaagaaaatacaactgcctcatcatagaacaggcagagtagataaaccctcatgcagtggaggagctagaaaaatatcattagcacattgcaacttctccgaagtgaaagatcaacattccaaagcattagacttgaggaacactaaaaaagagaagcagtgtgactattctaggctcaaccagaatttggaaaatcgctctactctgaagttggaagagaaaaggcaaagtagggatacatgtgagaagatgatacatgtgagggaccatactactcattcaaaaggatattgtgaacgcccattgtcaagaaaggtccatactagtatccagggtggtccctgtcgtgaagatggactgagaaatgttgctgaggaacaaagcttgtatgcttgcttggtaacatcagcagatttagcttcctctcgtgacaaatttggcagtatgttctctaataggggtgtgaatcttgttaatgaagaaaagagattggctaaaagctctgaggatggaaacacaagaaatattgttgattcaaaaactgagatccagtctcttgttaaattgaatctgaagctcttaactagagataaaaaattaggctttgataccttcaaggtagttgcaaggcaggccactcataccatcttggctgcttgcagttctgatcagcaaaagtctagtacatcctcctctagctcatggtttagtatatacgaagcgttagattggttcaagactccccttataaaagtagcagttttaatggcccagtccatagaaaatttgagcagcagaattgctagaggaaataaagctgatgctggggcgtag

SEQ ID NO: 41527 - DNA, 714 bp, Glycine max
  Peptide Sequence Number=SeqID_158305
atgcgtcctgctcggtgtaagggtacggttgagagatttaggaggccaaaaacacgagggaagggaaagtttaagggaagttacctcaagacccatgatttcttgcagccactagaacgggtagaaacaaaagcctgtgcaaaggaagaagccacagaagaaatattatcggtggttcaaaagcaacgtccaccttcagttgagcacctcttacctggaggaattgggacttacagtattagccacatttcatatgttaataataataataatcaaaggggggttctgaaaccagagacatcatcccttttcgtgcgtcaagcaactagtacggataagaatgaagaaaactctaactgcagttcatatacttcaagtggttttactttgtgggaagagtcatcagggaagaggggaaatacaggaaaggagaataatgcgggcgagaaaccctctctaggagtgacagagtctgcagcgaagctagggcagtggacatcaacggagcgaacgtcacagtcgttttctaacaatcgtcacggcggtttcagctctcgctcttcatctcagacaactgggcagaagaaccagagttttattgaaatgatgaagtctgcaagggatagtaatgcccaggatgaagtgctagaaagcgaggaaacattttttctcaagaaagaaccctcctcgaatacccaaagaggtatgttttaa

SEQ ID NO: 41528 - DNA, 864 bp, Glycine max
  Peptide Sequence Number=SeqID_158306
atggttaacttattccaaatgctaagagagcttattccacacagtgaccaaaagagggacaaagcatcttttttattggaggtcgttgagtatattcattttttacaagagaaggtgcacaagtatgaaggttcatttcaagggtggagtaacgagccagaaaaattgatgccatggagaaataatgacaagccagcagaaacttttcaacctcgtggcactgataatggatcaagtccatctccaacactgctgtttgcttcaaaggttgacgagaaaaatattaccatctcccaaacaattcctgggagtacccagaatgtagaatctggcttgagctcagcaactacccccaagacaatggatcatcatgctggaatgatgaacaaggcttttccaattcctattccttcacagctaaatttcttcactccaacccaaataggtggtccaggtggagtagtatctcagctaacacatagatcagcatcagatgctgagaaaactaaatatcaaccttcagtggaatgtcagactatgactgctaccaatgaaaagctgaaagagaaagagctcactattgaaggtggtgccattagcatatcaagcgtttactcaaaagggttgttgcatacgcttacacatgcacttcaaagttcaggggtggatttgtcacaggctagcatctcagtgcaaattgaacttggtaaacaagcaaacatcagaccaagtgtaccagtgtcagtgtgtgctgctaaggatggtgacgttcattctaacaatcaaaagatgatgcgctctagagttgctagctctgggaagtctgaccaagcagttaagaagctaaagacatgcagaagttaa

SEQ ID NO: 41529 - DNA, 528 bp, Glycine max
  Peptide Sequence Number=SeqID_158307
aattgtgtggttgtgtggtgcggtttcgatttggataataagcgccgtctgcgcttctctggcggaagaagcggtgtcggcattggcgaatggtggtttcgtgagattgttttaagttcgatctggggtgaagcaaggatctcggcagagtgggaaggtttgatgggtctgaagaagtgggagagtaaggttcagaaagtgggaatgggtgtgttaggttcggggggttcaggttcaggttcgggttcgggttcgtcgcggtcgagaatgaagatgtggatgatacgggcaaccacatcggtgttattgtggacctgcatcgttcagttaacggcgttgggtgacatgtgggggccgagagttttgaaaggttggccttcttgtttcactcacgagtctgccgttagagcaatggatgtcgagttaccgtcacagcgtccacctcttctccctcccaagagggtttataaaaacaatggataccttatggtttcgtgcaatggaggactcaaccaaatgagagctgcg

SEQ ID NO: 41530 - DNA, 394 bp, Glycine max
  Peptide Sequence Number=SeqID_158308
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatccaatatctggagttcctttttgtatattatatggatgatccgatcc

SEQ ID NO: 41531 - DNA, 429 bp, Glycine max
  Peptide Sequence Number=SeqID_158309
atggctgctcgacgaaccgatggggccggcacagatcgccggcaccgtgctggtgctgatcggtgtactactggtgacccgcctgcggcgctgacgccggagcaggcgcgggcgcgcatcctggcggtgatccgcgcgatcccggcggggcaggtgatgggctatggccaggtggcgatgcgtgccggcctaccggggcgtgcgcgcttgaccgcgcgcatcctcggccagaacgacgatcccgacctgccctggcatcgcgtgctgcgttcggacgggcgcattgccatggaagaagggtcggctggttggcgcgagcagtcacaacggctgcgtgccgaaggtgtggtggtggagaacggccgggtgcggatgccggccaccgatccggccgcggcgctggatgccgccgtgtggggcccgggctga

SEQ ID NO: 41532 - DNA, 531 bp, Glycine max
  Peptide Sequence Number=SeqID_158310
atggaggccgttccatgccggtgctcccatgttcccgcgactgcctaccgtcaccaaggccctgttgatcgccaacgcgatcctgttcctgctgcagcagccgttcctgctcggcatgcagaccttcgagccgttcatgctgcaaccgctgcagcagggcttcgatgcgttctcgccgggcggcaacttccagccgtggcagctgctgacctatggcttcctgcatggcagcttcggccacctgttcttcaacatgctggcggtcttcatgttcggcgcgccgctggagcagacctggggcgagaagcgcttcctgctgtactacctggtgtgcgtggctggcgccggtgtctgccagctgctggtgggtaccctgctggagaatccggccacggtgctgggcgcctccggcggcgtgttcggcctgctgctggcctacggcatgctgttcccgaaccagcgggtgatgctgctgttcccgccgatcccgatgaaggcacggaccttcgtgatcctgttcggtgtgggtga

SEQ ID NO: 41533 - DNA, 264 bp, Glycine max
  Peptide Sequence Number=SeqID_158311
atggataagtggcaaagacgatctccacaaacacgatctccacaatgtggttgcagtcacagaagcgcaggcgactttgacacaaagacgatctcaggcagaaggagaaagaagaagaacgatagggttcaagcgcgcgggttgtacaatttcagaagtttaatatataatgataacaacatcggttttttaaaaataaccgatgttaacatcaactacgtaacatcggttataataaaatcgatgttaacatcgactccataa

SEQ ID NO: 41534 - DNA, 510 bp, Glycine max
  Peptide Sequence Number=SeqID_158312
ggtggacccttgggtactagtaccctcacccttagagggctacacgccctcgccatcagaggactacacgtcctcaccttcagagggctacacgccctcaccatcagaggactacatgtcctcgccttaagagggatgcacgccctcgccttcagaggactggacgacctcaccttcaaagggctacatgcccttaccttcagaggactacacgtcctccctttcagagggctacacgccctcgcctttagaggactacatgtcctcaccttcaaagggctgtacgccttcgccatcagagggctacacggcctcaccttcagagggttgcacgccctcgcctttagagggctacacgcccccgccttcagaggactacatgtcctcagagagctgcatgccctcaccttcagagggttgcatgtcctcgcctttagagggctacgcattctcaccttcagagggctccatatctgcgccttacgagaatttaaggtcctctgcccttaa

SEQ ID NO: 41535 - DNA, 529 bp, Glycine max
  Peptide Sequence Number=SeqID_158313
gatgagtacgccaagatatcagcagaaagggaagcaagggaaagggtaattgattcattgcaccaagaggcaacaatgtggacggacttcgatttactcttacctagaacaggaaacaagaacttcaatttctgtgatcccttacaaaggcgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccagagatacttaacaggaa

SEQ ID NO: 41536 - DNA, 270 bp, Glycine max
  Peptide Sequence Number=SeqID_158314
atggtgaggaaagaacaagtagatatgttgtgcttacaagagactaagaaggcagtgatagacaaggccctatgtcaagttctatggggtgatgctgaagttagacggaaaatgcagccaacaattaataggaagggacatgggctggtgacagtggaaaaggtacatggcgggggtagcatgaaggaatttaatgattggaatgttgacttagaggttgaggacagtggtgttccaagtggcaaggctggactcagcttatcatggacc

SEQ ID NO: 41537 - DNA, 1128 bp, Glycine max
  Peptide Sequence Number=SeqID_158315
atgggcgggcgggtagggcgccgggtcggcggcgggcagggctacggtatcagagaatgccggccgccgccgccagcgccgccgccttgcgcgcgatggccgccacgccgaagctggtggccagcgcctggccgtccagttcggccagggacacccagcgggcgtccagcgcatcgtcgccggccaccggttcgcccgactgccagcggcacagtaccgcgaccaggatgtaatggcggcgcagcgcgccgctgtcgtcgtggtcgaacacgtcgacggcgtcgaacacctgcagcgcctgcgcgcgcacgccgcattcttcgaacagctcgcgcgcggtcgcgtcttcgaggcgctcgccggcctcgatcttgccgccgggaaaggcccagcggccctggtccggcgggttggcgcggcgcaccagcagcacgtggccgtcgcgcagcacggcggcgatggtggcggggatggggcgggaaggctgggcggtcatggcaggtcgggcgagaggccgtcgagcatcatcgccaatccatattcgaaggtcgcgtccggtccctgccggtccagcgccttcatggtgcgtgccagggcgggcgggggcgcgggcggcgcgacgcgctcgggcgcggcggcctcgccggcctgctgttccatcaccgagccgaccacgtagtggctgatggccaccagcgcattggcggcccgcagcggcgtgaagccggcgtcgcacagcagcttgatctgcgcctggacgcgatcgtattgcggttcggcggggcgggtgccggcgtggatgcgggcgccgtcgcgataggccagcagcgcgcggcggaagctgcgcgcgttggcgtacaggaattccttccaggggccgcccggagacggcagggtatgcatgtgctcgcgcatcatggcgtccgacagcgcgtccagcagcgcctgcttgctcttgaaatgccagtacagcgccggttgctgcacgcccaggcgttcggccagcttgcgcgtggtcaggccgtccacgcccacctcgttcagcaagtccagcgcggcggcgatgacggcgtcgcgttgcagtttggccatagggactccttgttgggcttgataatttatcactga

SEQ ID NO: 41538 - DNA, 1023 bp, Glycine max
  Peptide Sequence Number=SeqID_158316
atgtcccattcttttatgccaaagctcagaagatgggagttgcatcaaatggatgtgcataataccttcctacatggtgagttggatgaagaggcacccagatgtttgtttgccaagttggcaacggcgctaaacacgtatggatttcaacagtcatattctgattactcactgtttacttttaaagatcgacatgttcaactccacgttcttgtctatgttgatgacctgattatatctggcaatgatggggtggctatgcaaaggttcaaagattatttgagtcagtgttttcatatgaaggatttaggaaaactaaaatacttcttggggattgcagtggcacgaaactcggaaggtatcttcttgtgtcaacgtaaatatgcgttgaacatcatttctgagactggactgttaggagctaagccggttgggactcctcttgaacaaaatcataaattagcacttgctatgactgctgattgggataatcttggacagtatagacgcttgatagggagactaatttacttgacgcttactatgcccgaactgtcttattgtgtgcatatacttgcacagttcatgcaacagccgaaagaagaacattgggaggcagctttgaggggaaatccaggacaaagtattctattgcgtgctgattgtcacctgaaactgtatgcttactgtgattccgattgggcaagctcttcgccaatctcttggaagaccaagaagcaacaaatagagtctcggtcttcggctgaggcggaatataggtccatgacaaccatcacttgtgagttgaaatggttgaaaggcttgttgtctactcttggtgtgatgcattcgggacttgtgcttctgcattgtgacagtcaagcggctttgcatatagctgctagtccagtttttcatgaacgaacaaagcatattgaagtagactgccactttgttcgtgatgcgatccaaaatgcattcgggatcctcatgcttcaccttgaagggggtattgaagattga

SEQ ID NO: 41539 - DNA, 951 bp, Glycine max
  Peptide Sequence Number=SeqID_158317
atgaccaaaaagttgattacagttgcttggcgtaacctgtgtaggccgaaagctgaagggggaattggtatccgttctatctatgccattaacaaagcatccatgatcaagctggcttttgattttgtggcaaaagatgagcagtgggcaatcatgttgagagctagagtcttgagaaatggaaaaccccccatagtctcttacttggagcttcctgatcaacttgcccttcaagctacagttaatttgtttattcaaaactcctcctgggtcattcttaatgttatccagcaaaatcaccctgctcttgtgcagcatattagagaaattgtcattcctttggagcaaaaagaggatactatgattttggatcattccaccaatggtcgtctgaatctcaaggaaacctacaaacatcaagccatatccattgtgtctagcaaggttaatattactggtaatagcactaaggttgttatgggcccctctgtttctgagcttctcatcttaaagcatttgggtattaatggccaccctaggaagttcattcgcatcaaggaggtcatttggtgtccccctaagtcgggttggattatatataactcggatggctcagctcatggatacccagtcatgggagcagtcagagccattgagttggcggacagatttggttggtctaatctctggctggaaagtgattcagctttagtggtccaatcttttgctggtgtttctttgatgcattgttctcttaggaatagatggttgaattgtacagctataaccaaatctttctgctttgtggttggtcacatttatagagaaggcaatgtctgtgcagatacgcttgcctctaaagctacttctatggctgggttctgctggtggaaatccaccccatcttttttggtagcagagctcaataggaacagaatagggcttacctag

SEQ ID NO: 41540 - DNA, 249 bp, Glycine max
  Peptide Sequence Number=SeqID_158318
atgacaattgtggtggatgaagccattaggtcaaagcgttcttggggaggttgcgagatcgtcttcagttttcttgttgaggaattgcttcatttgaggaagtttatgagcctaactgaggaggtcatgaatgagttaatgtatctccttgaagctcatgctgataacatgtgttggaatatccttgcaaggccaaaacaccctaacgcactattggcgtgtcatctcggtgagagtgatagtgtctag

SEQ ID NO: 41541 - DNA, 384 bp, Glycine max
  Peptide Sequence Number=SeqID_158319
ggaaagggaagaatcaaaagaattctcagactgtgtcgttttgaattctttgacaaggagaagggagacacaaaagaattcaagcggttagtcctttgttcttttggaaaagggagaagagagacacaaaaagaattcaggcggttagtccttggcaaattctttttggcaaagggagaagagaatgaaaagatgaatagcacaagttttcaaggtttagaaaatcagaaaactttgaaaagattttgttacaaagaagaagaagaaattcaaagagattcaaggcttgtaaaggattgtatgaataagtgttcaagattcttaaaatgcaaaacaaagccttgcttttatagactcttcatgtctggtcaagacaaccattaa

SEQ ID NO: 41542 - DNA, 396 bp, Glycine max
  Peptide Sequence Number=SeqID_158320
atggcagaggtctccacagaggccattgcctccctcgcccaatattatgaccagccgttgaggtgcttcacctttggggacttccagttatcacccacggtggaagagtttgaagaaattctgggatgccctctgggaggaaggaaaccatacctattctcaggattttatccctctttagctagaatttctaagatagtccaaatctcgacgcaggaattagaccacagaaagcaagtgaaaatgtggtggttggagtaccaaggaaatgtttggaagcaaaagccagagtcttggcaggaaaaggcagcgattgacgcttttcttgcctttcatgaccgcaaggaaagcccggttgtcactatcttagccgatttatatgacaccttcgactga

SEQ ID NO: 41543 - DNA, 310 bp, Glycine max
  Peptide Sequence Number=SeqID_158321
atgaaggttgatatggagtccatgaaggaacatatgacaacgatgatggaagcaatgatgagcatgaggaagatgatggaggataatactgctatagttgttgttgtgagtactgctactgagatggacccgattcacccggccggtttcattcaagtgaatcgtccaatctcaaatgtagtaggtcaaaaaggcgaggcaacgaaaaatgcatgtgggccttatcatgttcaggttcagagcaagcattccttcgcaccatatgggttgcctcctaattatacaccacccactgttgtgtatgcttcta

SEQ ID NO: 41544 - DNA, 327 bp, Glycine max
  Peptide Sequence Number=SeqID_158322
atgtcagagtgggaagaagacccagatgagtatatacagaagaatcttccttcagatatagatgaaatttcaggatggagagaggatttattcactgctagaaaaagtgcagtaaacttacttggtgttatttcaatgtcaaagggtccaccaatggagactgccactgacagtttatcagcttcatccaagcgtaaaaaaggtcaaaagaacaaaaaaagcaatcaacgccgctctatgggggagttattggtgcttccatttttgtccaagtttcccattccttccgcttccaacttgtctcaaaagaaaatcttgaatgagtga

SEQ ID NO: 41545 - DNA, 978 bp, Glycine max
  Peptide Sequence Number=SeqID_158323
atgaaaaccacactctcactctctcctttacttctcttcctactcttctccctagtccaaggactcacccccaaatgtgacacccaagaccatggctcaacccttgaagttttccatgtgttcagcccatgttccccatttaggccatcaaagccactctcatgggcagagagtgtcctccagctgcaggccaaggaccaagccaggctacagttcctggctagcatggtggctgggaggtcaattgtgcccattgcctcaggaaggcaaattattcaaagcccaacttacattgtgagggccaaaatagggaccccaccacaaaccttgctcttggccatagacactagcaatgatgctgcttggatcccttgcactgcctgtgatggctgcacttcaaccctttttgctcctgaaaagtccaccactttcaagaatgttagctgtggctctcctgaatgcaataaggtacctagccccagttgcggaacaagcgcgtgcaccttcaacttgacctatggtagctcctcaatagctgctaatgtggtccaagacactgttactctagccactgaccctattcctgggtacacctttgggtgtgttgcaaagactactgggcccagtacaccaccacaggggctattgggcttgggccgaggcccattgtcattgttgtcccagacccaaaacctctaccagtccacattctcttactgcttgcccagctttaaatcacttaacttctctgggtcactgagacttgggcctgtggcccagcccataaggatcaagtatacccctcttctcaagaatcctagaagatcttccctctattatgtgaacttgtttgcaattagggttggccggaaaattgtcgatattcctccagcagcgttggcgttcaatgcggccaccggagccggcaccgtctttgattctggtaatgcctttctacccagacatttaagaaaataa

SEQ ID NO: 41546 - DNA, 543 bp, Glycine max
  Peptide Sequence Number=SeqID_158324
atgatgtgggacattcctaatatctccaaaagcctcagtgatcctcaaggtcttggtgagtatggacacattttgttaattggatgtatctataagactattgcaaaggtgttaccaaggaagttggaaggggtactcaatacattgatgagagatgagggaaatacttggattttgtgcaagctaaatttctatcttagtcaatggaagtcccatctcagaatgcactccacaaaaaggagtgagacaaggggatcagtcggcttcctttctcttcctcacggaagtggtcttatgagacaagctgtagccaagaatccttttaggagttacaaggtggataccttcttcaatttgccaatgacactatttgtggggatgcttccttgcataatattggagagaaactttctatgggtaggtttggaaggaggaataggaaaattgcctgggaaaatgggaactgtttgccttccaaaacagaaaggtggcttagggattaagaatatctccgtatttaatgagcccttactagcaaagtga

SEQ ID NO: 41547 - DNA, 288 bp, Glycine max
  Peptide Sequence Number=SeqID_158325
atgggaagatccccatgctgcgatgagaatggccttaataaaggtccctggactcccgaagaagatcaaaagctagtccaacatattcagaaacatggccatggtagttggagagccctccctaagcaagctggtttaattgactctagtaggaattatgttcagaaacctttactttatccttgggagaagggaataccaatgcaaagaaagaaaacaagaaggtcaaataaagcctctaatacctacccagttagtcaaacattagaaattgttggctgcatttaa

SEQ ID NO: 41548 - DNA, 384 bp, Glycine max
  Peptide Sequence Number=SeqID_158326
atggatatctctgaagatactgacatccctgtaatattgggaaggccattcatgttgaccgcaagttgcatagttgatatggggaagaggaagttggagctaggtaatggatggaggtcaagaggttctgaaaataagaaccaaaacataagatcgcctagtgagcgccagcttcgcgctaagcgcatctttggtcatgcgctaagccgagagtctcaagcgcttagcccccaacctttgcatctgaggctgatttggttcgctaagctagacaaggatgagctaggccaacttcaattcaatctaaattcggctaagcttcagccgggatcgctaagcgacaacttatccttggctaagcgagacctattgtcgccaagctaa

SEQ ID NO: 41549 - DNA, 174 bp, Glycine max
  Peptide Sequence Number=SeqID_158327
atggaaacaggagacaaaaaaaatcccccacaaaaggttcatcataatttgaacttagaagaggcctatagaatcaagcctaacttgaaaaagaccaagctcgaaaggaaagatgaacaagataacggggtcggcctcgtggtggaaggagcggaactaggcattttcctatag

SEQ ID NO: 41550 - DNA, 276 bp, Glycine max
  Peptide Sequence Number=SeqID_158328
atggtgcggtcttcttgcttcactcccattttgttcctatgctgggatgagccgccacgacgacaatgcctctgtgcggctctcttcccctttcccacctcggcatacctccatcacataccttgtggtggtgctttcaattgcagcaatacccgccacagtccattatcgctatgttgcgacgatgcagctgctctccaagatctagtcgcacatatcagagaaagagaatggtgtttagggttatcacttcaagtcagaaatgtattcgattaa

SEQ ID NO: 41551 - DNA, 387 bp, Glycine max
  Peptide Sequence Number=SeqID_158329
atgggggagacacatgaaatgccccaccacaatctagccgacttcgagccttgcctcggatatgccactgaagggcaagcagttggtgatatacccctacaaaacactttggacggccctcaattttgcccccaaccacaacccttgcattccacagcaggtaaaatccctcctattatggcatgtcataccctaatttcgtctagggaccatccgtttgttgggatgcgaccctcgtttgaccacttcgagggggtacaaatagcaattaggcccacttgggccatccaggaagttccaccagaaggtggtgccttctggaggaagcaacctagctcgcctgggcgagctgggtggcaagctccttcctctttttcctataaatag

SEQ ID NO: 41552 - DNA, 323 bp, Glycine max
  Peptide Sequence Number=SeqID_158330
atggagcttacatcacggttggtttgcaccaaccaaacggatatgaccgaaaggctgcttgtcggttcattggctcttgaaatccgtatccttcattatctaattgttcgtatcctactccctagatcttcaaaccttgcacaggcattgcgattaaatgctcatttgccctatcctcacttagttacttttttccttcaacattttaacatccctcttgattctgaaccttatgttccaatcaagagatctttcttgatcagtgctgctatggttgcctcctttggttaccacaaagagcatgatggcatgatggctcttgg

SEQ ID NO: 41553 - DNA, 194 bp, Glycine max
  Peptide Sequence Number=SeqID_158331
acttccaaattgtgccatgacacatgttaacgcttgtggtaaacacatgaccattctgagaagaattggacctccattacatttgaatgttatggtccttgacattcgaatgagccagagatatgttatacaaccatggtatcaattcctcacggatagtgatttctcacacggcgatgaggtctctgatcaag

SEQ ID NO: 41554 - DNA, 309 bp, Glycine max
  Peptide Sequence Number=SeqID_158332
atgacaaagtggtgggattacgtgaattacgttatatatgtgaggggtagagggtgtcacaaatctcccttgttacacttacgcttccacttcactttctcacgttcattgctcatgtgcaagactcgttgtcttcctcgtcctcttcgtccttggactccgactactcttcgtggcggcggtggaggagacacgagaagcaacggggcagaaagagcgaggaaaagaaggaggaagaagagagacaaagagcggaaaaagaaaaagaggctcaacaattttgatgactcatactcttcggaggagtga

SEQ ID NO: 41555 - DNA, 126 bp, Glycine max
  Peptide Sequence Number=SeqID_158333
atggaggagttccgggacattccactgagcactgccattggtttgtttgctcaagcgacccgcgctcctgagtttggacttccaaaacagttcaatcagaaattacttgtgctacacatttggtga

SEQ ID NO: 41556 - DNA, 240 bp, Glycine max
  Peptide Sequence Number=SeqID_158334
atggtgctaagctcaaattcacttactcgcgctaagcgcgagaatggcgctaagtgcgacgtcgagatcaggaagccctttttaagcctgatttgcacaacattaggcctgaagagtgtgaattttagagagcgtagagcagagcaaggggccaagttttcatctttttgggagattagtgagtttttgagtgattgtgagattcctaaaggtggaggacacatccccactcctttgtaa

SEQ ID NO: 41557 - DNA, 540 bp, Glycine max
  Peptide Sequence Number=SeqID_158335
gatggaccctcgggtactagtaccctggtcttcagaggactacacgtcctcgccaacagagggctgcacaccctcaccttaagaggactgtgtgtcctcactttcagaggactgcatgtcctcaccttcagagggctacacgccctcgccatcagaggactgcatgtcctcaccttcagagggctacacgccctcgccatcagaggaccgcatgtcctcaccttcagagggttacacgccctcgtcatcagaggactgcatgtcctcaccttcgtagggctacacgccctcacctttagaggactacacgtcctcgccaacagagggctacacgccctcacctttagaggactacacgtcctcgccaatagagagctacacgccctctccttgagaggactacacgtcctcacctccagaggactatacatcctcgccttgagagggttgcacgccctcacctttagagggctacgtgtcctcattttcagtgtgctccacatccgcaccttaagagaatttaaggtcctctatccttaa

SEQ ID NO: 41558 - DNA, 498 bp, Glycine max
  Peptide Sequence Number=SeqID_158336
atgagtggaaagggattgcagcatgttcggaaatcactttctcaatatcagcgtcttagagcatgtttggaaatcaaatgggataccaattgggaaagaggatttgtagtttatgtaaagaactcaaaaacttcgacatccttaccttcaggaacacttgaaaggtggcaacgccactcaaaaaggcacgacttcggctacgtggcggtggtgggagcagcaggtccacttcggcttcaagtacttcacggcgggaaacaaaacgtcagggtggtagcgggatggagttcacggcgggatgaagtagttcaggcaatagcggtggcgctaggtttttggagggtacgagagagggtgtttaccgcgagactatataaactacaaaatttacgacggtgtttaatgacatcgactttgtatgtgactatttctaggacggtgtacctacaagcaccgtcttttatgacttccatcaaaactacaacgacggggttatag

SEQ ID NO: 41559 - DNA, 192 bp, Glycine max
  Peptide Sequence Number=SeqID_158337
atggctaggaccagaggattaggtcgtgccttaggtcacgttactggcagaggtgtgggccgaggagatcgtgatgattccgatgatgctccacaacgtcgaaggcctaccgcatccgcacgaaggcagcgagtccctgtgactgcggcgcacgatgagccagtggtccctgcgccagatgtagaggttgac

SEQ ID NO: 41560 - DNA, 357 bp, Glycine max
  Peptide Sequence Number=SeqID_158338
atggagcgtgtaactgcagttgcagctgctgcattttccattcattcactagaagaagcagggttacttaatttgcagaaaatgaaagagagtcccaaatttccaaggaccaaaacagtgagagaaaaagaggggaaagtatctaggcaaccaagtcatggggagatttcaacaaaaaggtcattaggacaggaactcgcaatgacaacagaaagtgattttccttctaaatgtccaagtggtgtatccccagccgcaggcattgtctctggttcgtgggttcgttgggaatggttaggtgcagtgaaggtgaaggtaccgacgttgagcgttgcggtggtcggcggcggcaaatga

SEQ ID NO: 41561 - DNA, 417 bp, Glycine max
  Peptide Sequence Number=SeqID_158339
atggcttacactctcaacccttttattctttctactttgttgactataactgcattgatctcatcagcatctatggttgagtcaaggccattctctagcccctcttcttcaagccttgcggttcggttgaagacggagggtgaatcctcctactgttgggattcactgtggcagctccaagcatgcagtggagaaattgtaacattttttctcaatggtgagacttaccttggacatggatgctgccaagcaattagggtgattggacatgattgctggcccaacattgttgcctctctaggattcaccaatgaagagactgatgttttggaggattattgtgatgaggatgttgttcattcacctcctcctccaccaccgcaatctattgataacccaaaatatattgatccataa

SEQ ID NO: 41562 - DNA, 798 bp, Glycine max
  Peptide Sequence Number=SeqID_158340
atgactgaggatcctaccaaagaactatcaaggttgataagcgagggcaaatttgaggaagcatttacaggagcccttcatagaagtgacatttcaatagtttcttggttatgttctcagattttgagttttcctttgagtttttcctatggcaaaattgtaaatttctgggggtcctccatgaaaatacctcttaatgtaagttacatacatggaactcttatgccacctgatggacctgaatcttggcctaagaacaacagtaggcaccaatggctggtcttttacagaatcaatggaatgtcaccagaaggaagtggtttagtagataggagaggagaaaaatggtgggaccttccctgtaagcctcacaaggtgcttcaaacaaccactgacaccaacttccctacaaaaaatgcctcagggacctcatgggacaacacactcccaggaccttgtgatagcccaattgccataaggataaagaacagtcctcggttctatttcaaatttgatggctacaaaaatgtccatatagaatcgatctacataacagctccaaaactaagccccaacactgatggaattcacatagaaaataccaatgacgtgaaaatatacagttctattatttctaatggttgcaatgatgtcgatattaagaacattacatgtggacctggtcatggaattaggatgacgttgctattaggacctccaggatcgagcaaaactaccttacttttggctcttgcgggaaagcaacctcaaggtagtacaaattctatgcatgattaa

SEQ ID NO: 41563 - DNA, 138 bp, Glycine max
  Peptide Sequence Number=SeqID_158341
atgaatgcaagaatgcacgaatttggtgagggagatgatgcaggcagtgttctgaaaatttcaggcaaagaggggcttgcgcttagcgaatatgatggaccgcttagcactgctatggctgcaaggaatttggcttag

SEQ ID NO: 41564 - DNA, 426 bp, Glycine max
  Peptide Sequence Number=SeqID_158342
atgggcgagcaacaagatagccttgacgaatcacttctaaagttggtttcaatccccggtggtttagggcctgatgatgatcgaaatgatttgggcaagtttgttgctgctatgcaaaacactatgctagctatgcttgagaagctcacacaggatgttcatttgaatggtgataacaaaatcagcttaattgtagcagatttctgcatgggatgggctttggatgttgggagtaaactgggaatcaaaggagccctgttgtggacttcatcagcagctttatttgcccttctatacaacatccccaagcttatcgatgatgggatcatagattctgatggtgaagcaagcttcatgataatgaatcaagttgattcaagtagttttgataatgacaaagatgatgacaaaaagcccaaagaatga

SEQ ID NO: 41565 - DNA, 1142 bp, Glycine max
  Peptide Sequence Number=SeqID_158343
gtatcaaggctgcaggagggggacgaatgatgctggtggtgagtgtttgggtaaggggtgaaagacatggatatattggcgtaattggtggtgactggcccgagttgcttgagccattgtactccaagcacaatatcgacaccgctaagagggagggcatacaggtccgctgtgaaggagtggttctggatggttatcggcacctgagggaaatattgagtgcattccatgactccatcgttgcccaccatgacctggagaggggtaatcggggtaggaagcatgggcagaaacgtcacaactctagttttgataaagttatgtgtgctgccgtcgtccacgaggatggctgcattgttgtgactcatctgatgaggtacaaagggtgtcatcaggaggtgccgagggaggatccggagtggttgtgggagctgatggtcctcatcgatgtcggctatgagaaggtgtatacaggtcttttgaaagggatctttggctatggcgtagtggtaggtgctggtggtggtgggttgaaaggggtacgggcagagcagcgccggtcagccaatttatcctcctataatctggcaagggcaattgtgtgggataaagacagaggctggaaagcctggacctcgtggtgtaactccaggtggagaccgaaaatgaagcagctaaggagggaagatgggggtgacccgatgatacggtttgcaatctgctcaaagctggtgagctctttacgggtcattgtagtaagagggtgcgaaatgagattccaaggcttggagcatggtggaccaggagggggtcctggtcgtcaaatcgaggcacctcaagtttcagatggggtctgggatggacgaggggaggtgtgggtggtgttttgggagaaggtgggggatggtaagggaggcaactcgatccatgatggatttgagcttactgttcaactctgcatgaccctgagaaaaggcagcgactgcttcatcgaggcgctcaatggaggcctgacgggtgttatgctcaggcatattgttgttgcaaggatagatgtagtcatccaaatgcatgtgccttctagtggctcttctaggcctgctgctgttcaacttggtattgttaacagtccccctccttga

SEQ ID NO: 41566 - DNA, 132 bp, Glycine max
  Peptide Sequence Number=SeqID_158344
atggagaaagttatcaaggctcacactgatgctttgtgggctcgattgccagaagaaaatgcaaagcaagagaagttagacctcaactgtcaggtcagggaaatcaggttgaagggaaccctggagcaataa

SEQ ID NO: 41567 - DNA, 195 bp, Glycine max
  Peptide Sequence Number=SeqID_158345
atgtcacctggtagggaacaccattgggctcccaggctgatcacctatgggaggggggctgttacgtgcacaaccgggtggtctcgacaaactcagcacagttccctaagtgagagtgtcgtgtggacacgcttaggctatttcctgagtcttgattgggtccatggatggatgatgagtaattgttggatgtga

SEQ ID NO: 41568 - DNA, 474 bp, Glycine max
  Peptide Sequence Number=SeqID_158346
atgcaagtttgcaaccctaacgcgaagctcgttgttgctcccaaggcctctgccgtctccgtcgcgccagagtccagacatagcatcatgaacggcgcaaacatgcttgttgaaaaaggtagtaaccattcaccactggtattagtcgtgtggaatttgttgcttggtgtttccattatggttatcggaaatgtgttgttggcgattataaaatgtgtgttgttgtattctgttaaagctagagattggaagctaagagggatgcttttcgctacagcaagctcatgtgccgggtttattcatcttagcattggactatgtgaacgaggttttacaatggataaattcataataggtgttggagccattaataagatactcaaaagcaaaaagcttcaatggactcttctagttttccagtatcatttcaacaagattcaagtcccttatatgtttgaaatgagtatttcatga

SEQ ID NO: 41569 - DNA, 1644 bp, Glycine max
  Peptide Sequence Number=SeqID_158347
atgagattccaccttgcattgtttctctttttggcttctcttcaagccactttaagtcaagatattgaacatggttcacttctagtagatggagctcagacaaaggctgaaacaggtgataactttatttgtgccactattgattggtggcctcatgataagtgtgactacaaccattgcccctggggctattcttctgttgtaaatttggacttgtctcatcctttccttgccaaggcaatccaagccctcaggccattgaggataagacttggaggttctttgcaagatcaggttctgtatgatgtgggaagtttgaagtctccttgccatccccttcaaaaggttaaaggtggattgtttggattttcaaagggatgtttacacatgaaaaggtgggatgagctgaatcagtttttcaacgagacaggggccattgtgacatttggcttgaatgcactgcatgggaagcaccagattagtcataatgtttgggaaggagcctgggaccctacaaatgcgtatgattttatagagtacactatttcaaagggatacaagattgattcatgggaacttggtaatgagttgagtggtaagggcattggtgcaagtgttggtgttgcacaatatgggaaagacttgataaagcttaaacaaattctaagcacgttatacgagagctccaagttcaagccttcacttgtcgcacctgggggattttatgaaaaacattggtatgacaggcttcttcaggtttcgggttcaggcataatcaatgttctgactcatcatttatataatttgggcccaggtagtgatgagcatcttgaaaggaagattctagatcctgagcgcttgagcagggtggaatcaattttcggcaatctttcagaaaccattaaaatatatggtccttggtcttctgcatgggtaggagaagctggaggggcatacaacagtggtggcaatcatgtttctaacagatttctaaacagcttttggtacttagatcaacttggaatagcatcctgctacagcactaaagtctattgcaggcagactttaattggagggaactatggccttctcaataccaccacctttgctcccaatcctgactactacagtgcacttttgtggcatcgattaatgggaaagaaggttcttgcggtctcaagtgatgtttcttcaccctttttacgcacttatgcccattgcacaaaagatagagcgggtgtaacgttacttctgataaacttaagcaatcagacagatttcatactcaccgtccgaaacccggtgactgcaagtgttgtagaaaatgaagtggccacaagcacccataaggaaagttcattttttgataaactcaagaagacattctcttgggttggaacaaaagggtcagaggtcacattcagggaggagtatcacctaactccaaaagatggttacctcagaagccaaaccatggtgctgaatggtattccattggagttaacagacgaaggagatcttccaccgttggatccagtgcgcaataacgtgcgatctccaatatacatgactcctttgtccattgcatttgttgtataccccaactttgatgctccagcttgtgctacacacagaaaactttag

SEQ ID NO: 41570 - DNA, 150 bp, Glycine max
  Peptide Sequence Number=SeqID_158348
atgtcggcgatagcggtgttggggagaggtggtcatcgaaggcgaggtaggcattggggacgacaagaatggagagggaggagcgttatcaatattaaccttgatctgttcttcgaatcacaaagctcaattaattacaaagaaaattag

SEQ ID NO: 41571 - DNA, 522 bp, Glycine max
  Peptide Sequence Number=SeqID_158349
atgacattcgtcccttccaaccaaactcccactgttctgcgcgctacaccatataaatattgctatccaaagggggtgaatgcggtcacattggatgcaaatccacacgtggttgggctggttctcaaagacagtgtcgataaccacaacttcgacaagcacagtggagaaggaggccgcctccccaagtcgacactactctcagttgctaccattatgcatatgcatgtggtcacagctcttgtagatagagacctaacccgtgtcattgtctggttcacgaggttggtgttgatgatgggatgcctcccaatcatgtgtcgagcgcaagccatggcatacgctttcatgttggagcaaatagaggtattcaaatcaaaggagggcacagaggagttgactttcatgttggagcagatggacttattcatattggtagaggatgtaatcaaggagtcagtcgagaacgaggatgaggtggaggtgtcaaacatgatgaatggcatgagaaaattgtcctaa

SEQ ID NO: 41572 - DNA, 1593 bp, Glycine max
  Peptide Sequence Number=SeqID_158350
atgtttagtataggtaaaatctcaaagatttttagaaagggtgttcacttccgcgagcagcaccgtgacgcgaatctcgaagccagagcgaacctcgtggttcaccgaggacaacaccgaccgcatcgacttccagaataccatagcggcgacgctgatacacttcgcgtgttggaagatttggtcgcaggagtccgccgccttgcgcgcggcgcgctctgcgccttcgtacagtggattcgttcctccgccgtgatcggaattggagaggagcacggcgaaggcgacgacgacggagatggaaatggcggagagatggaatcggcgatattggaaattattttctcacaaatttcgggcttcgatcaattgtggcggctctccattgtagctgctgtcatatccttcacatactccactattgggctaggccttggtattggaaaagttattggtatgaattcatgctattcacatgtccatcatgatgatatttgttcatcttcaatcactggacacagtgaaatcccctccatcagagtaaaaaacaatctaggcaccgtggtttctaaaaaaggatatgtgctaaatactaccgaggcagagactttgctttcaactactctgatacatgaggttatgcatgttcttggttttgatccacatgcctttgctcattttagagatgaaaggaaaagacaacataatcaggccgcaaaacgtgtacacatggaaaacaatagtcccagagttggatttttgaagtcaccttcaagtaaggaggatgttaaccctgatgcttatggcaatgggtttgttactgctagaacaaaactggaaacacccttaaaaggacgagcacactctattattgaccaggtgacgaaagttgggaattctatccgcagttgtggttatggagaaggtcaaactcagagctttgatcttcctattaagaaaaggatggtcattgaggagatattcatatggcatggtgcttcaattggtttctggcgtggggatgtcaaatttgtaattgatgatgttgggaaactaaaactaactattttctatgttgttccctgtgtgcttgatagagtgtactcaggtttgacacagaagatttcttctgggggcttcttgaagaagacattattcaactttgcttattcatataagcttaataacatggagaaagggcttagacatggagaggcatctccacttcttgatataattgtgtttgacaagggggtagagtacgtcatattttgtctggagccgcacctttatctgcacatgtggaaggttacttacaggtggttacttgtgctcatgtcctacaaggatatgtggagggccagctctagccaaggcctaagtaattatgaacttggcaaagctagttggagttggagctggaaggatcgttggattgctgcactgcccacattcaattatgtatgttctaagctctctctaagatctaaacatttacctacagttgaagatgataggttgggtcccaatagaggattggattcaaatcctcctcacaaacagaaaatattgtctcacaatccaaaagggtag

SEQ ID NO: 41573 - DNA, 216 bp, Glycine max
  Peptide Sequence Number=SeqID_158351
atggcatttggtatcacagagacacgaggatctacaatgccacaaggagaggttgcaacagatatgagatcgttgcccaattttgataccggaaacgctgggaaggagtggttcctcttcaatgacaaggacaacaattcctttgacaatgataaaggtttttgcgatggtgaccacgtgggtggtgttggagagggaggggtgattggagattga

SEQ ID NO: 41574 - DNA, 813 bp, Glycine max
  Peptide Sequence Number=SeqID_158352
atggcaccaaagagaagcaaagctactgtcatttcaagaatgaacactaaagaggaggccaagaataacgatgtcaacatcaaaggcaccgtcagcgggaaggaagtggtagtctctctagtaaccattgttgttgcgtctgaatatgctaaagaaggtttggtgtttgacaaagattgggagaaggaaataacccagaaaactgtggacatcaggctctatggaagcctacatcctatcatagatgataagaaggcgatgattagtttccttagaactgccaacctgacctacatgtggaaactgattcacagcttcctattgaacatggtgatgcctagactagggccacgagacgagatatattttgcatgtcttctaggaaagattataaggaatattggagtgaatgtgtctgccatggaagtgtttgctagagcttcacaactgaagggagtgacctttgagaagattggaattgctgaaattttcccaaaatatgctcaaaagcatattaagaaaaaggtcaagaaaggaggaaccatagtctatgccaaaaagccaaagaaacaaccaccctcagaccctagaaccacccaaaagaggaaggctccatatctaagtctaaacttgaaccttgaccaacaaaaaaagccaaccatcaagatcaaacatcctcaacctcaacctacaccttcctcacctctgaaacctcaaccaacctcacctccaaaagaccaagaatctgatgatgtgattcttaaaacctctacacctcaacccccaccttctctagcccttccacctcaataa

SEQ ID NO: 41575 - DNA, 297 bp, Glycine max
  Peptide Sequence Number=SeqID_158353
atggaaccaatgtgtggttctaagttatatttaattctttttgttgttttgttgaatcgcgatgctcaatccttgcttcctctgacagtgaaacagatatacaatgcgtctcagtcaaggttttgtgggttctcttgtcctcttggtgttgtttctacttcttctagtgtgcttcataaagcagtaggatttggaaggaagtatagagtttcaaagtgggtagtgatcatggcagttgcaaaacttgaggagataagcatcccaccactggaccaacttcaaggcttagagtattga

SEQ ID NO: 41576 - DNA, 1332 bp, Glycine max
  Peptide Sequence Number=SeqID_158354
atgcttgcatctgttaaagcactaccagaggacgagcgcaaagggaaattgcctgaaaatgacaagtttgttgccttagaaggcaagttatttgaagaaattccagacgaagtcattttggaatctatgaagacattgtctgttgaggaaaagcataggcacaatgctataaggctaccgtcatggagatatatggccatgcttcaatcagttattgaagcatctattgtggaagcagaagatggtatcattgagaaaaccctagaattgctcctattcatccaaggccagtgtctaatattgatgaacaattctttgttgctcaatatggtggaaaggaagataatgatgatatctgaagagcccattagggtaatagaactctttcataggcttaatagaagattgatgaaaccagttgaacacgaagccacaacatggatcttaccttcaagacctcctattcagaagaaaccaaacattcaagtgcatcccaatcttcacactagactatatcatgggttcagaggatacaaagttctggaatggcagacttgcaacaaagtctggaaagaaatgggagacattgggactcatattcttcacctaaagatgcagaaagtgaagttggaaaagcttaatcttacaaagctctggaaggcaagttttctaggtattgatccttttaatttttcatcttgggatacatttcctaaagaagaagagtatgcacttggagtatatggagattgggaaccagtagttgctcccaatcctaacagtctgatttttgagcatcaaccaacaaaaacaaaagtttatcctcctagtgtcatcgtctggaaaagtagagacgctgagccttctggagagacttttcagacaaaagagatcattctagaggcacctaaagaaagtatgaactttcaagattgggaattatcatactatgttcatgagcttagtatgaagttgtatgcatacagagaagagatcagatcaagacaagcttcctttcacaggattcaaaggctcaacattcatttgccttttatgcttgggtcacaattttcctgcctagctactttaaaaacccagtttcagatagtgattgataagtttgtcctatatcaaaaggaaaattgctataaaggaaatgagccactgattgaagaagatgaaaacgcttcaccaaccaaatatgtcaaggcttgccttggtagatttttcaaacatgagcttgaagctttgaagcaaaagattgaggtcattaatctggattggtatgctataaagatgttttacaaactcaagagtgttgctctagtctag

SEQ ID NO: 41577 - DNA, 345 bp, Glycine max
  Peptide Sequence Number=SeqID_158355
atggaactgtgtccaacacgaccgcgtccaccccctctggatcatcttctactgagagtttgttgggttcctattcacaccattttccatcgttcaactcatttggaacccatcacattttttgctttggtgggtagacgaaaaaatgcacacaatggcattgggcatcgcagatgtacatggatctacaatgccacgaggagaggttacaacagatttgagattgtaaacaacaagaggctttcacaaatgacaaaatcacgtaacagaggccaccatggaagggctaagagagaaatagccatatttgagatcaaaagcaacaagagccaccactacatctga

SEQ ID NO: 41578 - DNA, 504 bp, Glycine max
  Peptide Sequence Number=SeqID_158356
atggctgagtgtgatggctcatataaaaattctaagggatccatagacgataaagtggcgctcatgtccagaaatctcaaacagatgctgaaaaagacgatgaagaagatatgcactatgatgttattcttcaaaatagtcataggatctcccctcagtgcaaaaagtttaagttggtaccggaataatgaatgctcacgacacatgatgggggaaaggtctatgttcctcaagctaaagccagttggaggaggaaaagttgcctttggaggcatgggtaagaagaagattaatggtataggtataattggtattccttctttagcttccatagacaatgtcttatatgttgaaggtttgaagtataacttactgagcataagtcaattttgtgatagtggttatattgtgttctttaacaaagagcaatatatagtcaagacagaagatgacaagttcttctttacttccagactacacaacaatttgtatgagattatatga

SEQ ID NO: 41579 - DNA, 294 bp, Glycine max
  Peptide Sequence Number=SeqID_158357
atggagcgatatctacagcacttggttcgccagcaggcggccaaccaccgggggcaagtgcagatacatgagtgtctctaccagctcagcctcagtcagcagggccagggtttcgttccttttgcgtgccctactccagatcagtttagggctgaggtcgcatggctcggagattggcctgaggcccaggcaggggaggcgcctacaggatccccgggcgatgcagagaaggcccgtatggatgaggagatgacggatttgctcggtttcttgggagggagcggagccacatga

SEQ ID NO: 41580 - DNA, 501 bp, Glycine max
  Peptide Sequence Number=SeqID_158358
atggattcacgcgctaggagtggtcccttcaatgcttcactagaaatagaaattcgcgaggatatgttggtaagctgcccctcctcaacagcatatgtagaggcagcggaggaatcattggaaacagctttgcaatccttcgaggtggtaatgctcaggcacggttatgagcccggaatgggtctgggtaaggacagtcacgggaatgccgatgtggttgacattaggggtaacccgtacaaatatgggttggggtatgaacccgggaaacctagaagaaggaatgcaccatcaagactctgggcagatagggcatggcccgatcatgttagccagtgtttcacaagtgctgggataatgttcgaggaagaggtggcggcaataggagaggaggctccacaagatccaccgggtttcgtgcgaccgtgccctaccaatttccaagtggggaattggcacgtgatgagccagtcggaagtctataccgctgattcaatgtaa

SEQ ID NO: 41581 - DNA, 327 bp, Glycine max
  Peptide Sequence Number=SeqID_158359
atggatctcattgaaaatatgactgttgtaggatgtaccatctgtgggggagctcatgaatttggatgttgtattcctattgaagaacaccctactcgtgaagtcaattacatgagaaatcagcccaaaaataatttcaatgcaggaggattttctggattccaacatggccaacaatataatcaacaacagggacaatggaggaaccaccctggaaatgagttcaacagagatcaaggtggaccatccacaaggccacagcaacaagagcctagtctctttgatcgcacaaaaaagctagaagagactctagctcagtttatgtag

SEQ ID NO: 41582 - DNA, 222 bp, Glycine max
  Peptide Sequence Number=SeqID_158360
atgtcagaattcacaagcaattgtcctcctcgaattttagccagcctccatcaattagactttgcaccttatgtttcagggtcatacaatgctcaatggaatgccccgaaattcctcaatgataagcacatgttgcattcgagttgtatcctcgggaaaatggaggttgaggaatctttgctgggattatggctaccattgcattatttgttagatatgaga

SEQ ID NO: 41583 - DNA, 546 bp, Glycine max
  Peptide Sequence Number=SeqID_158361
atgactagaagtaagaggattcaagaggactctaaggagaaggaaggttatttcccaaaaactgcagatgacatccttattgagaaggaccaaacaccttggaaagttgaggttcctactgatgggaatctagtggcaagcaaagagggtcagaaggaggtactgacacctcaagtaagtgttcccttccaacaaagatcaaaagacaagagtgaggaagcacaatttgctagatctattaagatgcttaaaatggtgcatattaatatcccttttgttgaggcaattgctcaaatgtcaaagtacaccaaatatttaaaagaaattctttcaaataaaggaaagttgatggactttgctataaatggtctcaacaaagaatgctctactatagttttaaagaagttgtcacctaagcttagtgatccaaggagtttctcagtcccttgtactattgacaacttacaaattaatagagctttatgtgatttgggtgctagcattaatctgatgccttattttgtctataagaagttggggttataa

SEQ ID NO: 41584 - DNA, 168 bp, Glycine max
  Peptide Sequence Number=SeqID_158362
atgaatttcattaggactaggattaggggaaaattgctacatagcatgcaaactaggtcccataatccaccactgcaatacaaacctgatattgacaagctaattcagaaacttcgtgtagatatccgagaagagagagaaaaagcaatggcatctaaccaggcatag

SEQ ID NO: 41585 - DNA, 573 bp, Glycine max
  Peptide Sequence Number=SeqID_158363
atgaaacgactcatcatcggcatttccggcgccagcggctccatctacggcgtgcgcctgttacaggttttgcgcgacgtcgcagaggtggaaacccatctggtgatgagcaacgcggcaagacagacgctggcgctggaaacgccgtacagcctgcgggaagtgcaggcgctggccgacgtggtgcacgatgcgcgcgacatcgccgccggcatctcctccggctccttcaaaaccctgggcatggcgatcctgccatgctcagtcaaaacgctgtccggcatcgtcaacagttacagcgacgggctgctgacccgcgccgccgacgtggtgctcaaagagcgccgtcgcctggtattgtgcgtgcgtgaaacgccgctgcatttgggtcacctgcggttgatgacccaggcggcggagatgggggcggtgatcatgccgccggtgccggcgttttatcaccagccgaaaagcgtggaagacatcatcgatcagaccgtcaatcgggtgatcgatcagtttgatatcgaactgcctgccgatctgttcacccgttggcagggctttagttaa

SEQ ID NO: 41586 - DNA, 307 bp, Glycine max
  Peptide Sequence Number=SeqID_158364
gtcgcttgagcaaatagaccaatggcttgcacccgatttcggatttacatgcgattctcctcaaatttcagccagcccgcatcaatcagaccttgcaccttacgcttcaggcccctacaatgctcaatggaatgccccggggcttctccatgacaagcacacgttgcgttcgagtcgtattctcggagaaatggaggttgatgaaccttggttggggttatggctaccattgaattatcaagcagatatgggagcaagtgatgttcgtcattggaagtgcggtagacagactttgtggttgacttag

SEQ ID NO: 41587 - DNA, 371 bp, Glycine max
  Peptide Sequence Number=SeqID_158365
atggctgacagaggaggaaagagcatgaccgttgacagactaaaacgcgatctgctgaacaagctgatcaacgcccgaatcgacctggccgcgtacctgcagttgaggaaggcaaaagggtatatgtcagtcagcgaaagcgaacatctgcgtgataacctgtttgaactttgcaatttcatgcgtgaaaaagcaccggccctgcaggcgaactacggcgaaagtgaagaagtcgcgctgcgccgcgccgccgaggtgctctccattgcaggggtgtgtctgatgaacggacgccacgactgcccgaattttatcgccgtaaacgcggagaagcttgaaaactgcctgacaacgctctctctatgcatcat

SEQ ID NO: 41588 - DNA, 144 bp, Glycine max
  Peptide Sequence Number=SeqID_158366
atgtcgcgagggtcaggagaccttggggacgtcaggtggggtgctattgcccaaaaccaagcttggccaatcccgacccaacccgggcatagtcagccaggtttaaaaattgaaacaaaacgttcagtagctgctggtaattga

SEQ ID NO: 41589 - DNA, 207 bp, Glycine max
  Peptide Sequence Number=SeqID_158367
atggatgaatatcaatggtcgtatgacaatgtgatgtctcaagaagttgatatggattatgaaaatgaacaagaatgtggtgtgaatgaaccgtatgttgattgttcagatgcttttaatacttctcaggtctttggtacccgagatgatgttttgcagtgggctcaatcgattgcccataaaaacggatttgttcaatcattatga

SEQ ID NO: 41590 - DNA, 567 bp, Glycine max
  Peptide Sequence Number=SeqID_158368
atgtccaaatcttttgaatttgggatgaccggctctctcgatgagtcgatctcttgctttctcataaggatggaccctcggaggactgcatgtcctcaccttcagagggctacacgccctcgccatcagaggactgcgtgtcctcaccttcagagggctacacgccctcgccatcagaggactgcatggctacacgccctcacctttagaggactacacgtcctcgccaacagagggctgcacgccctcaccttgagaggactacacgtcctcgccaacgtagggctacacgccctcacctttagaggactacacatcctcgccttcagaggactccacgtcctcaccttgagaggactacacgtcctcgccttgagaggactacacgtcctcgccttgagaggactacatgtcctcaccatcagagggctgcacgccctcacctccagaggactacacgtcctcgccttgagagggctacccgccctcgccttgggtactagttaccctcaccttcagaggactacatgtcctcaccttcgtagggctacatgccctcacctttag

SEQ ID NO: 41591 - DNA, 576 bp, Glycine max
  Peptide Sequence Number=SeqID_158369
cagagcgagtttgatttcgcggcccatcagcagttcctcgccgacaacgcgccggaaatcagtgccttccgcaaacgtcaggccgcagcgtttgagcaggaagtcacgctgtgggcgcaggaagagcaggaagcgccgctcacccgtgaagagacgctgggggtcgccgacgcagaggacgacgcgctggcagtgtgcgctgacatgaacggcaacatctggaaagtgctggttgcgccgggcgatacggtgcaggccggtcagacgctgatcatcgtggaagcgatgaagatggagctggcgattgtcgcgccgcaggccggcacggtgaaacgcattgcctgccaggcgggccgtccggcgctgaagcaggacatctttgaattccgtctgatgccgggtgaccgcttcagcgaaaacgaaatcgccgagcggctggcggtgagccgcacgccggtgcgtcaggcgctgttctggctggagcgcgaaggctacgtcgaggtgtggtttcgcagcggctggcaggtgcggccgttcgatttcgcctacttcgaggagctgtacgacttccgcacc

SEQ ID NO: 41592 - DNA, 513 bp, Glycine max
  Peptide Sequence Number=SeqID_158370
ataatgattagaactagaggtgttggtcttgttttaggccgaacaattgaaaaagttatggggaggagagacacgagtaacgatgatgcccccaacagcgaaggcctactgcatttgcccgaacgtcctgagctgaagttatcttcccatggaaggaagatgactaggttcgagagacttgctccagagattgaaggccttgtggctgctagtggactaaattcttggatcgaatgttccctagatatgggcgatcagagactaatgtttgcttttgtggaacgcaagcataaggaaactagtagtttccatttgcctgttagagaggtgactatcaccttgggtgatgtcgcgtcgttgttacatctgcctatcgtaggggcgttccacagcttcgagcaacttcatgtcgacgatgcggtcgatatgttggtggaattacttgaggtcagcgctgcaaaggcgagagctgagacaattcagtgtcatggctcttatgttcgactatcgtga

SEQ ID NO: 41593 - DNA, 138 bp, Glycine max
  Peptide Sequence Number=SeqID_158371
atggagcttgcatcaggagctaagccagtgaggtggccacagtggagactcaatcccgttattctagatgtggtgaaaaaggaagtgaccaagctcttacaagttggaatcatctaccccatctctaacagccagtgg

SEQ ID NO: 41594 - DNA, 237 bp, Glycine max
  Peptide Sequence Number=SeqID_158372
atggggctccgaataagatttgatggtggaggatgcacgaacagcgctaggcaatcaattcgtggggcttcggactcgatggaaatcaattcgtggggctccagactcgatggtggaggatgcatgaatgacaatcaattcatggggctccgaataagatttgatggtggaggatgcacgaacagcgctaggcaatcaattcgtggggctccggactcgatggtggaggatgcatga

SEQ ID NO: 41595 - DNA, 168 bp, Glycine max
  Peptide Sequence Number=SeqID_158373
atgaagaacctatgctatttagcaaatacaaatggtaatgatgttgatgttgcacctgaattttctcctttgaaaactgttcattttggaaatccttctcaagacactgttgacccaagagatggaggctttggaggaagactatcgagatggaaatgggaaaaatga

SEQ ID NO: 41596 - DNA, 228 bp, Glycine max
  Peptide Sequence Number=SeqID_158374
atgtatcaatttcttctccaccttcatcatttcctagctttgaaatggggtcaagacaggatcaccaacagttgcaaaaccctccaacaccatcacatcctccaaggtgacatttttctcaccctaggagcacaagaaggtgagaaaacaaacaccttggaggatgtgatggtgttggagaattttccaacagttcatgatcccgtcttcaccccatttcaaagctag

SEQ ID NO: 41597 - DNA, 162 bp, Glycine max
  Peptide Sequence Number=SeqID_158375
ttttgggacttgagtgttttgtgagccaccttgatgttaccctaacatcaagtgttggacctgagtgtgtagagttgatctctatagtttgtgtagagttgatctctagtgttcagagagcaatctctgagtggctcttaggtagagattgcacgggtagtg

SEQ ID NO: 41598 - DNA, 1500 bp, Glycine max
  Peptide Sequence Number=SeqID_158376
atggcttctttgtattcagcaccacccctcttgcgtttttcctccaggaggtcttcatctttggcacccgatttgagtttggtcaatttgaggaaatcccatttaagatttgagtccaaaatctcaccaataaaattgcaatggaaaagtatagaagggaagtggcagagaaagagaaagatacaatggggtgtgaggtgcactgcagatggcatagatggtggaatgtttttgggtggcagaaaagaaggtgcaggtgttagcatcccagagaggttgaaggtggtgtctttgattgcatgtgttatgtgtctgtgtaatgctgatcgtgtggttatgtctgtggctattgttcctcttgctgccaaacatggctggtccaattcttttcttggcattgttcagtcatcattcctgtggggttacatattctcttcagtgattggaggagctttggtagatagatatggagggaagagggtgttggcctgtggtgtatttatgtggtctttggcaactattctcacacctttggcagccaaccactccacagtgagcttgttggccattcgtgctttctttggattagctgaaggagtggcctttccatctatgagcactctcttatcaaggtggtttccaactaatgagagggcaagtgcacttggaatgtcaatggctggatttcatctaggcaatgtcataggcttgttgctaacaccaattatgctgtccactatgggaatttcgggtcctttcatcttattttcatcccttggattgctctgggtgataacatgggcatatcgagttacagatgatcctacggaaagtaattttatcagcagattagaacaaaggttaatccaagctgggaaaactggttctccaaagaaaagtaacaagtttcctcccatacgccttctgttatcaaaattaccgtcatgggctataatatttgccaatgcaactaataactgggggtactttgttctcctgtcatggatgccggtatataatgttaacttgaagcaagcagcttggtttagcgcggttccgtgggccacaatggctatgtcaggttatctagccggtgttgcatcagacttcttaatcaatgcagggtaccctacaatatttgtccggaagttcatgcagacaattggattcatcgggccggcagtgaccttgctctgcttgaattatgccaatacacctgctgttgctgctacactcatgactattgccttgagcctgagttctttcagccaggctggctttatgctcaacattcaagatattgctcctcagtatgcaggaattctacatggaatctcaaattgtgctggaactatagcagctatcataagcacaattggaactggttattttgtacagtggctgggatcatttcaggcattcttgactataacagcttgtctgtattttgtgacaaccattttttggaatctttttgctacaagcgagcaaattttgtga

SEQ ID NO: 41599 - DNA, 237 bp, Glycine max
  Peptide Sequence Number=SeqID_158377
atgggttgtggcatggaaaattgtgaaaggagttgtgttaagcaacatggttggaacttggaaacgttgggtattgagccatttaatttaaagctcactgctaaggttaacgcattgcgtggcaccatgtgtgggagtgagcacgtgccatcaagcgccaacctctccccgtcacgatttgtagattctttctattaccataccagtgaaaaatacaatttacaatatacgtgttaa

SEQ ID NO: 41600 - DNA, 696 bp, Glycine max
  Peptide Sequence Number=SeqID_158378
atgaaacaaaggagggtgaaacgtacactgaatctgtcccctccaacacaatcaaacataccaacaactagtccaacaacaaaagctcatcaagctacaaaaccaatcccttcccttccttactctcctcaacaacatcacaattcccaacacaacacaatctctgacctcttccttctgtggtccccactatccccaacacaccatcatcaatactttgcttccaaaaatcctcactttcaggaatcatctctttcaccccaatcccttcaaactcacaccgccatatattttcacctctttccccaagtgggttctcatcaaaatctgattttttttttgcctatgctgaaagccatgaatttcaggagcttggaggagttctgggccttctacgtgaaccagcattcgatgccttccacgaggaggtggcactttgtgggaacgctcttcagcattttgtttttgttcttttcagttttcttcagctggtggtttttgttctttgtgcccctttctgggtatggatgcgcctggtacagtcacttttttgtggaagggaatgttccagccacttttggacaccccttttggtcactcttgtgtgatttcaagatgtttgggttgatgcttaccgggaaaatggatagagagatcaagaggcttgggaaaagacctgtgctgcaagtgttctga

SEQ ID NO: 41601 - DNA, 327 bp, Glycine max
  Peptide Sequence Number=SeqID_158379
atgactactaaatgcattcttgatggtagaatgcctatatatagcagatgtatttggtccctgggatcatctctttcaattcattctgatacaccatctagagagagaaagagagagagcttggaagaaccaaaacaaggcaactctgatgtaagctccattggagcttgtaggcctaggatcttcttcatcaatggattcctttgcttcttggaaaatgaatggcagcggaatggagaaaagaagagagagagcagacgccacttcaagaagaagatgagtctagaagaagcttaccaccataggaggccatggataagagcttag

SEQ ID NO: 41602 - DNA, 297 bp, Glycine max
  Peptide Sequence Number=SeqID_158380
atggctttatttgcttctcagggcggtttggatcccttgcattattccggaaagatcattgagtgttcttgggattctgacagacaggaatggatattcaagcgaatcagaacagataaatcaacaccaaatgactttaatacttatagaaaggtgatgcgaagtataagagacaatatcacagaggatgtcctgttgaatgaaataaatgagataatttgccttcccttgtatgcagacaggataagaattgatagcaaagcccatatccacaccaatatggcacggcgaaggtaa

SEQ ID NO: 41603 - DNA, 147 bp, Glycine max
  Peptide Sequence Number=SeqID_158381
atgaaaactaatattagaattggtccagtgacctgggacatgcccaatattcaacaaaaataccaaataaggctaaggagaatttacaactgttacgacaacgttattattatgcaacatggaaagctgatggaacaagatatatga

SEQ ID NO: 41604 - DNA, 357 bp, Glycine max
  Peptide Sequence Number=SeqID_158382
atgtctgttactcaggcaataaaaatattttctgatgcacgccctccgggaatctataaacctgagtacattgatgcattgtatgcattttatcatgaaaaaaagcctgaaatgatagtttgtcctcctacccctgagtggaagagaactcctgaacttgttgatctaaatggtgaagcaatgccagatgatgatgatgatggagtaccaggctctcctttgcatgagaatcatgtgactgacactataatgagaaatgatgatgttttgggagatgagatacctaatgatcagcaagatgcatttcgtcagttctgctttcgaacactcaaactaggtgttggggtaagatcatga

SEQ ID NO: 41605 - DNA, 1473 bp, Glycine max
  Peptide Sequence Number=SeqID_158383
atgatggaaggaatcctcatttgtgcagctcctcactgtctcaagtctttcttgaagaaagctgattttgaatctcatatccaagacagccacgccagccttcttcgacccaatgcagataaagaagatggaaatgagtcggaggcacagagtgttaggcaatcgacagcctcagattccactgctcgaggtccccaaagaccagttttttctcctggttcaaattcccagcaacatgatctggaagagaaatctcgtagacagacacctagagagcaaccaccttcaaggcaaaccatgcagccaaagccaccatattatagtcaacaacaacacccttccgataccatgtctggctctgttggaggtggacaacagggctttcatcaacaaagttttgacatacagcatcccccacaagaatcttcccagtttgctgacagacaacaagcagttggtccagagaccccatttcctgagtatccaacaatgcacccagcacaaccttccaatgttccctcactggttacttcaaacccaatgctgaaccctcccatgccatttggttatcccccatacccaaacgaacgagctcagccattttatggtgctccatatgatatgcctaggcaggactcgggttctgatataggtggggaccaaagttcattactgggtttcccacaaggtgtcccaagtggcccaaattttccaggaaattatctccagccctggaattcaggaatgggtggtgtgccttttgaacaagcgcagggtggtatggtcgtggatccaagggagggcaaaggtatattggcaccacagcccatgcccctcccaccgccacctccacctccatcccacatgtcacatgggaaacagaactactattctggggaggttgggcatgatggtcagggttatgggtggcagcatgataaccgtgataactttggtaaccaagggaaacatggctgcttcttcggcatctcttgctggtgcttctgcttcggattttctgaggagttcaaccagcagtttcaatggtgttcctttgagaaccttggggaagggaaagttggttttgaagaggaggattttacagttgctgctaagctgaggaaggtgaagaagcatgaatatctttggcctgctaaccctgatcccaatgtgaaaggtgaggtgctgagccacctttcccagttcaagccactcaaggagaagccaaagcctgtcactttggattttgaaaagcctcttgttgatctgcaaaagaagatcattgatgtaacttctaacttactctctcagtgtgttgtgttggtgcggaagatggcgaacgaaactggacaggacttcagtgatcagattctcttattggaaactaagtaccagcagcaaactgatgatgataagagttctcatgagaaaattgccatcatgcttctctctgattgtcacttgcaagattga

SEQ ID NO: 41606 - DNA, 282 bp, Glycine max
  Peptide Sequence Number=SeqID_158384
atgagggcctgggctttggggttgtgggagtggaggcccagtgggaagagcaggaggggggcctggaggaaggtgagggagaggaaggtggggggtgcgattaggaagagggtaaggagggagctgtggaagagagatgagtcggactgcataatgatagttgctgtggatttgaatgcctcacctgtgccagaggacgatgaagatgattttggccgccaggttgaagagtaccgtacaccagaagagcgtgtggaatctgcagttgatattgctcaccag

SEQ ID NO: 41607 - DNA, 852 bp, Glycine max
  Peptide Sequence Number=SeqID_158385
atgttgggtgttgcaaattccaaatccgatatctcctttgctggcacttacgctagcagtgctttcgctgcatgtttccccgaggtgtgcactcttcctttggacactgctaaagttaggcttcagcttcaaaaacaggcagtacttggtgatgcagtgaccttacctagatataggggtttgctgggaacggttggaaccattgccagggaagaaggtttttcagcactctggaaggggattgtgccagggctacatcgtcaatgtttgaatggggggttaagaattgcgttatatgagcctgttaagaatttctatgttggggctgaccatgttggagatgttccattgtctaagaaaattctcgctggatttacaactggtgctatggcaattgcagtggcaaatccaactgatcttgtgaaagttagacttcaagcagaaggaaaattgcctcctggcgtgcccaagcgctactctggatcattaaatgcttattcaacaattatgagacaggttataatcagttttgttcaatctgcttcctacacacaggaaggagttggagcactttggactgggattggtcccaacatagcaaggaatggtattattaatgctgctgaactagccagctatgatcaagtgaaacagactattttgaaaattcctggattcaccgacaatgttgtaactcaccttcttgctggtctaggagcaggattttttgcagtctgtgctggctcccctgttgatgtgggaccttttgccttttatatggggttcataccaaattttggacggctaggatcttggaatgtgatcatgtttttaactctagaacagggataa

SEQ ID NO: 41608 - DNA, 253 bp, Glycine max
  Peptide Sequence Number=SeqID_158386
atggagatgaaggcatggttcgatgagggagagaaggaagagaggcaatggccatggatattgagagtggaacagacagatgctcttttgggcttagatctccgttttgagtctgacacagattgttgtcaatgggaacgaatcaagtgcgactcctccacagggagagtggccagactcaatctttatcacttgttgcttgatggatttgaagagtctcaactggggatagctggttgcgcatacaatgaag

SEQ ID NO: 41609 - DNA, 654 bp, Glycine max
  Peptide Sequence Number=SeqID_158387
atgaagagtactgttggcgtctgtttcttgtttttccttttattggaagccattcgctgtgaaggctgttggaaggaagagagagatgctcttttcggccttgattcccgcttagaggatcattacttcccctggaacggcccagattgttgtcaatgggaaggagtcatgtgcaactcctccactgggagagtggcccaactcagtttgcggttcagatgggcaaacaaactatatattaattactcggattttgttgtcttcaaagatttgaagaacctcgacttgtcattcaatggcatatccggttgtgcagggactgaagcgccgctccaaaatctggaagtccttgacttgagcagcaacgatttggataatgctgccattctatcttgtttggatggcctttcatctcttaagtctctgtatttaagagatagtaggttcaatgcatcctcatttcacgtttttgaaactctgtcatcaaagttgcgtaatctgaaggtccttgacataagttttaaccctttgacaaatgacatcctgtcatccctcgggggattcacatctttgaaggaactacatctggctggtattgatttggactcagatcttcatattcaaggtaggatcatttgtccatttcattattaa

SEQ ID NO: 41610 - DNA, 2427 bp, Glycine max
  Peptide Sequence Number=SeqID_158388
atgggtagtatagtatattcaaagaccaaaaagtttcaagaagaaagcaattctgttagccatactattgtccctgaacaggattttgaacagttgcctgccctgcctgatgcagttgcctgtcagttttcagccttagaaaagattgtggtcatttatggagatcatagtctctacatctatgacatacatgatgtgaatcgggtcacaaagtgttttgtgctagtttcacattcctcatgcatatgggacatcaagaatctatgttgtgaaaacatgcatgatccatctcttgcatgcactgctagaggttgtttggggggaatttcttttgcaacttgctctgctgatggtacagttaggatatgggatattgctttgcaatctgattttttaaaagatgctgaagagttgaagactgaattattgagttcttcatgtttagtaactgctgggacatttgaacgtgatgcagttaaggcagatcttaccaatcaagagtttcgatcacttgctgttagttcagatggaaattatcttgctgctggtgattgcaaaggaaaccttcatatatacaaccttcatacatcagattacacatgtttccagggtgctcatgatgcagagattcttacattaagctttaccttgtccacccaagatatatctaaggaaattgcaaaagacaattactttcttgcctcagggggacgagattgtatgatccatctctatgatgtgaaaagaaattttgatctcattgacagcattgatgatcattcgggtgcagtgacttctatcaaaattagcagcaatggttgcaggatcctcagttgtagttctgatagtttcctggtgcttcgtgatgtggtgatagcagatagtggctataaatttttgcagcaacatcgtcaaagggctttacaacgtggaactgtctatgacatggctgtggatcggacatgtgagactgttgtcactgttgggcaggataagaagataaagacgtttgacatggctgctcagaaactaattaggtcttacaatcatgataaaaattttggagaacctataaaggttataatggatcctagctgcacttacgtggtctgctcattctctaacaagtccatatgcatgtatgactttatcactggagagatggttgcgaaggccacagggcatgctgaaattgttactggtgtcatcttcttgcctgattgcaagcatatagtttcggtggacggtaatggttgtgtttttgtatggaaattgcctgctccattgtctgctagaatattggagagaataatggaaaaaaataatccattgtctccaagaagttctgttcaacgtccggcttataattatctatcgttttgcaaagaagaatgccgacattccaagatcaatcctgaggatgtttggtcactgaggaacaacagccaaagtggggatggaatgctttatcctgaaagcagtcatagtgaggcttcatcttttaaatttagtgtttcaagacttcccaaatgggctcaagcaaaagtgaccagttccattaatgtcaacaagaatcttaattgcaattcattagagtttcagaatgtgcaagagttgtccaggttccttgtcatttgtaggagagaaaatctagtcactgtcaaactgtgtctggagtatgctccttcatcccctgaagttcaaattccatccgatcatgcttctccattgcctgatactctgaactctcaagattcttcaaggtttggaggaacttatagttctttgctcattaagtcactaaatttcagcaacattccattggacaaccattggcactctatttatactgtttgtatggaagcactttcctccccagagatgcagaatttatgtgagacaaagtttccagagattcccttgagtctaagacaacataaggctgtgatttgtgaggaccagaactcctttgggcctaataaccttagcaagaatgaaaagaggggtgttgctccagaacatgttggctgtaacaataatgatgtttcttggtgttctgaagaagtttctgagagtaaagcagagcagttgtatttaagtgaatctggaagtgtgtcagaaacaactactgaaggcaatttgggaagtctaccatctgaagaagacagtgacatgtttaagcaacattttggtagcttatcaaatacacacaaggtaaagtcgaggaattcattagttagaaggttttctgcaagatatactgtgcaatgggattacccaggggattgcaagaaactttttagcagtcctgttgggaataaaagtggtagaaaaagctctgaggataaaggtgcaactcatactgtatcagaagacagatccttgcaggttaaggaaactgaggaagtgacaaattcttctgaacag

SEQ ID NO: 41611 - DNA, 315 bp, Glycine max
  Peptide Sequence Number=SeqID_158389
atgcgccttttgaatataaaccctgaaaagggtttgtttctcgagaaaatcgagctagaaactccgaaaggaaagctggttttggaggaggtcattgggttgacaacaaagaatggcaatgggctagcgtcaaatgccttgagttccaaatgtgcttatttggcaggttctgtggtggtgatatatgacatgaatttgggcactcagtcacacctcatggtgtctaatagatcaccaaagcctttgagttgtgtagctttgtcacgagatgggtgctttgttgcggctggagagggttggttcgaaactgcatag

SEQ ID NO: 41612 - DNA, 480 bp, Glycine max
  Peptide Sequence Number=SeqID_158390
atgttggttgacttgctactggtctcaggagaggcagccagggctgagacaggacattgccatggaccatacgtatgcctatcttggctacgagatatatacactttgcaagacctcagtcagactgggaggtatgcatggggagctgctgccctggtgcatatgtatgatcacttgaatgatgcttgtatcaacagcagccgacaacttgctggttacgccaccttgttacagtgttggatatataagcactttccgtcagttgcggagtgcatcgctgatccggactacgatgaggtgtctccacatgcatgtcggtggatttctatgaagaagactgtgaagaccatatctacaaagacctacaggcagcatctggatcgacttaggattcttgatgtctgctggatgccttatggggagcatcgactagtccgagaatttcaattgatttcatgctttttccgtcagctccgctga

SEQ ID NO: 41613 - DNA, 602 bp, Glycine max
  Peptide Sequence Number=SeqID_158391
tccaaatctcggcgcaagaattagaccgccaaaagcaagtcgaaactggggtggttgaaataccgagaaaatgtttggaggcaaaagcaagaatcttggcaagtaaaggcgaatgggccctgttcatagacattctcgcactgttgatctttggaggagtcctctttccaaatgtggatgggttggtggacctagcagcgattgacgctttttttgcctatcatgaccacaaggaaagctcggtcgttgctatgcaagccgacctctatgacacctttgaccgaagatgtgagaagaacagtacgaggattgtctgctgtactcccgttctttatgtatggttggtttcacacctttttcgccaagaggtgaggcatgcttgcccgctagaaagccaccgttcatgcacagagaaaggaggggcaaattgggaccaactcttagcaagcaaagaaggggcatctgtcaactggttccctcgatggaaggaaggaagaaccggaggttgcatcagctacaatctcgttcttgctataagacaacttggctaccctatgagaggggcgccactagaggatgagctcgttcctgtcatttcatga

SEQ ID NO: 41614 - DNA, 1154 bp, Glycine max
  Peptide Sequence Number=SeqID_158392
atgagtgaaccacggattatcgccaaagcgatgaaagacggaaaaccggagcaggatctggtgattctgccggcgttggccaaccgccacgggctgatcaccggggcaaccggcaccggcaagacggtgacgctgcagaaaatggccgaacagttctcgcgcatcggcgtgccggtgttcctggcggacgtgaagggcgatctgtccggcatcggcgccgagggcgtgccttccgagaaactgcaggcgcgcctggcggcgatcggcgtcagcgactggcagccgcaggcctgcaccattatcccgtgggatatttacggtgaaaaggggcacccgatccgcgccacgatttccgatctcgggccgctgctgctggggcgcctgttggatctgaacgaggtgcaaagcggcgtgctgcagctggtgttcaagatcgccgatgacaacgcgctgctgttgctggacatgaaggatctgcgcaccatgctgcagttcgtcggcgacaacgccaaacaattccagacccagtacggcaatatctctgccgcgtcgatcggcgccattcagcgcgggttgctgacgctggaagagcagggcgctgaccagttcttcggcgagccgatgctcgacatcaacgatctgatgaaaaccgacgccaacggccacggcgtgatcaacctgctggcggcggacaagctgatcaatcagccgaagctgtattcggtgttcctgctgtggctgctggctgagctgttcgagcccctgccggaagtgggcgaccctgaacagccgaagctggtggtgcgcctgatccgctccaaaggcgtcggcatttactatgtcacccagaacccgctggacatcccggacagcgtgctgggccagttgggcaaccgcgtgcagcatgcgctgcgcgccttcacgccgcgcgatcagaaggcggtgaagacggcggcgcaaaccctgcgcgccaatccggccttcgatgccgaaacggcgatcaccgagctgggcgtgggtgaagcgctggtgtcattcctcgacgagaagggccggccgaacgtggtggagcgggcgatggtgatcgcgccggaatccaaaatgggcatgctcggcgcggaagggctgaacagtgcgatcaacaagtcgccgct

SEQ ID NO: 41615 - DNA, 199 bp, Glycine max
  Peptide Sequence Number=SeqID_158393
gtggctacgacgtggaaaccaatatatcgacaatgatgatgtgagagtttttcgtcgcaagttggatattatgaaacgtcatgagccgtacccatcaaccgttatatcattgttgcctcccgtttgtttagtcggaagtctcacgtggcgaaagacaaagatgtttgttgacccacaaaatgcaaacacgactacatag

SEQ ID NO: 41616 - DNA, 608 bp, Glycine max
  Peptide Sequence Number=SeqID_158394
atgaatcatgatgttcttcaggaaataaacgccgaaccactttttccggtacagagcgatcaacatattgtttttggcgttgacggaaagtttaaagcgcatgcgctaatcacgattctgtccatcatgaaacacgccggtgaccgcgtgtatcatttccatctgatctcttcagaactgacaccggccgataacccccggctcgccaggctgtttcagggatcgcgccacggcgtgacgctgcatcatctgccggaccagctatttgccacgctgccggtcaccgaactttttacccgtgcgacctactatcgctttctggcaccgctgattttgccgcaggcggaaaaactgctctatcttgatgccgatatggtgtgcattaatccgctcaatgaactgtggcagatcccgaccggccctgaggcggttgcgctggtggtcggtgaaattgcctcgctgcagccggtgctggcgaagaatgccggcttgcgcggcgagcgctattttaacgccggcatgatgctgattgatgtggcgcaatggcgcgctgacaatatcagcgaacgcgcgtttactttactgtccgaacacgggcgaaacttcca

SEQ ID NO: 41617 - DNA, 336 bp, Glycine max
  Peptide Sequence Number=SeqID_158395
atgataaatgatggaacatacgaatttggggatcccacggtcatgtggctccgcatgcccccggactcttgggtcacggtaacaaaaagtggggtggtcgacaaaagcaggacttttgctcctatgtatcctcaatttgtgatgagggaactcaggacctacgtagttcttgatagctgtgagactaaaaatagtctcggtgttttcttcaccaaaatgcgaacatgctttagtaaagagacaaaacttccaactgatcagagcaacatatgcttttggatgaaaaacaatgtgtctatcggggaaggagagtatgctgatgaaattttctcataa

SEQ ID NO: 41618 - DNA, 1719 bp, Glycine max
  Peptide Sequence Number=SeqID_158396
atggaatttactgttgaacttgaaatatttgcaagaattcgtcacaagaatcttctcagttttcgtggctactgtgctgaaggacatgaacgattaattgcatatggagattggaagtttggagcaacaaaataccttcaccaccaagcaacacctcatatcatccatagggacatcaaagcaaacaacgtgtatctggattctgatttccaggcccgaattggtggtttccgatttgctaagttgatccctgacggagcaatacatgtgagtacagaagttaagggtaccctgagctaccttgcaccagaatatgctatgttaggtaaagcaaatgagggttgtgatgtctatagttttggcattctctttctagaacttgccagtggcagaagaccggttgaaaagcttagttccacggtgaagcaagcaatggttgatttggcgttgccattggtttgtgagaagaaatttagtgaacttgcttatccgagactaaatggtaactatgtggaggaggagcttaaaagagttgtttttgttgcacttatatgtgctcaggttctacctgggaagagaccaaccatgcttgatgtggtcgaactggttaaggttccggtagtacggtgcaagctttacttttggatcaaggggagtggttatttacaaatagcagaatcgaaatcacgttcccctaactcaccagtcaccgctaaggaattacactctgccacaaataatttcaactatgataacaagcttggagaaggtagcttcggcagtgtgtactggggccaactttgggatggatcacaaattgcagtgaaaagattgaaagtttggagcaacagagcagagactgaatttactgttgaacttgaaatattggcaagaatacgacacaagaatcttctcagtcttcgtggctactgtgctgaaggacaggaacggttaattgtatatgaatatatgcaaaatttgagcctccactctcatcttcatggacatcactcattcgaatgccttcttgattggaatcggcggatgaacattgcaattggttctgctgaaggaattgtgtatcttcatcaccaagcaacaccgcatatcatccacagagatattaaagcaagcaacgtgttgctggattctgatttccgtgcccgggttgctgatttcgggtttgctaagttgatgcctgacggggcaacgcatatgactacaaaagtaaagggtaccctgggctaccttgcaccagaatatgctatgttaggcaaagcaaatgagagttgtgatgtctacagttttggcattctccttctggaactcaccagtggcaagagaccaattgaaaagcttaattccacagtgaggcgatctatagttgattgggcattgcatttggtttgtgagaagaaatttagtgaaattgctgatccaagactaaatggcaactatgtggagggagagcttaaaagagttgttttagttgcacttatgtgtgctcaggatctacctgagaagagacccaccatacttgatgtgatagagctactgaagggagaatctaaagataaattttatcatatagagaacagtgaaatgttcagaagccttctagctgtagaaagcaatgatgagacatcagtggctgaagacagtttagactatatatcagaagaaaaagaattacaacgtcccttgaaagggaataattaa

SEQ ID NO: 41619 - DNA, 618 bp, Glycine max
  Peptide Sequence Number=SeqID_158397
atggcagaacctgaccacatatttgtaaatcctttgcctaatttgactaatggaaaccaaccagcagggtatccatttttttatataaaaccagttaaacatggaaaaataattaggaaattctaccccaaggcgaacggtcctattactgatattgatcccattggcaattctcctgtaatcattcagaagtccttgctggaggaaatagctcccacatgggtgaatatttccttgcaaatgaaagatgatccagaaactgatgaaacttttggatgggtacttgaaatgtatgcgtacgctgtagcatcagctttgcacggtgtacggcatattcttcatgataacttcatgctccagccaccatgggactttgatgttgagaacaagtttataatccattatacttatgcatgtgactacaatttaaagggggaactaacatatgggaagattggagaatggcgttttaacaagagattttatctaacaggtcctccacccaaaaacctttccttaccccctcctggagttcctgaaagtgtggtgctgctagtaaagatgattaatgaggctactgctaacatacctaaatgggattccttaaatagaagctga

SEQ ID NO: 41620 - DNA, 588 bp, Glycine max
  Peptide Sequence Number=SeqID_158398
atgttggtggctgatggagaggatcatcgctggtggacggtggagaggatcgatgcgacggatagagatgtcgagacggtgactgcagtcactcaaagcagcaacagtggttgcagtggcaaggagcagcgctggccttctttattcaatgttgagccccctaacaatgaagtagaatcaccaaccggtctagaaaatattcaactagatgaaggagaagaaaattcaagtgtttactcatcgtcttctaacccagggacacccattgaagttgaagaatatggcacgacatcaacaatgtctcgttcaataggacaaaaagcaacaaaaaggaagagcaaaggaaaaagagatgaaaacacttctaacaatctcaatctgtcaagcatagaaagtgcaatgaaggataaatatgccaacattgcaaaacttattgagttaaaggaggcacaggaaagacatctgcaagaacatgagaggtgtttggagtatgaaattctcatgaaggacacatctgacatgtctgagaagcaactccaagaccataaaaagtattgtgactatattagacagaaacaaggattttaa

SEQ ID NO: 41621 - DNA, 234 bp, Glycine max
  Peptide Sequence Number=SeqID_158399
atggacccaaacatcgatttagacacacttttagatcaaatggtagatgaggaacttgaagacaacacaaaagaacaacaagtcgaggtcactcgtggtcacagattgagaagaaaggtgaagtgcactgttgctcttcgtatatttgcatatggctcacccagtgatagtgtggacgagtgtatttggattgttgaagccattgcatcggaatgcttacaaagatttgtataa

SEQ ID NO: 41622 - DNA, 261 bp, Glycine max
  Peptide Sequence Number=SeqID_158400
atgcagaaatgcaattttgttatggtagaggagtgtgccgtggtaaatgtgcacgatagcacaatggtggaaaggagttgtgcatgtggagcctcgaaggtgaaggtcgctcgagctaggaatgttgtgcgtgacaacaataatggtggagaggagttacacgtgcgaagcctcaaaggtgaaggtcacatgcgaggaggagatgagatagggttgtgcaactatggcgaggggaggaaggagccacgattctggacctga

SEQ ID NO: 41623 - DNA, 165 bp, Glycine max
  Peptide Sequence Number=SeqID_158401
atgatgctactttcagcagaaagaagtcctgaaggtcctgcagctcaaaatgttgaaagtacagtagcaacagtggcggaacaaactgcacaacttgaagatcattatgacctgtggaagaaattgaaggacattgcaggaattacccatttgaggaagctctaa

SEQ ID NO: 41624 - DNA, 1227 bp, Glycine max
  Peptide Sequence Number=SeqID_158402
atgctggaatctgggattatcaaacccgccaaccgcccttactccagtcctgttatatcagtgaagaagaaagatgggagctggaggttttgtattgattatagaactcggaataaggtcacagtacttgacaaattccctattcctctgatagaggaattattagatgagttgaagggggctaaatttttttctaagatagatcttagagctggctaccttcaaataaggatgagacctgaggatattgagaagattgcattcagaacacaccaaggacattatgaatatgccataatgccctttggactgagtaatgcacctgccacctttcaatgtgcaatgaacttgacattacaggattttttgaagaaatttgtattggtgaatgagttctttgccaatattaagaagtgtagctctgggaagacaaagatcgaatatctaggtcatatgatttcaggagtcggggtggcagtggacaagaaaaaggtgcaagctgttctaaattggcccattcctaagactgtcaaggctttgagaggttttctgggattggcaggatactataggaggttcatctgtggttttggaaaaatagccagacccttaaataacatgttgaaagcaagaaatttcaagtggaccactaaaagttctgaagccttcaagaggttgcaggaagccttgacctctgcaccagttttaacaatgcctgattttgaccagccatttgtgatcaagtgtgatgcctcagaaaaagggattggtgttgttttatcccagaataaaaaggctattgcttacttcagggcttcaaatagggtagctgatgctttgtcacgaaaggaggaggataaagagattcaagcgctgaccagaccctattggcatgaggtagctgagattgacagagaagttcaggaggatccagtattggctaagattaaagatgacctcagactcgacccaaattcatatggtggacattctggagtggacagaacatatagaagattggcacaatcattgtattggaagggtatgatgaagacaatacaggagttggtggcaagatgtcaggtctgccaaagaaacaaatatcaggcctcttctccagcagggctactgcaaccactccctgtgccttatcagggttatgttgtcatgaatagaccatgggcttttgtccagtggctggagaaagcagacattgaggaagagtaa

SEQ ID NO: 41625 - DNA, 291 bp, Glycine max
  Peptide Sequence Number=SeqID_158403
atgaaggaaggcataggtcacatcttagacctcactcccataggagagaaaaggaaagaaagccttaagaggctaacattaacctctcatacttccataggaagaacaatggtagagcaacaacttaaaaggaagtctgcttcaaaatcttatggctctcactcatatccaaagaaaaaccaaggtcaaggcatcttaggggaggcaccttctaagcccaaagatgataaggaaaagacaatagaaaagcaaccccctaaggctagtatgcaagagaagactagctattag

SEQ ID NO: 41626 - DNA, 963 bp, Glycine max
  Peptide Sequence Number=SeqID_158404
atggagtcagatcctgtgaaaattgctgtggaaggggttgaacgattcaagcaagaaaactgtgatcttataattgttgacactagtgggcggcacaagcaagaagctgctctttttgaagaaatgcgccaagtttcagaagcaacgaaaccagatcttgttatattcgttatggatagcagtatcggtcaggctgcttttgatcaggctcaagcatttaaacagagtgttgcagttggagctgtcattgtcactaaaatggatggccatgcaaagggtggtggggctcttagtgctgtagcagcaacaaagagtcctgtcatattcattggaactggagaacacatggatgaatttgaagtttttgatgttaaaccatttgtcagtcgtctactaggcatgggagactggtctgggttcatggataaaattcatgaagttgttcctatggatcaacaacctgaactgcttcaaaagctgtcagaaggaaacttcaccttgaggattatgtatgagcagtttcagaacttacttaaaatgggtcccatcagccaggtcttttctatgctaccaggatttagtgctgaattaatgccaaaaggccgtgagaaggaaagccaggcaaaaattaaacagttggatagttcaaacccaaagctcatgaatgagtcccgaatgatgcgaatagctcgaggttctggtcgtccagttagggaagtaatggaaatgttagaagagtacaaacgtcttgcaaagatatggagcaaaatgaaagggcttaaaatacctaagaagggtgaaatgagcgccttatcccgaaatatgaatgctcaacacatgagcaaagtcctccctcctcagatgctaaagcaaattggaggcatgggtgggttacaaagcttgatgaagcagatggggtctgctaaagatatgatgggaatgtttggcggtggtggtgattag

SEQ ID NO: 41627 - DNA, 567 bp, Glycine max
  Peptide Sequence Number=SeqID_158405
atggttctcgcggagttaggagggagcatttcgcgtgctcttcagcagatgagcaatgcgacgatcatcgacgagaaagtcctcaacgattgcctcaacgacatcacgcgcgcgcttctccaatccgatgttcagttcaagctcgtccgcgacatgcagaccaacatcaagaacattgtcaacctcgaagacctcgccgcaggtcacaacaagcgcaggatcatccagcaggccgtcttcaacgagctctgcaagatcctcgatcccggaaaaccctcttttacccctaaaaagggcaaaaccagcgtcgtcatgttcgttggcctgcaaggaatgacgatattgatgctcgtggtgtgtgcttcaggatctggcaaaacgacgacgtgtacgaaatacgcgttttatcatcagaagaaagggtggaagcctgctctggtgtgtgcggatacgttcagagctggtgcttttgatcagttgaagcaaaacgctactaaagcgaagatccctttctatggaaggtacacgccggttttaactgttgttggatatgagatgactcgttag

SEQ ID NO: 41628 - DNA, 573 bp, Glycine max
  Peptide Sequence Number=SeqID_158406
atgagtcatcattcatctagtgttaatggtgagggtactagtcataaggaccctctatctagaatcttagatgagttgagttccctcaagttatggaaagaaaaactagaaagaaaagaaaaaggaaaagagaggttaaaaataaatcaagacgagagggaacaaataagggaagaagaaagaaggaaaatactaaaagagatgagaaaagagaaaaaacatgcctcctatagaaggcataggtcacatcttaaaactcactcccatagaagagaaaaggaaagaaagcctcaagaggctaacattaacctcccatacttccatgggaaggacaatgtagaggctaacttagtttgggaaataagggtagagcaacaacttaaaaagaagtctacgtcaaaatcttatggctctcactcttatccaaataaagaccaaggtcaaggcatcttaggggtgacaccttctaagcccaaagatgataaggggaagacaatagaaaagcaagcccctaaggctagtatgcaagagaaaactagctctataaagtgctttaaatgtcttggaaaatga

SEQ ID NO: 41629 - DNA, 486 bp, Glycine max
  Peptide Sequence Number=SeqID_158407
atggctactccacccagctttcctcctcctcttccttctcctcctcctcttactgaagcagcatcacaaccagtggtccacatcgatccttcgatcgggaaggccgacgatccctacaagaagaaattaaaaacatatttggggattgtcgcttgtgataaggtcaacgtgaaatacgagaattggaagcaaagacaatttaagtctgatttcacatcaaaatgggcacttgcaatcgataaggacaatgtggatgacactatttgcgaaaaatacggcattagtaaggaggagcgagcccagttttgtcagagtcgcagagacctctcgtgggaggatgtgcagaaaaaggcacaagccatccagaagcaaaacactgccccctacatgttgtctcgtaggggttatgaatatttagaacaaaagctgatggctgagaagacaaagaaaaaactggtggaagctgctcaatccaaaagcactgag

SEQ ID NO: 41630 - DNA, 498 bp, Glycine max
  Peptide Sequence Number=SeqID_158408
ggcaggctaaaacagttaacttcggaatcatttacggtcagggcgctttcgcactagcagaacaaacagggctatccagatcagaagccaaacagatgatcgaagcttattttgagacctatccgaagctgaaagagtatatggctgagcaggttaaaaaagcccgcgagctaggatatgtagaaactattttaggaagaaagcgtcatttaaaagatatcaactccaataactttgttgtgcgtggccatgcagagcggaatgccgtcaatgctcctgttcagggaagcgcggcagatgttgtaaaaatggcaatgatcaaaattgacaagcaactggatgaacaaaatcttcaaactaaaatgctgctgcaggtacatgacgaattggtatttgaatcgccgatcgaagaaattgaagttgctacaaaacttatcaaaaccgaaatggaaagtgctatcgaaacgcaggttcctttattggttgaggttggagtag

SEQ ID NO: 41631 - DNA, 216 bp, Glycine max
  Peptide Sequence Number=SeqID_158409
atgcaacagctcatgatgttgcttgaccaagatcaatatattcgctggcataggctgaaagatgaaaatgttcggtttcagggtcttttcatgaaagttgatgcactcgttggggttattgttaccgacagagatttggttttgatgaatgcagtgaaaactgtattctcggatgctacgaacttgtgtgttgatttcacattgacaagaatgtga

SEQ ID NO: 41632 - DNA, 1186 bp, Glycine max
  Peptide Sequence Number=SeqID_158410
atgacatcatcagtctttcaaggtggtttcaacttcagctcaaaacttcaaaatctttatttgggaaattgtagtcttactgatcgaagttttcttatgtcatcttctttcaatatgagttcttcatcttctcttgtttcccttgatctctcctcaaatctgttgaaatcgtcaactatattttactggctctttaactccactaccaatcttcataacctcgtcctttataataacatgttagaaggtcccattccagatggatttgggaaagtaatgaactctcttgaagttcttgacctctccggtaacaaactgcaaggcgagattccatctttctttggtaacatgtgcgcattgcagagtttagacctctcaaataacaagttgaaaggggaaatttctagcttcttccaaaattcttcatggtgcaacagatacatatttaaggggttggatttatcttataaccggttgactggcatgttacctaaaagcattggattgctatcagagttggaggatcttaacttggctgggaattctttggagggtgacgtcactgaatcccatctttctaatttttccaaattagaaatgttgtccctatcagagaactcgttgtctctgaaattggtcccgagttgggttcctccattccaattaaaatacttgggaatcagatcttgcaagttaggccccacctttcctagttggctcaagactcaaagttctttgtataggcttgatatttctgataacgggattaatgactctgtaccagactggttttggaataacttgcaatatatgagagatttaaatatgtctttcaattatctcattggttcaattcctaatatatcattgaagcttcgtaacagaccgtctgtacttctgaatacaaatccgtttgaggatgtatcacacaatcaaataaaggggcaactcccagattgttggaaatcagtaaagcaattagtgtttcttgatttaagcagcaataaattgtcagggaagattcctatgtccatgggcgcccttgttaatatggaagccttggttttacgaaacaatggtttaatgggtgagttgccttcttctttgaagaattgcagcagtttaattatgctggacctgagtgaaaatatgttgtcgggtccaataccatcatggattggagaaa

SEQ ID NO: 41633 - DNA, 369 bp, Glycine max
  Peptide Sequence Number=SeqID_158411
atggctccaaagaaactctccacgaagaggtctagaatagacgccacaggagaaggatccagtgctgcctcagagtttgatagtcatcgtttccggagtgccgagcaccaggagaggcgtgtccagctcagggaggatgagtatacggacttccaggaggagatagctcgcagacattggacaccgctagagactcccatggccaagttcgaccccgagatagccctagaattctatgttaatgcctggcccgcggaggagggagttcgggacatgcactcgtgggtgaggggtcagtggattcccttcgacgccgatgccctcagccagttcctgggtgacccgctagttttggaggaaggccagtag

SEQ ID NO: 41634 - DNA, 358 bp, Glycine max
  Peptide Sequence Number=SeqID_158412
atgtctcgcaaggaaaacataatctttgagttgcataccaagaaagggacttggaagaaagtagtacgaatcaatgatatgtggcatgttaacaagcacaatggtagaaaagcaatagaaatggtgttcatggaccaaatgggtgcaaagattggtgctactttttcacgggaactgtttgttgaatttgagtcaaggttgcattgtggttctgcatatgtcattcagaacattaaggttgttgagaatcattctgaatacaaagaggccgagcatcctgagattcttcctggtgtccatgttattacttcatttactgatattattgttgaggtggcaccacgtgacactttagttg

SEQ ID NO: 41635 - DNA, 327 bp, Glycine max
  Peptide Sequence Number=SeqID_158413
atgacgttgctacttagcaaccttcttcccagcgaccatcactctgatctcccccagccgaagtggatcgcgtcccctatgaggagccccttggacctggagaagtccaacagggccctagggttcccagctctgatcatcaggtcccccattaaccgggctttcatcaagaagttttgtgccccctggcaagcgcagggtgaggcaccacaacagcctagggatggccagcaactggcaacagacgcacgaccaccacctccaaagttcacctcagctcatatacaaaggctagagtgttgcctacaacctgtggtcgaccagtag

SEQ ID NO: 41636 - DNA, 296 bp, Glycine max
  Peptide Sequence Number=SeqID_158414
cccagtggacccggagaagtccaacagggccctggggtttccagctcgggttacgggcctctgtcagtcctacagggtgcccgtcccccccagcaaggtcatgccatcgtgacatagggattgcgcctgcaagacacccaatggacccggagaagtccaacagggtcttggggtttctagctctgattatgggcctttgtcagttctacgaagcgcgtgttgcccctaacaaggtcattaggcccccaattaaccgggctttcatcaagaagtactacgccccaaggcaggcgtag

SEQ ID NO: 41637 - DNA, 228 bp, Glycine max
  Peptide Sequence Number=SeqID_158415
atggcacatcacccccactccttatgttcccatggacccgggtatagggccccttttcaactcacctccccagtggagtcaccaactgtcgcaaccaacccttcggtggaagggcgacacggggctcacgggtgcatcttccaagggaggaaggcacgtggagtcgccaccaacgtttattcaaggaaaacgtcagaaaaaccgaaacgtgtggtctacgaactttaa

SEQ ID NO: 41638 - DNA, 438 bp, Glycine max
  Peptide Sequence Number=SeqID_158416
atgataaacattatattgcccgtggattttggggataaaacagaacaactcgtagatggtgcgatcaaatttgccaaagagataaatggcaagattcatctgatccatgtagcacctacagacattggatttgctattggtgatatgggatttcagtattttcctgaagttgaagaaaatgagatcagagaagaactggtacagctgaataggcttgaacagagaattatttctcacgatgtagaatgcgagcatcttttaaaacaaggtattgccaaagatattatcctggaatacgctaaatcaaaaaatgccagctatatcgtaatgggctctcacggaagaagtggaatttatgatgtttttgtaggcagcctgactaaaggtttaacgaaaagctctacaattccggttttggtacttcctattcacgaataa

SEQ ID NO: 41639 - DNA, 138 bp, Glycine max
  Peptide Sequence Number=SeqID_158417
atgggtttctgcgggaaagaaaaaggctacaatgcgaaggatatttctctcagctcaaacatgatatcgaaattcccaatggagagaatgcttggaattgggttgcggtgtttaaatttcacgatcatccaatgctag

SEQ ID NO: 41640 - DNA, 378 bp, Glycine max
  Peptide Sequence Number=SeqID_158418
atgggagaagagcggtgtaaagctgttaaagaagaattcgacaagctactacgtgcaaacttcattagagaggtcaggttctttacctggctcactaacatcgtcatggtcaaaaaggccaacggtaaatgggcgtgccccaaagacgcatacactctgtctagcatcgatagactagttgatgggacgttcgggttccaggtgctaagcttcccggacgcctactccagatacaaccaaattagaatgcatcctctagacgaggagaaaacaacattcattactaaagatgtcaacttttggtacaacatgccattctgcctcgaaaatgcaggtgcgacataccaacgactaatggaccgactcttcaaacaatag

SEQ ID NO: 41641 - DNA, 375 bp, Glycine max
  Peptide Sequence Number=SeqID_158419
atgaaccaaaacaccaaccagggaaggaattttccagaaaagaagcttgtaggattcaccccaattctggtgtcatatgttaacttactcccatatctactcaataatgcaatggtagccataatcccagcaaagattcctcaacctccattttcccgaggatacaacttgaatgcaacatgtgcttatcatggaggagttttggggcattccattaagcattgtatgaccttgaaacataagccaacaatagatacctcagagccctacactggggcaatgagaggcaccatgcatgagcctcaagcgaacctaggggcagatcaaaattctcatccggtaggtcaaaaacccgaaagggcggccaaggattaa

SEQ ID NO: 41642 - DNA, 288 bp, Glycine max
  Peptide Sequence Number=SeqID_158420
atggaatcaagaaaaagagctataacagaagacatcccttcgtcatccactccagctcctccgtcagtaactgtaggacaggatgtgcaaagttcaccaactttagttcctatgctacaaagcttattccgaggacagttcattatcatgcacagcctgcaagagttggctcacaataggccaatcatatctatggagcattttcttgagcaagtagcctggcctgaagctcaacttccattggtgagacccaacgaggctgcttcgcttgagcccacacctgtgcag

SEQ ID NO: 41643 - DNA, 201 bp, Glycine max
  Peptide Sequence Number=SeqID_158421
atggaccaattaaagcgcctaagcatcccctcagaaatgcttagattctctaaccacgctagttacccacgtctgggccatccgacaagaaaaatcagcatgcaacagagacaggcaaatatccgcatagttaggttccctgaccctaactatggtgttaaaacgataaatttcataataaactccccttacctatcgtga

SEQ ID NO: 41644 - DNA, 402 bp, Glycine max
  Peptide Sequence Number=SeqID_158422
atgggagagttggatcagctagaggaaaggctcagggacattgaaggaggcgaagattatgcctttgctaacctagaagagttgttcctagtacccaatatcatcacccctcccaagttcaaggtgtcggactttgacaagtacaaggggattacttgccccaagaaccatctacagatgtattgttggaaggtgggggcatacgcaaaagatgagaaactgctgatacatttttcccaagaaagtcttacggggacaattgtcacccggcagtgtcagttgatgcaatcctaccctccaagggcattggatagaagactccaagaagattgggccaaagatgcaagagaaggccctagggttctcatgagccttagggtagattttgggcccatgggctaa

SEQ ID NO: 41645 - DNA, 300 bp, Glycine max
  Peptide Sequence Number=SeqID_158423
atgaccctgggtacattagtttatgatactgaacctgatgattatataccttatctgtgtggtctaggctacagcgatacccaagttgggatcattgcacacaaaacaattaagtgctctaagatttcaatcattcccaaaggagagctcaactatccctcattttctgttgtgcttggttccccacaaacattcacaaggactgtgaaaaatgtgggtgaggctaactcatcttatgctgtcatggttaatctaccagaaggggttgatatcaaggcacctaatgccttagggcactag

SEQ ID NO: 41646 - DNA, 177 bp, Glycine max
  Peptide Sequence Number=SeqID_158424
atgacgatgagagcttttgagcaaagcagctacgccactaagatgtggaatggccaagtagctaggatgttcacacctggttgtatgatgtctggtttcaatatagcaggacttggcaagttgggaactcttgaagagaaggatgtaacaacaggagctaagaattttcaattatag

SEQ ID NO: 41647 - DNA, 147 bp, Glycine max
  Peptide Sequence Number=SeqID_158425
atggtcaaataccacaccaaatccaagacagagatgaatcgaggtacttggggacgggcacgaatggacgctaggcccatgatcaacagatcgctgtcccgcatccagctctggacaatcgagaagcgctactgggaggcagcctag

SEQ ID NO: 41648 - DNA, 788 bp, Glycine max
  Peptide Sequence Number=SeqID_158426
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaagggacgggggaagccgtctgatagcgctctgtgcgcgtactccgaaaagggaatcggggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 41649 - DNA, 456 bp, Glycine max
  Peptide Sequence Number=SeqID_158427
atggatccaatctcaatcaaactggatgatgacaatttcccagcatggaaggctgaagtcttaggaaaaatcaaagaacgcaaccttgaaaagttcatgacaatgaaagatttgggaggaaggccacccaagtccagtgaagaatacaaaagctggaaggagcaggatcaggttctttataggtggcttcttgcatccttgtctacaaagattcttcacggaattgcaagatgtgaatatgctttggaattatggaaggtgatagaggtttatttcttagatgggtgggtaaacggacccaagtccatagactggcctgcggggcctacagtccgcgtgagtaatgaaccaatttttttaaacgatccatggttatgtcatatttttggacccgccccgcttaatccgtggaccatgcgggtttggcctgcggggtctgtgggttacccgtattag

SEQ ID NO: 41650 - DNA, 387 bp, Glycine max
  Peptide Sequence Number=SeqID_158428
atgactattgaagaatcaattcatgttgcttttgatgagactaactctattagcccaagaaaggatatacatgatgatattacaaatactttagaagatacgcatattcatgaagaagttcacaaagacaaagaagatggaaatagtagagattctcaatccaaagaaaatcaaataaacatggattttccaagggagtggagaacttcaaggtatcaccctctcgataatatcataggtgacatctcaaaaggggtaacaactcgacactctcttaaagatgttgtagaagcaagtttcatgatgatgaaccaagcaattttgatgataccaaaagcccaagtgattgattcaagtttgattcaagacttcaagatcaagcattaa

SEQ ID NO: 41651 - DNA, 252 bp, Glycine max
  Peptide Sequence Number=SeqID_158429
gaagaagcatacataagcggcctctttttctcaccggtgacatcggcgaaagaaagaaggctaccgcgggtagagatcgaccctggggcctccatcaacgtgatgccactgcgggccctagccgatcttggaatgaattcctacgagccggctaagtcagaccaaggttactattccggggtacaatgccgactcgcagccatcggcaagattcgtctcttgtgtgtgccaaacatgggatctgaagactga

SEQ ID NO: 41652 - DNA, 540 bp, Glycine max
  Peptide Sequence Number=SeqID_158430
atgtggtggaaaggaaaagatgttgattatgactccctagaagatttgatgacagatcaagacgcactgaatttggcaaactatgctttggagcataagcatgaagctaagatttatatggccaataatgttgttaatgaggagctaatcaatggtcagggtgttgttgaaatgtattttgaaggttatgataatgacttagagtatggtgtaaatgatgcttttgactgggactttggtctagataatggtcaatcatccatgaagcagaaagcaaagaagaaggtggctaataaggatccacttgagatgtctggtgacaatgaagtcgacccaccacatataggtagtggggtgtttaacaaaggctacaagaatgaaagcaaggacactaagaagttaatacttagcatgcaattaggtgattggttactcattgtcgagatgacgacgtcgaccaccttccatcacttgttctacgacaaccttcataacttccagatctttccatggtcaccagtgacggatctaagacgctaa

SEQ ID NO: 41653 - DNA, 285 bp, Glycine max
  Peptide Sequence Number=SeqID_158431
atggcatgcagagacaaatatggtcatctgcccccttttgtcgaagactcaatgtctttcgaccgagactattgtaatctacctttaccctccatagacaagaaagtcagatggcatgcagatacaaatatggtcatctgtccatttggtcgaagactcagtgtctttcgtccgagactgttaaagtctccctttgctatccagagacaatcgagtctgatggcacgcaaagggaaatatggtcatctacccccttttgtcgaagactcaacttctttcgactga

SEQ ID NO: 41654 - DNA, 330 bp, Glycine max
  Peptide Sequence Number=SeqID_158432
ggttcgcacccacaaagacatccagtggacccggagaagtccaacagggccctggggtttccagctctggttacaggcctctgttagtcctacagggtgcccgttccccccagcaaggggtcgcgcctgcaggacacccagtggacccaaagaagtccaacagggtcctgggtttccagctctaattacgggcctctgtcagttctacagagtgcccgtcacccccagcaaggcaaagggcgagacaccacaacagcctggggatggccagcaacaggcaaaaaatgcaccaccgccacctccagagccgctcagctcatccacgaaaag

SEQ ID NO: 41655 - DNA, 180 bp, Glycine max
  Peptide Sequence Number=SeqID_158433
atggcacgcagcgtgtccgcttcgtgcccctattcaaggggcctatatgggagagagctaaaaaggtttttagtgataatccctaaggtggtcatatctctcttgatggtctctggaggaattaatgaaacattgggcttaatccggattttggttatggacttgaagagggcaaattaa

SEQ ID NO: 41656 - DNA, 405 bp, Glycine max
  Peptide Sequence Number=SeqID_158434
atgactttagcatataattccctggatacaacatgtataccgatgtataatatgaatgtttattacacatgggttatgcctttcttgaattcgaggagagatctaagctctgggagggaggaggaaggagtagagataatgagcaaaagaagagacagcaacagcgacaagaatgaagttgggtgggaattcatcggagtcaatgtggtcagaaacagaaacaaagatagagacaccttaattattattcatctacagaggaaccctagggagtggacaacgagtaagaaaataagagcatgtctggtagagggaaaggagtgggagggtgcaaatagaatgatgcacccactattcctaatttccattctcacatgggatggggtttctatcttctaccattga

SEQ ID NO: 41657 - DNA, 2208 bp, Glycine max
  Peptide Sequence Number=SeqID_158435
atgactgatgctatcaaggatgctgttggacggccaaggccagacttcttctggcgttgtttccctgatggaaaaggggtgtttgatccagtaacaagtaatgttctgtgtactggagataagggtgttattaaggaagggcacaaaagtttccccagtggacatacctcttggtcctttgctggtcttgtttatcttgcttggtatctatctggaaaacttagggcatttgaccgcagggggcatgttgcaaagctctgtcttgttttcttaccaatcctcgtggcagctatgattgctgtctctcgtgttgatgattactggcatcattggcaagatgtgtttgctggagctcttatagggatgataattgcttcattttgttacttacaattctttccacctccatatgacgtagatggttggggacctcatgcatatttccagatgttggctgaatctcgtaatggtgctcagccctctactgtcaataatgagattcatcatgtgcaatctgctgagcttcaggctgtatctttgtatatcccacctcaacatgatgcagatacacgaggcaatagctgggattcaagccccatgttagtggagaaaacagctagcaacataattcatgttgagctaacacttggcaaaaaccaacacgtacgctttacttctgtgtttctttacttgaagatcatggattctgcagctactgaaaacatgatatccccatcacatgtggttgcaattacaaatggtgatgcttcttcttcacttgattctggtcatgcccgtcttcttgaacttggttacaaacaacaactcaagcgtgatctttcagccatttcaaatttctccctctcgttttccgttttatcagtgctgactggtatcaccaccctatacaacactgggttgaactacggtggccccgtttcaatgcaatatggttggtttatagcttctggtttcaccatgcttgttgcactctcaatggctgaaatttgttcatcttatccaacttctgggggtctctattattggagtgccaaacttgctggccctacatgggcaccctttgcttcctggattactggctgcactggtggcaaaaatggtggtggatatgaggcatccaaatatgtagtcattgcttttcatgggggaatattgttcctactcggtattattaacagtcttcctatctcagtgatatcattcttaggacagctgggagctatctggaatgctttaggcgtttttctgcttatgattctcattccatctgttgcaaccgaaagggctagtgtcaagtttgttttcactcatttcaatgataaaaatgacaatggaatcaacagcagaccatacatatttctcttgggacttctaatgagtcagtatacccttagtgggtatgatgcttcagctcatttgacagaggaaacaaagggtgctgatagaaatggtccaaaaggaattatcagctctgttgggatatctattatagttggatggggttacatactaggcattgcctttgcagttactgatatcccttaccttttgagtgaaagtaatgatgctggtgggtatgccattgctgaaatattttatctggctttcaagagaagatatggcaacggaattgggggtattatttgcttgatgattgttgctgtttccatatttttctgtggtatgactttagtcactagcaattcaaggatggcttatgcattctctagagatggggcaatgccgttgtcatcattatggcacaaagttaacaagcaggaggtccctatatatgcagtttggctttccgttttcatatcattttgtatggcactaacgtctctgggaagcatagtggcattcgaagcaatggtgtctatagcggtgattgtcctgtatattgcctatgccctaccaattatctttagggtaaccttggcccaaaagcactttgtccctgggcctttcaacttgggccgttacggaatcattattggctgggtttcagttctctgggtggtgttcatctccatactcttctcattgcctgtttcctacccaattaccattcagacacttaactacactcctgttgcccttggatgtttgattattcttgttgtctcctactggatactcagtgctcggcactggttcaaaggccctataaccaatgtaaaacactga

SEQ ID NO: 41658 - DNA, 168 bp, Glycine max
  Peptide Sequence Number=SeqID_158436
atggaagcttcgggggctgctattcctgttgtttcccaaagtacgtgttctctacgggtcggtgttcgcttactcgaaacccctagggatattccaacagaaggcggtgccttctggtggaagcaacctagctcacctgggcgagctgagctcgcctgggcgagctga

SEQ ID NO: 41659 - DNA, 1134 bp, Glycine max
  Peptide Sequence Number=SeqID_158437
acaactagaatttatgctccgtggaaagttgaggcttctctccaagatggagaattttggcatgaaatagctcgccctcaagttcatggacatgatataaattgtatggcagttattcatagtaaggggaatcatcgttttctctgtggagctgaagaaaaagttgccagagtgtttgaagccccgttatcatttttgaagacattaaataatgccactttgcagaagtcctgttcttccgatgatatcatgggagatgttcagattttgggtgcaaatatgtcagctcttggactatcacagaaacctatttatgctcaagctgtgcatgaggcccctaaaagaagtgggatcgatggtcttgacaccattgaaactattcctgatgcagttccaactgtgttcactgaaccacctattgaagatcaactggcttggcatacactttggcctgaatcacacaaactctatggtcatggaaacgaactattttctttatgttgtgatcataagggtgagcttgttgcttcttcatgtaaggctcaatctgcagcagttgcagaggtatggctttggcagttgcaagagtttcttattggctactgcaactcagcatatatcctaatcacgcagttgtggtttacaggcaccggtgaaatcagttatagtcttcttgtgagacaggaggggcacaaacggattatctggtcatgttcttggaatccacatggtcacgaatttgcgacaggttcaagggataagacagtgaaaatctgggccatagagagggagtctgtcaagcagcttatgtctttacctcaatttacgagtagtgtaacagcattatcttgggttggtctccatcatcggaagaataatggacttctagctgttggaatggaaaatggccaaatagagttgtggaatctgtcttataacagagcagatgatgggagcatagcagcaccaggtttggctgcttctcttgctgtacgtatagatccttttatatgccatgcgtctaccgtaaaccgtctagcatggaagaaaaatgaggatgatcaaacgagtatgcaacttgcttcatgtggagctgataattgtgtaagagtgtttgatgtatctgttgagtaa

SEQ ID NO: 41660 - DNA, 2166 bp, Glycine max
  Peptide Sequence Number=SeqID_158438
atggaggcgcaaccgccaaccccctcgaccgccccgccgcctccgccgcagcacctcagctaccccgactccgtggaatcctcgccacgctcccgcaacaccgactcctgggacgagcccttcgcgccggcgtcgacgaagctccgcctcatgtgcagctacggcggccatatcgtcccccgcccccacgacaagtccctctgctacgtcggcggcgacacgcgcatcatcgtctccgaacgcgccacctcactcgcggacctctccacgcgcctctcgaaaacattcctgaatggaagacccttcacgctcaagtaccagctccccaacgaggacctcgattccctcatctccgtcaccaccgacgaggacctcgagaacatgatcgacgagtatgaccgcaccgccgccgccgccacctccgccgtcaaaccctctcgcatccgcctcttcctcttccccaccaaacccgaatccactcactctatccctgcccaaattctcgacacgtcagccaaatcggacgattggtttttgaatgctttaaacggcgccggattgcttaaccgcgggttttcggactctgcctctgttaattgccttcttggacttgacgacgaggttgccgggaacaacctcgaacccggttcgaaggacggtgtggatggtggtgttggcggtggtggtgcttcgcagggtggatctttcgggaacgggaagaatttgaagcaggatgttcactccgttcctgattcgcccatgctcgaaacgacgtcgtcgtttgggtccacttcctcgtcgccttcgctcgcgaacttgccgccgattagggttcatgtcgtggaggatcagagggtgttggggattgaggatcagttcgcgcagataggggttggtgtggggccgaagcagcagccggatgagggttttgttttgctctcttcgccgcctccgccgccggttcccgcgactctcgccgcggtgggtgtgccgattgggcccgccacggtggttgctggggagcatcataaccgcgttgtctccgatgatgagagatcggaccatggggttcctgttgggtatagaaaaccacccactcctcaaccacaggttcagtcacagacacaagcacagtcacaggcacaaacgcaaacacttgctcctcaatttcatcagaagtcaactgctggtggcgccgttgttgatttgccttctcctgattcagtttctagtgatagtagccttgcgaatgcaatctcgcgttcaaaagctgctgtatatcaagaacaagctcagattcaacctggcactacaagggttcctagtaaccctgtggatccgaagcttaatgtgtctgatctgcatggtcggatccagatgcagcaacatgtacatgaccccggatatttgttgcaacagcaatttgaacagcaccagcagctgcaatcacaacagcaacagcaatttgaacagcaccagcagctgcaatcacaaccgcaacatcaatttgaacagcaccaacaccaacaccaacagacactgccgcaacagcagcaacagtttattcatggcgcacactttattcaccataaccctgctattcctgcatattatcctgtatatccttcccagcaacatccccagcatccccaggtttactatgtgaccgcgagacaggcgcaggcttacaacctgcctctgcagcaggctaatatgggcgagtctgcagggaacatcgcttctagccggccacaaactccaccaaatccttctacattggttcaacagcctgctacttacaaccctattagaaatgctcccatgcctaaaactgaaatgaatgcttacagagctgcaactgcaggcaaccctcaactagttcaagttcctacaagccaacatcagcagcaatatgtcacctactcacagattcaccatccttctcagtccatggctcccaattctgctgcccctgcgaattatgcttttgattatgcggatcctgctcatgctcaaatatactactctcaacctatggcacccacaattccttcacagtaccagactatgactgctgctgctgtgatgatgcaggaaggttcagctcagcatccctcagacagcgtgaagcagcagcagcagataagaacctcacaaccattataa

SEQ ID NO: 41661 - DNA, 180 bp, Glycine max
  Peptide Sequence Number=SeqID_158439
atgtaccgcaatgcgtggttggctaaacaaaaggttgttgaagacatctacgacaactggaaaatatcgtaccacgatctaccgagatttttgcaagcaatgcaacaatatcttctttgtatgttgatgaagaaggaaacactgctaatgccaccacaaggagggggaccttccttgtga

SEQ ID NO: 41662 - DNA, 573 bp, Glycine max
  Peptide Sequence Number=SeqID_158440
atggaatcaaacacatcaaggtttcttttgaactcttcaactttgcactcagttttctaccaagaaaaacaagatgatggcataattgatctgggtcttagtctaggaactgttcgacatgaagcttaccattcttctgccaacttgtatgatgaagagcttatggattggcctcactccaatctcaatctcaagaattcaagaacaatgcattctagatccgtccaccaaaattttgatgaagagatagagggcgtccagagcaatgagaggtgggcttatgtgaaggttaacatggatggggttaccattggtaggaaaatttgtgtacttgatcatggtggatactcaagtctagcactccaattagaagacatgtttggaagccaatctgtttctggattacgactgttccaatcgggatcagagtactcattgttctacaaggacagacaagataattggaggcctgtcggtgatgtaccatggaaagagtttatagaatgtgtgaagcggttgaggattgcaagaaagaattcgggcattgtttcctattcatcaagatgcacctaa

SEQ ID NO: 41663 - DNA, 210 bp, Glycine max
  Peptide Sequence Number=SeqID_158441
atggaggcatatgagagggaaatcaaaggtcattgtgttgcagacgttgttggtggtgacgaacttggcagtgtcggtggtgttgtcgacattgtgcgcaagagagggaaatcaaaggtcactactatctcgcgaaggttggtggtggtgctgaactcgtcgacgccggtggtatcgtcaacggcgttgtgtgccggtgcccagatgtag

SEQ ID NO: 41664 - DNA, 408 bp, Glycine max
  Peptide Sequence Number=SeqID_158442
atggcgacgcgccgcgatcgttggaatgaagaaagagcattgggccacctagtggacttcgagtgtgtatttgcaaggcggctagaaaatgaagatgtcgtcaaagatataatggttgaaggtgcacatggtagattgaagaggttgcttcgtgatagcacgagagatttgaataattgttgggatgcaatgaacaacatggttgtcttgcagcatacaacaattaaggcttcgtttcggaaaaacataaatgtggtcgagcacaagtttaataccccagtgtataagttgcacgactttgtatcaagagaagcacaagacttgattttccatgagttgcaatgggttaacactgtagttctaatttttggaataccacttcgatctgtccccctacaacaaaaataa

SEQ ID NO: 41665 - DNA, 1293 bp, Glycine max
  Peptide Sequence Number=SeqID_158443
atgcgtgaagtcgaagtgaaaagggtgtttattggagcgggatgcaacagaatagtgaacaacgtttcatggggtgcttctggtttgctctcttttggagctcacaacgccgttgctattttctgccccaagagtgctcaaattttgactactctcccgggtcacaaggcagttgtgaattgcactcactggctcccatctagcaggtttctatttaaagcaaaacaattggagcagcactatttgctatctggagatgcagatggtgctattattttgtgggaactgtcccttgctgatgggaagtggaggcaagtgttacagctgccacaatcacacaagaaaggtgttacatgcattagtggaattatggtttctcaaactgaggcaatgtttgcatctacttcttcagatggcactgcttgtgtatgggaacttgcatttccaatgacaggaagcggtgactgtaaattatcgtgcctggattctttctctgttggttctaaatctatggtaaccctatcgttagctgaattgcctggagatagtgggcaaattgtccttgcaatgggaggattagataacaagattcacctctattgtggtggaaggtcaggaaagtttgtacatgcatgtgagctaaaagggcatacagattggatccggagtttggacttctcattacctataagcatcaatggggaagtaaacaatatttttctggttagttcatctcaggataaaggcatacgaatttggaagatggcattacgtagctctatgtccaatggacacggcatagacaggaaaggagaaataagcttatcatcctatatagaaggtcccgtgcttgtggctggttcatcttcttttcaggtatccttagaatctcttttaattggacatgaggattgggtatattcagtaatgtggcaaccccctttggttgcacccatggaagaggatgcctattatcaaccccaaagtatcttatctgcatctatggacaagactatgatgatctggcaacctgaaaagacttctggtgtctggatgaatgtggtcactgttggggaactaagccactgtgctctggggttctatggtggccattggagcccaaatggagattcaattttagcacatggatatggtggatctttccatctttggaaaaatgttggtaatgataattggctgccacaaaaggtcccctctggtcattttgcatcagtgactgatattgcatgggctagatctggtgattatatcatgtccgtcagtcatgaccag

SEQ ID NO: 41666 - DNA, 2352 bp, Glycine max
  Peptide Sequence Number=SeqID_158444
atgagaggagaaccaaccgaggaggaaagaggtggggaggtcagtgttggtagagtcatggaaggagggagaggtgaggaagccagtggtggtggcaaggaggataacagagaaggaagaactaacctcactaccgacccttcttcttcttcttcttcttcttctttcccttgcatttttggatttgctccaacggtcactttgttggaggaaggagaaatgcccccttttgctttgttgttttttcttctttcctgcaactctcttgcacctgtggtgcattctctgaatgccgaaggttctgtgcttttgacactaaagcagtcccttacagacccacaaggatccatgagtaactggaattcctccgatgaaaacccttgttcatggaatgggatcacttgcaaggaccaaactattgtgtccattagcatccctaagaggaaactctatggctctcttacttcttctctgggatctctctcccagctccgccatgtcaatttcaggaacaacaagctctttggaaacttgcctccacagctctttcaggctcagggacttcaaagcttggtgctttatggcaattcactttctgggtctgttccaagtgagattcagaacctcaggtaccttcaagctctagatttgtcacaaaatttcttcaatggatcgttgcctgctggaattgtccaatgcaagagactcaaaacccttgttctcagtaagaacaatttcactggccctttgccagatgggttcggtactggtttgtcttctctggaaagactagacctttctttcaataagttcaatgggtcaattcccagtgacttgggaaatctttcaagcctgcaaggaactgttgatttgtctcataatcattttagtggttcaattccagctagccttggtaatctgcctgagaaggtttacattgatcttacttacaacagtttaaatggtccaataccccaaaatggtgctttgatgaatagaggaccaactgcttttattggcaatcctggtctatgtggtcctcctttgaagaattcatgtggctctgatattccatctgctagttcaccttcttcatttccatttattcctgataactactcacctcgggatggtaatggttcaaggggaagtgagaaaaacaaagggctaagtaagggagctgtggttggcattgttgtgggtgatataattggaatttgccttttaggtttgctgttctctttttgctactcaagggtttgtggttttaaccaggatctggatgagagtgatgtaagcaagggaaggaaagggaggaaagagtgcttctgcttcagaaaggatgactctgaggttctatctgataataatgttgagcagtatgatcttgtcccattagattcccatgtgaactttgatttggatgagcttctcaaggcttcagcttttgttctgggtaagagtggaatagggattatgtacaaagtggtgcttgaagatggacttgctttggctgtgagaagattgggagagggaggttctcaaaggtttaaagagttccaaacagaggttgaagcaatagggaagttaaggcatccaaatattgcaactctgagagcctattactggtctgttgatgagaagcttctcatatatgattatatacccaatggaagccttgctacagcaattcatgggaaggctggacttgacacattcgcaccactatcttggtcctatagattgaaaatcatgaaaggaactgcaaagggattgctctatcttcatgaatttagtcccaaaaaatatgtccatggagacctcaagccaagtaacatacttcttggacacaacatggaaccccacatttctgactttggagttgggcgccttgcaaacattgccggagggtctccgaccttgcaatcgaaccgagtggccgcggagcaactacagggaaggcaaaagagcatatccactgaagtcacaaccaatgtgttgggaaatggttatatggcaccagaagcactgaaagtggtgaagccatcacagaagtgggatgtgtactcatatggtgtgatattgttggaaatgatcacaggaagatcatccattgtcttagtggggaactcagaaatagaccttgttcagtggattcagttgtgcattgaggaaaagaagccagtgttggaggtgttagacccttacttgggtgaagatgcagataaggaggaggagattattggagttttgaagattgcaatggcttgtgttcatagcagccccgaaaagagacctactatgaggcacgtgcttgatgctttggatagactgagtatttcctctgattga

SEQ ID NO: 41667 - DNA, 366 bp, Glycine max
  Peptide Sequence Number=SeqID_158445
atggttaggtggatgactatgaagaacctcacgctagaggatactggaacacaatactctgataggatagctcaaacaggacaaaccttatccgacaaaggatcaaagagatcttacacgtttcgtcgaaatctcgacaacaagggaggcaacctagagcctctctccggggttggagatgcagcgacggaggacagggaaaaagccgtgcttgttgacaagggagttgatgttgaggggaatgggaacgacagagaagttgtactgagtaggattctcatggttgcagaagagcttcttggcgtagggttcgttggaggaggaggaagatggcagcgatcggccacgaggttatgggaaaaatga

SEQ ID NO: 41668 - DNA, 228 bp, Glycine max
  Peptide Sequence Number=SeqID_158446
atctgataaggcccttgccagcatccttataatgcagttctcatccttaaggctccatgggataaaaggtgtgtgcggtcacatcatgcacataagggatatagtggctcagcttaaagccttagagggcgaaagggtgaacttaactcttcatggaaagaagaaaggggatcaagccaagaataagggcaagattcttgatcattcagtcataaagaaagagtcaaa

SEQ ID NO: 41669 - DNA, 543 bp, Glycine max
  Peptide Sequence Number=SeqID_158447
atgctgcacaaacagtgccagcgccaccagcgccatgccggtaccgagcgccatactcatcaccgccagcataccccagcgcgtaatcccgatgacgctggcgaacaacagcaccgtcagcgcaccgctgcagggccgcacgccggtggcaataataatacccgtccagcttttccagtcgctgcggtgcccagccgcgacgccatgcgcgtggccgcaatgatcatgatgatgatgctccgctggcggcctgcgccaggcttgcagcatcatcatcatgcccagcccggcaatgaacactgcgctggctttctccaaataccagcagctcatgctgagatcgccggtcgtcaggttaaaaccaaccgcgaggataaagacaaaggcaatcgcgctcaggccctgcaccaggctgcccagcagcggcacgctcagcgccacgccgcgcgggggctgatgggtggtcagccaggtggtaacgataaatttaccgtgcccgggacccaccgcgtgcagaatgccgtaaatgaaggtcacagctag

SEQ ID NO: 41670 - DNA, 386 bp, Glycine max
  Peptide Sequence Number=SeqID_158448
gagacctgctggcgatagtgttcgactttcagcgtgtgaatatcccgctgctgaaacaggatctggccgctatcgggctccagcatgataccggcgccagcaagacagctgcacaaggcaggggaatgcgtcacgatgcggagagcggctgccgtttaaccgccgtggctttacaacgcggcagaaatccgcatgctggtgacattcaggaccactttcttcattactatgaccgccaccaaaaccggatttctctgcgcgagcgtgctgctgctgagcgcgctgacgctgctgtcgttgcactggagcgcgtttcaggcatgggcgctgcaaaatcagattcagctgcaccggatgctggttacccatttactgcaaatcaatag

SEQ ID NO: 41671 - DNA, 584 bp, Glycine max
  Peptide Sequence Number=SeqID_158449
gggtcgcgtccacaagacacctagtggacccggagaagtccgatagggccctggggttttcagctctggttacgggcctctatcagtcctatagggtgcccgtccccacagcaaggtcatgccatcgtgacataggtaagggtcgcgtccacaagacacctagtggacccgaagaagtccaacagggccctggggtttccagctctgattacgggcctctatcagacctacaggggatcgcgctcgcaggacacccagtggacccaaagaagttcaacaggatcctggggtttccagctctgattacgggcctctctttcatcaagaagtattgtgaccccagacaggcagacggcgagacaccacaacagcctagggatggtcggcaacaggcaacagatgcaccaccaccacctctagagttcacctcagctcagtcacaaaaaggcgaccaagtccaaagccaaaggaaagtaaagtacttggtccgtgaccgacaagtcataaggcgtccagctcaagacgttaaagaagcgctactaggaggcaacctagtaccttttaaatctctgcttgttatttga

SEQ ID NO: 41672 - DNA, 419 bp, Glycine max
  Peptide Sequence Number=SeqID_158450
atgacggaaagttgcatccgatccgtcgtagaagccattcactcctctcctttccaagccgttctccatctcgccggtggagcttctcaggttcatttctctctcctatttggttgcacgcagagtgttgaattgaacgaaacaatagtaattggacgttatcaggtggtgggttcgttgctatcagttcccggtgcttcgaatactgtgctcgaagttgtggttccttactctaagatgtctctcattcagttactcggaaagattccatcccaattttgtggccaacagactgctgaagatatggctttattggcgtataatcgcgctcttaagctctccaagccaggatccccggctgttggagtgggtttcactggttctttggccagcagtcgtccaaaactcggggaacacag

SEQ ID NO: 41673 - DNA, 219 bp, Glycine max
  Peptide Sequence Number=SeqID_158451
atggcgaggcaattgaaagagatgggagtagtgaagagtggtgaagagtttggaattggaggtcttgtttttgtgttatgtgtgacactttctcttcttacaaccatcatcttcttctgtgcagatggagtgcccaagaactccaaaaaagcctcccaagacaacaactatggtggttctgcctgcgccgccgggtgtggcggaggctgcggtggttga

SEQ ID NO: 41674 - DNA, 105 bp, Glycine max
  Peptide Sequence Number=SeqID_158452
atgggattagagaaactcactcccaacctctgcccagttgtcatccctacaacccacctcctctttgtatatttgctgttcgcggtggagtataataacttgtga

SEQ ID NO: 41675 - DNA, 378 bp, Glycine max
  Peptide Sequence Number=SeqID_158453
atggggcctcttcaagaagagacggaaatagtggacttaggaaccggaaacaggaagaaggaagtaaagataggcatgggtatgaccgcccccatccgtgaagagttgacagccctactaaaggactaccaagacatctttgcttggtcgtaccaagatatgcccagtttaagttctgatatcgtacaacacatattacctctaaatcctgagtgttccccggtaaaacagaaagtgaggaggatgaagcccgagacatccttgaaaataaaaaaagaggtaaagaaacaatttgacactagttttttggctgtcgctcggtacccagaatgggttgccaacattgtaccggtccctaagaaggatgggaaagtatga

SEQ ID NO: 41676 - DNA, 427 bp, Glycine max
  Peptide Sequence Number=SeqID_158454
aaaaactgacatccaaacaggaccattcacatgcggatgtggcaaagataatgatcagcctgttctaaggtatagagttgaagtaatggttagccaaaacaatgacagtagcaagtttttgctctgcgaccgtgaatgtgctgaattgattggtgaaatagttgaagtgaatagggtcaagattgaagatggtgatgttgatttgaatgcttctcctcaagcacttgataggttgttgggttatgtgcttgcttttaaggtcaggattcaatcaaaattcaggaatgtcgttgttcttagatactcaaatgaattagatttgatcaatgttgtgctcgacatgctggctaatactgaggcatgttccaaaatagatgcttcgaatgttgattgcaataatgctatgcatcctgaatgtgtaagttaa

SEQ ID NO: 41677 - DNA, 1494 bp, Glycine max
  Peptide Sequence Number=SeqID_158455
atgcaggttttccttagccagattgagaacgacgcaggggcgcagcgtgctgcgcccgcagtcggggataatgacttattcgaacaggttgtgatgcagggtacgcaccacctgttcggcttcttcgcccggcaccaggaagcacaggttatagctgctggcgccgtagcagatcaggcggatattgaacggatcgagcacaccgaacacctctttgcccacgccgcaggcgcgcgacagctggttgccgatgatcgccaccagcgccaggttttcttccacttccacccggcacagcgacgacagctcggtcagcagcgaggtggtcagcaggctgccgccaacggaggtggcgccggtggtgtccatggtcagcgcaatgctgacctccgaggtggtgatcagatcgacggagacgttgtggcgcgccagaatgttgaacacctcggccaggaagccgcgcgcgtgcagcatgttcaggctgtgcagcgtcagcagcgtttgcttgcggcgcagcgccagcgcgcggaacagcggcggattctcggtggtgttgcacaccagcgtgccgccggccgccggatccttgctggagccgacgaataccggaatgtcgctgcgcaccgccggcaacagggtggccggatgcagcaccttggcgccgaaggtggccatttccgccgcctcttcgaaaccgattttgtcgatgcgcttggccgccggcaccacgcgcggatcggtggtgtagatgcccggcacgtcggtccagatatctacccggccaacgccgagcgcctcgccgagcagcgcggcggtatagtcgctgccgccgcggccgagcgtggtggtgcggcctttcggctcgctgccgataaagccctgggtgaccaccagcgcttcctgcaggcgcggttgcaactgcgcccgggccagttcgctgagcgcggcgctgtccggcacggcgcggccgaagtgatcgtcggtgcgcatcactttgcgcacgtcgaaccattcggcctgcacgttgcgggcgcgcaggatttcaacgaacagcagggtggacatcagctccccatggctgaccagttcgtcggtcaacgccgtcgaggtggccagcgacgcggcttccgacagcatggcgatgttttccagcaggcggtcgatctcttcgcggatcaccgccggcgccgtgaggcgatcgaggatggcgtactggatgcggcggatctcatcaagccggtagttgcgcttgtcggcctcgcaaccctcggccagggcgaccaacaggttggtgacgcccgccgaggcggacaacaccaccaggcggacctgcgggttggccagcacgacgtcggcgctgcggttcatggcttcaaagtcggcgacgctggtgccgccgaatttggctaccacggtggaattctggggtgctgcttggttcatctagaaacctcgtgtcagggatgcccgtttgagggcactgtaattccatag

SEQ ID NO: 41678 - DNA, 1572 bp, Glycine max
  Peptide Sequence Number=SeqID_158456
atgacgcgtttgccgcctcgtttcagctttcactctatacttttggctaacggcctgttatcggggttgccgaattgtcatcaggctgtgtcattgttgcttatttcgtcatttgaaagggatctcgcttatggaattatctgccccgctcatgttggtgcttatcggcctggcgtcgctgctggcgcagtggctggcctggctgctgcgcctgccggccattttgccgttgttgctgttcggcatcgtgctcggcccgacggtgcatctggtgcagccggatctgctgttcggcgatctgctgtttccgctggtgtcgctgtcggtggcgatcatcctgttcgaaggggcgctgacgctgcgtttcgaggagatacgcggcctcggcggcgtggtgcgcaatctggtcaccgtcggcatgctggtcacctttctggtcatcagcctcgccagctggtggctgctggatttcccgccggagctggcggctctgatcggcgcggtgacggtggtgaccgggccgacggtgatcgccccgctgatgcgcgtgaatgcggagtcctatacccatctgttttggacgctgggcatgaccgccgccgtcggcctgatcgccggcgcgctgttcggctacctgctcggcctggcgctgcgccgcgtctggctgccgcgctacctgcagaacctggcggtgctggcgatcatgctgaccgccttcggcgtttccaacgccatcgccgacgaatccggcctgctgaccgtcacggtgatgggcatctggctggccaacatgcgcgacgtggacaccagcgatattctggcgttcaaagaggagctgtcggcgatcctgatctcggcgctgttcatcattctggcggcgcggctcgatatccaggcgctgtggaacatgggttggccgctgctcctgctgctgctggtggtgcagttcatcgcccggccgctgtgcatcgcggtgtcgacctggcgctcttccctgcactggcgcgatcggctgttgctgtgctggatcgccccgcgcggcatcgtcgccgcggcggtcagctcgctgttcgcgctgacgctgcagcgcagcggctaccagggcgccgaccggctggtgaccgtggtgttcgccatcatcatcggcaccgtggtgctgcaaagcctgaccagcgggatgatggcgcgctggctgcgggtgcagcagcaaaagccgcgcggcgtgctgatcgtcggcgccaacagcgtggcgcgcatgctggcgcaggcgctgatcaagctaaacgtgccggtaatcgtcaccgacagcagctgggaatactaccgccaggcgcgcatggaaggcatcccggcctactatggccacgcctactccgaacacgccgagaactatctcgatctgagcaatatcgcccaggtgctggcgctgtcgcccaatcgccaccagaacgcgctggcggtctaccacttcggtcatctcttcggcgaggatcacgtgtttgccatccgttcgggagcgccgctgaaagggcgcggcgccagcgcggaaagctcgcgtttccgccggcatga

SEQ ID NO: 41679 - DNA, 2911 bp, Glycine max
  Peptide Sequence Number=SeqID_158457
atgacaaatatcaatcctagtcaaaccgctgcttggcaagccctgcagcaacattatgcacagatgaaagacgtacggatcgccgacctgttcgcccaggacagcgatcgtttctccaggttctccgcgaccttcaacgaccaaatgttggtggactattccaagaaccgtatcacgcaggaaaccctggagaagctgcaggcgctggcgaaagaaaccgatctgcaaggcgccatcaaatcgatgttcgccggtgagaaaatcaaccgcaccgaagatcgcgcggtgctgcacattgccctgcgcaaccgcagcaacagcccaatcctggtcgacggcaaagacgtgatgccggaagtgaacgcggtgctggccaagatcaaacagttctgcgcgcgcgtcatcggcggcgagtggaaaggctacaccggcaaaccgatcaccgacgtggtgaacatcggcatcggcggttcagatctcggcccttacatggtgaccgaagcgctgcgcccgtataaaaaccacctgaacatgcacttcgtctccaacgtcgacggcacccatatcgccgaaacgctgcagtcgctgaacccggaaaccacgctgttcctggtggcctccaaaaccttcaccactcaggaaaccatgaccaacgcccacagcgcgcgcgactggttcttgagcagcgccgccgatcaacaacacgtggccaagcacttcgccgcgctgtccaccaacggcaaagcggtggccgagttcggcatcgataccgacaacatgttcgaattctgggactgggtagggggccgttactccctgtggtcggcgatcggtctgtcgatcgcgctgtccatcggttatgacaacttcgagcagctgctgagcggcgcgcacgccatggacaagcacttcgccgaaacgccggcggagaagaacctgccggtgctgctggcgctgatcggtatctggtacaacaacttcttcggcgccgaaaccgaagccattctgccgtacgatcagtacatgcaccgttttgccgcttacttccagcagggcaacatggaatccaacggcaagtacgtcgatcgcaacggcaatccggtggattatcagaccggccctatcatttggggcgagccgggcaccaacggccagcatgcgttctaccagctgatccaccagggcaccaagctggtgcattgcgacttcatcgcgccggccatcagccataatccgctgggcgatcatcacgccaaactgctgtccaacttcttcgctcagaccgaagcgctggcgttcggcaagtcgctggacgtggtggaggccgagttcgcggcgcagggtaaaacccctgagcaggtcaagcacgtggcgccgttcaaagtgtttgaaggcaaccgcccgaccaactcgatcctgctgcgcgaaatcaccccgttcagcctgggcagcctgatcgcgctgtacgagcacaagatcttcacccagggcgcgatcctgaacatcttcaccttcgatcagtggggcgttgatcggcacttcgaagctgacgccggcgcccacgtcgtcggcggtgctgtgatcgctgttggtgtaccacaggctggtatcgaatctaacctgagaatcgaagctgtaaccccagccgagctgaatgcctttcagcgtatcggaacgcgggaacgcccggttgatggtttggttgttcggattcaccttggcgtacaccagacgggtgctccaacgctggccgtcgtccagcaccatttccacgcggccggacagcatctgaccgtcgccgcccatcgcatggcccagcgggtaaccttgctggtagtaaccgccccgatagatgtagtggttgtacatcacgttgttggcgttgccgttagagcgggtatcagtaccttcgatatgccagttgatcgtggtcgggccccattccggatggccttcaagccccagcatgtaggcgttatgcgaaggcaacatgcctgcttcatcttcaccggtgatctggccatacaggctgaccggcatgccgatgagcggctgcagcttgagtttgaagtcaaaaccgcccaactggttgcccggatcgtttttcggatcgccggtattgtcgttgccggtgacgccatcccagaaggaactccaggagtgcggacggccatcaccaccccacatcatgacgcgcgaagcgcccaactccaggaagtcggtcggcatcatggtcaggcggccaccgatcagcttggtgtccggcacggcagcgtactgcgacagctggccggcggacaactggtattgccagcggccgatccacgacagccacggggtttcaaacggcgattggtcggcgcgctgcagcataaagccggccaccgggcgcgcggcgtcggagcggatcaggctgccgtcgtagcccgggccccaccactgggaaacctcgccgaaggagagccattggttccagattttcaccgcgccgtaggagccgttcatgttgaatttggagccgtcgctgacgcgctgatcgccttccaccgagccctgcagacgcacgtcccagaactcgccgttggcgccggcgccgatggtcaggcgatcgtcggcgtattcgttttggccgaagccctgcggggtgccgggtttatcggtcgaggcgtaaccgctgacgcgaatgttggctttcagggcatcgacgcggcgttgtacgcggtcgataacgtttttctcggtgttggtcaccggcttggcctgcgcgataacggagctgatctcttcctggctcagcggccaggtggacaggctgacgttgatgacgccgcggtcagacagccaggcgagatcgttacgcagatcgttgtcaggggctaccaggccggcggcgtggccggacaatgcacag

SEQ ID NO: 41680 - DNA, 249 bp, Glycine max
  Peptide Sequence Number=SeqID_158458
atggcgggtagggtaggggtccataaattaataatgaagggtctgctgtcaccgttttcttcactccataccaagtcaggcatgtgttttcaacacagctcacatcctctttatatatattcatgtattgttaaccaaccacttccactagatgtgaatgtgattcatattcatagagagagaaagggaaagggagaagagcttgaggaagtgatgggagatgggagggtcggtaaagaatatatctga

SEQ ID NO: 41681 - DNA, 1332 bp, Glycine max
  Peptide Sequence Number=SeqID_158459
gaatcttctgcagctgcgtctattactatctcccaatctgatcttgacaataaggatatgaatcctctcagccagtaccgtccaagaagcatggatcccgcccttgcaattcgaccatttgattcaaccataccattctccgttttgagattcaatgaggaaagcagttgcactagccatgatgacagtgccctttctccctacagtgaaaggaaggcttattcagcaccgagtaaaatgcataacaaggacacttgctctccctcctccaacggcggatttggcggcggcgcctctgccggtcaaatgccatcaaccggcggcctctacagttcgctgtactcggcactgtcgagcgagaaccttccctcgctctccgcgagctgcagcaacagcagcggcggcggtggttcgctctatccttactccgagtcaattcagaagcaccaggacatggtgaaccgtcaaagcatgtgtctgaatcgcctggtggaaacttcgaaggaggtggaggctctgagggaggagaatggcctgctccgagccgcgaacaaggagctccagaagcagctgcacctcgtcatccaggcttcgctggagaatcactacggcggcggcggctcatccggccagatgcaaccgacgctgttcgatgtcttgcatggcttccgcggcctccacattggggaagggaataaagagaattatgccgattggaataacaacaaccacaataatcaaaatcataacaatattatgaacaataataataataacaataaggagctgcaggaagtttcggacgagagtccaacgagcgtgattgagaataacaacgtggtggaagtggagaggttctcgctccctaagagcatttctgtgaggtccaatggctacttgaagatgtctcagtctgcggctcttgcccccaacaacaacaatgccactcgcaacaaaggcgccactcgcccacgcgcctccgccactccacctgaacccgttcaaaaggtatatgtgcgtggaggggagaaagaggaagagcctcttgaaatgatagtgtataaccaagggatgttcaagactgagctgtgtaataagtggcaggaaactggcacatgcccatatggagaccactgccaatttgctcatggtattggggagcttcgcccagtgatccgccacccacgctacaaaactgaggtctgcagaatggtccttgctggggttgtgtgcccatatggccatagatgccatttccgccatgcacttactgaacaagagaaagctgtcgtatcgcagcctaagccaagatcaatgaagctcgaaagataa

SEQ ID NO: 41682 - DNA, 177 bp, Glycine max
  Peptide Sequence Number=SeqID_158460
atgactgaagacctgaatcacgaagaagcttccctcatacacaatgtagtttatcttccagatacagtggaagtgatatttcccaaggaaaatgtaaggaaacatctgcccataactcaggtctactctcgcataaggaaaaatctgggaagggaaccacaatggcagtatgtatag

SEQ ID NO: 41683 - DNA, 1597 bp, Glycine max
  Peptide Sequence Number=SeqID_158461
ttatttctctgatgcgtgttggatggtttatctgtgtttacaggttcaatattgttggccagtgggcagtgacaacaagtgtagattattcacttgcacaactgattcaggttattattctccttagtactggtggcaaaaatggtggtggatatgaggcatctaaatatgtagttattgctttccatgggggaattttgttcctacacggtataataaacagccttcctatctcattgttatcattcttaggacagctggcagctatttggaatgttataggtgtttttgtgcttatgattgtcattccatctgttgcaacggaaagggctagtgccaagtttgttttcacccatttcaatacagaaaatggtgaaggaatcaacagcaaaccctacatatttctcttgggacttctattgagtcagtataccctaactggatttgatgcatcagctcatatgacagaggaaaccaaggatgctgatagaaatggtccaaaaggaattatcagttctgttgggatatccattgttgttggatggggttatattctaggcattacctttgcagtcactgacatcctttaccttttgagtgaagataatgatgctggtgggtatgctatagctcaagtattttatcaggcattcaagaaaagatatggccatggaactgggggtactatttgcttagtaattgttgctgttgccatatttttctgtggtatgagttcagttaccagcaattcaaggatggcttatgctttctctagagatggggcaatgccattgtcatcattgtggcaccaagttaacaaccaggaggtccctatatatgcagtatggctttctgttttcatatcattttgcatggcactaacgtctcttggaagcatagtagcatttgaggccatggtgtccatagcaacaattggcctctatattgcttatgccttccctatattctttagggtgaccttggcaaagaagcactttgtccctgggcctttcaacttgggccgttatggtgtcgttgtgggttgggttgctgttctttgggtactcaccatttctgttctcttctccttgcctgtttcctacccaataaccattgagacacttaactacacccctgttgctgttggatgtttgcttattcttgtactttcttactggattatcagtggtcggcattgtgtgattggttcatcaatattcatgggatctggtaaaagcaaaacagtctcatctgacgtgggatacgttccacttgattctggccatgcccgtcttcgacaactcggttacaaacaagaactcaatcgtcatctttcggtgatttcgaatttcgcgttttcgttttctattatatcagtgctcaccggagtgaccactctttacaacactgggttgaactatggtggccctgtttcgttcgtgtatggttggttcatagcttctggtttcaccatgatcgttgcactctcaatggctgagatttgttcatcttatccaacttctggtgggctttactattggagcgccaagcttgctgggcccagatgggcaccttttgcttcctggattactggctg

SEQ ID NO: 41684 - DNA, 276 bp, Glycine max
  Peptide Sequence Number=SeqID_158462
atgaggacgcgtagccctctaaaggcgagggcgtacaaccctctgcaggcgaggatgtgcagtcctctgatggcgaggacatatagtcctctaaaggtgataggtactagtatccaagggtccacctttatgagaaagcaagagatcaactcatcgagagggccgattgactgtccttttgaaaaaggtgataattcatgcaaccttatcctatctttttcaaatctcttcgggaactccctcagagtgtatattctgtttgattcagtcacttga

SEQ ID NO: 41685 - DNA, 183 bp, Glycine max
  Peptide Sequence Number=SeqID_158463
atgccaatctccccctgcagatgtatcggttggtctgtgccatcatggcatagggatcgcgcccacgagacgcccaatggactcgaagaagtccaacagggccctggggtttccaactctggttacgggcctctgtcagtcctacagggtgcccattcccccagcgaggtcatgccatcgtga

SEQ ID NO: 41686 - DNA, 244 bp, Glycine max
  Peptide Sequence Number=SeqID_158464
aggatttccgaatgttcccttgatagggacaaggggttgcatcagttacaatcatgttcttgctataaggcaacttggctaccctatgagaggggcaccgctagaggaagagctcgcgcctgccatttcacgaggtttcaataagaccaacggggatgtgaatgtatgtatacatgattttgatgatgtcaaagaagaatctaacaaggctgcttcaaatgataagcatttgcttcaagaataa

SEQ ID NO: 41687 - DNA, 2172 bp, Glycine max
  Peptide Sequence Number=SeqID_158465
atggctctgaagctcccgcacactttccccatcttcgccccttccctcgaccccaacccaaacccgccgcgccaatcctcggagctccgattctctcgctggaacaacccagaaactcgctcccccaatgcccgccgaacaccccggcccaccgggcctgccaaaaggtccaaaagcccagcaaggcccaaggtcgaccggcaatcgcacccagcgttcaggttctccaacatccccaaatcgaagccgcaacgggtatccggcgcccccgaaaacgtgaaaatcagcgacgacggactctcctacgttatcgacggtgccccgttcgagttcaagtacagctacacggagaccccgaaggtgaagccaattaaaatgcgcgaagcgcctttcgtgccgttcggaccggacacgatgcctcggccgtggacggggcgggcgccgctgccggcgagtaagaagaagctgaaggagttcgactcgttcgtgcttccgccgccgcacaagaagggggttaagccggtgcagtcaccggggccgtatttggcggggacggggccgaggtacgtgaagtcgagagaggagatattgggagaacccttgacgcaggaggagattcgtgacttggttaagtcctgcatgaaagcccaacgccaacttaatatcggtagagatggtttgacgcataacatgttggataatatacatgctcattggaagcgccggagggcttgcaagatcaggtgcaagggagtctgtactgttgatatggataatgtctgccaccagctagaggaaaggacaggggggaaaatcattcacagaaagggcggtgtgttgtaccttttccgaggcagaaactacaattataaaacacgcccacattttcctctgatgttgtggaaacctgtgcctccagtatatcctaggttggttcagcgagttcctgaaggtctaacgctagaagaagcaactaaaatgcgtcaaaagggaagcacattgattcccatatgcaaactaggtaaaaatggtgtttactgtgacctagtaaaaactgtcagagaggcatttgaagagtgtgaactagtgcgtataaactgtcaaggactgaataaaagtgactatcgaaagattggagcaaaactaagggatcttgttccatgcacattgctttcgtttgaatatgagcacatacttatgtggagaggaccaaattggaagtcatctataccagatcgaggagatgaccgcaaggaatccaaacaaatagaggttgaccataaaaattataaaccactgccgtcagaggccctagaattctcagcaccgagtctacaaatgaacccattagagcatgaaagcaatttattacatgacactagcatttcctctatttcaagtgatgtgactttggataaggttgaggtgtcatatcccaatgaaaatagccaccaatctatgtctggggttactgaagttccttcacttacaaaaatctatgacgttgaaaccacaaatgattccacagactcctatgctgagccagaacctcgcacaagcctcattccaagtatgaccataccacactatgatagccatgctgaattctcctcgaaagctatgagtgaaagtcatggaactgagcatataatggatagcaaaagctgcagtgatggtctttctgcttcaatttcaggatctcatgcaacgctaggaggtagtgacaattctactaatggcatggtggattctcattctaataagttgctagatgctttgggagaagaagatgtcagtcaggcaccaaggtcagctgctccttctatgaaagcaatttggttactgttggaacaagctgttgagaaaggcagtgctcttgttttagataaggattctttggatgcggacaatatttatcaaaacacagttgcctttgccaaatcagctccacccggaccagcttttaggaaaaacacaaaggctgtgtctcaaaagaatcctaagcaagaaggttcaactttggagactaaagaaactaccattgattccatgaaacggaaaaaggagaatagtactaaaattcctagaaaagcaaattttgatgaccaattactaaatgttgtaccacaaggaacattaggagttgatgaacttgctaaacttttaacatga

SEQ ID NO: 41688 - DNA, 603 bp, Glycine max
  Peptide Sequence Number=SeqID_158466
atggagatggaaatgccccatggtcttcagtgccccaaaaggatgataattactgcagtgagtattcctaggagaaagatgaggtgtatgatgccgcctaagtcaagaacgttatttcaggagatgaaccgtattctagtgcgcaagcgtgcttctgctcgtgctatgagaccaaggttgtcatccaaacttgacctggaaattcttgctgcgaggtcagagattgagcatgctcctatagtaacacatgacaaagaactttatgctcctctctttcgcaaggctccatatgaaacaagacaccatatggaatactgcataaaggccctctgcaatgctgatgtgactcaaggctttaaaataggaagggatgtttctcttccggaagcttatgtccggtcagacaaagaccctgatatgaagatatatggcccaatgcctcatggtgttacaagcaaaatgaattatatcaatcacatgaagaacagcaaatactgcatatgccctaaagggtatgaggtcttaaattgggatgtgttctcaataatccttgcagagaaagatattcccaacttgaaacagatacttctttcagtgtcacaa

SEQ ID NO: 41689 - DNA, 603 bp, Glycine max
  Peptide Sequence Number=SeqID_158467
atgatggtggtgatgtcaatagtagacaatagtggcagtggtggaggtggtagttgcggtagcggtggtggaggtgccattggtggtgacataggtggtattagtggtggcggtggcgatgttattcgtaatggtggtagtaacaatgtcagtgggcttggtggcaataacggtactagagtgatggtggacgacaacgatggtggtggtgatggtggttgcgacgacattggtggtggttgtagtgacagtagcactaatggtagtggtggtgatgataacggtgttggtggtcgtagtgatagtgatgctagtagcaaccctgatattggtggtggtggtggtggtcatggtgataatggtagtagcggtatatgtgaaaacaaaattggaattagcgaaggtgaggaatttgagggtgtgaggaacttaccagagggagagggaagatgggagaaagagatacggcgagaagggctgaagagagaaaaggaggaaggtgttgagagagcgggtcgtattgaagaagaagccatgggaaccagtctcaccaataccattgaattgtggatgaggaaggaacagagtgagaggggagaataa

SEQ ID NO: 41690 - DNA, 519 bp, Glycine max
  Peptide Sequence Number=SeqID_158468
atgaagctcctcagaaagagggacataccagaggagaaatatactaatgcctttcttggatatgggcccgaagactcacactttgttattgaactgacatacaattatggagttgacaagtatgatattggaactggatttggccattttggtattgctgttgatgatgttgcaaaagcagtggagctaataagagctaagggtggcaaaataactagggagcctggtcctgtcaagggagggcgttcagtaattgcatttattgaagatcctgatggttacaaatttgaacttatagaaagaggtcccactcctgaacccttgtgccaagtaatgcttcgagtgggtgatcttaatcgttcaatagaattttacgagaaggcatttggtatggagctgcttcgtacacgagacaatccagaatacaaggtttatgagattgtgaaaattttgttacgtatacttcatgacacctattctggaaaaattaagcttgaggataacagagttcctttctaa

SEQ ID NO: 41691 - DNA, 339 bp, Glycine max
  Peptide Sequence Number=SeqID_158469
atggaggtggacattgtctcttggtttagccacagtccctgcgactgtcatgcattggagagagttaggggtacccccaatgtggatgctgaattcgaagatcttgttgaggctagcaaagaagcaaagtccatggagaacccattccagaacctcctcctaaaaaagaacagaccccaattcataattggtgccttggccgttcctgtattccaacagctgactggcaacaactccatcctcttctgtgcccagactttgggatttggcgctagggctgctctatattcatctgtcattactagtgtggcacttcttctacccacaaaaacaaactag

SEQ ID NO: 41692 - DNA, 345 bp, Glycine max
  Peptide Sequence Number=SeqID_158470
atgacgggagtcatcgttttaaatagaggtcaacaacccaaattggggccacatcaatcgcatttttttgcagttgctcgcaatgtaaatgttttctggctgacagcaactgcaacagcaattttaaaccatgacaggagtctttggtgcaatgttgttgaatcaaatttttgggctttggctgacaagtatagcaggttactcacaaattcttgtaatccgaatgccgtggtggctgaaatgggatattgggtaccctcccaaacaaacaatgttatttttagaggggccaatgtcgattgggaagctgtgttgtgtgcccgcaagggatccggcaaaacttag

SEQ ID NO: 41693 - DNA, 267 bp, Glycine max
  Peptide Sequence Number=SeqID_158471
atgactgtaataccccatttacagattgcaataggcacagatgatgtgtacaaaactgcagaagcaattaaactagctggaggaaagattactcgggaacctggaccattacctggtatcaacacaaaaattactgcatgcttggatccagatggctggaagtcgaagaataagggcaatagagatgaaagtttaaaccacttggtcataaaggttttgatactgttaaatataaaatcattcgtatatccttacctagcaatttaa

SEQ ID NO: 41694 - DNA, 342 bp, Glycine max
  Peptide Sequence Number=SeqID_158472
atgaacgaagaacggatgacgaatggtgaagaacggcggaaaaccttcacggatttgctcacagaaacatctcggaagcgttacggaagcacctcggcttggattttcttcacggaaacaattttttttcacccaaaacaactaaaatgcatagccaaaggggaattttacggaagcattacgaaagccttatggaagcatataggacttgattttcctctttttcctcttccctttcaccaatgttatgtgaaatatgcttacccaagattttcagaaattttacggaagcattacggaagccccgaaaaccatttttcaacaaaacgtggaggatcttga

SEQ ID NO: 41695 - DNA, 330 bp, Glycine max
  Peptide Sequence Number=SeqID_158473
atgcccggggaaaaagacagcgttggtgattctctggatatcacccttgtcgccttgttccagaaacaaacacggtatccttctggtatttcgctaaccccacagtgcaacccattacatgaaccgaccagatgggatggatccgaggcagacatttttcatcagttgaagggatctgacattagggagtttcatcccttgcacacacacttgaattggatcaaaggtttcacgggaagacgagacaagatttcctcgatgagttcgtcacagaggagtggcgaccatggtttcttctctgatcgcatgtttctatggtttcttctctga

SEQ ID NO: 41696 - DNA, 1896 bp, Glycine max
  Peptide Sequence Number=SeqID_158474
atgtcacactcgctcaaggttttttttgttttcactctcttgttccttgctgtggttgaagctaaacacaaaaagaagcacaaacacaaaatccgccatggtcctaaaccatttcttcccctgatcccaccctttggttctgatgagcttccacccgttccccagctcccgcccattttcgagcccccatccaatattccccagctcccaccctttcccttgaagcaagatggagaagaaggacaaggggttgaaaatactcagcaagatgcaaaagaagggattgaaaataaacttttcgaagtaacgtccattggacactgggagataatttctgaaaatgcaggtgtgtcagccatgcacatcaacttgttacccacaaacaagatcattgtctacgatgccaaagtttaccgcacctcaagaatcaaattacccgatggagtgccatgtgttccatacagagatatggggggtcaagaagacaaactcgattgttttgctcatgccgtggaatatgacattgagactaaccaagttaggccactccagataacagctggagatccgtggtgctccagcggaggggttgcacctgatggtacctttgtgagtgctggtggttttgacaccggagcaagaagcgttagatatatgggtcctaattgccaaaattgtgaatggagggaatacgacaacatattcggagcagacagatggtatgcaactcaacaaatccttccaaacggagaattcattttggtaggagggcgtagatcattcagctatgagttcatcccagtagaaggccaaaggggcgagaaaccctactttttcccattcttatacgaaacttcagacatagatgagaacaatctctacccttttgtgcacctttccacagatggaaacctcttcatcttctctaacaatcgttcccttcttctgaaccccaccacccacaaaattgttcgcacctttcccgtcttacccggtggctcccgcaactaccctgcctctggcatgtctgcccttctccccatcaaccttaacgaccccgccaccgccaccaaggctgaggtcatggtttgtggcggcaaccttcccgatgccttccatattgccgagactaccaaaatcttcctcccagctcttcgagactgcaacaggttaaccatttcggagccatttcctgagtgggagagcgagttgatgccttcagggagaacaatgggagaccttttggtcctccccaatggggacctcttgctcatcaatggtgcaaccatgggtacggctgcatggtgggatgctgacttgcctaactacacgcccgtgttgtacaaacccgaggaccctaaagggttgaggtttacggtgcttaagccaagccaaattgcgagaatgtaccactccacttccacggtgcttcccagtggaaagatttgggtttctggaagcaacacccacaatacctatagggatgtggataagttcccaactgagacaagagttgaagctttctctcctccttatttggacgccaactttgacaagtataggccacaaattgacgaggatgcttcggagaaagagttggcgtatggtggtttgtttgaggcaagtttctcggtggaagatggagctgagttaaccaagaataacattaaggtgtccatgtattctccacccttcactactcatggcttctctatgggacagaggcttttgtttctcaagattgacgagttaaacgtacaaggccaagaagggtcttacagggttagagtggaggcgcctccatccaatgccatagctcctcctggatactacttgctcttcgtcgtttaccgtggcttgcctgcagccaagggaatgtgggtgcacattcaatag

SEQ ID NO: 41697 - DNA, 852 bp, Glycine max
  Peptide Sequence Number=SeqID_158475
atgtgggtagctttgttaatctttgcactcgcacccaacattatccaagtggatgccaacatttccaagagcatgcacctcacttggggtgttcggcatgcttcaattctgggtgaagaccttcatcttgtgttggataaaacctcaggatcagctgctcaatcaaagagatcattcttatttggaagcattgaaatgctaatcaagctggtacctggtaattctgctggaacagttacagcctactatttatcctctgcaggaagccagcatgacgagatagattttgaattcttaggcaacagtacaggacagccatacactgtccacactaacatatacacacaaggaaaaggaagcagagagcaacaatttttcctctggtttgacccaactgctgattttcacaattacaccattcactggaatcccacagcaattgtatggtatgttgatagtgtgccaattcgggttttccgaaaccatgaaaaagagggcattgcttacccaaacaagcaaggaatgagggtttacaccaccctatggaacgcagacgactgggcaaccagaggcggccttgttaagacggactggcacagcgcaccattcactgccagattccaccatttcagagcaagggcttgcaagtcgggcggagcaaggagcaccaatcaatgtgcctccaatgtccctgcaaattggtggacttcccggagatacaagcagctgagtcactcccagatcggacagctaaattgggtcagaaataattacatgatctatgactactgcacagataccaaaagattcaacggacaaatccctccggaatgctttaaaccacaattctag

SEQ ID NO: 41698 - DNA, 567 bp, Glycine max
  Peptide Sequence Number=SeqID_158476
atggagaagatgatcgcagtgggtatagtgtggggcgccaccaacgctatcatgcgccggggtgcgctactctgggacgaagctctcaaatcctccgcaaagccaaatccgcactcaactctgtgccaaaagatgcgcatctccctcggaaactgggtgaagcttctctccatttggcaatactcgatccctttcctcatcaacctctctgcctccgccactttcttcgccatcctctccgacgccccgctctccctcgccgtccccgtcaccaacgccaccaccttcgccgccaccgccgtcttcggcatcctcctcggcgagcgcacccacctcccccgtgctttcttcggtaccgctctcatcgtcctcgtgactcagctgcttgtatctccgggaagtccaccaatttgcagggacattggaggcacattgattggtgctccttgctccgcccgacttgcaagcccttgctctgaaatggtggaatctggcagtgaatggtgcgctgtgccagtccgtcttaacaaggccgcctctggttgcccagtcgtctgcgttccatag

SEQ ID NO: 41699 - DNA, 633 bp, Glycine max
  Peptide Sequence Number=SeqID_158477
atgcagcatgaacaggtggctaatatgcattatacttcttcagcaaatcgagttgaggatgcatattggaatctcagaaaaactgttaggttgaaatctacagggaataaacctgtgaaagcctccaaacttcaggacaaggaccatgctgatgattcagagaacagtgttactactttgttgaatgttaaaacggaggagatttcaaaggaacattcttcttcagagcaaattgatcttcttaaaatagtttcgtttaaacgagaaaattttgttcagactcaacacccaccaggaaagcagtatgatacaattctttgtttgagtgtatcaaagtggatacatctaaattggggggatgatggcttaattactttatttgcagaggtttggaaactgctccgtccaggtggcatttttgtgctggaacctcagccatggaagtcatatgaaagcaatcgtaatgtctcagagaccactgctgccaactaccgtaatattatgattcgaccagaacagtttcaggaaatattactagataagattggatttcgaacagttgaagatatcacttcaggtttgacagatagcaagactggtttcaacaggccaattctggttttttgcaaatga

SEQ ID NO: 41700 - DNA, 288 bp, Glycine max
  Peptide Sequence Number=SeqID_158478
atggcagttgacgtcagagaggcagagcctgaagaggatcttggtcgggatttgagaaagaggtttctttttttaaaaaaatccgagaaaggggagcagtttgtggcttccggatataagaaaaagagcgagacttgttgtcgctgcgacgagtgctttcggagcaagtgggatgttcgcaatttccaagtgggagagaaggagacagagataaggttaaattgggaaagacaaaagaaaatgaaaaagaaaaagataaaaatattcaatggttcgtttaaaatctaa

SEQ ID NO: 41701 - DNA, 168 bp, Glycine max
  Peptide Sequence Number=SeqID_158479
atggagacttttaaaaatttgagagagtataggcttatcaaggagaagagtagtgggaagataactcttgcaactcatgaaaatcaaagccaagcttggttgacccatccacctcctgcgtcctacctatggaggcttcaccaaccagcatttatatctcccaaataa

SEQ ID NO: 41702 - DNA, 792 bp, Glycine max
  Peptide Sequence Number=SeqID_158480
atggctcctgtaaagaatgaagatttgattcctggggcaacttttactgggaaagtaaaatctattcaactatttggtgcctttattgattttggaggtttcacggatggccttgttcatgtttctcagttgagtgacggctatgtaaaagatgttgctagtgttgtttctgtaggacaagaagtgaaggtgaagctaattgaagtcaacactgaaactcagcgaatttctctctctatgcgtgaaaataataatgacactgttaagcccggtccaaggaaagatgaggtgaagaaaaacacgaaatttgttgaagggcaggaccttaagggtacattgaagaatttggcaaggtctggttcttttatatcacttcctgatggggaggaagaatttctgcccatatctgaggaatctgatgagggatttgagaattttacaggaatttcatcattgcaggttggtcaacaagtcagtgtacaagttttgcgtatcaatagagggcaactgacattgactatgaagaaagaagatgttgcagcattggactctgaaataggccaaggggttgtccatgttgcaacaaacccttttgcattggcttttcgcaaaaataaggatattgctacatttttggaagaggggaagaaaatacataatacagttgaaatatcatcggcagctagaacttcaaaagaaattgtcaagcaaggggaaattgtatcagatgtttctgatgcacagggtgaacctgaaagcagcaagggtttggttgacgatgcttccttctga

SEQ ID NO: 41703 - DNA, 258 bp, Glycine max
  Peptide Sequence Number=SeqID_158481
ctgagacacctattaaacattgaatcaagtcctgaaaaacataagaatttccttaatcgtttcatcccaatttggtatttgacgggtgacatttggaagggggatgtggaaacaacacttgacagtgagaggaactatgcaccagctcacacattaacccttgacggcgccgttaagtgccttgagggatggttacccccatgtaaccttccggacctgccgccgacagccatgactagccgtgatgatggcggatga

SEQ ID NO: 41704 - DNA, 409 bp, Glycine max
  Peptide Sequence Number=SeqID_158482
tatgcgattgtggaaaggctcttactatacaatgcagtatgcgattgggggagtgtcctgtgattcggtctttcatgtgaagatgcttgcacatccccaaattcgtttgaccgagttttcatcgagtgtcacacgattcagagggtttcatgaagtgtctgcgattgggagaatgttctgcgattcggtctttcatgtgaagatgcttgcacatccccaaattcatttcaccgagctttcatcgagtgtcgtgcaatttggaggatctgaccgaggtttcatggagtgtcatgtgatccaggaagattcttctgcgccgaagatctgggagaggacgaagttgtatgtgaaaaaccttgagatgaagaacaggtacatagaagggcatgctgaagactggggcatttga

SEQ ID NO: 41705 - DNA, 242 bp, Glycine max
  Peptide Sequence Number=SeqID_158483
ggatttcctgtctgttgtatctctcgttacaatctttcaaagaaatgaacgtggatttgaggcttttagtcctcacgggcaggatcaccttgggctaccttctggagtggagacaaaacacgaacggcagaaaccaatcaaggcacttaaggatgaacgcaagcggggatggggtcacaaccgaccgatcgttgctcttctctgtgcgaagcaagcagggaatgtcgctgcaaggcagcccc

SEQ ID NO: 41706 - DNA, 1023 bp, Glycine max
  Peptide Sequence Number=SeqID_158484
gtgaagatccttataagcatcttaaggaattccatattgtttgttccaccatgaagccccctgacgtccaagaagatcatatctttctaaaggcttttcctcattctctggagggagtggccaaagattggctatactaccttgcccccaggcaacttagtggagaaagcttgtatgagtactgggaaagattcaagaaatttggtggagctcttggtgatatgacccctgctgaagctaggaatttgattgagaagatgttttccaactcccaacaattcagtgcaagaaatgatgctattgttcttaaaggagtccatgaggtggccacagattcatcttcatctactgaaaataaaaagcttgaaggaaaacttgatgccttggtcaacctagtaacccagcttgccatgaatcagaaatcttacactgttgcaagagtctgtggtctatgttcttctgtagatcatcatacagatctatgtccttctttgcagcaatctggagtcaatgagcaacctgaagcttatgttgcagacatttataatagacctcctcagcagcaaaaccaacaacaacagaataattatgacctttcaagcaatagatacaatccaggttggaagaattatccaaatctgagatggacaagtccttcacaacaacaacaaactgtccctcctttccagaatgctgctggtccaagcaagccatatgttcctcctccaatgcagcaacatcaacaacagtcacaacaaagacaacaaacaactgaggctcctcctcaaccttccttagaagagctagtgaggcaaatgaccatccggaatatgcaatttcaacaagagacaagagcctccattcagagtctgacaaatcagatggggtctggcaaccaaattcaagtgcctccactagtagtagcacctgcacctgaacctgtcaagcttcattctactcctgaaaaagaggatgagatagttgcacaaaagagaaagcttcctaacaaaaattttcatgcag

SEQ ID NO: 41707 - DNA, 579 bp, Glycine max
  Peptide Sequence Number=SeqID_158485
atggaacttcatttcttagtgatctctatttctgttctcttcgctccaaacactcccattcccagtgcacttagagaccttgtaaagcctggccctgaaggtgttgaaattgataatctccccatgcaaattgttgatacgcagtacccgaaaaccttcttctatgaagaggaccttcatcccgagaaaacaatgaatgtacaattcagcaagagtccctttacacaaccttttactgtattcgcatggttaaagggcttggaaatcaaagacatagaaaaaggacacacttttgctgatatatgcatgatgagagagcacgttgagggagaacgcaactgggaaagaacattcaagtactttcaagttccctttgtggacaagcaagagcaatacactgtggaaggagtgcaaaatcttggaggcaaagcagtgatgtgtcataggctcaatttcagaacggcagtgttttattgccatgtagtccatggaacaacagctttcattgttccaatggtggctggtgatggaaccaaaactaggacactgtcgtttgccactcggatacttcgaccatga

SEQ ID NO: 41708 - DNA, 700 bp, Glycine max
  Peptide Sequence Number=SeqID_158486
atggtgcttggtgcttatgttgctgcaagaacgtctgtaaatactggtatgccaccagtagttgaagcagaagcatcctccttgctagaagccattttgtgggctaaggagttcttgtacttggcgcagaacaaggaagggacttctgaaaatggtcctgaaacacaagcaatctcatcaaatcggaccaagatgcaagacgtaggcccttgtagaccggcctggcctatttccactctacttgagagtggagttggatttgaatttaggaggaccattctagatgaccagggagaagacaaatactgtgcagaatccttggaaaccctaatgaactttgtcatttcaaagcttggaaagaacgttcaggcattttcaagctccttcttgagtaagcaagaggaatacacagtggagggagtgcataatcttggaggcaaagcagtgatgtgtcataggttgaatttccaaaaggctgtgttttactgccatgaagtccatgaaacaacagctttcatggttccattgcttgccggtgatggaaccaaaactcaggcacttgctgtttgccactttgatacttcggtcttgaactttgaattgttccgtcaaataatgaaagttgatcctggaactaaccctctttgccatttccttggaaacaagtccattttgtgggttcccaatttagccacggagg

SEQ ID NO: 41709 - DNA, 816 bp, Glycine max
  Peptide Sequence Number=SeqID_158487
atgacggcgagttctggctcccgccgcagttcctcgccgacgacgacgttttgccgacaccctttgaagcaaagttcccatctttgcccgacgacactgttttgttcccctccgagtggccgtgggtgtggttgcggcaaagggtcgagccagggaagccctgatggtgtttgcaagttgtcctctgcgaagaccacttgggatctgctgcatgcggctgcaggggaagttgagaggatgaggttgaagcaagaaggttatgctttcaaccatcaaaatggaaacctcattccccaaagaaaaccttctccagtcatccctttaccctccaaaaccaccacctcaacgccaaaccctgatatgggtggtttctacacgcaacaacactcactttctcaccagcgattgcagatagcacaatttcagatgttgagacagcaacagctggcaaagcagcagaactcggtgtggaatttacagaagcaatgtggtggggtttactctcagaggcaacaacagaacaaccaaatggatcacaatagagggaggaacaatgatgttaacaacagtgttggtggaagaaatgttaggcctttgggtttgtctgcatctgcatggcctcctctgcagcacgcgaagcagcagaaccagaattatggttctggcatgagggctgtgtttctcggaaacccttctgggagaagagaatgtgctggaaccggtgttttcctccctcggcgagttgataccccagagccacgaaagaagcaaggtgaattacacaaacacatcttcgaggttttgcgttgcatttaa

SEQ ID NO: 41710 - DNA, 339 bp, Glycine max
  Peptide Sequence Number=SeqID_158488
atggaaaaccatagatttataagcaagtctgattcagcaaaagccaggagcaacagaaagcgtattagacaacaaaaggtccatcttaatgttcaggatagtgtccatgcaagtgtcaatccagcttcatcccatactgaagatgattataaccaaccaaagtcaccaccgcatagtgtccatgcaattttcaatcgggcttcacacgatgctgaagatcattttaatatctgcgattcatctcagaatgagagttctggatcaatagaagttggatatccaaactgtgaatcgtcccatcatgattcttcaatggacacagaggtaaatgtcttatag

SEQ ID NO: 41711 - DNA, 150 bp, Glycine max
  Peptide Sequence Number=SeqID_158489
atggaggttaatgaaccttggttggggttatggctaccattgaattatcaagtagatatgggagcaagtcagcataggacaccaaaattggggtaccaggtaggtccccttgtacttgtcaagtccagcaccttgaacttgggagggtga

SEQ ID NO: 41712 - DNA, 267 bp, Glycine max
  Peptide Sequence Number=SeqID_158490
atgaaagcaaaacgcgatcaaaagtggcttaggggagcaagaaccgtgagtcccgggaacatcaaccatgtcccctcctcccttatgggccagcgtttacctaacttgaacctacttaacgacgttctctgctcgtttagcgccgggaaagggcaacgattggtcggtcgtgaccccatccccatttgcatccgttcccatgtacctgcaaataggaaacaaaaatacgcggccaatcgtgaccggtcatcgtcttaccttggttga

SEQ ID NO: 41713 - DNA, 462 bp, Glycine max
  Peptide Sequence Number=SeqID_158491
atgaattgcgttttcgttcatgtgtcctccactttcgggtttggaactgtgtttcatgattgcctaagtgcggaccctcaaggcaatcctccattctccccctttcttcggagctccatgaattgcattttcgttcatgtgtcctccactttcgagtttggagctgtgtttcatgattgcctaagtgcggaccctcaaggcaatcctccattctccccattttttgggatctccatgaattgcattttcgttcatgtgtcctccactttcgagtttggaactgtgtttcatgattgcctaagtgcggaccctcaaggcaatcctccattctcccccttttttcggagctccatgaattgcgttttcgttcatgtgtcctccactttcatgtttcgaactgtgtttcatgattggctaagtgcggaccctcaaggcaatcctccattctccccctttgggtga

SEQ ID NO: 41714 - DNA, 615 bp, Glycine max
  Peptide Sequence Number=SeqID_158492
atgacgtccgggattatcggcgatctgaacgtggccgattttgtcctgcaggcgctcgaaggtcgcgacgagatcgccctgcatgatttgcatgtggtagaaatcatattggatcagcaggttggaatgcccgacacggtccatgatccgctcggcctgatcggtgttggtgaggaaatagccggacaagggcaattccggaatccgccagacgttgcgcagcgtggccgagattgccgacaagcgtgtcttccagaacttgcggatcgacaccgggcggttgataccggccagacaattgatctttcggcatcccagaacttttgcatagcggatcgccgtttcaacggacgtctcaaattcggagaccctgtccggcaggctggcgatgccgcgctcgcctgcggcccagttgccgggcggcaggttgaacagagcctgtgtgagattgcacctcttgagctccgctgcaatcgtctctgccgcctcctcgtaggggctgacatattcgactgccgcaaaaccatcggcagcggcggcggcgaaccgttccatgaacggatgttcggtataaagcatggacagattggcggcgaatttcggcattggcaatga

SEQ ID NO: 41715 - DNA, 159 bp, Glycine max
  Peptide Sequence Number=SeqID_158493
atgtcggttgaaaaatatcagtcagggctatttaaggaccgacgtcaggaaatgttcgatcggcgtcatccggtgattctttttattttagacatcgatcggtcatctttcctggccgacgtcaactatcatttgttttttatcaatatcggtgaataa

SEQ ID NO: 41716 - DNA, 411 bp, Glycine max
  Peptide Sequence Number=SeqID_158494
atgatagaggttttcaaaggagaggatgttaagcccaattttaagataattgcacatagagttaaggcgtgttatgagggattccaacagcctaggcattctatgtcaggcattgagtacaattgtggtcatctgaccacaacccaagcagttagcataggtgttgagtatggttgtggtgactctactacgaccgtggagggaatattagtatgcatgactatgaactatttcttggagctagcctcagatatgtcaattctgagccttgattctcttgactctgccacttggtcacgactatggtacattcaacacagtcgtggtaaccaatatgacaatggaagtacgatgactcctcttctgaataatgtcaaccttctgacaatggtcatggtgaattcactatga

SEQ ID NO: 41717 - DNA, 378 bp, Glycine max
  Peptide Sequence Number=SeqID_158495
atgtttattcaacttgtcacttacgacacctccaccaaatgtgtagaacacataatttttgattgggcagacttggagatcaacttaggagcgcaaggtcatacagtgctcaatggaatgccccggaactcccccatgataagaacatgtcacattcgagttgtatcatcgaggaaatggaggttgaggaatctttgttgggcttatggctaccattgcaatattgagcaaataagggatgatattgctggggaggatattggtacatgggattataagggaataatggaaagtttggccacacatgaactacaaccactacatgaggttctcactccttcttcccctcgccactcctcgtgggtcccctattactag

SEQ ID NO: 41718 - DNA, 255 bp, Glycine max
  Peptide Sequence Number=SeqID_158496
atggctagtgacgatggaaagatgaacttgctccttaaaactagcaagatcagtgaaaaccgcatggtgacgagaatgaaagcaccaaaaatgattggtaggctctcctttcgagtaggactgactctagaggtagcaaataactactacaggcctgacctcaaaaaggcagctttggcaaggttgagtgttgtcaataggagcctcagagttgctaagtctggtgtgaagaagaggaacagacaggctgtgaag

SEQ ID NO: 41719 - DNA, 339 bp, Glycine max
  Peptide Sequence Number=SeqID_158497
atgcacaacgtttcaaaacatcaaccaatttggcaaaccaacattggcgagcctgtttcaacccatacaacgacttgtgaagtggacaaactttacaagaagccagagttcaaagaattacacaataggaggcttggaagagggttgaagaactggagcagtgcgctcagcgcgtcaacatccgctcaacacgaggagccaacttggaggccagacttagcctgcatctggtggcttagcacacatttggcggcttggcctgcatttggcggcttagcgcacaatcacttatacccgttggactttgcatgtgtgcttagagagcacatgcaggcttag

SEQ ID NO: 41720 - DNA, 153 bp, Glycine max
  Peptide Sequence Number=SeqID_158498
atggcgcttccacagccacgtggctcgtccctgtcgaaggcgccagtggtggtggcgccatgcatggccttaaaaagggtcaacattcgatctattgtcttcgaagtgcttaaaacaatgaaccaaaattgtatccatgagactccaaactaa

SEQ ID NO: 41721 - DNA, 1742 bp, Glycine max
  Peptide Sequence Number=SeqID_158499
atggagaaattgcaagaaattgcagtgtccttggctgttgattatttgcttccacccttaaagaaagcagtgaattcagtcatggaggttccaaaagatgctgcagacatgaaagacaaacttgatgggattcaagccatgattcatgatgtggacaagatggcagcaactgaagaaggcaactcacgtgatggtctcaaagcaaaggtgaagctgctggtggaaacatctttttgcatggaagatatcgttgatgaatacattatccatgaggaaaggcagcttggtgatgttcctggatgtgcatctttaccttgtaaggctattgatttcgtcaaaactagggcctctcgtcttcaatttgcatacatgaaccaggacgtgaaatcagaatttccagggatcaaggagaggaacaaaagtgaggattgctcccaaattcaatcttctagaggaaaccaaaacatcacgtttgacaaccttcgaatggctcctctgtttcttaaggaggctgaggttgtgggctttgacagccctagagatacattggaaagatggttgatagaggggcgggaaaagctcactgttgtctctgtggtaggaatgggaggacttggaaaaactactcttgcaaagaaagtttttgataaagtccagacacacttcactcgccatgtctggatcacagtgtctcagtcatacaccatagaaggattgttgcttaagtttctagaagcaaaaaaaagaaaggatccttctcagagtgtttattctacaatggataaagcatcgttgataagtgaggtgagaaatcacttgagccgcaataggtatgttgtcgtgtttgatgacgtgtggaatgaaaatttttgggaggaaatgaaatttgctttagttgatgttgaaaatggaagtaggataataatcacaaccaggtaccgtgaggttgcagagtcttgtaggacatcttctcttgttcaagtgcatgagttgcaacctttaagtgatgacaaatctttcgaattgttttgtaaaacggcatttggatctgaattagatgggcattgtccaaacaatcttaaggacatatcaactgaaattgttagaaagtgtgaaggtataccactagctattgtggccactggtggccttttatctcgcaaaagtagagatgcacgtgaatggcaaagatttagtgagaatctaagttcagaattaggaaagcatcccaaattaattcccgtgacaaagattttgggtttaagttattatgatttgccttaccatctcaaaccatgcttcttgtatttcggaatatatccggaagattatgaagttgagtgtgggagattgattctacaatgggtagctgaggggtttgtcaaatctgatgaagcggcacaaactttagaagaagtggcagaaaaatatttgaatgagttgatccaaagaagtttgattcaagtatcttcatttacaaagtgtggcaaaattaaaagttgtcgtgttcatgatgtagtacgtgaaatgatccgcgagaagaatcaagatttaagcttttgccattctgctagcgagcgagggaacttgtccaaaagtgggatgattcgtcacctaacaatagcatctggttccaacaacttgacaggaagtgttgaaagctcgaacattcgatcacttcatgttttcggtgatcaagaattgtcagaatccttggtgaagagtatgcctacaaagtacag

SEQ ID NO: 41722 - DNA, 564 bp, Glycine max
  Peptide Sequence Number=SeqID_158500
atgatgcatgtgctggaaacatggtgggaagcatgggtgcatggatatttcgctagtggcattgggggaatcctttgggcgagtctcgctggagggaatggcgaaataagggtttcgccaacaggaatggcggaacaccttcaaacagaccctctcaagaaaatgtttgaaatcatatctcctttggaatacataggtagagaaagagacaaagagaaatttacaaagttagacaaaacaaaatttggtcaaggaaaaggatttaatgtagatttaattaagttgatatcagatgctgtaagtatccctgttattgcaagtagcggtgctggtgctcctcaacacttctctgaggtgttctataaaacaaatgaaacagtagcacttgctgccggcatttctttcacaggaaagaggcaattttcggtttttaagaaccctttgtctttaaaaattaccacaaacaaatgggattatttgtgtccttttggtgcctattcagtcggtaaaagagcatttgttaaaggaaggcgtagaagttggaatttgatcataagcatttaa

SEQ ID NO: 41723 - DNA, 2415 bp, Glycine max
  Peptide Sequence Number=SeqID_158501
atgaaagaagtcgtggtgggatcaaagaggagtcgtggacggccaccaaaaacggtgtctccgatacctattaatcctccatcgctggtggctccaccggaaatggaatcagaaatccatgacgaagacgaagatggtgatttggctaatagtaaacaaggacctgctaatggaagtgaaacggtggctcaagaaaccctaatcgaagaccaagatggaattgggcgtaaactctgggttgacgtaattagtggaaacagaaatctagctaagggtagagttatgcagtatgtggctcccaaggtggtagatggtgaaatagatgtgaaaattgaggataaggatgttgccccagaattgaaattttgggaaactactttgatcttgtatgtcttaggtggtgatatcagtatgcatatgctgaagaatttcatggagaaggcttggaactttgtctccctgccggatatgtactatcacgatgatggatatttcatgctttgcttcaaatctcatgcggatatggatgctgttttgatgaaagggccttatacaattaggaatatgcctttgattttgcaggaatggaggccggattttgatctcaagaaagacatgttgagcaccatccctatatgggtgaaattgccaaaacttgctctgcatctatggggagaaactagcctaaacaaaatcggtagtgccattggaattcctccggtgacagatgagtgcactacacataggcttagagtttcatatgcgagaatattggtggaatgccagacaattgggcatcaatgtgatggagctgctaagcataagatttggaagcctaagccgaagaaagttgatcctgataaacagccgaaagcagaaaagaatagcactctggtgaagactccaattagagacaaaggtcccaatatcattgatgttgaagacggtggttgttggacagttgttaacaaatctagagataaaagaaaaggtaaagatgctgctgaatcatcctctacattacaatgtctgaatggctttgaggctttaggggctttgaatggtccacaaggcccttatgacagaggcccatctggcaagctaagggagataagctcccatctccttaagcttcagcctactattgttgttttgattcaaactagggttaaacaagaaaaagctcaaaaaattcgagataaactatgcttgaagggtagatacctggataattacaatcatcatgaaaatggtagattgtggatagaatggaatgataacaaggggccttggtgtgctgttggagattataacaatggggctaaaagtcaagacagggttggaggtaaactggttactgaggcggaatatgaagatcttcaagctatgatggatgcaaccggtttgagtgaaatggacagctctggagaattttttacctggactaataaacaggcagacaatcctatctattctatgatagatagaatattggctaacatagactggttccaaactcatagtgatgctaatctgactattctcccccccccccatgtatctgatcatagcatcctttatttgtctgagccacttcatgttagaaaaagaaatcagttcagattcaacaactgctgggtggatgcagtgggtttctatagtattgtggaaagaagctggaaccaacctgctagaggcactccaatgcagaggctgtggtataaacttcataggcttagacctcatctcttgaaacttaataaatttactaatgatattcaaaagaataaacttgtagcaagagaaaagttggaccaggctcaacaggaccttagaaataacatcatggatgcccccagaattgaggaggtgaaaagattgactaatgaagtgatccactggaatgaaatggaggaaaaaatgttgatgcaaagatccaaaattgactggattcgggctggagatggcaataatgcattctttcatgcatatctgaaatccagacaaaatgctaaaagaattaaagttatccacaaagatgatggcactatcctcactactcagaaggaaattactcaggaagtgctagctttttatgggaagctcatgggtcatgatagtagaagcctccaacatgttgatattgatgctttaagaagaggagatcatctcaccatggttcaaagagaggatttagtgagacctgtcactgttaaagagattgaagatgctctaaatggaattagtgacttaaaatcgcctggagttgatggttatagctctaagttttttaagtcatgctggaacatagtgaaagaggatgtggtcaatgctgctcaggaattttttgctcaagatcagttattcttgccctttaatcaaactgtggtgacattggttccaaagagtgataat

SEQ ID NO: 41724 - DNA, 1130 bp, Glycine max
  Peptide Sequence Number=SeqID_158502
atgaccgcagaagcaaccaaagtgctcggcgcctatcttcgcgatgtgatcgatctcaacccgaacaacttccggctaatgggccccgatgagacggcatccaatcgcttgtcgacggtctacgaacgcaccgacaaggtatggctggaacgtagcgaaaccaccgatgaacatttgggccccgagggccgggtgatggaagtactctccgaacacctgtgtcaggggtggcttgagggatatctcctcaccggacggcacggcctcttcaactgttacgaggccttcgcccatattgtcgactcaatgctcaaccagcatgccaaatggctttccagcagcacagaagttccgtggcgacagccgattgcttctttgaactatttactgacatcccatgtttggcgccaagaccacaatggcgcgtctcaccaagacccggggtttatcgatcacgtcgccaacaagcgcccggaggtagtgcgggtgtatctaccgcccgacgccaacacgctcttggcagtcaccgaccattgtctgcgtagcaggcactgcgtcaatgttgtggtggcgggtaaacaacctgccctgacctatttgagcatggaggcggcacgcgcacactgcgccagagggctgggcatctgggattgggcgagtaatgcgccgaacgagccggatgtcgtgctggcctgcgccggagatgtaccaacgctggaaaccttggcagccgcggacatcttgcgccggaggttgcccgagctcgcggtccgggtagtcaatatcgtggacatcatgcgcttgcaaccagcatctgagcatccacatggactgccccacagtgattttgacgcacttttcacccctgataaaccgatcatcttcgcctaccacggctatccctggttgatccaccgccttgcctaccgccataccaatcacgatcggatgcacgtacgcgggttcaaggatcggggcaccaccacaacaccttttgacatggtgatgctcaatgatctggaccgtttccaccttgtcatggatgttatcgacagggtcgaggggtctgggcagccgagccgcaaacctacggcaggaaatggtcgacgacccgaaatcgctgcctgccg

SEQ ID NO: 41725 - DNA, 237 bp, Glycine max
  Peptide Sequence Number=SeqID_158503
atgacagaatacactaattgtttgacaaatggaattctagaggcatactcagggatcttagaaggatttaaagcaacggataacgaattggtggaaataataataaagaagggtgagggttacttacgtagacaaagtgagtgctccaagaaagagagacgaatggactgcgacggaggtgcagcggaggacggaggtgacggcaagcagacaactaaagatgcgaggctgcaatga

SEQ ID NO: 41726 - DNA, 276 bp, Glycine max
  Peptide Sequence Number=SeqID_158504
ggaagatccaacagaggatttatctttccataccaggaagcctttctttacaacaaagagaagaacaagatgaaagattgcaaaagtacaagtggcaaggatgtctcctttacctctaggatctcacaatcactcacaaactcatctcaatctttcaaaccggctcttgcttcaagctctggtcgctgcaaatcttcacacaaccaaatctctcaaaactctctgcaacttggacctttttctctctctagaaaccctagacatgtaaagctttga

SEQ ID NO: 41727 - DNA, 213 bp, Glycine max
  Peptide Sequence Number=SeqID_158505
atgtcaggatttacacgcgattctcctcaaatttcagccagcccgcatcaattagaccttgcaccttacgcttcagagccctacaatgctcaatgggacgccccagggcttcttcgtgacaagcacacgtcgcgtttcgagtcgtattctcggagaaatggaggtgttgttcatcattggaagtgcagtagacagactttgtggttgatttag

SEQ ID NO: 41728 - DNA, 162 bp, Glycine max
  Peptide Sequence Number=SeqID_158506
atgtccattaccgttgatcatgatcggtcaatgcttggctcaagtgagcctacagagcttgaatctcaatctgtgtctgttaccggggatcatgaccctcttctcaggattccattgacaccaactaagcgcgtatcttccgatgagttggataatgaatga

SEQ ID NO: 41729 - DNA, 682 bp, Glycine max
  Peptide Sequence Number=SeqID_158507
accctccttggtcactccaatacattgtcttgaagtccaacaagccaaaataatgaagagttcaattcctactacaactacttccaccttgctcactctcttccttctctctgccttcacctcacacctcccttcagccggagccgatgccgtcaccgacagagacggcgccgccattcgaaacggcggcacataccacatcctacccctcttcggggtaaagaacggcggactagaactcgccgccaccagaaacgaaacctgtccactcaccgtggtgcaatctcgcactgctcagattttcaggggcctcccagtaagaatctcatccccttatcgaatcgcttacatctccgaaggccttattctgaacctcgccttcgcttcttcgccgtcgtgtgcccccactcctccgaactggaccgttgttaaaggtctaccagaagggcaaggtgtgaaactactcgggtacgggaggagcacggtgagtggctggtttaagatcgagaaatcttcccttgaatacttgtacaagcttgtcttctgcgcacgtgccagcaaagcgtgtggggaaattgggatcagtgttgatgatgagggaatcaaccgtttggttctgactgaggaggagggtgatggtatcattgttgagtttatgaaagctagttcagtttctgcttga

SEQ ID NO: 41730 - DNA, 201 bp, Glycine max
  Peptide Sequence Number=SeqID_158508
atgtgtgttagtcgtgcgcataaagaaagaaagaaagaagttgggatgtgcacacaaagaatgaaagatgacgaaatggaggtgcttgggagtggtcgtcacacaaagggatggtgcaggaagcaaatgtggagtgtaggaagcaaaggcccaaatatggttagactaaggaaaggcccatgtaagaacaacaccaagtga

SEQ ID NO: 41731 - DNA, 1581 bp, Glycine max
  Peptide Sequence Number=SeqID_158509
atggctaagcacaacgaccgcacacggttacaacatctccagtctcaagtttcagctattcaaacatggatggaggatcaacgtactcgtgataaaaaattacaggaccgcttcgatgaacttcaagcttcaaaccaagctcggatggatctcacgcaacgatctatcgatttgttgattcaaagtcaatctcataccattggtggttcgaaatcaaatcgtggcactccaggttcgtctaacggcgtttcggttacttcgattgcgacagtttctgcagttcgagacatttctttgggttttccgcattttgatggcaatacaccagtcttggagtggatcttcaaagaagagaagttcttcaattatcatagcactccagatctggatcgagttgatattgcttctattcattttcagaaggatttttcattcactcataagtgtcctaatagacaaattttattgctacaaactgagagtgatgatgttgagcttgaaggtcatgatagtaaagacataattgataatgtggatggcacaatcatgtttacgacctatattgataagcttccagttaaggttttggtggatggaggcagttcggacaattttttacagccaaaagttgctaaagtccttaagctacctgtggaaccaacaccttcttttaaggtcatggtggggaatggaaattacatggctgctgaaggcgtggtcagcaagttgactatcaaggccaaaaatgccaggttccaattacctgtgtttttattacccatatcaggagctgatctcatcttgggatctagttggttgaaaactattggtcctcatattgcaaactatgataagttgcaattgaagtttatgtatgatggctctcaacttgttaaggtcaaaccttacaggtatcctcacagtcaaaaggaggaaattgaaaagttagtgaatggtatgctagaagaaggaattattcatccaagtaaaaacccattctcatttccaataatcttggtcaagaagaaagatggatcatggagagtatgcacggattatggagcactaaattccatcactatcaaagacacatttccaattccaactgttgatgaattgattgatgaattatatgaagcggtttttttttctaagttagatttcaaatctggctatcaccaaattctttttaatcctgaagatagatacaagactgcttttagaacacaccatgggcactttgagtggttggttatgccttttggcttgaccaatgcaccgataacttttcaaagtttgatgagtgatattttcaaaggagcattgaggagatttgttttggttttttttttttatgacatccttatactcagttctaactggaaggatcatttgtctcatttggaagtggtgctaaataccttgaagcaacaccatttatttgctagattctcaaaatgtgcatttggagttagagaaattgattatttaggtcacactcttttaggagttggtgtagctatggaaacaacaaaactgcaagcggtgttgaattggccattacctacatctctcaagtag

SEQ ID NO: 41732 - DNA, 171 bp, Glycine max
  Peptide Sequence Number=SeqID_158510
atggcccaaacgaaagtgcataggtggtgttgcgacgacgtagtggtgtctaggccaataggttgcacacatgcggatctagagttaggagcgatagggggtcgcaagtggatttgtgcgatgtgggtgtgcacaacaatgttgaaggacaagggtggggtggcagaatga

SEQ ID NO: 41733 - DNA, 441 bp, Glycine max
  Peptide Sequence Number=SeqID_158511
atgtatatgtctccaggccaagacatgtcatccatgtctaatgacagaaacaacatgtctatgatgatgcacaacagtttctactggggcaaagatgccatagtgcttttccctaggtggcctgagaacaatgttggcatgtacatcttagccctaatttttgtgttcttccttgccatggctgttgaagtgttatctaaccaaccactcctcaagccagggactagtccccttgtgggaggacttattcaagctggtgtccacttatttcgtatcagcttcgtttacatggttatgcttgccgtcatgtcctttaacgccggaatcttcattgctgctgtggttggtcacaccttgggattcttcgtcgccaagtttcgtgcactttccatcgccaataggaaagacaaagggtcttcctcaatcttaaacaatgtttga

SEQ ID NO: 41734 - DNA, 246 bp, Glycine max
  Peptide Sequence Number=SeqID_158512
atggcgtcgatgcttgtgtcgcgcaccattgagttcaacaacttgaccggaaaaattgggcctagcgtctttaaccactgtactccgagcaccacatcggctccacaatttggtaatatgtggaagtcgacagagaagaagccactctcttgtcctatggagaattcgtccctaacagttaaccacttaatccaaccctatttcaatttactaagcgaaaaccaacttagggctgtcaatacgtga

SEQ ID NO: 41735 - DNA, 336 bp, Glycine max
  Peptide Sequence Number=SeqID_158513
atgatggtacaagggtggttttgtggttgtcgtggggttggagttgagagtgacgttgagttcatatttgggcagggtgggggatgcacgtggttttggaatttggtgagtggtggtggtgcactacatggattagaagaggtaggactgtcatgcaatgcaaaggtggtcagcattgattatggttgcgtgagttcagatgtagacggagctgatgggttgggtgagaagaaggggccaatagcaatatggttgggatcaatatcaacttctgttcataactggtactgggccaccaccaaagcccacttgacattcatggaggccacatggtga

SEQ ID NO: 41736 - DNA, 1029 bp, Glycine max
  Peptide Sequence Number=SeqID_158514
atgagcaatgcacagcgcagtttccacgtcgccgtcgtcagtgccaccggtgcggtcggcgagaccatgttgtcgatcctggccgagcgtgatttcccggtcggtaccctgagcgttctcgcttccgagcgttcggccggcggcgagatcgagttcaacggccagaaggtcaaggtccaggacctggctacctttgatccgagcggcgtcgagatcgccctgttctcggccggcggcagcgtgtccaaggaatacgcgccgaagttcgcagcagcgggcgctgtggtgatcgacaactcctcggccttccgttacgacgatgacgtgccgctggtggtgtccgaggtcaacccggagcaggtcgccaaccgtccgcgcggcatcatcgccaacccgaactgctcgaccatgcagatgctggtggcgttggcgccgctgcaccgcaagtacggcatcgagcgcatcaacgtctccacctaccagtcggtgtccggcggcggccgttcggcaaccgaggagctgggcaagcagaccggccagctgctgagcttccaggagatcgatccgcagcgcttcccggtgcagatcgccttcaacctgattccgcacatcgacgacttccaggacaacggcttcaccaaggaagagatgaagctgatctgggagacccgcaagattctcggcgacgacagcatcctggtgaacccgactgcggtgcgtgtgccggtgttctacggccactccgagtcggtggcgatcgagacccgcgacaaggtgaccgtggccgaggcgcgcgcgctgctggagcagtcgccgggcatcgaagtggtggaccgccatgaagccggtggctacccgaccccggtcacccacgcctcgggcaccgacgcggtctatgtcggccgcatccgcgaggacctgtcgcacccgcgcggcctgaacctgtggatcgtgtcggacaacgtgcgcaagggtgctgccctgaatgccgtgcagctggccgagctggtcgccgccgagcagcgctga

SEQ ID NO: 41737 - DNA, 399 bp, Glycine max
  Peptide Sequence Number=SeqID_158515
atggcttctaggaaaagaaaggcaccatctacacccacacaagttagatttgacagatcaagatttacttcccaagaggcttgggaaagatatacatacattattgtgcctaggaagcttctgccagagaggaacgtggtggaattctacaccaacctctatgaccgcaaggacaaatcacctaagcagatttgccctcaggagttggctgctaagctctgtatcccagggaggggattcgagcttaatgctgatgggcaacccctgaagattttgaggaagaacatgaccaccttagctcagacatggagtgttctttccttctcaaacttgattcccacctcccaacttctgatgtcactcttgacatggccagactcatttatggcattattatga

SEQ ID NO: 41738 - DNA, 528 bp, Glycine max
  Peptide Sequence Number=SeqID_158516
gcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcacgtgggggatatgatttgctggagaagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcaaataaaatagtaggttcaccaatatgttgcaatgttcatatgtttaagtattttgagtag

SEQ ID NO: 41739 - DNA, 588 bp, Glycine max
  Peptide Sequence Number=SeqID_158517
atgggcccgaaatctaccctaaggctcatgagaaccctagggccttctcttgcatctctggcccactcttcttggagtcttctatccaatgcccttgcgaggacaccatccaccggaaaaagaatgtttgtagtaggaaatatacacgtgttgttcaacccaaatcgtggtgacatcaaactcagccagttagacatccaattacatgatcacagaaatatgttaggacagcttgaaattcagactaacaaagtcttcggatcacaaattgttgatgagccaagtttacttactgacctcacgcttctccacatcaacactaaccgcttctacaacactgtgcaacacaagttcgacaagctgaaactcccctttgagttagatctcagcaacaactgcttcgtcaggaagttccccgatgtggtgttgtgtttgtcgcaactcaagtttctagatatgagattcattaaattcaaaggtacggttctgaaggagctcttcgacaaggacctggacgcgattttcatcaatgacaaccgcttcatcttcaacttattggaaaatttgaaaactcgctggtgtcggtga

SEQ ID NO: 41740 - DNA, 126 bp, Glycine max
  Peptide Sequence Number=SeqID_158518
atggtctcgcgacgtgttagagagtcaggggtatttggtcttttcggatgggagggatttatcctgtggagtgaggtggcggcgggtgtatggaagaaggggtggaaaaaggatacaaaggaatga

SEQ ID NO: 41741 - DNA, 234 bp, Glycine max
  Peptide Sequence Number=SeqID_158519
atggatagagattttgaacacaaacacgatcagagtctagtgcactcggtggaggacaacaaagtaaattatcttctagaatgggaggaaagcaactgtgatgatattgcaactagtgttgatgttgaagaacacctttacgggcttgcaaaagatatgagaatcatgcttgttacttcctcacaacgccttgctttaataccatttcattccaatggaactgcggctggttga

SEQ ID NO: 41742 - DNA, 375 bp, Glycine max
  Peptide Sequence Number=SeqID_158520
atgggtgatagtgattatgggggtttgattcaacaacccctaatagactgggaggccatttttgttggcggttcctcctcagagaatacccatcgtggtgcctccaatagcgagtcctcctccttggagagggttagggctttgcaccgtactggtagaggcatttctcacctttgtgggagggcatggccttccgctacttccggggtgcctatcccagttattgtgatcctccccacttcagcttcttcgggagtaacgaaatgtagtggttgtggagatgtcaaggcgtctccccacgaattactccaagcaaatgatacaagagcaaggataaacctcaggggacatccaatatggagagcctttgcttga

SEQ ID NO: 41743 - DNA, 393 bp, Glycine max
  Peptide Sequence Number=SeqID_158521
atgtactcacgaatgcaatcacaaggactcgcactgtctcctaaggctaaggctagtgttgaggaagtccgagatgctgatgctcgtattcctgtacccactcaagaggttcagttagtggggatgacacttaacaccttcctttcttgggcgacatatcttgtaaagcctttttcagaacatgataaacaagtagttgaggggcaagtgaaacctatagatatgtcggatcctgacatcgatcccctctacctaatgacattgatcatcccacagcttttcctcaagctgttgcaggcatatgactcagacaactatgcgagcggggaatgtcgatgtgaatggattcctcgagtcacagtctatacaaagatttgggcaatcgcactttga

SEQ ID NO: 41744 - DNA, 398 bp, Glycine max
  Peptide Sequence Number=SeqID_158522
ggtacatcctttgtggtacacgtagagggtacatctacttgggtttgactgagaacaagagagggtacatctcttgtggatcagttctagtggagggtgcatccactagggtttcaaagagaacaagggagggtcactcgatgcaacaatcacaagatgacaagagtacaattcaaaatagtggtgtaagtctaatggctgaatctcaacactttgctattgtacctgatgacaaaccccgtctagctttcatgctttactttggagctattgaagaaatcttggaggtagatagcaatatcagtgtcagaaccgatgatttcggatttactttgatagatctgaagaagctcgcttatcagaatgagcctttcatcatggcagaacaagctaaatag

SEQ ID NO: 41745 - DNA, 1062 bp, Glycine max
  Peptide Sequence Number=SeqID_158523
atggacttcgttttctgcatttttttggaaaacgcgatgagatcgctaagcacgcatgttgcgctaagcgagatgaacactcatctccctgatgagttgcctatggctaagcggggcttattcgctaagcccagatggcctccaggaagtgtaagagcattggggcaaggccaactgcttaagaggaaggttgagatataccacacggagtttgatgacttcaagacagagttggagaggcttaatcttcacaaacacctcactaacttggcttatgggactattgatgttgctttggtgaaggaattttatgctaatctttatagctttgaggatccttcaccaaagcaagccagagttagaggccacttggtgaagatagatgtcgacagcctcaacacatttctagagactcctgtagtcctagaggatgggggagtgtggagtgttctctcttactccaacttggcccctacatctcatacatcagatcttactgtggacagagccaggttgatctttggcctagtctctcatatggacatgaacatcggcgctctcatctcaggacagatgactttcattgcccagtctaactcttgcagacttgagtttcctgctttgatcaccgccttacgccaagcccgaggggttgtctctgatagcctcacatttgagcgcctgagcccgaccattaacttggcctacatcaggaagaactattggaacattgatgatctaatagttgctttccggggggctaggagggcgagggcgagggtagtctgtcctggggcccaaccttcttttgatagggaaggtgaaggtcccatagcccaggtaccccaacaggtacaggatgcttcctccgagaccaccattccagagccattcactcatcatcctgaggcaggggaagaacaagtgagactagagactactgctactcttgagagatcactggagagcacatcagagcttcctactccaatggcagacctctcctcaccacagccggcagctgacccttctactcctttacatgacataccagaggactag

SEQ ID NO: 41746 - DNA, 1884 bp, Glycine max
  Peptide Sequence Number=SeqID_158524
atggatcatctacaacatcaagagatggtagacattgagtcacaaaccgtggaaatccctgacatactccacaaaggaaaacgtcaagtgattcttaagtttgataacgttgtgtataaaattaagaccaagaaaggtggagtatttgtgaagaacaaagagacagaagagaaagagatactgaagggagtgaaaggtgttgttgagcctggtgaaatgctagccatgttaggtccatctgggagtggcaaaacaactctactcacagcattgggaggaaggcttagagggaagctttatggaagcataacttacaatggtgaagccttctcaaattccatgaagaggaacactggctttgtcacacaagatgatgttctctaccctcacttgactgtgactgagaccctagtcttcactgcacttctcaggttgcccaacactatctccaaagaagagaaagttaagaaagcaaaagatgttattgatcaacttggtttaaccaagtgcaaggatagcatagttggaagccctttcttgaggggggtttctgggggtgagagaaagagggttagcattggacaagaaatgctcataaacccaagcttgttgtttcttgatgaacctacctctggcctagactcaaccacagcacaaagaattgtctcaactttgtgggagcttgcatgtggaggaagaactattgtgatgactatacaccaaccttcaagtagactttactacttgtttcataaggtgttgttgctatcagaagggaactcattgtattttggaaagggatctgaagccattgaatacttctctaacattggatatgccccagccttggccatgaaccctgcagacttccttttggatcttgcaaacggtatctacactgatgaatctaatacggatcatgccatagataaacaaaaattggtttcgatgtgtaagataaactgtgctgctcaattgaagccagcagcacttgaaggaatcaatgactctagtaaaagccagaatagatttcaagaaaagggctccgaaaaatggcctaccagctggtctcagcaattcactgtgttgttaagaagagacatcaaagagagaaggcatgaatcattctctgctttgcgggttgctcaggtctttgtggttgctcttatttcaggactactgtggtataagtctgatatctcacacttacaggatcagattgggcttctattcttcgtatccggcttttggggtttcttccctctctttcaagcaattttcacctttccccaagagctattgatgctagagaaagaaagatcttctggaatgtaccggctttcatcatactttatgtcaagggtggtagctgaccttcccatggaacttagtcttcccaccatatttattctcataacctattggatggcagggttgaaaggcaaactgctcaacttcttatacacattgctcaccctcttactccacgtcttagtctcacaaggccttggcctcgccctcggcgccactgtgatggaccaaaaagctgcaaccacacttgcctcagtgctcatgctgtgtttcttgcttgctggtggtttttatgttcagcatgttccagtgtttatttcatgggtgaagtacatttccatcaactactacaactaccagctctttatcgcgtctcaatatagcgatggcgagacatacccttgttctactggccagtgtcgagttgccgaatttccttctataaagcaaacagggtttcatttcaatctgcaagagcaagtcatggctgcatcagctcttgtgataatgatgataggttacagacttatagcctatgttgctctcatgaggattggagtgacaaagaaatag

SEQ ID NO: 41747 - DNA, 354 bp, Glycine max
  Peptide Sequence Number=SeqID_158525
atgagtatgcctaacttcaactgccaaaagagcatgaacataattaataacttcaacggccttaaccaagaattcctaactataatgcctaactttagagttcataatgccacactatcttcagagttcataatgcctaacaaaaaatgcctaacttcaagtaccaaacgaagaatgcctaactataatgtcattcgatctacacttattcaagctaacttcaaagttcataatgtcattctacattacgataatgtacctaaaggtgtgagacacaatgatgcaagacagaggaaagcacacggtagagatcatcaagtcatgaatcgaacactacgtatcgcaaagggttaa

SEQ ID NO: 41748 - DNA, 282 bp, Glycine max
  Peptide Sequence Number=SeqID_158526
atgtatgtctgggccattcgcaggtttgtggggagtgtttctaaggccaatgatgttccaacatgctgcagagatgggagtggtgattggatgcaccatctacgggctcataagagaaagaccttcttggattctctcaaactattattttccatcatagggcattctagtctcatggaaaaaagagtggaatcggctttgaaatttgatcttgaatttctaggaacaaaagcctcattgacatcaaatttgattagaataactaggagtaatttcgcttag

SEQ ID NO: 41749 - DNA, 3570 bp, Glycine max
  Peptide Sequence Number=SeqID_158527
atggatccatactctcgtcttgatcatgccctctttcagctcactccaaccagaaccaggtgtgaccttgttgttgttggtggaggtgtgagtgaaagacttgcttctgggctgttagaaccgtttctttctcacctcaagagtgccaaggatcagatttctaaaggtggctattccatcactctgcgtccacctggtgaacatgctcactggttcaccaaagccaccctccaaaggtttgttagatttataagcactccagaagttctagagaggtttgtgacaatagaaaaggagattgtgcagattgaaggatcgattcaatcaagtgagaggaacaatttgttggcagaagcagaaggaagcatttcatctactgatgggcgtgtcaaaaggtcaacaacttcctctaagatgaaagatgaatcagctggaatcaatgaagatggacatgaagaaaactccagggttcgccttcaacgtgttctagataatcgtaaagctatgctttgcaaagaacaagcaatggcctatgcccgtgctttagtagcaggatattacccagaatctgtggatgatcttatatgttttgctgatgcatttggagcttcacgtttgagggaagcatgcattaatttcttagagctgtgcaaacaaaagaatgaagacaagctatggatagatgagatagcagccatgcaggcggctgctcagcctgaactgccatacttgaggacatctggaatcatacttgctggagaagatgatacaagcagtaaattaaatggcatagttgatgcctcaatttctgagtcaacaccaagtcatgcaagtttggacataggccatgattatagcttgccaacatcgggtcaaacaccatcaacagatggaagagctcaaataccaatgtcctggccaaaccatcttccacagtacatgcacaactttcagggtcaccacccatttcaacaaatgtccccataccaagggtacctttatcctggtatgcaggttccttcttcatattatccggggaatatgcaatggccttcaaatatggaagaccctcatattgttcatgaccgagacaaggattatcataaatcatcgtataagaagaagaaaaagaaacattctcaaacactgcagcaatctgaagaagatagctctacagcatcctctgactctagttatgagagtgattcagataaccattcaaggaaaggtaaaaagcactcttcaacagaacatcaccacaaaaagaagcatggaaagaagtcctcaaggaaagtggttatacgcaatataaactacataacttctaacggagatggcgaaaagggtagtgtcactgagggaagtttgtccaatgaggaagaatttatcaatggagattccctgaaacagcaggtagaggaagttgtaggatcatttgaaagaagaaacaagtcaagctcccgtcaccgtaagaaacagcatattgcaaagcactctggcaagctaaatggttcaaatgatgctgattccaatggcatgaaaggcaataacaactgggatgctttccagaatcttcttttgagagatgatgattctactcctgatactgaagaacagcctatgaagttccaggaggaatatattggcagtcagaattttgagaatggaaggtcaaatgaatttaaccacgaaccagactttagtaaaactcgagcagtttcaaatgattcctttgttgtgactgagaggggattcgatggtgaggttcaaaaccgtgttgataactttaaggatggaaaggatgctccttcattaatgaagaaaaacattaacacagatgaggcgatgttgttttctcagagaaatgacaaatcaggtagctattctatgtcaaatctgtcgggcaatggcccagaatcttccctcactaaatgccagacagaagaggattggttcattatcaaccagtctggtaaaccaggaaatgtggatcaaaaccgagatttcagcatgtttgatggcatttccgtttcatcatcagctactgattcgtttcatgtagagaaaaacagaaaagacattgtgactgatgactctttcatgattcaagctcgatcatcagaagatcaattcaattctcagtcagcagctgatcttagtttggtttcagacattgttggggctactgaattcatgaatagcacacaagaaggttcacacaataagaatgaaaccttaaattcccatgagcctgatgatctcttcatggttcttgaccgtgattctactttagagcaaagtctggcaccctggagcatggaaatggattatgataataacatttcttcaaatgaagctaatagaaagctatctgaagttgaaacagataaaaatcattcatctaatcttgagggtaccgatacaaaaactcctggagtgaaaaatgggaaagtttccagtaaagaggcaaagcctaaggctctaaatgcatctcttgggaaaagcaaatctaatatcacgtcaagaagcaaagcatcccctggaagcaaaactagagttactaagagcaaatctgagaaggaagaggaaaatagaaagaaaaaggaggaattgatgattcagcggcagaaaagaattgctgaaagaagtgcctctaagaagactggaactggaactaagacttccttgacttctgcaaagaaagagaatcctaagatacatccatccaatgaggagaccaagaaattgcaaaaaccagtcatcaggaattccaccattgaacgtcttgcaactgcccgagtaagtcagtcgaaggtttcaccaagtccagcaaaatcaggtccaaccaagaaaccaaccttgaaggcaaatggtgtacctttgcagaagactacaagcacagaaaagaaacaggacccaaaagaagtcaaatcttcaagtcttaaagaagacgcgaagaaaacaaatggggaggttctaggagccactaatggccaggctaagaatgaaatagaaatctcagtagcattgccaaggaactctggcgccacacagtctgttgaaacaaataacagtaatcttggtttgaaagacaatggagagctatccaagacgtcatcagagaaagatgcgacatctttgatttcagaaagagagcatgtgcacgcaaatgttggccagcttcatgccgatccatctttgccgaatcacaatcttgcgttgggaggaaatcagcccagaggtgaagaagtgtcaaacaagttatcttcacttcctggtgatagcaaacctcaacatattactgatgtgatcacaaatcctacagctgcattacctagcaaacccctcacagtttctgctgtgaactcaaatgttaatcaagaaatacacgagaataatgctatcttgcctcaagtcactgagaaacaaatttctactacccctccacccaataaccaagtgatgatgccagaatcagtccactccaggaagaaatggaacactgatgaggacaattcaaaaccagcaaaaggatttcgtaagcttctattctttggaagaaagagctga

SEQ ID NO: 41750 - DNA, 339 bp, Glycine max
  Peptide Sequence Number=SeqID_158528
atgtctaacccctcaaaatctcataatgttgatggtaaaaaagatgttaagtttgatggaatagtgatgtttattaagtgttacatgttacatgcgtccaatatgaaaattgggattgtatttcttaccttagatgcaaatattattttagctaaatgtcacaacctaccctttagcaggagggtgaggcaagactcaaaggagtgtcatccaaaaaggacaacgcgtgggagttgccaccaatgtttatttgaggaaaacattagaaaaaccaaaaagaggtctgcgtattttgaaaataagggtccaagagttgtttacgcatggggaagatattag

SEQ ID NO: 41751 - DNA, 228 bp, Glycine max
  Peptide Sequence Number=SeqID_158529
atgagattactgatcaaagaagaaggagatgaagatgcacaatacaagaaagaggaccccaaagggcgagctggttatttcacccctaagtcttttgggggcccaagcgagctagaggctaggcagggcgagccaggtagagacaaggacactaattttgttcgagcgatcttgctattcgactgggcaactggcgaaaaccagggaagtgaaaccgagaaaatatga

SEQ ID NO: 41752 - DNA, 576 bp, Glycine max
  Peptide Sequence Number=SeqID_158530
atgacagatcttgaactttttctcacttgggtgaagaagttcggcattgatgtcatagtcaaggttctttttcaaaaacaatcaccaagtgcttgtgaaaatgtaatggctagtgttgtgacggacaatgaaaagaattataattactgtgtctataactctgatatagcaactggctatggtgttggagcatttttgtttctcttggttagtcaagtcctgataatggtggcaagtcgatgcttctgttgcgggaagcctcttaaccctggaggctcaagggcctgtgcagttgttcttttcataatctgctgggtgtttttcatcatagctgaggtgtgcttgttggctggatcagtggaaaatgcctatcacaccaagtacaggaccatcttcggggagaatcctccgtcttgcgaaacagttaggaagggagtctttgctgccggtgctgcttttgttttcttcactgccataatctctgaattctactatatcaactactcaagggcaagggaaagcttccaaccttatgctggcggcgagactggtgtcggtatgggaacctacaaatga

SEQ ID NO: 41753 - DNA, 351 bp, Glycine max
  Peptide Sequence Number=SeqID_158531
cccatgggcccgaaatctatcctaaggctcataagaaccctacggccttctcttgcatctctggcccaatctacttggagttttctatccaatgcccttgcggggtaggattgcatcatatgactcctgttgaggctaggaatttgattgagaagatggcttccaactcccaacaattcagtgcaagaaatgatgctattgtccttagaggattccatggtgtggccatggattcatcttcatctgctgaaaataaaaagcttgagggaaaacttgattccttggtcaacctagtaactcagcttgccaggaatcagaaatctgcatctgcacctattgcaagagtctgcg

SEQ ID NO: 41754 - DNA, 1347 bp, Glycine max
  Peptide Sequence Number=SeqID_158532
atgagcaaagccctgggaggaacaacagaagacgaagacgaagaagaacaacaactactagaacaagaccaagattgtttctacgactcacacgaccgtttactctctctctcttcttcatgctcctgctccaactccaactccgacaacgaaaacgacgccgaagaacaccaaaacgacaccctccccaatttcaccaacttttacgacatatggatctcccaaccctcctccgtttcagaacgccgcacgcgccttttactttctcttggactctcttccctcacgcgcccaatccctcgcgatcgcgcgtccccgctccgtttcatatccgacaccaccaccacaaaccctaacaagccaccaaatcctaaaccccccccaccgcctccgccgccgccaccaccaccaccaccaccaccatcaccaccaatagaagagctctgcacgattcgagatctcgataacgggaaagagttcgtcgtgaacgaattggagaatctgcgcgaggttgctacggggcggcaattgacgatggaagaattcgaaatgacggtggggcattcccccatcgttcaggaactgatgcggcggcagaatgttgaagaggcgaacgttgattccaatgcgggtggttccaaagcgaagaagaaggggaccgggtggttgaagagtatcaagagtgtagcgagttcggtggcggggtatagggatcgccggagtagcgacgagagggacacgtcgtcggagaagggcgggaggcggtcgagctccgccaccgacgacagccaggagggcagtggtggcgcgtttcacgggtcggagagggtgagagtgaagcaatatgggaagagttgtaaggaggtgactgctttgtataagagtcaggagattcgggggcatagtgggagcatttggagcattaagtttagtttggatgggaagtatttggcgagtgccggggaggattgtgtgattcatgtgtggcaggtggtggagggggagaggaagggggagttgttgttgttggatagggagaagggtgaagatgggaatgtgaatatgtttttggtggtgaatgggtcgccggagccaatggcgggggcggcggggttgctgtcgccgctgggggatggggagaggaaaaggaaggggaggtcgagtgtgagtaggaagtccttgagcttggaccagtttgtggtgccacagaccgtgtttgcgcttactgacaaaccagtttgctccttcctgggacatctccatgatgtgcttgacctctcatggtctaaaactcaggttattttctgcactcttattttggacttgcctgatttttcgcttaactga

SEQ ID NO: 41755 - DNA, 957 bp, Glycine max
  Peptide Sequence Number=SeqID_158533
atggacaaaactgtgcggctgtggcatctatccagcaagtcttgtttgaaaatattttcacacagtgactatgtaacttgcatccagtttaatcctgttgatgatagatacttcattagtggatctctggatgctaaggttcgcatatggagcattcctgatcgacaagttgttgattggaccgatctacatgagatggtcactgctgcttgttatacacctgatggtcagggtgcactggttggttcatacaagggtagctgccatttatataatacatctgaaaataagttgcaacagaaaagtaagatcaatctgcagaacaagaaaaagaaatcacatcacaagaaaattactggtttccagtttgccccaggaagttcatcagaagtacttatcacatctgctgactcacgaattcgggtggttgatggggttgatctagttcataagtttaaaggctttcggaatgccactagcccaatttcagcatccctcacggcaaatggtaaatatgttgtcgcggctagtgaggactcccatgtatacatctggaaaaacgaagctgattgcaggcctaacagaactaaaggtgtcactgtcacacgatcatatgaacattttcactgtaaagatgtgtcagtggccattccctggcctggtgtgggtgatgcatgggacatgcatgatacgctatccggagaacaacccgagcttgataaccatgctgatgaagtcgcatcagccaaccatcctcctacccctgtagaggagaactttgttactgagggttcaagatctgcatcaggttacagcaacagtccacgccatgcaaccattgcaagtgcaacaaatacttacttttttgatagaatttctgcaacatggccagaggaaaaacttcttctggctactagaaaccaaagccctcgtgtcagcatggatttctctaacggg

SEQ ID NO: 41756 - DNA, 524 bp, Glycine max
  Peptide Sequence Number=SeqID_158534
atgggggcctaccaagtaaccaaggacgggaatgatcataatttgtgctcagagattgttaaggcttgtgattctgcttcaattgattcccgcaaagtgacatttatctgtgggcgtgctggtgtttgtgctcttggtgctgtcatagctaggcatagtgaacagattgggatacctcatgatttgccctatgagctattgtatggcagagcagttgcggatgaagttactatggctggcagacaattaggtcgcaaaggaagatgtcctctgatgtatgaatggcatgggaagaaatactggggtgctgctcatggacttgcaggaattatgcatgttttgaaggacatggaactcaagccagatgaggtggaggatgtcaagggtatgctacgatacgtgattaacaatcgtttcccttggggcaattatccctccagtgaaggaagtgaaaatgaccgtcttgtgcattgttgtcatggtgctcctggactcactcttacccttgttaaggcaactgaaaa

SEQ ID NO: 41757 - DNA, 717 bp, Glycine max
  Peptide Sequence Number=SeqID_158535
atgaaaactccagtgctgacaaacttgtggctaagcgagtgctatctcgctaagcccaggaagagaaagagctcagcttccagacctcaagctcaatatgacactaggcgattccattctttggacgcttggaacagatacatggataacattctcggtcggaatatccttccggagagaaatgtgcagatttatcatactaagtttgacgagtttaaagtggagttggagaggcgtaatctacacaaacacctcaccaacctccaagaaggaagcattgatgtggcgatcgtcaaagaattctacgccaacttgtacaacttggaggatcaatcacccaagcaagccaaagtaagtggacatctcattaaaattgatgcagacagcttcaatgattttcttgagacactagtagtcctatatgagggggagtctctacccacttattccagattctgcaggttgaggactaaccatcaagagatagaggctagattatgtattccccgcaagggttttgtgctgaatgttgaaggtcaaccatggaagctccttaaaaaggacttgaccacattagctcaaacatggagtgtcctatcttactccatcctagctcccacatcccacacctcagatttaaacatggatagagctaggttggtttatggcttggtaacccacatggatatgaacattgtattctctatgtcaagctaa

SEQ ID NO: 41758 - DNA, 1692 bp, Glycine max
  Peptide Sequence Number=SeqID_158536
atgtccccctttgagcatggagaagtgtttgtgttggatgatggtggtgagtctgtcattgacaaagagaggagaggagactatttgggaaaaactgttcaggttgtccctcatatcactgatgctattcaagattggattgaaagagtggcccacatacctgtagatggaaagaccagtccagctgatgtatgtgtcatagaattgggtggaaccataggagatattgagtccatgccatttattcaggcattaggacaattctcatacagagtaggtgctggcaacttttgcttagttcatgtcagccttgttcctgttttgaatgttgttggtgaacagaaaacaaaaccaacccagcatagtgttcgtgcactgcgtggccaagggctgactccacatatcttagcatgccgcagcactatgggaatccagatcctagagtacacacaaggcacaagcatatactatgatgcacaaaaagaacagaagtgcataccagcattcacactgatcttaactgtaaacatttttaagtttctaacgttcagcttttttcaggcagaaaacattgttaccctttatgatgttcccaacatctggcacattcctttgcttttaagagatcagaaggcacatgaagcaatgtttaaagtgctgaaccttcatggtgtaactaaagagcctaatttagaggaatggacttgcagagctgaatctagtgatttgcttcatgaaccagtgggttcgtatagccttagtggggaaatatacgtgcctttcagattcctacctctccgttctaaaggtggagttaacttcaacttcatggctgccttactgcatgcttctgttgattgccaaaagaaacttgttgtggactggattccagctagcaaccttgaaagtgcaactgcaaaagagaatcctgatgcttttaaggcagcatggaagttattaaagggtgcagatggtgttcttgttcctggagggtttggagatagaggagtgcaaggaaaaattattgcagccaaatatgcccgtgaaaacaggattccattccttggcatttgtcttggaatgcagattgctgtcatagagtttgcacgatctgttcttggtgtacaagatgctaacagcactgaatttgagccccataccaaaagtccatacatcatatttatgcctgagggatcaaaaacacatatgggaggcaccatgcgccttggatctaggaggacatatttccagaccaaggaatgcaaatctgcaaaattatatggctgcaaaagcttcattgatgagagacatcggcatagatatgaggtgaatccggatttagtggcacgccttgaaaatgctggtctttcttttactggaaaggatgaaacaggtcaacgcatggagattgttgaactacctaaccatccttattttatcggtgctcaattccatcctgaatttaaatcaagaccaggaaaaccttctcctttgttcttaggattcattggagcagcatgtggacaattggatgctgtcttacagcgctcttcaattgttgataatggtctctcaaaaggagtcattaatgatatctctgcagtcaaaacataccgaacaagaaccgctacaaggacaacttataggtctgctgaatatgtatatgggagttgcaatggattgcatttctaa

SEQ ID NO: 41759 - DNA, 585 bp, Glycine max
  Peptide Sequence Number=SeqID_158537
atgtcctggaaagaagttgggtatgatggatggaggcttgactttgtgagaggattttggggtggttatgtaaaggactacatagatgcaagtgaaccttatttttccgtgggagagtactgggattccctcagttatacatatagtgaaatggatcataatcaagatgctcataggcagaggataattgattggatcaatgccactaatggtacctctggtgcatttgatgtcacaacaaaaggaattcttcaccctgcattggaaagatgtgaatattggcgattgtcagatgagaagggaaagcccccaggcgttcttggctggtggccatctcgagctgttacgtttatagagaatcatgacactggttccacccagggtcattggagatttcccagtggaaaacaaatgcaaggatatgcctacattcttactcacccaggaactccatcagtgttttacgaccacatttcctctcacgataaaagtgaaatagcaagtctaatatctctcaggaagaggaacaagatccactgcaggagtagagttaagagagtgaaaccaaatactcaaaaatcataa

SEQ ID NO: 41760 - DNA, 705 bp, Glycine max
  Peptide Sequence Number=SeqID_158538
atggaatcgtactttgttatttccgttagtttcggtttgcttcctcttcttcttcctctgcgcttcacatcctcagacctcaaccatcagcaccaccataccaacaacatcatcgcggcgccatcaccaccgtaccaacaacatcatcgcgcgatccaagcaacactcacaccaacagatctatgcgccacaacaccaccgcgcaacggagaagtcgcgcgcgcgcaggaagcctcaaagattgattcgcgcacacagatggagaatttggtagctgaggcttgggcatttaacagaatggaatctgaaactgttaatgaacacattgatgatgatttaaatgaaacaatgccacttataccagaagagactgacaatgaggataataataataatgatagagcaaattttctacggtgtcagtttttaattgtgatattggagaatatgaggagacaattggcacatgcattgcttttacagaacaagttgtttgataaagcacccctttgtgcagaagccgctgtggttcatgaagagactggaccatctgaagtgaacattttctccggaacaagactaattgattcaagtcaagctccaacaacgcaagtgaaacctgtgtgtcagcttcacaaggttctcaagtttaaactatcacctgattctgaaattcagaacgtcacagctaaggaggccaaatga

SEQ ID NO: 41761 - DNA, 282 bp, Glycine max
  Peptide Sequence Number=SeqID_158539
atgggacatgaaaatggacttcaagtggttagggggaagtgtttggggcttggaaatcaggttagaatagcgctggagaagtgcggagagctagggctcaaaatgggtagtgtcgcaacctacccttttgcaggcgagcgaggcgaggctcatgggtgcatcttccaaaggaggaaaatgcgcggagtcgccaccaacgtttatttgaggaaaacgtcgaaaaaatcgaaggaaatcggtcatgaagaatattctagattcgggagttgtatttacgtttga

SEQ ID NO: 41762 - DNA, 837 bp, Glycine max
  Peptide Sequence Number=SeqID_158540
atgggacaaatgtttagtatgtgtggttttgtgcaagtggagcagtcaagtgttgtcatcaaggaagtatttgggaagtacgatgatgttcttgatcctggttgccactgtgtgccgtggtatttcggcaatcgtgtggctggtgcactttctttgcgtatacaacagctagatgttcgttgtgaaaccaagacaaaggacaatgtgtttgttactgtggttgcctcaatccaatatcgagcattggcagaaaaggcatcagatgcttactacaaactcaccaataccaaagcacagatacaatcctatgtctttgatgttatcagagcaagtgttccaaagatggaactagatgctacatttgagcagaagaacgacatcgcaaaaacagtggaggaagaacttgaaaaggccatgtcagcttatgggtacgagatagttcagactcttattgtggatattgagccagatgagcgtgtgaagagagccatgaatgagatcaacgctgccgaagcagagaagatattacagataaagcgagcagaaggggatgcagaatcaaagtacctagcaggtcttggagtcgctcgtcagcgccaagccatagttgatggcttgagggacagtgttattgctttctccgagaatgttcccgggacaacatcaaaggatatcttggacatggttctcatgactcaatattttgacacaatgaaggacattggtgcatcctcaaaatccaatgctgttttcattccacatggaccgggttctgtacatgatgttgcttcacaaattagggatggtcttctacaaggaaatgcaacaaagtcttga

SEQ ID NO: 41763 - DNA, 516 bp, Glycine max
  Peptide Sequence Number=SeqID_158541
atgggacaagtgtacggttgctttcaagtgaagcattcaagtgtagccattaaggaggttttcgggaagtacgatgatgttcttgaaccaggttgccactttgttgcatggtgttttgggcggcgtgtggctggtgcactttctttacgtgtgaaactaagactaaggacaatgtgtttgttagtgtggttgcctcaatccaatatcgagcattggcagaaaaggcagcagatgtttactacaaactcaccaataccaaagcacagatacaacccttatgtctttgatgcttatggttacgagatagttcagactcttattgtggatattgagccagatgagggtgtcaagaaagccatgaatgagattaatgctgcttcaagattgaggatggctgccaacgagaaagccgaagtaaagaagatattgcagataaagcgagcagaaaagattggaaatgaaattgaaagaccggaggatgatggtgagtttggtaaagcattgaataagggctga

SEQ ID NO: 41764 - DNA, 192 bp, Glycine max
  Peptide Sequence Number=SeqID_158542
atgaatctcggggaaggagagatggacttctcaactatgatgcacaaggagctgaaaggcattgttcgaatagagataggagcgaaaggcacaaaaatcccgattgaaatttacatcaagcattatattggaggtcttaacatattagtgaatgatttgtctcttgcattgatggaaattgattttgattaa

SEQ ID NO: 41765 - DNA, 1215 bp, Glycine max
  Peptide Sequence Number=SeqID_158543
atgtttgcaactaccaattcctccactttgtcacctttattctctttcagtagaacaacagcaacctctctgccttccaaacccacattctggaatttggttccaatgaaacaatcttcttctccggggcacttggccttagccttagacaatccacgtagaacacttcacgtgtcttgtggctccacatcaccacatgcttcccagagatcatcaattcaggggggtgaagcttttttcaggggtgtgttggaaagtatgcaatctgtttacttgaacagaaatcgtactgctaaggccatattggaccttgttcactctgctgagaataactcattatgctatgatcatcttgcattcaggacatttggggtgaatggttatggaattgattccatggctagtttttttctggattatggctatacacaaagggaagagttgaggtttccagccaaaaagttgagggctttgtggttttctcctcctgctgattcactggctagcaatggcagtggcattaatgggcctttgccaagaatatttatatcagagctactggtagatcaaatgagtccacaaactcaggaaataattaaaaaatacaccgaatcatctgtggatggaaacaagtatgcagcacttgcaagttcccttggacatttaacatgggaaaagcccttatattctgagtttcaacaattggcaagtgaaagtgagtatgctgcctggaccctagtcaacgggtatgcactaaaccatgttactatatccactcatcggctgaaaactcatttgaaggagataaaaaaactaaatcagtttattaaggatagtggattcagattgaattctgaaggaggagtgctgaaagtgagccctgatggtcttctccagcaaagctcaactgtagcagattcaatttctttcaaattttctgatggtataactgaatcagttccatgctcatacattgaatttgctgagcgactggtgctgccgcagtataaaaatttacctgacacagaggttaaagagttccatagaagagatggttttgaggtagcaagtgctgacaagatatttgaaagcacatccaaggagcagttgagcagacacaatatagagtctcagattttacatgcaagttcgagattctcccttgtcttcttgcagaaatctggtctggccagagatgaggaagtttctatgtaa

SEQ ID NO: 41766 - DNA, 522 bp, Glycine max
  Peptide Sequence Number=SeqID_158544
atgcctaccgctgaaacagtgaagctgacgcgaggttcggcttggcttttgctacgccgaccaagggcagccacgtcagcatcacggcgggtcccactttttcgggcagctcaaactccttcccgtcttcttcgggcagctagccacaaaatacaaatccccttttttcttctgagaggaccccatatctgttatgtagcggagattactcagttcagctcagtttcaatttctggggtttgtgggttacccggtttcaagggttgttggcatatggggttgggtgctgagaatggcaaggtggtggagtcttgggatgtgtgtaaatcaaaggggaggaagaagaagaagggggatgaagggggtgaggctgaggctgggtgttgggttaggttgaggttcattgggagctgcatttcttcaagatccaaggttgatacctcagtcagtggcagtggcaccagtactcattatggtaaattcatcactatttccttgcaagacttgctgttgttcttgtga

SEQ ID NO: 41767 - DNA, 273 bp, Glycine max
  Peptide Sequence Number=SeqID_158545
atggctgctccaccggcaagggctcgtgccgattacgattatctcataaagcttctcttgatcggtgacagcggtgttggaaaaagttgcctcctcctgcgtttctccgatgggtctttcaccactagtttcatcacaactataggtatcattgtatgtgacacatggaaacttgttgctttaccagttggcatctggtttgtggcacttcctgatgtaggattaaaagatagtgaaaaaaacaagggagaaatagtactgagaaaaatataa

SEQ ID NO: 41768 - DNA, 222 bp, Glycine max
  Peptide Sequence Number=SeqID_158546
atggtgcctaacaacacctgcaacaagagaaaaaaccctctcaacactgttcacaaacataattcaacctcaacatctaaacaacgaaggaaaatgcaaacacagcaagaattttcaacaaaaaagaaatcacagaaactgaaaaagaatgaaattcaagaaatgccgctattcgagctcggaaattgggaacaagcgattgatcaccttggcaaatggtaa

SEQ ID NO: 41769 - DNA, 1443 bp, Glycine max
  Peptide Sequence Number=SeqID_158547
atggctaaggaacttggactttttgtgcagggtctgattgtactcaccatccaagctcgtgatccttcattgaagccaccaaagtgtgacttagacaccccatgtcaagaagttaatggtagcaaagcagcaatgttgttcattggcctctatctggtggctctgggggttggaggaatcaaagggtcactgccagcacatggtggtgagcaatttgatgaaaccaccccatctgggaggaagcagagatcaaccttcttcaactacttcgtcttctgcctatcatgcggtgcccttattgcagttacttttgtggtgtggattgaagacaacaaagggtggcaatggggttttgcaatatctactattagcatatttgtgtctatcccagtattcttggccggttcaccaacctacaagaacaagatcccttcaggaagcccacttacaaccattttaaaggttcttattgctgctttactgaatagctgcacctacaaaaacactagcagtgcagttgtgaatatgacttcaagcccttctaatccacactcaggtagaacagaatcacaacaagaaactgttaaagcaagcacaacaactgaaaccccaacaagcaacctcaagtttctcaacaaagcagttacaaacaagccaaggtattcatcactagaatgcactgtacaacaagtagaagatgtcaaggtagtattgaaaatgctacccatatttgcttgcaccatcatcctcaactgttgcctagctcaattgtccacattctctgttgaacaagcagccacaatggacaccaagcttggttccctaaaggttccaccgtcttcgctaccggttttcccggtggtattcatcatgatcctagcaccaatctatgaccacatcatcatcccctacacaaggaaagcaaccaagtcagaaatgggaatcacacacctccaaaggattggttttggattggtactctccatagttgccatggcagtggctgctattgttgaaatcaaaaggaaaagagtggcaactcagtcagggctacttgatgatccaaccaaaccacttcctatcacattcttgtggattgcttttcagtacttgttccttggatctgctgatcttttcaccttggcaggattgttggaatttttcttcacagaggcaccaataagaatgagatcattggctacttctctttcttgggcttctttggcaatggggtactacctaagttcagtgattgtgtctatagtaaacagtgtcactggaaatggcacccacaataaaccatggctatccggtgccaactttaaccactatcacctagagaagttctattggctcatgtgtgtgctaagtgggttgaacttcctacactacttgtattgggccactaagtacaaatatagaggaacaggtactactaattaa

SEQ ID NO: 41770 - DNA, 2296 bp, Glycine max
  Peptide Sequence Number=SeqID_158548
atgaattttttgctgcggtccacgacgggcgtgtacagagagccttctccgtcgattccggttccggagccgcgtgttgatacgcatcataggtctgcatctgctggatcttctttggagaatcgtgtgtctgatgatccgtatgcgtggtatgatgcaagggttgttagtggcgtgttccttaagcacgtggatgttgctgaggatgaaggatgggttaccattccatgcaaggaacttcctgaaaactggacttgtgcaccagatatacagtctctgtgctctcttgatcgctcctttcttttccctggtgaacgagttcatatcttggcatgcttttctgcatgtaagcaggatacatcttcattcaaagttgatgcagtgacaagtgacaatggcataggtcacagccccaagaaagaaaatggaaacattgaaaacagaaacaattcagtgtctggagaaggggaacctggtaccagtgatgaagagcagatggaagatgtttctgatgatgaatcccttcttcaaaaagaggttctcaaaaaacaaaccgcattattgttgcaaaagtttgaaaattctcacttctttgtgaggatttctgagtctgatgatcccctttggtccaaaagaagctcttcagaaattttttccaactcttctgatgcaaatactgaaaaggcctcaacaatcaaatctaaaggggacacattttctcctattagtactattattgatagagggaattttgattcaaatgtttctggtggagtggcaagaaattctgtgaagtgttgtgctttacctaatggagacttagtgggtttggattttaaagttccactgtcagacgaagtagtttgggcacatgtggagaagacctatagaagaatccctagtaaggagagtaaatcagataaaggtaaccctggcactatagctagaggaagactgagaaaagttgtaggtgaaaccattttgaaggatttagaggtgaatgttggtgttaattttcttagagatccttgtatagaaattcttcaatttgaaaagcgtcaggagagaatgtcatctcctgacagcaaggtggatgcagcaaatcaggattcatgtgcagagctgttaaattggatgcttccgttggataatgggaggccttctacttacccgccatttcctcctcatttaacttcaacttcaggaattggtagctcctctcagggatccaatttttctggatcatctagctctcagttattctcctttggcaattttagaagttactccatgtcatcattaccgcaaaccatgagcactccatctgctcctgtcaaagcagttagttctaagccaaattttgaccttaaggattgggatcaaatctcatctcagaaatatttttggaaaaagatggggtttgaaggacttctatctttccgaggtgtttcactggaacaagagagatttcataatgttgctcctatacatgctccagacattgtgatatttatagataccataactattgttcttgaggagtttacaaaaaatggatcactgtcgtcattgccgatttcatgtattgaagctggaaatgatcattctttaccaaatctagctctcagggatattatgatctcggttgtgtcagagatgtcaggacagtctcttgctgcttatggaaaaacttgccaacttcccatacagatattaactcttcaagcttcaaatttgacctctgaggatctaactttgactgtgcttgctccagcctcatttacttcacccctttcagtagtctccttgaattcaccaacgactccaatgagtccttttttaggtttctcagagttattagtaagagtaaatggtgaaagaggaattggtgccacccagcgacaaagtttcactcttggtgtaaaagataatgagaaacaaagttatgatggcaaagcccaggctgtttctacgagtgatgatgtcattcctggttctgatcttagttgtacacatctatggctgcagagtagaattccacttggatgtattccatctcaatccattgccactataaagcttgagctacttccattgactgatggcataattgttctggacactttgcaaattgatgtcaaggaaaaagtcagcggctacttgctatgtgctggcgagtggttggcacaggaatggtatgtggctttcacgtgttgggaagaagcatgtgtagtggtggtggtggaaggcaacgtgaatttggggacaagccaatctggagatgacaccccatccg

SEQ ID NO: 41771 - DNA, 157 bp, Glycine max
  Peptide Sequence Number=SeqID_158549
atgaatgtgaaaagaaggattaaagtcaatttcaatgttaatggtgtggaactagaagctccacaagttagcacatgggaagggtatgtggattggaggaacaagcctgctcttagaggtcgccatggaggcatgcttgcagcctcctttgttctgg

SEQ ID NO: 41772 - DNA, 153 bp, Glycine max
  Peptide Sequence Number=SeqID_158550
atggaaaccctaactttgtcaggcaagatactgcgaatcgctacagactttgcagacattgacaaaaacttgtcttctcttttgttgacattgtgtgacatgctaggggcagatacactcgtcgaccttgtgatatcgaatgcaactgctctc

SEQ ID NO: 41773 - DNA, 690 bp, Glycine max
  Peptide Sequence Number=SeqID_158551
atgggacaagaaggggtgaaaagtttcacgccgcgctccaccctgcgcgatccggccagtttcagctgtaaggcgccggtcggcagcgagcccggcccgatgaaaaccgcggtgatcggcccggataatcaactgtacctgactgatggccaccatacgttcagcaactttgctgacatagccggcctgtcaacgccggtgcaggtgcgcattaccgatgatttccgcccgctgaaaagccaggctgctttctggcagaaaatggcggcggcacatctggtgtggctggagacgccaaacggtaagatcgcccccgaagcactgccgcaggagctgggtcgccagcatatgcaggatgatgagtatcgttcgctgatctactttgtgcgcgatatcggcttcgataagccagacaacccgccgccgttccttgaattcttctggggacagtggctgagccgggaactgccgctgaaagcgttcaacctgcgcgaccgcgacggctacgccgcagcggtgaaaaaggtggcggagaagatggtgagcgtgccgaaggatacggtgattgcgcagagtgatagcggtccgctgacggcgcaggcgctcggtgccagagacgcggtgaaccagaaggcgctgaacaagttaagcgctgataacggtaagctgagctgggcgtttaaacattaa

SEQ ID NO: 41774 - DNA, 279 bp, Glycine max
  Peptide Sequence Number=SeqID_158552
atggcaggagggcgctgccggagcgcgccagccagcgttcgcggacgcggcagagtcgctgctgcagctggcgcgccaggctgcgccacagttgccggtggtgatcaacggatcgctgtcagatgccgaacgcgccggcatggcgttgtatcagggcgcagattatgtggcgctgggcaaaagcgcgctggccaatccggactggccacagcgcgttcgccacggccagccactgcgcgccttcgatcaaaacctgctggcaccgtccgcggatgttaa

SEQ ID NO: 41775 - DNA, 201 bp, Glycine max
  Peptide Sequence Number=SeqID_158553
atgaggagaggagctaagagaaagatgaagcagggtcaagaagccaaacacgatgcacccgaagataacaagcccaaagctcagcctcgagctaaacgagccaagacctccaagcctcaatccgaacctgagtactttgaagacaagcacaacttgtgcacgctataccttcctctcttctggtttggagctcttacatag

SEQ ID NO: 41776 - DNA, 462 bp, Glycine max
  Peptide Sequence Number=SeqID_158554
atggtcttcctcgcgattttgggcttccgtttcagtggaagtcatcgtcacttgctttttgaacaaagggaggtgtggaaggtttgtgactttgtgcgcgtgagcatcacgataatcgtaaggagatggaacgccaatacttttgcaggaccccataaaagcactgagcagagggtgattgacgcatcctcaaaaaagttgaatgatgttgaggatgacgacgttgttgtaattgatggagtggaggctcgggttgaagctgtggcggagggtgaagttaaagcagtggtggagggtgaaattatggctgaggggcaagttgatcaacaggctttggttgaggttcaggtggaggttgaggttcaagttggtgaacaaggtttggtgaaggttcaggtggagcctgtaggggagactaatgttcaagctcagatggaggctgaagttcatgttcatgaatag

SEQ ID NO: 41777 - DNA, 363 bp, Glycine max
  Peptide Sequence Number=SeqID_158555
atgaaaaatggaagtctgaaggaaggaacacttaactgggaaatgttgcaattcaagccaaaatttccacgtcaagtattgctttgcagagttggggaattttatgaagcttggggaataaatgtatgtattcttgttgaatatgagggtttaaatccttttggcgtgcctgccatcttaccagtctatgagtacatgctgctaataaattttggtctcaacactgcattgtggaggaggcaggctcagggcccaactcaagctcgatccaggaaatgtctctttatatctggattaaaagaaggaaggggcatatggacagaggttaaggtatcatccataacagatagagagcaaccttga

SEQ ID NO: 41778 - DNA, 711 bp, Glycine max
  Peptide Sequence Number=SeqID_158556
atgaccgctcggctccccggcccgatatcaaaaaaatatcggcgacagaagatcatttccggctacgcgttggcgattaccgcatcgtctatacgcttcgggacgaacccgataactattgttatgttttggccgttaagcgcagaatatcaacaagttacctgcacgaggagaaagccacctatggctgttcagctaattaaggacgataacggaaaaacgcagtacgtggttattccctatgatgaatattttcgtatgtgcctgcagatggcggaaatcgacgacgaaaccgacgacgatctggaggatattgaagtcgaacacgatgagctggatgacgttgaacttccaggtgaggtttgcagcatcatgacctggcagaacgtcagcctgcaggccgcctggcgcatcctgcgcggcatgtcccagcaggaggtggcagagaaactcggcatcacccagtctgccgtatcacagctggaagcgctggactcccgtccgcaaaagcgcacccgtgaaaagctggcggcgatctacggctggttaacagcacttcgccccgcccttgccgccgtaacgggcgtcctgacgatcgcggaaaaattcgtcgtaggtcattggcgtctggtccggatggttgacccgcatatgctcgacatagttgtcgtagtccggcacgccaatcatcattttggcggcctggcccag

SEQ ID NO: 41779 - DNA, 749 bp, Glycine max
  Peptide Sequence Number=SeqID_158557
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgccctgtttctgttgtagcactttggcccatgcttccagattccacaccgtgtgcaggagctgtaaccgatggtgcacggatagcagaccgagaatatggagaagagggtctgagatctgatgaagaagaggatatgtatgctgatacggccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgctcaggaagatacttaacaggggaa

SEQ ID NO: 41780 - DNA, 362 bp, Glycine max
  Peptide Sequence Number=SeqID_158558
gcgtgaccaccatggatggctgggatgtgattgagccagcagaaccaggtggtaaaccaggcaaggtgaggttacgagactcgattgagttaacgccaggcaatgtacgtgtttacaatgagaatgaaattcactcgccacgacgcgatggcccggccaagttgatccgtattgaagggaatcccaaccagagtttaccaggccgtgtctggcaaccactggttggttcttccacagtcagcagtgatgatgcgattaagaatgccatcgagcgagcagcaaaaacgctcaatcacctaaactggtttgaggtcgtagaaacacgcggccatatcgcggatgggaaagtcgcccactttcag

SEQ ID NO: 41781 - DNA, 261 bp, Glycine max
  Peptide Sequence Number=SeqID_158559
atgaatgaagaacggacgaatggtgaagaacaagggaaaatcttcacatattggctcacggaaatgtctcggaagcgttacggaagcacctcggcttggattttcttcacggaaacacgcccttccggaacattttggaagttgggttgcttaaggaggaagcaactgggcgacaagctcctccacgtttttgaaaaatggtttccggggcttccgcggcttccggaatacttccgtaaaatttccgaaaactttgggtaa

SEQ ID NO: 41782 - DNA, 222 bp, Glycine max
  Peptide Sequence Number=SeqID_158560
atggccccaaggaagcttgcctcaaagagatccaggaaagacaaggcggagagacgtgtccagctcagggacgacgagtatactgacttccaggaagagatagttcgccagcagtgggcatcggtggttacccccatggccaagttcgacccagacgtagtccccgagttttatgccaatgcttggcctacagaggagggtgtgcgagatatgcgatcttgg

SEQ ID NO: 41783 - DNA, 258 bp, Glycine max
  Peptide Sequence Number=SeqID_158561
atggttgtggatgttgtaaattcaattggtattgaaaccagattgaacatcattggaataaataagcaccaaccaactcgttcaagaggcctacaaggttggttttttgcatacccattcatgggaaaggtcacaacctttgtagcccagcctgtgtctcaagaagcttccaattacgatgaggtttttttgcaattaagcttgctctttgatgatattctgaaagtacttatgatcttctacatgctatttagttag

SEQ ID NO: 41784 - DNA, 231 bp, Glycine max
  Peptide Sequence Number=SeqID_158562
atgtggaagagactcacacttgagggggagatgtgttggagtacaagtgtgacaacacaagatggttatattcttaacttggctagaattagaatgggagaatcaagggagccacaaattcttctatggcatggacatttcatggaaactttgattgcattggttgcccattcccaagatcaattacagaacatgttgacatcaattgtcttacttagtccaattgcttaa

SEQ ID NO: 41785 - DNA, 417 bp, Glycine max
  Peptide Sequence Number=SeqID_158563
atgccaggttaccatctggtcggttcatgtaatgggttgcactgtggggttagcgaaataccagaaggataccgtgtttgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttga

SEQ ID NO: 41786 - DNA, 171 bp, Glycine max
  Peptide Sequence Number=SeqID_158564
atgaaatcgtctcaggttgtcttgacttatggagcttatcccctgatggttgtgaggagtttgtgtgacttccaccttgttgaaggtcttgtcgaccagtctagtggtagtttgtttggacttgtggaacctggacctttaactgtggttgtcatggttcttaaggagtga

SEQ ID NO: 41787 - DNA, 492 bp, Glycine max
  Peptide Sequence Number=SeqID_158565
aagcagaggaaataagggaggacacagaggatgggatttttgtgcttttgtggaaacttaagataccacctaaggcagcggtatttacatggcagcttatcaaagacctcttaccaacgaagatgaatctaagagggagacaagtagagataagtgacccaatgtgcccgctatgcaacaattcggaggaggttgcagcacaccttttcttcaattgcagtaaggtcctccccttgtggtgggagtcactctcatgggttaattcagtgggtgctttcccgaaagaacagaaagatcatttcatgcagcatagcagaaggaatgctacacgaacaaaagatataagatggagctattggcagatagccctcacaaggaccatatggcaacatagaaataaggtggtctttgataaccaaacttttaatgcaagcaagctgatggatgaagcgcttcttctaggagggtacatgttgagacctcttccaagag

SEQ ID NO: 41788 - DNA, 245 bp, Glycine max
  Peptide Sequence Number=SeqID_158566
atggggaccgatgttaagagaaacgaggatatgggctacgtgggagtacgtgagctcagttggaggtgggcaacaggggatggtggggtgaaacttcctgcttttattgttgaccacagagtggtacctggagatatgtcgcgggggtcaggagaccttggggacatcaggcgagctcctggcagtcaacagataaaaggaaaacaagaccacaaagcaaggaggcttgtggtggctggccagct

SEQ ID NO: 41789 - DNA, 293 bp, Glycine max
  Peptide Sequence Number=SeqID_158567
tgaattgtctagtaccccttcttctcagtttcatattgtcagctctacttcttcttctaatcttgttcttccttcacataatgtccaccctatgcaaaccaaatctaaatctagaattcatcaacctaggatgcatcctttactatttttggcacaatttgaacctaagactattagacaggctattgatgaccctcaatggtttgctgctatgaaacaagagtatgaggctctttttaacgataaagcatgggatcttgttcctcttcccaaagacagaaaggttgtaggtt

SEQ ID NO: 41790 - DNA, 633 bp, Glycine max
  Peptide Sequence Number=SeqID_158568
atgatcgacagctccaagtgggacgtgatcgagaccggcctgaagtgcgtgcagggtaagccggtggtcaactcgatctccatgaaggaaggcctggagccgttccgccaccacgcccgcctgtgccgccgctacggcgcggcggtggtggtgatggcgttcgacgagcagggccaggccgacacgctggagcgccgcaaggaaatctgcggccgcgcctacgagatcctggtcgaggaagagggcttcccgccggaagacatcattttcgatcccaacgtgttcgcggtcgccaccggcatcgacgagcacaaccactatgccgtcgatttcatcgaaggcacgcgctggatccgcgagaacctgccgcacgcccgcatttcgggcggggtgtcgaacgtgagcttctcgttccgcggcaacgagccgatgcgcgaggccatccacaccgtgttcctgtattacgcggtcaaggaaggcatgacgatgggcatcgtcaacgccggccagttgggcgtgtacgccgacctggatcccaagctgcgcgacctggtcgaggacgtggtgctggatcgcgccgagccggtcggcaagaccgacccggccgacgaacgcacgccgaccgagcgcctg

SEQ ID NO: 41791 - DNA, 545 bp, Glycine max
  Peptide Sequence Number=SeqID_158569
atggactccacatcctcgcctttagatggatacatgtcctcgccttcagaggactgcacgtcattgcctttagaggactgcatgtcctcaccttcagagggatgcacgccctcaccttcaaaggactacacgtcctcgccttcagagggctacacgtcctctgtatcggagggatccacatttgcgccttcagaggacttaaggatcacgcccacaagacacccagtggacccagagaagtccaacagggccctggggtttccagctccgattatgggcctctgtcagtcctaccgggtgcccgtccccccagcaaggtcactccatcatgacataaggatcgcgcccacaagacacccagtggacccagagaagtccaacagggtcctggggtttctagctctgattacgggcctttttcagttctacagagtgcacgccgcccctatcaaggtcatcaggccctctattaaccgggctttcatcaagaagtattgcgccccccaggcaagcacaggcggagacaccacagcagcctggggatg

SEQ ID NO: 41792 - DNA, 186 bp, Glycine max
  Peptide Sequence Number=SeqID_158570
atggcaaaacatgtaattgcagctgaaattatctcagtattcactcatggccaattatatgttgcattgtcaagggtcaactcagcaaaaggattaaaaattctcatccatgatgatgagcagaaaagcatgaattccaccaccaatgtagtatacaaggaagtgttcagaaacattaaaacttaa

SEQ ID NO: 41793 - DNA, 522 bp, Glycine max
  Peptide Sequence Number=SeqID_158571
atggttctgagccatatgcaggcgatcgccgacccttatcagtggaagtgggtgattaccggctggcacagcatcctgcagaacgcgatggttttggcgttatgtcagggcaatgactttctggtctacctgttcgacggtaaagcgtcgactcgcgcgatctacgagcaaatttataacgacgatttttccaacatcgacaagctgcagctaccgtcctttatgacgctataccgtgcgacgagggagaacagctcgttcacacccagcgaagtctgtacggtggcggtgggcaagcttcaccagctgcgtaatgatttcatccactatcatccgcgaggttggagtctacaggtcgatggtttaccgcagtggattctggcgagcggtgaattactggatcatttccttgccagcggtgaggtcgtacgctggtatgacgaaaacgatgaaaaggcattcagagagaaatacgctgaatttcaagaccgactacacggcgtgatatcggtctattcctga

SEQ ID NO: 41794 - DNA, 291 bp, Glycine max
  Peptide Sequence Number=SeqID_158572
atgtcctcgaacaacagaaatgcaacattcgcgaaacctgagcctaaaagcaacaacagcggaagaagcgaaagaatgaaaacgcacgaagcaaaagaagcggttagagcaagggattgggagtgttgggaaagtgaaatgaggaaggaggagggagaagaatggagtgggaaaattagggttttggagaatgggtcccagtggttgggcggcatcataaagaggtcgtggctgcacactacttactccaactggaatggtgagggaagctatcgtcaatggggaggatga

SEQ ID NO: 41795 - DNA, 885 bp, Glycine max
  Peptide Sequence Number=SeqID_158573
atggcacgcaacccaaggcaggattttagcgtttctaagccttcttcttcttttctcccatccaccattgttgcccaacaaagcttcaacctttggtgctcatttctgctccaaatcgcgaaaggagggcattttcggggtcgtgaagtgcgtggctacaagtgggacttcgaaaatccaggggaagtgtggttttcgaaatctgcattttgtgcagatttttgctgtgaaattgtgcagcaggattttgcacaagtgcagaaaaatactaggcttttgctggttgtggaaagagcagtgcagaatgagttctggatgtttgctagtagatcccaacggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctatggtacctggagatatgtcgcgggggtcaggagaccttggggacgtcaggtggggcgagctcctggcagtcaacagataaaaggaaaacaagaccacaaagcaaggaggcttgtggtggctggccagctgcttgaaaacgaagtcaggaaacttagggagcctctggtaatcgattaccagcctatcgtgatggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggcgtggacagctccttggattagttttgtatacttttga

SEQ ID NO: 41796 - DNA, 390 bp, Glycine max
  Peptide Sequence Number=SeqID_158574
atggtggccttggttttaaaattgcacaagcttcctaaagaacacttttggaaaaatagtgatgaagacaactgggaagttatgatggatgatgatgatgtgataagagacaatatttctcaacttatagatgagaacaccactatgagttgtctctttaaagaggaaaaggtcttagaagtaaggaagtaccacgattccatcaacaagtacaagatgggcactcgcaatacagaagccttatgctttaggtgggtgatgaaggtgtcggttgagatgcgcatagaagactctagaagaaggatgagctatacaaaagcgttgagcgagtgtcaactcgctaagcgcactgcttgcatcctccaggttgagcgagaagactggcgctaa

SEQ ID NO: 41797 - DNA, 207 bp, Glycine max
  Peptide Sequence Number=SeqID_158575
atggctcaggctctttgtgagcttcagttggaattgcaaaatgggttgccttgtaccattgttgtgtcggggaattcaaaaggtgagagtgagggattcatccccaaaacaccagcttctaaagagactaggagaaacaaggtttcaaccaagggtaattggagcccgtttgattcgccaaaggatacttctttttccaagccttga

SEQ ID NO: 41798 - DNA, 237 bp, Glycine max
  Peptide Sequence Number=SeqID_158576
atgaagctagctaggtataccagctaccctctcttcttccatttcaaagatatctctgcatcagctaccctctcttcttccatttcaaagatatctctgcatcggtaccatattttggctgcttttcaacaaatatcagatagatatatacatcagtcagaggtattagctgcagatattagcagaatcataaatctcaaggaaaagcagttgaagcatatctatccttctgcaaag

SEQ ID NO: 41799 - DNA, 735 bp, Glycine max
  Peptide Sequence Number=SeqID_158577
atggcagctgagcagaattcagacttcgtggacttatggaagcttaaaattccagctaaagcacaggtgtttgcttggagatgtataagggacagacttccgacaaagatgaatctaacaaggcgacaagtggtggtcaatgacttgatgtgcccactatgtggagaggtagaggaggaggctgctcacttattctttaactgccgcaatatcctacccatatggtgggagtctttaccttggatgggcttatcaacagcagtaccccaaagtcgtaaggatcactacttgcagcatgtgcccgaatttgcagacggaaagaaacttataagttggaggtgttggtggattgcaatgacatggacaacttggaagcttagaaacagaatagtattccaaaatgccatttttgatggaagaaaattgatggaagatgtaatcttaactctttggacatggcttaaaaccatggacaaggactttgcaattcacttcaatcaatggtcttctaacctcaaggaagcttctttcactgtcaccagggataacactggtcaggttcttggcaggggtactaagatcactctctacctcaaggaagatcagcttgagtaccttgaggagcgccgcttgaaggatttgatcaagaagcattctgagttcattagtagttaccaacttgctggtctctctcctattacattacatttgagtaatagcaacccccaccaatga

SEQ ID NO: 41800 - DNA, 390 bp, Glycine max
  Peptide Sequence Number=SeqID_158578
atgagtctcatacaatgcaatacagaacagtcaaaaccagccatagaaaaagtctttgtgaggttagtgaagcatgtatgtaatcttattgggaaacaaaatttgaaaaaccaacgacatgcttaccttcacgaacactcaaaaggtctcaaaaaccaacgacttcgcctacgtcgcggtaccgatggtgtaagcagcgggtcacgacgagaaggacttcacggcgacaaccaaaacgtgaggctggaagcgggacggagttcacggcggaaggaagtagttcaggggctaggttcgagctcgagggttagtacgttcaggcaagcgagggcgctggtgcttacggcgagactatatataaactccaatatctacgacggtgcttcttaa

SEQ ID NO: 41801 - DNA, 147 bp, Glycine max
  Peptide Sequence Number=SeqID_158579
atgacgaaagtggcatgtgcgctgtatataggagctgctgcttcacttgcaatggtcaccaaggtgaagagaaagaggagtagcaagtgggatgaagaggatttcaagtttaacatctttgtccctcccaaagacttttggcattaa

SEQ ID NO: 41802 - DNA, 732 bp, Glycine max
  Peptide Sequence Number=SeqID_158580
atgcctccaatcttcaacacattagactactctctagaccaacatcatttgtatgcaccaaatcaacaccaacaacacctgatgaagttccaaggttccggtgatgaaaacaacaatggatcaatggtggattacatgcctcaaacaacacccccacatggcttttatggtgctactagtgccgccacaacatcctatgacaaactgagttttgcagatgtgatgcagtttgcagattttggaccaaagttagctttgaaccaagcaaaaaactgtgaagagtctgcaatagacccggtttattttctcaagtttcccgtgttaaacaacaagatggaggaggatcagcagaatatgatgatgaataatgatgaccctgatggtgatgaagcagaaaatcatcatcatgatgagaggttcaacaacttggtgagtgtggaagacaaagagggaatgatggtgagagaggatgaagagactacacgggtttccgacgacaacaactcggtgcagattcggtttcttgggcatgaagagcctcagcagaagaataattgtgcagtgcaggagaacaagaacggcaagaggaagaggccaagaactgttaagacaagtgaggaggttgagagccagcgcatgactcacatagcggttgaaaggaaccgtaggaagcaaatgaatgagcatcttcgtgtccttagatccctcatgcctggttcatacgtccaaagg

SEQ ID NO: 41803 - DNA, 300 bp, Glycine max
  Peptide Sequence Number=SeqID_158581
atgacaaaattgaagacaaccttgtctcctggaactaagccagttgcacctaagtggattgaagttaagagtcacgttcaaaccggatgttatgaatatggatattacataatgcattggatgtggaacatcataaccagcgacataaagagtgactggtccatgttcactagcagcaaaatgactagcagcacaagcattgaagagctatctgttttatatggtattggtatagagattgcagggatgccaagggaaggcgaccaggggatgaaaattatgattaaagagagttcttga

SEQ ID NO: 41804 - DNA, 456 bp, Glycine max
  Peptide Sequence Number=SeqID_158582
atgaagcttgtggagatggagaccggactccacgaagaaaccgcggagagcaagtcttgtttggctgatgttgaagtgaagcttctaggatttgatgccatgatcaaaatcctatcaaggaggaggccaggacagctgatcaagaccattgctgctcttgaagatcttcagcttatcatccttcacaccaacatcaccaccattgaacaaacagttctatattcattcaatgtcaaggtggctagtgattcaaggttcaccgcagaagatatagccagctccgtccagcagatattcaattttattcatgcaaacactagcatgtgctgtagtcgtacaagaatcacttgtgatttctatagttgtctttatgagataaaaatattgattttacaccgccgcttgcatcctaagtcgtttggatttactattgtcattgttgtaaggggtgactga

SEQ ID NO: 41805 - DNA, 222 bp, Glycine max
  Peptide Sequence Number=SeqID_158583
atggttttgcattcaatagctattgtaggagatataacaccatctgatggtgtgcccaaggctgaaaagagcagaatggagcaggaagccttaagcaaaatgtgtgaacttctcggtggagggataagagctgaagagatcaaagaactttgggcagagtatgaaaacaattcttctttagaggcaaatcttgtaaaggattttgacaaggtatctgtttga

SEQ ID NO: 41806 - DNA, 285 bp, Glycine max
  Peptide Sequence Number=SeqID_158584
atgaccgacgaagaagaagcggagaacccaacggaggcatcacgagaagagtgtttgttgggttcgccgaagccctccgagcctggaggttgggaccaaaccgagacgagcctgaggttcggagcggcgtcgcggaagaaaaagattgcgggtgcgagaatcgagcgagaaggcgaagagcgtagtggtcctgagaggtatagtgtgggtcgtggaatgtgtatggtgggaattgggatggggacacctatttccggtaccacaattgctattaagattacccac

SEQ ID NO: 41807 - DNA, 741 bp, Glycine max
  Peptide Sequence Number=SeqID_158585
atggtgagagcctttgaggttctatgccctgtcttcaacattcagcccaatgtgctggtgtttctacattttttccaaatgaagttgacgggcaatatcggttgggtctctgtcgcaacctaccctacgacgggggtgcgaaaggcgagccagatgctagcctgggcgagctggggtataggaaaatccaaaaatagaccattttgcccccttccttggtatccttttgtattcttgatcaagacattgagtgattccttgcttcgtgtggaaactgtctccatgaacagtatgtccaagaagttgttcgagtttgactcgaacatattttgccacttcaagggccgtttcttcaaggtcctggctactaatgtcgtggctgatggatttgttgatccttgtggaaagggtcgacaaggacatattggagtagctcccagcctcactagacgcgcagcccctcatgaagaaggtcggattatgccaccatcttctgttgcccctgctgctggagaagggggtcatcctaccggtgaggttggccctgctactattgttgttaagggggccaataaggaacttgaagaagagctgctaatgtacaagaaggaggccatggagcagcatgaaaaggattttcacaagaccgttaggcaggccgagttcttcaccaaggaccttcagttgggtctttttgaccctttcaaggacatggaggacgatgttcgatgttctacttga

SEQ ID NO: 41808 - DNA, 405 bp, Glycine max
  Peptide Sequence Number=SeqID_158586
atgatgcaaagtggtcaaagaagaagtgaacaagctcctcaaagtcaacttcatcatagaagtcaggtatttcacctagcttgccaatgttgtcatggtaaaaaaggccactggaaaatgtgcaccgactacattgatctaaacgggacgtgtcccaaggatgcataccctctacctagcatcgataggctagtctatggagcgtccgggttccaaattggacaaaatgtcaaggtctacgccaacaatatggtggtcaaatctcaaagcatattccaacatgtggcagacctaaaagaggtccttggagagctccacaaatacgacatgcaccttaacctggaaagatgtactttcggggttggtggaggcaagttcttgggcttcatgatcacgcatcgatga

SEQ ID NO: 41809 - DNA, 453 bp, Glycine max
  Peptide Sequence Number=SeqID_158587
atgaaggaagacattgtcattaaaaataccttgaaagcaaagaaaacaaatgaaagggaaaaggaatcacaatcgcaagcaagaagattcaagaagagaaggcagaaattcgaagtgatggctggggggcttgacaagtttgacaaacctgtaattctcacacctatcgaggttaccattctcgacaccagacaactcctgtccatgcttggggcctcgaaaaaatcacgatcctcctatttgtcaaggatactaccccaacatcaaacagtctcccttgacataggacaaactcctttgacactggataatctctttcgcccgcatgccggctcaaagcttggggggcttacgtactatccaagctccacaaaatccacgtggcaagctacatggcaaacatcagccttccatgtcagccatggcacaagagcacggacgacagacccttaa

SEQ ID NO: 41810 - DNA, 351 bp, Glycine max
  Peptide Sequence Number=SeqID_158588
atgatagagaaggtggatctagcactcattaactcagctcgacgtctcaagccatacttccagagtcaccacgtgatagtcaaaacgaaataccctatcaaacaggttttgcgaaagcctaaattggcagggaggatgtatgaaccttacggccccatgaagacacaatccatggcagactttcaggcaaaatttgttggaaacgaccaaaccaccccagactggtggagcctctacgttgacagtatgtccaacgtgaagggaagcggggcaggaatcattctcgaaggctctaacaatgtcactctagagcaatacctcaagcttaacttcaaagcctcaaacaattag

SEQ ID NO: 41811 - DNA, 1871 bp, Glycine max
  Peptide Sequence Number=SeqID_158589
atggcagcatgcctgaagccacctagactatccagcacagaagatgactctttgatactcttttcaacttctaattctcctgaagagtccaatagtccttcttcctctttctaccattcaccaccaacatcacttcatcaattcagaactgcaaacaaactttctgtgagaaatctctcctacactttgcttcctcacaagaccactcccttatcatttttccacctgactcaaaacccaaagcctgtaaacatactcaagtcagtctcttttgttgccagaagttctgaggttgttgctgttgttggtcctagtggcacaggaaagtctacccttctgcgaatcatttccggaagggtaaaagatgaagattttgatcctaaaagtgtctcaatcaatgatcagcctatgactagtccagctcagttgaggaagacatgtggctttgtggcacaagtggacaatttgcttcccatgctaacagtcaaagaaactttgatgtatagtgcaaagtttaggctaaaagaaatgacaccaaaggatagagagaggagggtagaaagcttgttgcaagagctaggcctttttcatgttgcaaatagttttgttggggatgaagagaatagagggatatccggtggagagaggaaaagggtgtctattggagttgatatgattcacaatcctccaattttgctcctagatgagccaacatcaggtctagacagtacttcagctttgcaagtcatagagcttctgtcatcaattgctaaagcaaagcaaaggacagtggttctttcaatccaccaacccagctatagaatattgcagtatatttccaagttcttgatcctctctcatggttcagttgttcataatggtagcctagaacagctagaggaaaccataagtaaactgggatttcaaattccaacacaactgaatgctttagagttctccatggaaattatacgtgggttggaaggttctgattccaaatatgacacttgcaccattgaggaaaaggagccatttccaaacctcatgtggccagaggaagaaaactgtggagtccaaattctccgatcacaatgtaacaaggaaagttatggcagtctttgttatgcaaacttgattgagatattgtttctctgctcaagattttggaagatcatctatagaacaaagcagcttttcctggccagaacaatgcaagcactagttggtggctttgggctaggaagtgtttacataaagataagaagggatgaaggaggagctgctgaaaggttaggtctatttgcatttagtcttagttttctcctctcttctacagttgaagcactttcaatataccttcaagagaggattgttctgatgaaagaagcctcaaggggagcctataggatttcctcttacatgatagccaacacatttgtcttccttctattcttgtttgtggtatctatactttttgctgttcctgtgtattggcttgtaggactaaacccttccctttctgccttcaccttcttcactttagtggtttggctcattgtgctcatggcaagttctttggtactcttcttaagtgcagtatctcctgatttcatttcaggtaactccctcatctgcacagttcttggagccttcttcctcttctctggatacttcataccaaaggagagcatcccaaagtattggcttttcatgtactatgtgtctctctataggtaccctttggatgcactcctcacaaatgagtattggaatgttagaaatgagtgtttctcacatcaaatagagggatcacagtgtctgatcactggatttgatgtgttgaagagtagaggactcgaaagggataacag

SEQ ID NO: 41812 - DNA, 897 bp, Glycine max
  Peptide Sequence Number=SeqID_158590
atggttagaacgagaggtgttggtcgtgctttaggtcgagcaataggaaaagaaacacctattgaagaagttcttactggtatttacggttttccaggaggaccctatgacacatcagttctgagagattttgaaaatcaatttgctctgagagtctggaatggagagcacaaggaggaggaggacgacgacgacgacgaaaaccccaatgcggaggaagacctcaccaaacacaactacgatttggaagaccaaatgcaccacaaccaccctaattcgcaacctcacgtggagacggaggtcctctccgaccacggcgttcagatttttcagttcccgacggtgatgaagcgctctgtgaacttccctcactcctccatcaccgcaattgttgctctggagcgtgccctcgagtccggagagaacaaggctccaagcgctctcgctgctccggttctcgagaatgtgtctcatggccaacttcaagcactgtcgtttgttccctccgatagctttgctttcgacggtgattcctcttttgtcatcactccccctcccattttggaaggtcgtggcattgttaagcgctatggaactaaggctcttgtagttccaatgcattcaacagattggtttttgcctgccacggtgcacaggttggagaggcaagtgagtgtcttacccggcattcttcaaggggacaagtcagactccctcttgtacggctctgttgacaatggaaagaaaatttgctggaatgaagattttcattctaagggtggaaggttgaggctggagaaggccaaagaagactatcttgtgcgtttgaagagagaatgggaacaagacgctctagatgatgctactcaaaaaccacccactgctgcttctgagtag

SEQ ID NO: 41813 - DNA, 336 bp, Glycine max
  Peptide Sequence Number=SeqID_158591
atgtggaagcctagtagtgcatcttccttccatgggaagatagcttcagttcaggacattcatgcaaacaataatatcgatcatatacctctccattccagactctcagagcaaattgattttcaaaatctctcagaactgatgtgtcatagggtcctcctggaaaaccgtaaataccagaggatcctcaacaacacgttcatgatgtcgctgcctacgggcaaatgcgataggccttcgccgctagaggcatcattatcatcgtcagtcgccgctctccttccaagacttttcctattgctcgacctaaagcacgaccaacacctctcgttctaa

SEQ ID NO: 41814 - DNA, 300 bp, Glycine max
  Peptide Sequence Number=SeqID_158592
tggttcacgacttcacgaagtgttggtgttgtgatcacagattggaacgatgtggctacggtggtgcacgtggtgtttggagggtcgagattggtggtagtgtcagtgtttgaggcattgtggttgaaatggcgtggctatggtgattgtaaagtcggtttgctgaaaagagttaatagtaaagcagggaaggaaggtagaggttatgtatatgaagtgcgagagagaacggtggttagttactctttcaaggcgttgaagaagtgcagttttgaattggcgaacaccacgaccacttga

SEQ ID NO: 41815 - DNA, 240 bp, Glycine max
  Peptide Sequence Number=SeqID_158593
atgtcaacacctgaaagtgcaggagcaactagcaagttctcaaataaagactttactaatctcgtcttaactcttaaatataattgcaaattgcatgagaaagttcactcaagttccagttcacaagttgttgaagaagagtatgaaggagtgatgcaatcctacccccaagggcatttgacagaagacttcaagaagattgggccagagatgcaagagaaggccctagggttctcatga

SEQ ID NO: 41816 - DNA, 411 bp, Glycine max
  Peptide Sequence Number=SeqID_158594
atgaaagccaacaaaacaagaaatgaattgaaagtttcggattcgaaaacttaccggttgaagaacaaagaacgcacgaagaacgaagctttacagaagaatataggactcgattttcttctttttcctcttccctttcaccaatatcaagtgaaatatgcttacccaaggttttcagaaattttatggaatccccggaagccatttttcaacaaaaggagggaggtatttgccgcccagctcgcccaggcaagtggttgcttagctaggaagaaagaaaaggtccagaatcctctagatggacccagatttgaaaattgctatttacacccccagcttgataagatcaacaacagtccgcagatgaaattagggtgtaacattctatttacacacccctcactttgctaa

SEQ ID NO: 41817 - DNA, 387 bp, Glycine max
  Peptide Sequence Number=SeqID_158595
atggacctagagaagtccagcagggccctggggtttccaactctggttatgggcctctgtctgtcctacagggtgcccgtccccccagcaaggtcatgccatcgtgatatagggatcacgcccgcaagacacccagtggacccggagaagtccaacagggtcctggggtttccagctctgattacgtgcctttgtcagttctacggagtgcctgttgcccccaacaaggtcatcaggccccctattaaccgggctttcatcaagaagtactgtgccccccaggcaggcgcagggcgagacaccacaacagcctggggatgcccggcagcgggcaacagatgcatcgccgccacctccagagcccctcaactcatgtataaaggctag

SEQ ID NO: 41818 - DNA, 462 bp, Glycine max
  Peptide Sequence Number=SeqID_158596
atggtacatctcttgtggatcagttcaagtggagcgtatatccacttggtttttgaaagagaacaagggagggtacatcccttgtggatctttgcttgtaaaggattttacaaggttattgaaaatctcaagaaccggtgggtcattttggttgccttggcttcttttacaccaacctttggaaaagaaaaaagcacgaggttcacactggagagggggttagcttgtctaaccctcttcttggaagagaaaaaatcaacatcgttaccattgatggatatagagattagtagaaagaagaatggcacgtatctaatcacaaaaagaattatggaatccaaacaatctaaggacattcaagaggaaatttcagacgagggtgtcaaaagcctttttaatattgaatttgagagcaatgtttctagcaaaagactttttatggagcaaattgatggcctctga

SEQ ID NO: 41819 - DNA, 1148 bp, Glycine max
  Peptide Sequence Number=SeqID_158597
ttggatgaacgaaagtcgcatgagccctgcgtatgaggaaggtgtggaacagttcttgcaatttgcttctgaaagaagtcgactggatgaggacggaaaattcttttgtccttgtataaactgtttaaatgagagacagcaaatactcgatgacatacaagagcatctgttgtgtgatgggattaagaagaattatacaatgcggatatggcatggtgaattgacagacatacaaagtgggtcccaagctgaagcatttgatgtagaaatgggagatcacttagaggatatgatttgtgatcttagacaagagtcttttcagcaagcacatgcccctatgcatgatacattgcaaactgattcaaagaagcctttgtttccagggtgcaacaattccttgacgttgttgtcagtggtgttaagtctggttaatgtgaaggccatatatgggtggagtgacaaaagctttagttcaccgcttcaactagtgcacaatatgcttccagacgaaaacacattgccaaaaagttactatcaggccaagaagacattgtgtccgatgatgaaggatgatgacgagtttagtagtgacgaaaactcaaagaagaaatatgatggaatgctctgtcattcggctgattcctcccagtggaagaagattgatcgtttgtatccagattttagcaaagaggcaagaaatcttaggcttgggcttgccactgatggaatgaatccatatggcagtttaagcactaaacatagttcgtggctagttttgctaccaggaaatgacatcgatgtttatctcagtccattgattgaagacttgacaaagttgtgggatgagggggtttcagtgtttgatgggtttcgaaatgagacttttgatttgtgtgcaatgcttttttgtaccattaatgactttccagcacatgggaatttgagcaggtatagtgttaagggccatcgtgcatgccccatctgtgaagaagacacaagctacatacaactgaaacatgagaaaaatatctctgatagtgtcattgggacgctccttaacattcaaggcaagacgaaagatggtttaaatactcgtcaagatctagctgagatgggtatacgagcccagttaaatccaaggtctgatg

SEQ ID NO: 41820 - DNA, 147 bp, Glycine max
  Peptide Sequence Number=SeqID_158598
atggaggaatcatcaggaacaaggcaaatgaggagaaaattgtgtgttggtggattcaagatccaatttaactacaacacttattgtacttacgaaaattcggagctaggacacgtcagggtggatgtggtcaaagtgaacttctag

SEQ ID NO: 41821 - DNA, 390 bp, Glycine max
  Peptide Sequence Number=SeqID_158599
atgacgttgggattattttgggagagatttgtgtattcaaggtcaccattttcacaaatcactgctaacaagtatctcttcactaaagtcgactccaagccaagattgattagatggattattttgcttcaagagtttgacttggagatcaaggaaaaggagggttgtgagaatgtagtagttgatcatctatctagattggtgaatgaagaagtcacccttaaagaaaaggattttcttgacgaatttccttatgggtccttgttggtggtgcatgaacgcccttgtttttccaacatggaaaatttcaaagttacaagtgttattcctaaagattttaattggcaccaaagaaagaagtttttccatgatgctcgtcaatatgtgtag

SEQ ID NO: 41822 - DNA, 1194 bp, Glycine max
  Peptide Sequence Number=SeqID_158600
atgtacaaaacactagatgaaggcaaggagatcattaagaatatggcctccaatgactatgagttgctcactcaacaacttgatgtactcaccaagcaaactttcaaaaatccacaactccaaagtgtgcaaaatactcaatctagagctcaacaagttttaagttatgctctttgtggaagtggtcacccaagtgatcaatgcttcatgcacgatggttcccaagaagaaatgaattacaagggaaataaaaaccaacaaggaaactatggaaatcctccctacaacaatgcctttaatcaaggatggaggaacaacaacaaccatggttggaagcaagacgtcggtccctccaatagaccaccacctcatgtggagaagtttaaaagtggatcactttttgccaatactcaaactaatcccaaggagaaatgcaaggccatcactacaaggagagttaatgaagatgagaaaagtgagctcgaggaagagatgaatcctctcaccaaggatcttccatatccacatgctctcacaaggaaaggaaatatgcaagcttttgtccactccaagaagcaattatctgatgcttcacctcttaagaaatcccttatagatgcatttgaagctctcaacgaggaggaggaaaacgaaaatgaagaatgcttgaagcacctaaagacattgaaggaagtccctttggaagaagaagttgaaaatgatggcaacaaacccgtgattattagtggatctatctttcctatggaggaagaaaaattaattgatgttttgaaggccaacaaagaactgatcactcaacctcaaaggcagctcaatcctaatatgaaggaggaggtgagaaaagaagtgctcaagcttttggaagtcggtatgatttatccaatcttggatagcttatggattagctcaggccaagtggttcccaagaaaggaggcatgatgattgtctgcaataccaagaatgagttaattccaacaagaatcgtcaccggatggagaatgtgcactgactatcgcaagctaaatcaagctacaaggaatgatcattttcctttgcctttcatgaatcaaatgcttgagaagttagtcagccaagcattgcattgctttcttgatggctacaaccaaattgtggtggatcctaaagatcaagagaagactgccttcacatga

SEQ ID NO: 41823 - DNA, 636 bp, Glycine max
  Peptide Sequence Number=SeqID_158601
atggtgcgaggtaccaaggtgagatatgatgttgttactattaacaaattcctaaagactgattttcaagatcttgaggcgcagagttgtacctactttgagttgaaggacaaggatgattttgacccagacaagctagctaaggtgctttgtattcctggaaaatcttatgtcaaagcgaaggagagcaacaaggcatacaaattcaagaaggatgcattgaggaccattactcagatttcgatgtcctttgcattctccaacgttgctccaaccttgcacacttccaacctcaacagacaacgtgcttctctcatctattgcatcttggctaatatccctattaacatagggaaagtaatttctgacaaaattcatagccttgcctctctctcaagaaacccatcacaaaagaagaagattgagcagaattgtgtgaataaaaatgataccaatcagccttatgttccctgtcctccccctcctccatcctcgtctcctacagttgatcaaatgatggtcgttattcgtcgtggctgtcaaagcttaaatgcttcctcctacaggcccaaccctaacttcaatgcatttatggcttggccaggtggagaccaaccttctttaggggggtggtag

SEQ ID NO: 41824 - DNA, 321 bp, Glycine max
  Peptide Sequence Number=SeqID_158602
atgaggctcaattcttatgagtcctcgaaccattacaagccaaaggtgaagacatatcatgacaagaagatcttgcataaagagtttaggcctggccaacaagttcttttattcaattccaagcttaaattctttcctgggaagctcaagtcaaagtggtttggacctttcattgtcaaggaggtgaatccgtatggtgcaattgtattagaagaccctacctctaaaaggaattgggtgcttaatggccaaagactcaagctatatttgggtggtgaagttgaaaaagttaccaccattatgcttctcaacaacccttga

SEQ ID NO: 41825 - DNA, 246 bp, Glycine max
  Peptide Sequence Number=SeqID_158603
atgcagtatctaggaagtgatcctaggtcgtctcccacagaaacaaaaaggaaatcaaaggcaaaaaacgaactgaaattagaagacagaattgaaaacgaaactggaattaaaagcagaaaacaaaactggaatttgaagcagaacacgaaaatggagttgctacgtgaacagtgccatgccgtgaacagtaacccaaaaactgaaaatgaaaccctacaatatctctgcctacgtgaacagtga

SEQ ID NO: 41826 - DNA, 705 bp, Glycine max
  Peptide Sequence Number=SeqID_158604
atgtctcgtcgcggtggctctaaacaacaaccaaattcacgccgtccagcaccaccgtctgcatctccttctcccgccgaaagaggacacggccgtggccgtgggcacgaagaatcctccttaattcctgctccttctccagtgaatgcaccatccgatcctcctccggcttccaccatcggcgttccttctggtgtcgcacctgttcgtgctgcgtcgccgtctctaggggctgaattagaatctctcacttccgcggttgaaatgcaaccgtcggcgccgtcatcggcaaaggcggtgaggtttagtgaacgaatagggttcggtcttgtagggaggaaaatcaaagttcgagcgaatcatttccaagtccaagtcgctgaacaagatctatttcattatgaaactcactcgagtggtaagaaagtagaaagagtttgtaagaggtgtggctttgatagcttccgtatccaaaatgcccaaggccagcctgaaggaatttgggtgctttggaattctgaagattcgagaatggatgttctagcttcagaagaacaatttgttcacatgaggctagctttgagtaaaggtgaaccttggcttatcattggtgtatatggcagtccccaatatcaaagaagaaataagctttgggatggtcttaccaatattacttcttcttgtttggagccatggcaattttag

SEQ ID NO: 41827 - DNA, 393 bp, Glycine max
  Peptide Sequence Number=SeqID_158605
atggcaacaagaacttggggaattattgatttcatggctaatgaatttgagaaggccaatgttgagtcccgaaaggctcaagctgaatacaaagacaaagttaaaggagaccaagattcaaaaggagtcattatagatcatattagccttcgtaagaattttgctaaggctctcacgaaaaagattgagcgccttaataaggagtttgctctctttaaggtggacgctgaaaaggctgagaagaaattggaaagtgatctcggtgaggctgagttcaagatcttaaagtctcatgaagtcgatatcgagaaggatgtcaatcatcaaggagaattggtcaatgaagttgaaatacccgagaatgaagcaccaaccaagttggctcaagtttaa

SEQ ID NO: 41828 - DNA, 660 bp, Glycine max
  Peptide Sequence Number=SeqID_158606
atgggatatctaaaggtacacactttaacccttctcaacttttcattatgtctcattccagggacggttctgtgcgctttagcaggggcaagatgttgtcgccagaagtttgccttattggaatctagtgttccccttggtggtactgccataattggtggtgttgttcatcctggcgctggtgctaccacccctgctggtggcactacagctactgagggagaaccttgcccaaacattagagttcactcaatctctagggaggatgaggctgagtcccctctacctagttctcctcataatgttattaacctagagttggaggccactaccattcaagtcttagtctgtcatccttttattcctcctcctcctagaaaacctagtaaggttactcttagtcgggttcatgaggaagtcagatcctatgaaaatagttttctaacctatgagtctattactgacttcctcgagtctgttgagttttgtgatatcgatgggttggatatcaaaatatctccaaaccggtggtctacatgtctctttccaatcatgagggaattatggccaagtttgattacccaagttgacaggctaaagggaagaatcaggacaacatcgaagatgactaggttcctcttccctctcccatcagcctga

SEQ ID NO: 41829 - DNA, 225 bp, Glycine max
  Peptide Sequence Number=SeqID_158607
atggaggattgcactagagggtcctcactagtcaatcatgaagcatggctccaaactctttggtggaggatgcatgaacgaaaacgcaattcatggggctccgaaaaaaaggcgaggatggaggattgcactagagggtcctcgctagtcaatcatgaagcctggctccaatctctttggtggaggatacatgaacgaaaacgtaattcatggggctccgaataa

SEQ ID NO: 41830 - DNA, 938 bp, Glycine max
  Peptide Sequence Number=SeqID_158608
cgagcgcgccgacagctcgacaccttcaagcgcgccatgcgccaggcgccggagatcatgcagtgcctggcggtcacgggcgaagtggatttcgtcgtcaccatgaccgtgcgcgacatggcggaatacgacgccttcgcgcagcgccacttatggggcgatcccaatgtgaagcgcttttcgacgctggtggtgatgaatcgcgtgaaatacggattggcggtgccgacgatgccgtcggacgaggcataacgtgccggccggcgattgcgcgccccgagccggcggcgctagactggccgcctccctcctttacgcatatccccgccatggccttgcatagctggctcatctatctggttgccgtgatcggcctgtcgatcacgcccggtcccaataccctgctggcgctgacccacggcgcgctgcatggccatcgcaaggcgctgtgcaccatcgccggcggcgcggtcggcttcatcgccctgattgccctgtcgatgctgggcatcagcgcgctgctcaaggcctggggaccggcgctgacggtattgaaatgggctggcggcgcctacctgatctggctcggcatccagctgtggcgctcgcccggcgtgcaactgcgcccggcgcccgacatgccgcggctgcgcggcacgcgcatgttcagccaggggttcctgtcggcgatttccaaccccaaggcgctgctgttctatggcgcgttcctgccgcagttcatcgatccggcgcgcagcctgttcacgcagttcgtgatcatggccgccaccttcgcggtcatcgagttcctggtggaatacgtgctggcccgcctggcgcaccgcgtgcggccttggctggagcgcgccggccggcgcttcaacaaggtgtgcgggggattgttcgcggcgatgggagtggcgttgccggggtcttga

SEQ ID NO: 41831 - DNA, 1134 bp, Glycine max
  Peptide Sequence Number=SeqID_158609
gccgctgaggagttgacacatagtatcaaggatagagcagaaaatttaatgatcgttgatttgctgcgcaacgatattggcaaagtatgtgaagttggctcagtgcaagtcgatgccttgttcaagttgcaaaagttcacgaatgtgcatcatcttgtgagtattgtccgtgggatactggcgcctggctttaatgcactggatttactacggggatgcttccccggaggttccattactggtgcgcccaaattacgtgccatggagatcattgaagagctcgagcctcatcggcgcgggatttattgtggcagtattggctacattggctttgatggctgcatggatagcaatattgccatccgcacagccgttgtacacaatcagcagatgacattctttgctggagggggtgtggtcgcagactcagactgcgacaaagagtaccaggaaacatttgataaagcctcccacgtgacacactatggcagcctggtgcaatggctgcaattggttgtccgctggggggatggcaaagtcattatcgtgcctggagggggcctgtatgcagatgccgtgcgtgatttccagcgcatgcgagcagcgttgccacaaggtcatattaatgacagccaagcgcatgcactggcgatctatgcaatggatcaaatggcacgtagtctggtggcgatggtgcctgagctggcgctggtacgtaatccgcttgaaattgcagaaagtggttggcaacatcgtgggttggtatggttgccgagtgaaatggcgttgaatccggtgctggctaatgaattggctctgcctgaaacctgggaggtgacatcagacagcctggccgcctggctggcctggcaacttgaagccagccatttactcttggtcaaatctgatgaccggttgttagagatgcgtgacggtttgcaactcggaaaactacaggcgctggatattgtggatcaaggcttatcaagcttgcttacagaggccaaattccagacctggatagcgcatcaaacccaatataagctatttgaacaaggcttttcaaaatcactcgaggtgatcgcttttctcaaatcggccaaaatgcagcatgatcgttggcaggatcagcag

SEQ ID NO: 41832 - DNA, 438 bp, Glycine max
  Peptide Sequence Number=SeqID_158610
atgggtaaagtagaggaggtgcaagagcagatgaaggccgacatggaggccatgaaagagaaaatggccacaatgacggaggccatgatgagcatgaagaagataatggaagccaatgcggttgcagttgccgctaccagcgttgttgctaagatatggtgggcaaagattttgggaagtacggacggcccccatgatgcgcaaattcaaaacaagcatgccttcccaccatatggcttgcatcccaactatacaccacccaatgtggcatacactcccaaggaggatgtcaataactccactcccacactcattgaaagccaacaacctcaatctgatcatgcacatgtctctcaacccatgggggagacacatggaatgccccaccacaatctagccgactttgagccttgcctcggatatgccactgaagggtaa

SEQ ID NO: 41833 - DNA, 888 bp, Glycine max
  Peptide Sequence Number=SeqID_158611
atgtcctcacctccagaggactacacgtcctcgccttcagaggactacatgtcctcacattcagagggcttcacaccctcgccttcagaggactatacgtcctcaccttcagaggactatacgtcctcaccttcagaggactatacatcctcaccttcagaggactacacatcctcaccttcaaaggactacacgtcctcgccttcagaggatgacacgtccttacctttagagggcttcacgccctcgccttcaaagggctacactccctcgccgtcagaggaccatacgtcctcaccttcagaggactacacgtcctcgccatcagaggactacatgactacacgtccttaccttcagagggctacatgccctcgccatcagaggactgcacgtcctccccttcgtagggctacacgacctcaccttcagaggactacacgacctcaccttcagaggactacatgtcctcgccatcagaggactgcacgtcctccccttcgtagggctacacgcactcaccttcagaggactacatgtcctcgccttaagaggactacccgtcctcgccttcagaggactacacatcctcccgttcagagggcttcacgccttcgccttcagaggactatacatcctcgccatcagaggaccatacgtcctcaccttcagaggactacacgtcctcgccttcagaggactactcgtcttcaccatcatagggctacatactctcgccttcagaggactacacgtcctcaccttcagagggctacacgccctcgtcatcagaggactgcacgtcctcccattcgtagggctacacgccttcaccttcagaggacttcacgtcctcgccttaagaggactacccgtcctcgcctttag

SEQ ID NO: 41834 - DNA, 532 bp, Glycine max
  Peptide Sequence Number=SeqID_158612
gggaacggatctgagaaacaccaacatccacaacgtcgatgtcttgttcatttcagacactctcttcagtgctttgcgagtgagagcctctcctcctcttgctcctgtttgtcgaatccctatccctatctcgattccttcctctgtcagggagcagaaatcgtgtaagaatgaagagggagaagagagaggaattgctaatgggctgcgcacgacgaaggcgaggatgtgtagccctctaaaggcgaggacgtgtagtcctatgaaggtgaggacgtgtaatcctatgaaggtgaggacgtgtagtcctctgaaggtgaggacatgcagtcctctaaaggtgaaggcgtgtagtcctctaaaggtgagggtgtgtagccctacgaaggtgaggacgtgtagtcctttgaaggcgaggatgtgtagccctctgaaggctaggacgtgtagtcctctaaaggtgagggcatgtagccctatgaaggcgaggacgtgtagtcctctaaaggtgaggacgtgcagtcctctgaag

SEQ ID NO: 41835 - DNA, 1080 bp, Glycine max
  Peptide Sequence Number=SeqID_158613
atgctgggcggcgatcttgcccatccagaacggatcgagcgcaccgcccttgcgcagatggtccagcacctccgccagcccgcgcaaatagatcgcgtccttcgagaggccgccgcctcgatagatgcgcaacgtcatgttgaaggcgccagcctcatcaaaaccatggtcgcgggtcatgagccggaacgtctccacaaagctggcgccatccagcatggcggcacagccgacgacgcgggccgcaatcagccgcaggcgctcgcgcgtcattccgccagccagatgctccgccagcaccgccagcccttcctgcacgccctcatagccggagaggccggtacgaaagagcctgagcccctgaaacgacccattgaaataggtgaggagatgcacgccgatctcatgcgacaggagcgcttcgacacggcgctgttccataacggtgtgccgggaaatcagaagtttctcgcccgtcaccatcagacccggcggcaggtcgtcgcggatttccacccgtgccttgaagcccggctcctcggccaagtaggactcgaccatctcgcgcgacttccgtgcgacggcgtaacaatctaccatcgcgatttcgccgccctcctcccggcgagggcaatcctccagcacccgcagcgccagcgtcagcagcgcaggttcgacggcgccatagagggcgcgggaaaaatccgtgaaagtgcgccggtgcagattggccagcatcgtcagttgcagatcgatctcctgctgtttctctcgatagagatggtaaagcaccggatcttccagatgatcgaaaaccaccgaatagagctttcgcttctgctcctcgacatcgacgcccaacggccggtagagaagacgcggcgcgaactggaagctgccgtcccgaaattcctcgaaggcccggcgggcattgattggcgtgacggagagaaggaaatcgaaggacgatacgatatcgtcgatggacctgtctgcgcgcctgaccgcatcgacgaaggccttgcggccgagcgccctgtggctggtcaccttgagcgcgtccatccctgcagagaatga

SEQ ID NO: 41836 - DNA, 663 bp, Glycine max
  misc_feature (27)..(27): n is a, c, g, or t
  Peptide Sequence Number=SeqID_158614
gatttcgcccggaccgctgccaggagncgggtgcagatcatgcgcaccagcatgaccaccttgacccagatgtggatgacgttgctacttagcaatgtcttgcctagtgatcataactacgatctccctctgccgaagtgtcagctggtgtatgccatcctgacacggatgagtgctcacgtggctcagctgattgctgacgccatctatttatttgcaggaatgccacccaccaggcaccctctagacccggataagtctaacagggccctggggtttccagcattgatcatgggcctctgccagtcatttggggttcccgtcacacctagtaaggtgatccgaccgtcgatcacccgggccttcattgagaagtattgcacgcctaggcagctgcagggtgatgcaccacaggctgcagacgtaccgccacaacctcatcaggctgatcctgctaggtcattaggcatggacaggtatctacagcacttggttcgccagcaggcggccaaccaacgggggcaggtgcagatacatgagtgtctctaccagctcaaccttagtcagcagggccagggatccctgggcgatgcagaggggacccgcatggatgaggagatgacggatttgctcgatttcttgggagggagcggagccacatga

SEQ ID NO: 41837 - DNA, 336 bp, Glycine max
  Peptide Sequence Number=SeqID_158615
atggtccatgacatctttgtcaaggtgaagctggaagtaacaaggatatcaacaatcctaaacgtgtttggcagtagactaagcaatgatgtaacacgatccatcttttgccccaatttttgcaagatggttacttccatacttcaacttgactcgatgaaccttttcgtagaagcacgagcttggttcaaccccataacccagggaatggcaattttgatcgccaatacttcaacaacatttcatagggatgaaagactcgggaatacgcatgctatgcatggaaaatgtaattatgagattgagatgcccgaagagacatcctttcttagttaa

SEQ ID NO: 41838 - DNA, 336 bp, Glycine max
  Peptide Sequence Number=SeqID_158616
acaacagcgtgcgccgatgagcgaaagcggaaattctcgccgcgcagcagtcgcccgctcggtatcgtgcgggcgcgcttcacggtgaaacgcaaggagatgcgttactacctgcgtgggctgtttattctggcgttgatcgtcggtacggtgatgagcaatgcgattatcggcggcgtgatcgatcaatacggcatcccgttcagccactggacgctgaccatgtatctgacgcaaggctttatgatcgcgctttacaccacggtgttcaccgcgctgatgtcgattccgctgtggtatttcttcctcggcgaaaaggatgattcgcagggataa

SEQ ID NO: 41839 - DNA, 1124 bp, Glycine max
  Peptide Sequence Number=SeqID_158617
tactagtacttatcacctttagaggactacacatcctcaccatcagaggactaaacgtcctcgccatcagagggctacacgccctcaccttcagaggactacacatcctcaccttcagagggctacacgccctcaccttcagagagctacacgtcctcaccatcagagggctgcacgccctcaccttcagaggactgcatgtcctcgccttcagagaactacacatcctcgccttcagagggctgcacgtcctcaccttcagaaggctgcacgtcctcaccttcatagggttgcacgtcctcaccttcagaggactagacgtcctcgcctttagaggactgcacgtcctcaccaacagagggccgcacgccctcaccttcagagcactacacgtcctcaccatcagagggctgcatgccctagcctttagaggactacacgtcctcgccatcagagggctgcacgacctcaccttcagaggattacacgtcctcgcctttagagggctgcacgccctcgctatcggagggctgcatgccctcaccttcagagggctacacgccctcgccttcagaggactactcgtccacaccatcagaggactgcatgtcctcaccatcagagggctgcacgtcctcaccatcagagggctgcacatcctcgccttcagaggactacacgtcctcacctttagagggctgcacgccctcgcctttagaggactgcacgtcctcacctttagagggctgcacgtcctcgccatcagagggttgcacgcccgcaccttcagaggactacacatcctcgccatcagagggttggattcccttggcttcagagggttgcacgtcctcgtctttagagggctgcatgctcttgcctttagagggctgcacgccctcgccttccgagggctgcacgccctcgcctttagagggctacgcatcctcacttttatagggctctacatctgcgccttaagagaatttaagatatggatgacgttgctacttagcaacattccacccgatgaccacaatgttgatctaccccctatggaagtatcagttggtttgtgccgtcatgacataggtgagtatgcacgtggctcaactgatttctga

SEQ ID NO: 41840 - DNA, 1239 bp, Glycine max
  Peptide Sequence Number=SeqID_158618
atgctgcagaggcagctaagagctgtattgatactgttttgctgtgttcaatttcatgtccaaagttgtgatgaaattgaagatgtaatcagcagatctcaatttccagaagggttccttttcggaacaggcacttcctcttaccaggcaattgaaggagcgtattttgaagatggaaagggtttaagcaattgggatgcttttagtcatacaccaggaaagataaaaaaggatgaaaatggtgacattgcagatgatcattatcatcgctatttggaagacattgagttgatgtcgtctcttggggtaaatgtatatcgattttctatctcatgggcgaggattctaccaaggattgagccatttgtgacaattcatcattatgacttgccacaagaactggaagaaagatatggtggttggattagtcccctgatacagagtgattttgtccattttgctgaaatttgtttcaagagctttggagacagggtaaagtactggactaccatcaatgaaccaaacctgtttgcagattttggctatatggaaggaacatatgcccctggtcactgttccccaccttttggaaattgtaataccgggaactctgatgttgagcctctcattgtcatgcacaatatgttactgtcacatgccaaggctgttgaattataccgcaagcactttcaggttgggggaaagaggattaaattccaagatgggagtttaattagtaaactactcatgctaatccaggcaaagcaagggggaaccattggcattgttgcattttccttcatgtatgacccacttagagatgaagaatgtgataggcaagcagtgagtaggggcttggcttttgacatagcctgggtcttagatcccttagtttttggtgaatacccacccgagatgcgctctatccttgggagtaagatgccagtgttctctcctgtggagaagagtctcataaaaggaagcctagacttcattggcatcaatcactatggaactctctatgccaaggactgctccctctctacttgttctcttggagcagatcatccaatagcaggttttctagaaagaactgcaacaagagatggcattccaattggtgatccgacaggagtaccagatttctttgtggttccaaggggtatggagaagcttgtagagtacattaaaataagatatcgtaatatgcccatgtatattacagaaaatggtgggtga

SEQ ID NO: 41841 - DNA, 1833 bp, Glycine max
  Peptide Sequence Number=SeqID_158619
atggatcgaatcctgaaagcggcgagagcctctggttctctcaacctctccaatcgctccctcacagaaattcccgacgaggtttaccggaatctggaggggctcggcggcgacgacaagtggtgggaggctgcggagcttcagaagcttattctggctcacaatagcattgcatcgttgaaggaagatctgaggaatttgccttttctttctgtgttgaatcttagccacaactctctttctcagcttccagctgctattggagagctgcctcagttgaagatgttggatgtttcgttcaattcgatagttaagataccagaagagattggatcggctgtgtcacttgtgaagcttgattgttcaaataatcggctcacggaacttcctagctcgcttggcagatgcttagaattgtcggacttaaagggatcaaacaatcttattacaaacttgccagaagatttagcaaattgttccaaattgtctaagctagatatggagggaaacaggctaacagtgatgtctgaaaatctcatttcatcatggaccatgcttactgaattcaattcatcaaaaaatttgctgaatgggattccaaccagcattggaggtctttcacgtctaatccgtcttgaccttcatcaaaacagaatatcagcaatcccttcatcaatcatcggttgtcattcacttacagagctttatttggggtcaaattctaacctatcccgatgcaagaataacaatatttctacattaccggtggaaataggggccctttctcgccttgggactttagatcttcactctaaccagctgaaggactatccagtagaggcatgcaaattgagtcttttagtcttggatctttctaataattcattgagtgggttaccccctgaaatgggtaagacaattctcttcactgacattgaatctctaccttttgtttcttgtttaggcaagatgactacattgaggaaacttttgcttagtggaaatcctatgagaactcttcgaagctcgttagtatctggacctacaccagcattactgaaatttctccgaagcagactttctgaagatgaagattctgaagcagtaaccacaacaaaagaggtgatcacaatggctacccgattgtctatctcttcaaaggaactttcgatggaagagctggggttgagtgctgtcccatcagaagtatgggaatcaggggaggtcataaaacttaatctatccagaaactccatccaggagttgcctgttgagctttcttcttgtgtttccctccagacattgattttatctaagaatcaaattaaagattggccaggttcaattcttaaatcactttcgagcctttcatgtttgaagctggataacaatcccctcagacagataccttcagatggctttgaaatggtgcctaagcttcagatcctggatctaagtggtaatgcagcttcattactagatggtcctgcattttctagtttgccatacctgcaagagctttacctaaggagaatgaggctcagtgaagtcccatcagatatagtggggctgcatcagctacggatccttgacttgagtcagaattcccttcaatcaattccagtggggctaaaagctctcacttctctccaggaacttgacctatctaataacaacattgcagtccttccgcccgagctgggtttgctggaaccaagcctacaggcactgagacttgatgggaatcctctcagaagcattcgaagaactgtgttggataaaggaactaaagctgttctgcaatatttgaaggacaaattgccagagcaatag

SEQ ID NO: 41842 - DNA, 978 bp, Glycine max
  Peptide Sequence Number=SeqID_158620
atggaatcagcagatgtcaattcccagaagggttcctcttcggaacaagcacttcctcttaccaggtgcttgtttacttttcctttctctgctttcatatacgttcaaagaaaaataaacaatgatgagaatggtgtcattgcagatgatcattatcatcgctatttgataagtatcagcttcatattaacctgcatttattatatactccgactcatttatgacttaaccgctggccttgacattcaacaggaagacactgtgttaatgtcgtctcttgggcttaatttgatcttcatgaaacgaacaggagggatatacggggacataaatccaaatgggataatgttctacaacaagattatagacaatctgctgcttaaaggtgaaattcaagacataagaatagctctcgtgaaagtaaaaactaaacctgctaaggggaacctcataaatggtttaatatttatatttattactgtatggcattgccctaacctgtatctaaatccagggattgagccatttgtgacaattcaccatcaggacttgccacaagaactggaagaaagatatggtggttggattagtcccctaatgcagagagattttgttcatttagctgaatttgtttcaagagctttggagacagggttaagtactggacaaccatcaatgagccagccctggttgcaaactttgcctataggaaatgaatatatgcccctggtcactgttctccaccttttggaagctgttatactgcacaagccaaggctgttgaattataccgcaagcactttcaggggaaagaggattaaagtccaagatgggagtttaattagtaaaccactcatgctaatccaggcaaagcaaggtggaaccattggcattgtttcgcactccctcatgtatgaaccacttagagatgaagaatgtgtagacaagctgcgagtagggccttggcttttcagatag

SEQ ID NO: 41843 - DNA, 1914 bp, Glycine max
  Peptide Sequence Number=SeqID_158621
atggtgggcaacggccaacatctacagtgcacatgcttatgtgaggcaatcaccatcgacattcaatcaacacagttcagggttgatctctatttgttacccatctcgggtgctaatgtggggactggcctttattgtcacatcgcaattcttcttgacgaaattgcccatgacgccattcaggaacctcatcctgccattcaagcgcttttcaccaggttccatcttttgtttcaacaaccccatgccttacctccagaacatgacaccgaccatcacattcacctgctacctcattcaaatccaatcaataatggcctcatccaaccaagcaccagcccattttcttctccggtgctactggttaagaagcatgacgggtcatggcggttttgtgttgattatcgtgccctgaatgccatcaccatcaaagacagattccccatacccactatagatgagctcctcgatgaattaggcggtgctaaatgcttttcaaagttggatttgttgcaaggctatcatcagatacgaatgaattctgcggacattcctaaaacagctttccgcactcaccatgaccattatgagttcagagtaatgccatttgggttgtgcaatgcgtcatcctcatttcaagccacaatgaacaagatttttcggccttatcttcgccacttcatcatcattttctttgatgatatactaatctatagtggctccttcgaagatcacttgcttcatctggagatggcttttcaggtaaagtatcttggccacctcgtgttgcacaaaggcgtgaaaccactagcatctaaggtggaagccatttaccaatggcctactccgcgttcgaccagagccatacgaagcttcttgggccttgccgggttttatcgccgttttatcagaggatatgctacaattgcggcccctctagttcacatcaccaccatggagcatttcgaatggacagcccaagcccagacgaccttcgaacaacttaagcaagccctctcagaagcccctgtcttggccctgttggactttcagctccctttcattgtcgaaacagatgcctttggtatcaggatgggggtggttctctcacaacagggtcatcctattgccttcttcagtaaaccattcagcccaaagctgttacgtgcgtcggcatatgatgtctcccagtttgtttcgcattgcatagattgccaacacgccaagtatgagacgaaaagagtagtaaggttactgtgtcctctaccagttccccatcaaccttgggaagacttgtcccttgacttcatcattggactgccgccatatcacgataacacaatgatacttgtagtggttgatcgattctcaaaaggcgttcatcttggcatgctaccttcggtaaacacagctcatacagtagcctcattgtttatggaaattgtgggaaagattcatggaatcccttgcagcttggcacaagaaaacgtgaagacccttgcagatgctaagaggagggaaaggatttatcaaccaggagattgggttatgctcaaattacggccacaccgacagacttcagctaatgggtctcaagcaatcatggggaaattggctaagagattcaatgggccctttcaagttctagaacaagcttcatcaacagaacaaggaccttgggaagtgttggtgcaatggcaaggactatttccagacgaaacatcttgggaggattgggctcaactatgcaaggattaccaccttgaggacaaggtgattttacaagggccgaagaatgatacaaaagctgaggaacatggggtagctagcaaagaacacaagccaggggtgcgaatagaaggaagatcaaagagggcaatcacaaagccctcttacctcattgactacctataa

SEQ ID NO: 41844 - DNA, 642 bp, Glycine max
  Peptide Sequence Number=SeqID_158622
atgtgtactgtcatcgtccaccagcaccaccacttggtggtcggagatcaagcccaacaagccgagtcaggaggcaagtccaagtgtcactatattaggcagaatggtgtcttcatcctctgtaatcaaaagaaaaaccctagaggcacaacggtgacctctatagtatttctcatcacagttgaagtagaggccacacttgcgatgggaggcgagttcgtccgggcatgggttggtgtggtgaagcacgagggtgcgacagctaacggatgtccaagagtttctcctcttggggacgagcaaggtcggtcgcttgcacaagggtcaagggctggtgcgcctacacttcggatgaatcttcggggtgaggccagaaacaaaacaactcaggaagaagggcagaggaagatcaatgattcgattggcgaggtccttaaactccgacagggcttgaagaaatatgggccaggaggtgaattggctattactggtaccgaaggcggtggcggaatggatagggttggggaggaagatgaagagagtatgggacctgagaaaagcatcatcaagcttgtcgaagaaccccatgggtgttgttgggtggaggagaacaacgagagcatcaaaattgatagggaatag

SEQ ID NO: 41845 - DNA, 261 bp, Glycine max
  Peptide Sequence Number=SeqID_158623
atgcacttaaccactatccttgacattcgacaggaagacattgagttgatgtcgtctcttggggtaaatgtatatcgattctctatctcatggacgaggattctaccaagagggatatacgggaacatcaatccaagtgggataatgttctacaacaagattatagacaatctgctgcttagaggtaaagtagcaatgtcaatgatcacttgggtcattatattacatagtgctactttgtttgacttctttcatggctaa

SEQ ID NO: 41846 - DNA, 429 bp, Glycine max
  Peptide Sequence Number=SeqID_158624
atggacgaagatcagtggatgcatgacaatataatgtctgaagaaattgatatgaatgaacaaaatgaagatgaagatggtatgaaatcagaacatgttgattgttttgatgcattcaatacttctcaggtgtttgctacttgtgatgatgttttgaattgggctcgagctgttgtttatgaaattagttttgagctgtgtgggaaatcaatggttggaggccaaggatggatgatgaagttaacgtgtgggagtcacaatcatgaaatgacaaagtcattagttggacatccatacgttggtagattgactaaggatgaaaagataattattgttgatatgacaaagtcaatggtgaaaccaagaaatattctgctaacgttgaaggagcacaatgtcaatagttatacaacaatcaaacaaacataa

SEQ ID NO: 41847 - DNA, 1200 bp, Glycine max
  Peptide Sequence Number=SeqID_158625
atgccacaagaactagaagaaatatatggtggttggattagtcccctaatacagagagattttgttcattttgctgaaatttgttttaagagcttcggagacagggttaagtattggactaccatcaatgagccaaaccaattttcagactttgcttatatgagaggaatatatccccctggtcgctgttccccaccttttggaaattgtaaaactggtaactctgatgttgagcctctcattgccttgcacaatatgttactgtcacatgccaaggctgttgacttataccgcaagcactttcaggttaggggaaacaggactaaaggccaatattggagtttaaatagtaaaccattcatgctaatccaggcaaagcaaggtggaaccatcggcattgttgcagactccctcatgtttgaaccacttagagatgaagaatgtgatagacaagctgcgagtagggccttgacttttgagctagcccgggtcttagatcccctggttttcggtgagtacccagctgaaatgcgctcaatccttggtagtaagttgccagtgttctctcctaaggagaagagtctcataaaaggcagcctagacttcattggcatcaatcactatggaactctctatgccaaagactgcaccctctctacttgttctcttggagcagatcatccaataagaggttttgtagaaacaactgcaacaagaaatggtgttccaattggtgaaccgacaggaatagcacagttttttgttgttccaaggggcgtggagaagcttgcagactacattaaaatgagataccataatatacccatgtatattacagaaaatggatactctccaccgccgaagccggatgtgacaatacatgattcactacaggatttcaaacgaatagattatcataaagcctaccttgcagctttgcttagatccataagaaaaggtgctgatgtaaggggatatatgatatggtcattgatggataactttgaatgggcaagtggctatgacataagatttgggctttattatgtggatagacagactcttgaacggattcccaaactttctgttcaatggttttctagtttcctcaacaacactagccacaccaacaaacaagacctgagtgagcaatatgttagaagcaaagatgtgatgactgctggtttcgaagttatttga

SEQ ID NO: 41848 - DNA, 1698 bp, Glycine max
  Peptide Sequence Number=SeqID_158626
atggcgaagaagaaggagaagaaggtgaacgtctccggaaaacctaagcactctctcgacgtaaaccgcagcaatgacgcgaagaaggagtcgcgctccgccgccactgtgcgccgcctcaagatgtataacaccagacccgtccgcgatcgcaagggaaaagtcttatcccacgagcttcagtccaaggagcttcccagcacaagaatccaacccgaccgtcgatggttcgggaacacgcgtgttgtgaatcagaaggagcttgagtttttccgagaagagttgcagagccgcatgtcgagtaattacaatgtgattctgaaggagaagaaactgccgctgtcgctgctcaacgatcaccagaagcaagctagggttcacctgcttgatagagagccttttcaagatgcgtttggaccgaagactaagaggaagcgccccagcctcatggcggctgactatgagtccttgctgaagaaagctgatggttctcaagatgcttttgaacagaagtatggttccagtgtatctgcagaagctaatgatgaagatggatttagagatttagtgcgacataccatgtttgaaaagggtcagagtaaacgcatatggggtgagctttacaaagtgatagattcttcagacgtggttgttcaggttttagatgcaagggatccacaaggtacaagatgttatcatttagagaagcatttgaaggaaaattgtaagcacaaacacatggtgcttttattgaacaagtgtgatctagttcctgcttgggcaacaaaaggatggctcagagttttgtcaaaagaatttccaactctagcattccatgctaacattaacaagtctttcggaaaaggttcacttctatcagttctaagacaatttgctcgattgaaacgtgataagcaagcaatatctgttggatttgttggatacccaaatgttgggaagtcatcagtaatcaacacattgcgtactaagaatgtctgcaaggttgctccaattccaggggaaacgaaagtctggcagtatataaccctaacaaagaggatctttctgattgattgtccaggtgttgtctaccacaacaatgatactgaaacagatgttgtgttgaagggtgtggtgcgtgtaactaatttgaaagatgctgcagatcatataggtgaggttttgaaacgtgtgaagaaagagcatttggagagagcgtataaaataaaagagtgtcatttcacgataggttcattgttgaggctgatgatcagctctactaatttattctggctctcctctattcggccaagacttgatatgcttcctctttttgctctgggtggtgagcctgacctgatgactgcggcaaagatgatacttcatgactggcagaggggccgaattcccttttttgtttcccctcctagggttgaggacttgtccgaggaacctaatgttaatggtgttgacttagatgattcagttgatggcaatgaggcttctgctgctatgaaggctatcgcagatgttctttcatcacagcagcaaacaagtgtacctgttcaaaatgatttatatagtgagaatgagttgaagggggaagctgctgaccaatatccaaacactaatgcaaacgaagatattctggcccctgatagtaacacatctgaagaggatccaaccaacgtgtcataa

SEQ ID NO: 41849 - DNA, 207 bp, Glycine max
  Peptide Sequence Number=SeqID_158627
atgttgcagcagcagcaaatgggaacggtgtctcagcttctagcggttggattagccggtgcttttgccaagacctgcactgctccacttgcacgcctcaccatcctttttcagcgttccgcaaccgcaattgtggccgcaatgtcaaggtattttgattcaccgtcaccgcaatggctgcatcagccgcattttcttgcaatataa

SEQ ID NO: 41850 - DNA, 588 bp, Glycine max
  Peptide Sequence Number=SeqID_158628
atgaagaaggatttagagcatttggtgaccatagctcatcgtctcccttattcttcagtcaacttctatgcatatgaatgctacaagaatctattacgtttgcttctgggggagaagcatagaggaaatacaggtgcagatctctttgtacactttgtagctggtggtttgtctggcataacagctgctgcagctacatatcctttggatttagtgagaacacgatttgcagcacagagaagttccacatactacaggggcatctcacatgcttttactaccatttgcagagacgaagggttcttgggtctctacaaaggacttggagctacattgttgggtgttggtcccgatatagctataagcttttcagtttatgagagcctacgttctttttggcagtcccgaaggccagatgattctactgtcatgatcagtcttgcttgtggcagtctttcaggagttgcatcgtcaacagcaacattccccttggatcttgtaaggcgtaggaagcagttggagggtgctggtggtcgagcacgtgtctacaataccagtttgtttgggacattcaagcacataatttag

SEQ ID NO: 41851 - DNA, 1695 bp, Glycine max
  Peptide Sequence Number=SeqID_158629
atggaagaaaattcacaagaaacacggtctctggctttgactcctacatggtctgttgccactgtgttgactgtctttgttgctgtctctctgcttgtggagcgttccattcaccgtttaagcaattggctgcgtaaaactaatcgaaagccattgcttgcagctctagagaagatgaaagaagagttgatgttactcggatttatatcactcttattaacagctacctcacgcatgatagccaatatttgcattccatcaaagttctacaacagtgcttttgctccatgcactagatctgagattgacgaagaaatggaagataatggctctgaagagcgtaaattattgatggcttcttcttatccacacttagttagaaggatgttgaatggaataaatagcagcacctgcaaagagggttatgaaccatttgtttcgtatgaaggcctagagcagttgcaccgattcatttttgtcatggcggtaacgcatatatcttacagttgcctaactatgttgttggccattgtgaagcttattgtagctttttcttatgaaaaagggttcaacaatcaaactatcactttgatacttaaccatatgagcagagtgtctgacagtttaaaccagattcacagttggagagtgtgggaggatgaggctcatatggatcggcataattcattaactgaaattacaaaagagttgaccatgcgaaggcaatcaacctttgtcaagtctcatgcatcaaatccattgatcaaaaacagttccctcatttgggtgacatgctttttccgtcaatttgggcgttctgtggttcgtgcggattatcttacgcttcgcaaaggcttcatcatgaatcacaacctttcattaaaatacgattttcacagctacatggttcgatctatggaagaggaattccaaaggatagttggtgtgagtggtccactctggggatttgttgttgccttcatgcttttcaacattaaaggatctaatctatatttctggatagctatcattcctgtatctcttgtgctcttggtgggaacaaaactgcagcatgttattgcaaccttggcactggagaatgctggaattacagggttcttcacagaagcaaagttgaggcctcgtgatgaacttttctggtttaataaacctgaactattgctatcgttgatccatttcattctcttccagaatgcatttgagctggcttcattcttttggttctgggtatttccttatccattttacatcctagaattagaccatggacatggagtaaaagaaatcatatcgtttaagtttcaactgaattttgattgcttggaaatgaattatccaaaaatgagatggcagttcggatattattcctgctttattaggaatcaccttctcctttatataaggctaatattggggtttgcaggacagtttctttgcagctacagcaccttgccactctatgcacttgttacacagatgggaacaaactataaggcagcattaatcccacagagaataagagaaacaattcatggatggggtaaggcagctaggaggaagagaagacatggcatgttcaccgatgactccaccattcacacagacacaagcactgtcttgtccattgaagaagatgatcaattaattgatactcctgaagtagaattacaacaa

SEQ ID NO: 41852 - DNA, 488 bp, Glycine max
  Peptide Sequence Number=SeqID_158630
atggataactcacatgtcacagataatgatggttgttcaaagttgaatggaatgaacgccgaacacgccaacacttgtgaaggtggaggtagcggcggtgttcgatgttgcagtggtcgtcagcggtggcatacgaggtacacaatgttgggtgcgttctggtgtactgcgtttcacacggatcaagttgatcttttgcggatcaacttgatccgtaagttcatccaaaagtgttttgaggatcaagttgatccccgagatgatgttttgtggtgggctcaatccgttgcttatgaaaatggatttgtggcagtgattgtaaggaagaaagaatttgttagaagagacactgagactaggaaatataggtatcccttcaagcttcgtggtaagcttgtggtgggaggacaagggtggatgacgaagttgatttgtgggattcataatcatgaattggccaagtcattagttggacattcatatgccgg

SEQ ID NO: 41853 - DNA, 573 bp, Glycine max
  Peptide Sequence Number=SeqID_158631
atggttaagttgtggtcactgattttatggcttactaggcttacttatgggttggactacaaaggaaatgtgtgtgggcaaaagcatgcagttcaagatcttcgagaattggagctcagatactggctaagtcctaatcaggtttatcaaagtggattgaaggatagccaattcaaactggtcaatgcccgcagtatatgcttgctcgactgccccataccttctgaagattcacttacttgggtgtgtgattatcctgaaggagatattcacgtttcattgaatgattggattgatatgaactacgattattttgagttccttacgccagaaatgagaaactcctctcttcaacttcagggcccttgttatcctgtcatatttcctagtgtaaatgtttactggagttgccaattcattgctaaagcatcaaatgtatctttaaagcattggcagcagatgggtggagttaccatcaatgaaaacattgttattgacaagtccattcacaagtatatcaattctcattcagctgtcttaaagggaaagcataacactttatcagcatcttag

SEQ ID NO: 41854 - DNA, 1290 bp, Glycine max
  Peptide Sequence Number=SeqID_158632
atggctgacataggaaaggcatggcttgtgctgattgtttgtggagggattttacctctgtttgtgtctgtgatttggctgctgatgattcggcattttgttgctgccatgccttgggtgacagtggttttgtttgatgttctaataatatcagttacaatgtttttctacctcaaagttggctggataggaaatgatgctatttcccccatcataggtgagcatgatccttacattcatgtatttgtgagggttgctgcaaaagtgataggagaagttcgagcacttattatttttccaatcataccatatggtattcttgcagtgttctacatgttatggatttctgctgctcttcatttgtttagctctggtcgggttgttcagaataactgcaactctaactgctgcacatatgacctcttggaaaaaagggtgatctgtgatcagtgttgtggatatagcattcgttacacaccgcatattggagttgccatcctttttcacttatttggctgttattgggctacacaatttttcatagcttgctcatcaacagtgattgctggatctgttgcctcttactattgggcccatggtgaagcatctcctgaaattccttttctttcagtcttttcctccatgaagaggcttatgcgttacagtcttggttctgtggctcttggctctctgactgtatcatttgtagagtcaatccgctttctgcttgaatctattcgccggaaactaaaaggctctagtcacatgcctgatagctggattgacaaggctgcttaccaatcttctcaatgctttcgaaggtgtattgagtggaccatcaaatcagtgaaccgaaatgcttacatcatgattgctataacgggtaaaagtttctttagagcttctgctattgcaacagaattgatcatgaataacatcctacggattgggcatgttaacgtgattggagatgttattttgttccttggaaaactatgtgtcagcctctcaagtgctgtttttgctttcctcatgttagacacacacaactacagttctgcacataacaagatctcatctccactattacctgttgtggtttgctgggctcttggatatattgttgcaactcttttctttgcagttgtagagatgtcaattgacaccatcattctctcattctgccaagactctgaagagcatggaacagcacattatgctccaccgcttctcattgaaactctgggagaccaaaatgatatgcagagacttacacaaggaccccaatga

SEQ ID NO: 41855 - DNA, 285 bp, Glycine max
  Peptide Sequence Number=SeqID_158633
gtatctccgcgtatcatgtgtgcagaatacaccaaacttggtctctgcgtgccattggacacgactgtgtctgaatggcaaaggggtgcggataaccgtaagaatgaccagacttggtctctgcttgccatcggacacaactgtgtctgcctagcaaaggggggtgcggataaccgtaagaatgaccaaacttggtctctgcttgccatcggacacaactgtgtctgcctagcaaaggggggtgcggataaccgtaaggtatctccgcgtatcaccagctcttga

SEQ ID NO: 41856 - DNA, 141 bp, Glycine max
  Peptide Sequence Number=SeqID_158634
atgctgccgctgaaaattgcttccagtggcggcaaatggtggccagaggaattggataagggagttgctgggagggtgcatggatctagtgtggactatactatgaaaaagatatttcagaagctgtttctcaagagctga

SEQ ID NO: 41857 - DNA, 1239 bp, Glycine max
  Peptide Sequence Number=SeqID_158635
atgccaaatagaggttctgttttacgttctttgtgtttatcccccctcattgtatcccaaaaggccaaagtacgcagaaacaatggccaaaagtctccaacaaaaccaaaggcagcacaacttgataggattagcagtctgcctgatgaaataatttgccatatcctttcattcctcccaaccatagaggctgttactactagtgttttgtccaccaggtggagatcactttggactttggtccttactcttgattttgatgacaattggccttgcttcttcaacacaacctttgcttccgtttttggcagtatcttagctcaacgcaaagcaaaatgcatcaaaaggctttgtctatataactatagcaaacccttcagcttagacttgattggctcattggtttccactgccgtggcccaaaaccttgaggagatggacctcatttgcaactattattttgaggttactttgcccaacacacttttcacttgcaaaaccatttcagttctgaagttatcacttgggttgacaatcaatctaaataacatttcatcaattcatcttccttcactcaaggttttgcatgtcgatgtgctttaccttgtagatgatgaatccataatgaggcttttttctgggtgtcctgttcttgaagaactttgttatgaggaagtgaagtctaataattcaacctcgtttaaaatatgtgtgccttcactgaagaagttacatcttaagtgtcatgataaaagagtgcaggtagtcaccccttctctcgagtaccttcaagtgcaggaaactaaagtccgtgactctttggttggtaacttgcctaacctgttacaagcacatgctgatatctattttgaccagcatgaaaaagagtatgtgtttaactttttcaatgcaattcgtcaaactaaatttttggggctgtctacttatacaatagaggctctaactgatgctagctttggatttccagaatttcacaatttggttcatctacagctttgtttaagtacaattgactcttgttctctaatacaattgttacttgctagatgccccaagcttgaaattcttgacattgataaggtttatgggaaagtgaaaaaaagtggaaacagcccactgcaccagttcctaattgtattaactcacatcttacggcgtttaaatttaaaaagtatgggggctcccaatacgagttggaacttacaaagtatattctaa

SEQ ID NO: 41858 - DNA, 123 bp, Glycine max
  Peptide Sequence Number=SeqID_158636
atgttgaatgttaacggaattgggaaaatgaaaggtatagcatttattaaagatcctgatggatactggattgaaatctttgatcgaaaaacaataggaaatgtaacacaagctcccgcttag

SEQ ID NO: 41859 - DNA, 489 bp, Glycine max
  Peptide Sequence Number=SeqID_158637
atgggcactttagctacactttacgtccaggaaagcatgaccaaacgaccagagttcactgcatggttggcagaagtaaagcaggtgaatctggagaatatgtccaattgggaagaaaaacagatgttcaaagaattcatggaggatcacaacacagctacctttccttccaaaaagtactacaatcttgatgcttactacaggcgtgaaatggaaaaggagatgaaaaaaggttttaagaaggtccaggcaacagagcgcactattttcaatgatgaagaacagcgcaggcaagaattgttgcaagctcgtgaaaagcataaggaagagcaagtgatggcgttgaagcactctatgcaaactggaatggcacaggcaatgaaagagcaagctcaacttagggaggagatggcttaccagtacaagcttggaaactttgaggctgctgctgctatccagagaaggttggatcctgatgctgccatatag

SEQ ID NO: 41860 - DNA, 984 bp, Glycine max
  Peptide Sequence Number=SeqID_158638
atggagatggcggggccggtgacgcagggggacacggcggcgctactatactcctcgggaacgaccggattgagcaagggagtggtgctgacgcaccggaacttcatcgcggcgtcggtgatgatcggcatggacgacgacatcgccggggagcaaaacgacgtgtacctgtgcgttctgccgatgtttcacgcattcgggctggcagtggtgacgtacgcggcgctgcagcgagggagcgcggtggtggttatggggagattcgagctgaaggcgcttctgagggcggttgagaagcactgggtgacgaagctgtggctcgtgcctccgatcctgctagctctggcgaaacagagcgtgggttatggtatgacagaaacttgtggcattgtttctttggagaatccaagagtaggggttcgtcatactggctcaacgggaacgctaggttcaggagtcgaagctcaaatagtgagtgtggatacacagaagcctctccctcctagacagttgggagagatatgggtgcggggacctaacatgatgcaagtggatcaatggattttgtctcagaattcgtgcataacaagttggaccggaaattgcagttgtaaaattatgtttgaggcaaaagacttacattggaatgcgtgctataatactgtaaatcaagcatgcactaaaaccattagccatggagatcttggatattttgatgaagatggacaactttatgtggttgaccgtatcaaagaactgatcaagtacaaaggttttcaggttgcaccagcagaacttgaagggcttctcgtttctcaccctgaaatactagaggctgttgttgtcccgaattcacacttgagttacttcctttgcaatagatatcctgatgatgaggctggtgaggttccaattgcctatgttgttcgctcacccaatagttcgctgactgaagaagaaattcagaagtttattgctaagcag

SEQ ID NO: 41861 - DNA, 153 bp, Glycine max
  Peptide Sequence Number=SeqID_158639
atggtgaaatacgtgagaaatgggagggagggtgaagaaatgggcttgagaaccctgccttcttcactctacagtgtctccgctgctgctgtgttggtcagttttcccactggtgagggcagtgccattggcccttggacattttctaattaa

SEQ ID NO: 41862 - DNA, 165 bp, Glycine max
  Peptide Sequence Number=SeqID_158640
atggtggttttggaagatgacttgctagagggtgtgccaaaggagagtgaaggaaaggttatgaaaaagaatgatggacctgtagtccctctctctggtgaggagaccttatgttgtggcgaggaggattacaaatttgtcatgtttgaggtccctcgatggtga

SEQ ID NO: 41863 - DNA, 560 bp, Glycine max
  Peptide Sequence Number=SeqID_158641
gactgcacctcctcgccttcagaaggctgcacgccctcgccttagaggactacatgtcctcgcattcagacggctgcacgccctcgcctttagagggctacatgccctcgcctttagaggactccacgtcctcgccatcagaggactgcatgtcctccccttccaagggctacacgccctcgccttaagaggactatatgtcctcctcttcagagggcaacacaccctcgccttcgtagggctatacggcctcaccttcagaggactatacgtcctcccctttagaggactacacgtcctcgccataagagggctgcacgccctcgccttagaggactacacagggctacacgtcctcgccttcatacggctatgcgccctcacctttagaggactatacgtcctcgccttcagaggtctatacatcctcgccatcagaggattacatgtccttacctttagagggcagcacgacctcgccttcagaggactacacgtcctcaccttcagaggactacacgtcttcaccttcagaaggctacacgcccttaccttgaaag

SEQ ID NO: 41864 - DNA, 345 bp, Glycine max
  Peptide Sequence Number=SeqID_158642
atgaaacactttgtattattggatattgcagttgctcccgttactgatgcaaattggcaatcacttgtgattgaatccgagtctcctgtactggttgaattctgggctccatggtgtggtccctgccgtatgatccacccgataattgacgagctggcaaaagaatatactggtaagctaaagtgctacaaactcaatactgatgagagcccttcaactgctactaagtacgggatacgaagtatcccaactgtcattattttcaagaatggtgagaagaaagatacagttataggagctgtgcccaagacaacattgacctcaagcattgaaaaattcttgtga

SEQ ID NO: 41865 - DNA, 999 bp, Glycine max
  Peptide Sequence Number=SeqID_158643
atgttaacatatcattctgatacgattggcgaatgctatgcctatcctagatccattaaacaggtcacccaccatgttatccatgcaccaagcccaatagtgttgggtgtgaagggttttgatatagacaatggacccaaagcagctgagtatatccaggaagcagtggttaagtggccaccactaaggcccttgtgtttgattttgaaagtatttttgcagcaaagagaactaaatgaggtatattctggtgggattggttcttatgccctccttaccatgctgatggcaatgttgcggaatcttcgcctgagccaagcttctgctgagcacaacctgggagttcttttggttcatttttttgatttctatggacgcaaattgaacacctcagatgttggtgtgtcgtgtaatgggacaggcacctttttcgtgaagagtagtaaagggtttttaaacagaggacgaccaagtcttattgccattgaggatccacaggcaccagagaatgacattgggaagaactcctttaattatttccaggttaggtcagctttttcaatggctttaaaaaatttgacagatgccaagatcatcacgagcctgggacctaacaggagcattctcggcactataattagaccagatcctgtcttgctggagcgtaaaggcgggttgaacggggatgtgacttttgataagttgcttcctggtgctggtgagccgttacaacaacaatatggagatgaggatatgttatgcaattggcagttagattatgaagaagaaccactaccgcgcggagtcaacaccagtgcagagcctagcacgcgttcttcaacaaagaagagaaaatcttcgtcaaagaagtccagtaagaagctaaaggaaaatggggatttacagatggtcaggaacgaagagaatgactctagaaaagaaaacagtaaaaagaagagaagaaagaaaaaaacacaccaaggtgacagcggttattag

SEQ ID NO: 41866 - DNA, 429 bp, Glycine max
  Peptide Sequence Number=SeqID_158644
atggaagaagaacaagaaccaaagctgatccatggctccaaggccatgcgcatgcacactcctactcccaatcctaacccttcccaaacaatcatgagattggcctcacttgcgatcagcttcaacgtgcggttgaaatcatcccacatgcctcttcacatgcaggaacatgctctgcgccacactagatcacttttcctccttcaccaccctccttctccaaagccatccaacactctcattgctagagctctcaaaaaggagtttgactcgaagtatggattggcgtggcactgcgtgatagggaatagtttcgggtcgtttgtgagtcacacaggtggaggcttcatctacttctcaattgactcactttctgttcttctcttcaaaaccgaggttcacttggtcacgcaaccacctcctacttaa

SEQ ID NO: 41867 - DNA, 258 bp, Glycine max
  Peptide Sequence Number=SeqID_158645
atggccaccgtgcaactccaatccctaacccttgttcgctcctcagcacttccttccgccaccttctcccctccgatcgccgtctccggccgccgcaactccgccgcgctgccgcgctactccggcctccggctccgacccgccgctgagaccagtttcccgactcacgccagctcgagaaccgcttctcgcggcggaggtgtcaagtgcgaggcaggagacaccgctgttgaagtcattgagcattttgatgagtga

SEQ ID NO: 41868 - DNA, 603 bp, Glycine max
  Peptide Sequence Number=SeqID_158646
atggaggaagagcaggagcttaagatccccgaaaccatcatctacgacactatcggtcccctcgctctctcagccgtcgacgattctccactttccgaccacctcgaacccatcgccgttttccgcaacgagatttccctcgaaacgccccaacgcgcctcgcccgcctccgccgccgtcgatttcttctcccttgatgtcgccgccgacgcctccgcccgcgaccccttccctgagttgctcgccgctgcccccgaaccgatgacgccagctcccgcgcccgagccaaagctcgagagtggctggttccacgggaattgcaaattcaagagtcccatgcttcaactgcataaggattatcaagctaaattttcgctacttttgttggagaataacacacatagcacatacggaacacaaattagatacagtttcctagagatagtggacttttgtgcgtttttgtcgccaactgcagaagagaaagctgcacgagacttggctatagagtctgtgtttggagttgtaaaacatatatggcctcactgccaggtggaggtgttcgggtctttcaggacagtggctgtatcttccgacaagtga

SEQ ID NO: 41869 - DNA, 2778 bp, Glycine max
  Peptide Sequence Number=SeqID_158647
atggattctcttctctccatcctcttctttcttctcactctatcttctctcaacccttcctttgcttcacaaccctcttaccaagaccactgtggctccatagttccagagtcaactcccaatgaaaacactcacaattcttccccttttgatgatcatcaaagaggttacttcacaggtggtgatagcatcatcgatggtggaacttccttaaaccaatactttgacctccaaccaatgtacatacgtgcaaccaagttctctgacttgttcaatgttgaagccactgtttcactcacatccagcatatcttactactggaactcaagccatggtgacagcttaagatatgaacggaaacgccgctaccgtagaaaccatgtgtacttcaagcttgaagggttctggtctgagtcttcagggaaggcttgcatggtagggaaaggaaatggttattctaagacaggtaagcatcttaatttggatgctgtgtttaagcttgataaggttttcagtgcaagcaatatcactagcttggttaatggaagcttggagagcttgagttctccaaaggatgagagctacttcgaacccatttctgtggtgatgtttccaaaagcaaattacaaatataccttgaattccacagaagttaccaatgagttctcttctgggagtgatgctatgaagggtggtttgtcattgagttcattgagtttttgttctcgtcccctctcaagggctattagaaggctcccattagagttctctcctgagtgcaattcttcaaagaactgcactccttttagtgagaattctggtccactgccatttctagtgtctttgaaaggcattgagtgttccatttctaacaacaagcataggttgcggattctggtgaggtttttgaatactagtaactattggattagccagagtttcaatcctaaaactatgttggtaggagagggatggtgggatgagaagaaaaacatgttgtgtgtagtggcttgtcatatcatagaatcatccttggctggcacgcatgtgggtgattgctcaataagactaagattgagattcccctcaacttggtcaatcaacagcactagtagcatagttggccaaatttggagcaacaagagtactaatgattcaggctacttcaagaagataacatttagaaatgaagatgatggtagtgtgggaattcaagctacaaagtatgagtatagcctactagacagagctaagaagtcatgcccagcacccaagcctgtgaagaacaaggagaaaagatatccagatgccaattcttatgacatgagatttgacatggcagttagagagtccaacaaaagagtagcatggggttattcatctcccttggctgttggtggtgagatctctaccatagatcagatctcaagctccattacagtggactctacctttgatcagaatgtctcaagctccattgtagaatctcctgaggtagtactccacagtggtggcttgtttaacatcagctacaaaatctcactgtggcctaattcaacctcaaatgataagaattccctgcttaatcattcctctgggtcagtgaggatttctgctgaaggaatttatgattctggagaaggaagcttgtgtatgataggctgccgcgatcttcacttgaactctctcacaccaacagctcattctgtggattgtgagattgtggtgaagtttcagctaccaccattagatgaaagaagtggaatctacatcaagggaagcatcgaaagcacacgcaaaaagtcagattctctatacttcaaacctttggagttatcttcagctgcattttacactgaagcagcagaaaaattagtttggagaatggatatggagaccatcatggttctgatatctaccactctagcatctgtttttgtgggattgcagctttaccatgtgaagagacaccccaatgtgctccccttgctctcacttgttatgatggcaatgcttactttgggatacatgataccccttgttctgaactttgaggcacttattgctcaaaatcctaacaacaaaaactttgtgtttggaaatgttgtgtggcttgaagtgaatgaaatagctgtgaggctaatcaccatggtggctttcttgttgcaattccgactccttcagctaacttggtcatcaagaaagagtgatgaaagcaataaaggcctttggattgctgagagaaaggctacttgtgtcactttagccttgtacgctgctggtttattgattgcattgctgttgaagttgaagaaagatggagatgcggttcctgtcattactccattgaaccaacaccattcatcttgggagaacataaaatcttatggcggtttggtattggatggttttctcttgccacaaatcattctaaacctgttctcgaacatgaggggcaacgttctttcatgttctttttactttggaaccacttttgtgagactgttgccacatgcttatgatctttacaggactcataattatgctcgcgtagatagtggatcatacttctatgcagatccaagtgcagatttttactccactgcttgggatattgtgattccattgggaggtgtcctgcttgctatcattatctacttgcagcaacgttttggcgctcattgtattcttcctcaaagattcaaagggtctaaggtatatgaaaaggttcctgtggttgctgaatcagaagctgaagtagagaccgccaacttgtaa

SEQ ID NO: 41870 - DNA, 561 bp, Glycine max
  Peptide Sequence Number=SeqID_158648
atggccgagttcacagaattgtttccattgggcgaacaatttgatggtttgatgcacgtgtatgtgtatgtcatcacatttgatcttccaactctattcattgttctattcatactcacagtgttgttcttcatcttgtatcgaattctcaacggtttgttcttctggttattggaaatgaggccaattgaacatgatattgaagagggtaatactaatactcatttagccaattatggggaaactgagccatctcaccattttacaatatttcatgcccttgtgcatccttgggcattggtgactgcatttgaaggagcttttaatgagaaaagaggacaaagacttagagcttccaagaaattgccccctttggtgaattatggaaagcatggtgtcacaagaagttgtggtgaggaatgtgccatttgcatggaagaattcaaagttagtcaattgtgtcaagtttttcccgagtgcaagcacatttttcattctgattgcatagaccactggttgcagaagaaactaacttgcccaatatgtcgtagttgtatatag

SEQ ID NO: 41871 - DNA, 1077 bp, Glycine max
  Peptide Sequence Number=SeqID_158649
atgaacctatttcttgaacagcctcccaagaattgggctaaaaaaatccaggaagagtggaggattttggagaaggatttgccagcttcaatatttgtcagagtttatgaatcaaggatggatcttttaagggctgtgattattggagcagaagggactccttatcatgatggccttttcttttttgatgttttctttcccagtgcctatcccaatgtaccgccgaaagtccactaccactctggaggtcttcggctcaacccaaatttgtatgcttgtggcaaagtatgccttagtctacttaacacctggtccggcagcaaaaatgagaagtgggttccaggcatgtcaacaattctccaggttctggtatctatacaaggtctaatcctgaatactaagccttactttaatgaacctggatatgcacacatgagtggttcagcaaatggtgaaaagatgtcttttcagtataatgaggacacattcattctatcattgaggacaatgatgtatatgatacgaaagcctccaaagggaggaaggaaggggtggggggcaattaaagaagcaatgccaaggcatgcttttgcctttcagtggaagaatttcgaggaccttgttaaggggcatttctgcaaccgagctagcgatattctggtggcatgtaaggcatacatggaaggtgctcaagttgggtgtttggtcaaaggaggggttcaggacgttgatgagggagacagaagctgctcacagcagttcaaggattctttatccggatatatgaacatgcttgtcaaagaatttgctaaagttggagcaaaggacattgataaattgctgcctccagcaacaactccagtagcgatcaaaccatcagtgtttatgtgtgatggtaatgataatgataacaatgatgatgtcatcattagtagcgatgatagagatattagtgatggttgcgatgacactaacaatgacaatgataatggtggtgtggataatgatgttagtggtgacgatggtgacaatgacaatggtgttggtggtgacaccaagtggtggtactggttgtga

SEQ ID NO: 41872 - DNA, 192 bp, Glycine max
  Peptide Sequence Number=SeqID_158650
atggtaaagggaagaaaaccttttgttttgaatgagaaattgaaaggtattaaaggagctctaaaggaatggtctaaacaacacggtgaggattttgatgggaggattgtggaagcaaacaaggaggtcgatgatattgataagctgggagaattacaagatctggttgataagcagcataatagaaggtaa

SEQ ID NO: 41873 - DNA, 816 bp, Glycine max
  Peptide Sequence Number=SeqID_158651
atggagagcgttggggatgcagagcttgctaaagggaagatgttcaccaccaaagacatcggccaggcattgaaagactccttccgtgggatagaactggcaaaccctaaactgcatggcatttttggcgatgccagctggaccaataaagaacgcctttctgatgagttgctggttacgttactcaatcacttcaacaaggtgaatctcggcgttgccagtgtccgtgatgatgatatggggcgcgcatacgagtacctgatcaaacgttttgctgataaagctaacaagaaagctggtgagttctacaccccacgtactattgttcgcttgatggttaacattcttgatccaaaagctggtgagagtgtctacgatcccgcctgtggtacaggtggtatgctgcttgaaactatccaccatgtaaaagaaaacggtggcgacccgcgcttgctaaaaattaaaggtcaggaaaaaaacctgactaccgaagccatcgcgagaatgaacctgttcctgcacggtcaggaggatttcgatattgttcgcggggatacgctccgtgaacctaagtttttacaaagcgatcgtttagaaaccttcgactgcgttgttgccaacccaccatttagcttgaaggaatggggatacgatctgtggtcgaacgatccctatggccgtaagcaatatggtctggcgcctaaaacaaatggtgattttgcctgggtgcagcatatgtttgcttcacttaacggcaatggacgtatggctgtcgtgttacctcatggagtgctgtttcgtggcggcgtagaggga

SEQ ID NO: 41874 - DNA, 2595 bp, Glycine max
  Peptide Sequence Number=SeqID_158652
atggcatcattggtagccagtggtagcagtcaaatggctccggctgatccacctttaggtgaaccaaataagattattcctttacctcaacatgaaagcctcagctatgagttttctgctgaaaagtttgaaataaccccaggtcatggacaagttagtgcttctggcatgtgcagtgtaagccaagatcattctgatgcgttgaagcttgaccttggattgtctagtcctgtagcttcatctgatgtcaggattagccaaccaaaggaggaacttgaggtagatgaattccatgatgccgattggagtgatctcactgaagcccaattggaagaacttgttctgagcaatttggacaccattttcaagagtgcaattaaaaaaattgttgcgtgtggctacattgaagacgttgctacaaaggccatcttaaggtctggcatttgttatggatgtaaagatgctgtgtctaatgtagttgacaatggtttagcatttcttagaaatggccaagagattaatccttcacgagagcattattttgaagatttagtgcaactagagaagtatattttggctgaattggtctgtgttcttcgagaggttaggccattgttcagtaccggggatgcaatgtggcgtttgctaatttgtgacatgaacgtgtcacttgcttgtgcaatggatggtgacccttcaagcagtttaggtagtgatggcattgctgatggctgttcttctgttcagactgaatcacagtcaaaattagaaacaaaaggtcctgaattgagtcttccaagtccttgtaaatcagtctcctcaggttctcaacctaagaaatcctctgtggaaggaaatactggtttggacaagtcaaagaattctcaaattcttgttggaccatcggagaaagaggctgcaaattctggacgtgattctattgataaatcatctagtacttctgggacatctcaatctcctttggtggaagaaaagtgtggaaatattagaaaggtccattccagtagcactaagagagactacattcttcgacaaaagtcattccacatggaaaaaggctatcgaacatatgggtctaaagggtcttcaagaggaggaagactgaatggtttaaatggattaatcttggataaaaaacttaaatctgtatctgagcctactaccataaacttaaagagtgcatccataaacataagtaaggcaatgggagttgatgtgacacaagacaatttaaatgctgatttttcatctaatgatggaccatcaacccccactgcatttagtctggattctactgttactgtttctcggtcaaccaacactttatcttcagtgcacgatggaaatatacctgcagttggtagctcaaacgtattatcagctacagatactaatctttctctttctttgtcttcaaatagtaagtctcctacaacacctgtctgctgcaataataagccacctaatagtagttgtatggggatactgcatgacaggtccctggggaagtggataccccaagatagaaaggatgagatgattttgaagctagttccaagggttcaggagctgcaaaatcagcttcaagaatggacagagtgggcaaatcagaaggttatgcaggcagctcgtcggctgtgtaaggataaggctgagcttaagacattgagacaagagaaagatgaagttgaacgtcttaaaaaagaaaaacaatctctagaggaaaacactatgaagaagatttctgagatggaaaatgccttgtctaaagcaagtgcacaggtagaacgaaccaatgctgatgtccggaaatttgaggtggaaaatgctgcactgaggaaagagatggaggctgctaagttacgagcggcagaatcagccacaagctatcaagaggtctcaaggagggaaaagaagacccaaatgaagtttcaatcatgggagaagcagaaatccttgtttcaggaagagctaatgactgaaaaacacaaattggctcagttgcagcaagaattagagcaagctaaagtgcaacagcagcaagttgaggcagcaaaggcaaaagaagaactcctcctgcaggccagttctataagaaaagaaagggaacaaattgaggagtcagcaaaatcaaaggaggacatgatcaaactaaaagcagaggagaatctgcacaggtacagaaatggcatccagaaacttgaaaaggaaattgtgcaactgaggcagaagaccgactcttccaaaattgctgcactgagaaggggaattgatggaaactatgccagcagctgtatggacatgaaaggcacggctctgagagaatcgcaggccacttttatctcagaactggtttcaaatttaaatgactgctctttgatagggggtgtaaaacgggaaagagaatgtgtcatgtgcctttctgcggagatgtctgttgtattcctcccatgtgctcatcaggtagtttgcacaacatgcaatgagctccatgagaaacaaggaatgcaagactgtccttcttgcaggagccccatccagaggcgtatttttgttcgttttgcccgtacataa

SEQ ID NO: 41875 - DNA, 1473 bp, Glycine max
  Peptide Sequence Number=SeqID_158653
atgtttggtgtcattagaagaaaactccggcacctttattcaaggatattgtggctactatggaagcgccccaggtctaaagttgttatcaaaaggtttagaaaattgaactttaagggtcaccataaagcagaattgtgtaaaaacaaatctacaagtgacccaaatggcctcttagttgagtctcaatctggaagggctattaggattgctacattcaatgtagcaatgttttcacttgcacctgctgtttcagaatttaatgaatgggttgtctccaatcatgagaatggatctaacaagaagagtcttcttgcaaagggtgattttcctaagagtatattaaagcaatctccattgcatgcctctctggacaaggctcagagtctttctgactccgagattctgccacgttcgaatttgaaggtttctatcaatctccctgacaatgagatttcattggcaaatagtagattgcttgcttcaatagagagcaaagagggcacatcagatacaattatgggaaatgtttctggcaggcatcaagttccagcaaggtctcctgtgtgctttcctttcattatgaattactgtgagggcactgagagattcacatgcagcagaagcatcctggaagtcctgagagagattgatgctgatgtgctggccctgcaggatgtgaaggcagaggaagagaagaacatgaagcctctttctgatttggcagctgccttggggatgaaatatgtgtttgctgaaagttgggctccagaatatggaaatgccatcttgtccaaatggccaattaagaagtggagagttcagaagattgctgatgatgatgatttcaggaatgttttgaaggctacagttgatgtgccctgggcaggagaaataaattttcactctactcaacttgaccacttagatgagaattggagaatgaagcaagtacatgcaataattcgctccaatgaccctcctcatatcttggcaggaggtctaaattctctatatggagcagattactcatcagagagatggacagacatttttaagtattatgagaaacttggaaagcctaggccaaggtcagaagtgatgaacttcgtgaaatcaaaaggctatgttgatgcaaaggattatgcaggagaatgcgagcccattgcaatcattgccaaaggccaaaatgtgcaggggacatgcaagtatggcacaagagtggattacattttggcttccccaaactcacactacaaatatgtaccagggtcctactcagtcatttcatctaaaggaacttctgatcaccatatagtgaaagtggacattatgaaagtaaatgcatctgctcagaaaaatgccattagacagtgcaggaaactaaagaggaaagttgtgaaaataacaccaccatgttctgcaacaggtgtaagggaatcaaccccacctcccaaaatatttgtgccataa

SEQ ID NO: 41876 - DNA, 1536 bp, Glycine max
  Peptide Sequence Number=SeqID_158654
atggtgtgtttttggtattgtgatgaactaggtggaaacatcactagtgaaattgaagatacgcgatcttatgccattactaggtatgaatttttaaaacctcgtggagtaatagaagataagccacaggatagtaattcttctagggtgttctcattgacgagtagacatagaagtacagctaggcctcctcctgctcctaattcactgtccttgtccaagtctaaaagaaaaatgggatattttcctacttggggacatcgttgtgaccattttgcatttcctcctcctccaccagctgatagaagacgacctggaccacgcccatgccctgtgtgttatattccagtgaagcaagctatagctagtatgccaggttccccatcagaatctcctatacttcgcactttgacatatgtgcatgatgaaaatccaattgaaggtgaaccacatggtggctctgattttggtggatacccttctctggaagaaagggatgctgcttttgatataaaagagaccatgaaagtgcactgtggatttgtcaaaggaagcagacctggtcgccagacaggatttgattttgatgaggcggatctcttagagttggatcagtaccatgatgtcattgttgcatctgccatatttggaaactatgatgtgatacagcagcccaggaacatcagtttagaagcaaagaaaaacattcctttctatatgtttattgatgaagaaacagaaatgtatatgaagaatgccagtattttgagtagcagcaggagagttggattatggagaatcatcattgtccgtaatattccttatgctgattctcggcgtaacggaaaggttccaaagcttcttttacacaggatcttccccaatgtccgctattcaatatggattgatgggaagcttgagcttgttgtggacccatataaagttattgaaaggttcttgtggcgccaaaatgctacttttgcaatttcaagacactatagacgctttgatgtatttgttgaggccgaggctaataaagctgcagggaaatatgaaaatgcttccattgatcaccaaattcaattttataaataccacgacggtttaactcattattccaggactaagcttcctataactagtgatgttcctgaaggttgtgttatcataagagaacacattccaattacaaatctctttacttgcttatggttcaatgaagttgatcgcttcacttccagggatcagttaagcttttccacagtaagagacaaaataatggcaaaaactgattggagtattagcatgtttttggattgtgaaagacgtaactttgtgatacaggcttaccatagagacatattggagcaaatgcctcctccagctgctgtaacctggcgtcctggtccacccacttatactaatcggcctcagatgaggaatcatcctaggcgtgggagaggagacaggagatcaggttcaaagcatcatcatagagttgtaggcactgttcatatgaaccacattttgatttag

SEQ ID NO: 41877 - DNA, 417 bp, Glycine max
  Peptide Sequence Number=SeqID_158655
atgagtactgcttatcatcctcaaacatatgggcagacggaagtagctaatcgatgcttagaagcgtgtttgaggggtgggcaatggaattcaggaggacagtgccataaagaaactgagccaatattcaatgaagcttacttacaaagatatccttcaaaaatgttggctctcgaacatgtcatccaacaaatgaaagcccgagtagtatatatgaacataagtaggcttacagattacagaaaagatggacatccttcagtatacagaacggggtataaggcatcaatgaatcataacactgctgcactattcgaagattgcagccattggtgcttgcctggggtaccagatacttggaatgaattgctctatgtttctctcttaaaatatggaaagggaacatggaaaagctga

SEQ ID NO: 41878 - DNA, 945 bp, Glycine max
  Peptide Sequence Number=SeqID_158656
atgcatgttctttttaatgtgaagagagtagcgttctctgagtcctttctgtcacacagaagaaggcttttcacttggttcagtttaagtgtttcagcttctcttgttctggtgtccctctttcttctcagtaactccctcagggttcctaaagtttcagtctttgttccaaaacttgacgctgttggtgcaaactcttctattggtccttgccccttgttgcctttcaacactagccacactttttcctctgagagtaacacttttgacacttcaaagtcaaatgggtcagagagttctgtgcagagaattgaagagggaagtgttgctatggaaattcttcatggagtgaataatgtgtcaggtgaaaacattaagagtgttgcagaagggaggggtttggagaattctagtctttcttctaatttgttgccagagagtaacaatggaaaacaatcaaagcatgaagggggtttagatggggaaaagaatttaaagaatgtaactgtcactcataatgacgaaatgcatgttggtttatatgatgaaaaatgtgacatttttgatggaaagtgggtaagagatggttcaaagccacattatcctttagggtcttgtcgccttattgatcgagattttaattgtcaccgtaatgggaggcctgatgctgaatatgttaaatggaggtggcagccaaatgggtgcaaaattccaagtttgaatgcaactgattttctggagaggttgcgcgggcagaggctggttttcgtgggggattcactgaacaggaacatgtgggagtcacttgtatgcattctccgtcaaagcatcaagaacaagaagcgggtttttgaaatttctggaagaagggagtttaagaagaaaggtgtctatgcttttagatttgaggcaagtttccttgtcacttctatgttgtttatgtag

SEQ ID NO: 41879 - DNA, 375 bp, Glycine max
  Peptide Sequence Number=SeqID_158657
atgggagagcacatctccatagacgaaaatacaagctctctcacaagattgagatatgccagagccaggatcaaaacattgtgctttgaatccctcaacaaaatagtgaagctacaaatgaatgggttgataagagatttaagaatttatgaggagatggaaggtgatgaacaatattgttgttgtttcaaggagagaaaaaaaatcaacttttcagaggatgaatcgccaatttttggtatctcggaggaatggggaagttcaaatgcatctatcgataattttgaggaggagtatgaatggttaggtgggggatttccattcagaggagagatgccagaaatggctattgaaaatcttttctctcttgtttga

SEQ ID NO: 41880 - DNA, 228 bp, Glycine max
  Peptide Sequence Number=SeqID_158658
atggcttcacccctccccttttacattttttcacaacaatcatgctcgccaagacgagctggccactcgcccaggtgttatcgtgttcaattttacttaaacacttacgacaccccgttgatcgagccgaatggctccggatttagtgagcaagatcaagagggtatgttcttaaagacaataaaaagtaaaggacacaacactggaggtagagatgcaaatcattaa

SEQ ID NO: 41881 - DNA, 204 bp, Glycine max
  Peptide Sequence Number=SeqID_158659
atgcggggttacgttatggttacccgcacctttcgtcaaccaggggcaaacaagcccgtcgacgcacagagactaacgttgtctcctgcaccttttgtcgttctgactcgtgaagtcagcaagtcaggtggtaggcggagataccttatggttatccgcgcctttcgtcaaccgaggggaacgaattcgacggtatcaggatga

SEQ ID NO: 41882 - DNA, 225 bp, Glycine max
  Peptide Sequence Number=SeqID_158660
atggctatggtgaaccccaggaagatctatcaatctcccttcccccgatggtacaatcccaatgcaacctacgcctatcacggtggtgttccagggcattctatagagcagtgcatcgccttcaagcacaaggacggtctgaatgtgaggactaatccacttgctagtcatggaggctcgactgttaatgcagtggaagagtgggagcctcaggggctgaagtag

SEQ ID NO: 41883 - DNA, 405 bp, Glycine max
  Peptide Sequence Number=SeqID_158661
atgggctctaagtttcaacagtcaattcagagcgtttcgttatattccgggactcaatcagacatccgagtaagaagttatcgtcgtgtgaattggctcagagattcaacattcaattttgagcgtctcgttatattacgggactcattcagacatccgagtaaaaagttattgtcgtttgaattatctcagagtttcaacattaaatatcgagcgtctcaatatattacgggactcaatcagacatccgaagcatcaacattcaattttgagcgtctcgatatattacgggactcaatcagacatccgagtaaaaagttattgtcgtttgaattgggtcagaggttcaacattcaatttcgagcgtctcgttatattacgggactcaatcagacatccgagtaa

SEQ ID NO: 41884 - DNA, 282 bp, Glycine max
  Peptide Sequence Number=SeqID_158662
atggagaattggcgaacagcgctacgcaataacttcgcggggctccagactagaagggtctccgaaaaaagtggagaatggagaattggcggacaacgctatgcaataacttcgcgcggctctagactcgaaggtggaggacacatgaacagcgctaggcaattacattcatgggtctcccaaaaaagtaaagaatggagaattggcgaacagcgctacgcaataacttcccggggctccttactccaagggggaggacacatgaaaagccctcggcaatga

SEQ ID NO: 41885 - DNA, 1101 bp, Glycine max
  Peptide Sequence Number=SeqID_158663
atgggttgtgtccatggcaagtgctgtacccgttacccttcaccctcagtgggtggctccagagacttcagagaacttggcccttactgtgcccaaaggaagcacattctcactcagagttcactgcaatttgttcctgtcccttcccataacttcactttggaatactctgtgctcactcagagagggtactatcctgattcacctgataaagagaaccaagatagttttggcattaggacacagtttcaaggcaaccccagtgtccatttctttggtgtctatgatgggcatggcgaatttggtggccagtgttcaaattttgttaaggataggttggtggaaaatttgtcaagtgacattgcattgctggaggaccctgttaaggcctacacttctgcattcctgaccacaaatgatgacttgcataagaacgagattgatgattcgttgagcggcaccactgcaattacggtgctggttattgggaacaccctttatgttgctaatgttggtgattctagagccgtgctggctgttaaggatggaaaccgcgttgttgctgaggacttgtcctctgatcagacaccatttaggagagatgagtatgagagagtgaagctttgtggggcgagggtgttaagtgttgatcaggtggaagggcacaaggatccagatattcagacatggggtgatgaagagaatcagggtgatgatcctcctaggttgtgggttcagaatggaaagcttcctggagctgcttttacaaggagtgtaggggataagttggctgagactattggtgtcattgctgttcctgaggtgtcaacggttcagcttacacctaaccatcttttctttgttgttgcaagtgatggtgtatttgagttcctatcaagccaaactgttgttgatatgttatgttttttgcttgacaataccgttgaagatttttctgttctggcagcaagttattcagatccccgcgatgcatgtgctgccattgctggagagtcttataaactatggttagaacatgagggtcgaacagatgatataacaattatcattgttcagatcaaaggcctgtctaatgtatga

SEQ ID NO: 41886 - DNA, 223 bp, Glycine max
  Peptide Sequence Number=SeqID_158664
atgggttgcatgtgttgcaagccctctgccattgaagatagtaaggagagtccaagggagcgtttatcgagcaagtccgacaagtccgtgtcggacttgcgtgtgtctagggggacttcatcgaggagggaggaagccttctggctaaaggatagatatgataacaatgatggaagagctgcattaattgataagcaagggaatggttctgttagggtgcaag

SEQ ID NO: 41887 - DNA, 2694 bp, Glycine max
  Peptide Sequence Number=SeqID_158665
atggagccttctgggtctgcttttcagaattctggcagttctagggccttgaacagttctggagtctcagataggaaccaaagggttcattgtcctcaaaggaaccccttcttgggtgaggcatcccaggattcggggttcagaaaggaaagggataggtttctgttggctcaaggtggtcagcctaagaacttgggcggtggtttttcggggttgtgtgaggacgaggtggaggttgacccctttttctgtgctgtagaatggggtgatattagcttgaggcaatggttggataaacctgaacgatcggtgggtgccttcgaatgcttgcacatatttaggcaaatagtagagattgtcagtgtagcgcattctcaaggagttgtagttcacaatgtgaggccttcctgctttgtcatgtcctctttcaaccatatctcatttattgaatcagcatcttgttcagatactggatcggattctttgggagaaggattaaacaaccaaggcggtgaggttaaaactccaacatctctctgtccccatgatatgcctcagcagagtatgggaagtgaagattttatgcctgtcaagactttaaccacccctgctcagtcagattctagttgcatgttgtcgagtgccgtgtatgcggctcgtgcatcattgatagaagaaacagaagaaaataaaatgaaagataggagaaaggatgacgaagtagaaggaaagaagcaatcatttccaatgaaacagatactactaatggagatgagttggtacactagtcctgaagagggtgctggtgaatctagttcttgtgcttcagacgtttatcgattgggggttctcctttttgagctattttgtccgctcagctcaagagaagaaaagagtagaaccatgtctagccttagacacagagttcttcctccacagttacttctaaagtggcctaaagaagcttctttttgtttatggttactgcatcctgaccctagtggtcgtccaacactcggggagttgttgcagagcgacttccttaatgaacagagagatgatatggaagaacgtgaagcagcgatagagctgagacaaaggatagatgatcaggagttgctgttagaattccttttattacttcaacagagaaaacaggaagttgctgagaagttgcaacatactgtctcttttctgtgttcagatattgaagaagtgaccaagcagcacgttagatttaaagagattactggtgctgaactggggagtgatgagcattcagcatcaagtttcccatccatgacagttgttgatagtgagggttctgcttttctagggactagaaaacgagtcagactagggatggatgttaaaaacattgaggaatgtgtcgatgatgtaggggatgatcagaaaagtaacggaagttttctttcaaaaagttcacggctaatgaagaactttaagaaacttgagtcagcatactttttaacacgatgtagaccagcctattcctctgggaaactggcggttagacatccacctgtaacaagtgatggtagagggtctgttgtcatgactgaaagaagttgcatcaatgacttgaaatctaaagagcagtgcagggagggtgcgagtgcttggataaatccttttcttgagggtttgtgcaagtatttatcattcagtaagctaaaggttaaggctgacctaaagcaaggagatcttttgcattcttccaacctagtatgctcactcagctttgatcgtgatggagagtttttcgctactgccggtgtgaataagaaaattaaagtgtttgaatgtgattcaataataaatgaggatcgtgatatccactatccagttgtggagatggctagcaggtcaaagttaagcagtatatgttggaatacatatatcaaaagtcaaattgcttcaagcaactttgaaggtgttgtacagttatgggatgtaacaagaagtcaagtaatctctgaaatgagggagcatgagcggcgggtgtggtcaattgatttctcatcagcagacccaacaatgttagcaagtgggagcgatgacggttctgtcaagctatggagtatcaatcaggcaattccatttttgcacttgggagttagtgttggtaccatcaaaaccaaggcaaatgtttgctgcgttcagttccctctggattctgctcgttttcttgcttttggctcagcagatcaccgaatatattactatgatctacgcaacctaaaaatgccgctttgtactttagttggacataacaagactgtgagctacatcaagtttgtagacactgtgaaccttgtctctgcttccacagataacactttgaagctttgggatttgtctacatgtgcatctcgagttatagactcaccgattcaatcattcacgggtcatgcgaatgttaagaactttgtggggttatcagtatctgatggttacattgccactggttcagagacaaatgaggtgttcatataccacaaagccttctccatgccagcattgtcattcaagtttcagaacacagaccctctttccggtaatgaagtggacgacgctgcgcagtttgtgtcctcggtttgctggcgcggccagtcgtccaccttgctcgctgcaaattccacagggaatgtcaaaattctggagatggtttaa

SEQ ID NO: 41888 - DNA, 939 bp, Glycine max
  Peptide Sequence Number=SeqID_158666
atgaatgatgactggtggtacaagcaactgagcaagtggcgcaacctggtgatgagtggtaagactgaagagtgccaacatgttgttcgcatgttgatcttggaaaaagaggcttcatatgcagttgagtttgagaaaagaggtgtactgggtgataacaaagcagtattcatgaattctttcgccacttttgagctgctagttcatgcagcttctggtgtaagccagacagtacaagctctaaagggagaagttgacttgttactcaagggagtaggagaaagaagtgtaatgaaagaagtaaaacatatccttgagatggctagacgagcatcattaaagcgagagattctccatacatattttctaacccctccagtgctaaaggaatatatgcaagttttggaaaaactagcagatgtgaaagcaattgctcaaggaggttaccctcaggctgaatgttgtcggatttctgttggacatccagaagaactggccagtgatccagatattatttcagcattaagtcctccagcagaacatattcatattttatatctgattgaggaacagttacaacggtcagctaaggctgttggggaacagggtgctcagataattgttgtacctgaactcgttgaatttctcatgtcaacactggttaaggttcgtaatgttcctgcatcttgcaccaagattccattaatttctcttgattatgaaccaccaagtgctggatttaaagtttctcgttcaaagctagttgacatgatcagcaatggtgatgtgcgtatcaactggatccatgttactaccaaaggaaccacactcaagagtggagatattgtatcagttagtggcaagggaagattaaagataggagaaataaactcctcaaagaaaggaaagtttgcagtggagctcattcagtatttgtag

SEQ ID NO: 41889 - DNA, 162 bp, Glycine max
  Peptide Sequence Number=SeqID_158667
atggaaatgcgaagaattgcattgcgcttacccagagagatgaagatggcgacgatggtggagagggagatcgcagaaccgatgcacgcaaaaactctaacccttggcaaaggtgacactcgagaaggagcttctgggtttagggttttgagtgatgaatag

SEQ ID NO: 41890 - DNA, 264 bp, Glycine max
  Peptide Sequence Number=SeqID_158668
atggggttagcacgaacaagggaagagaccttcttttctgctgcaagaaccattgtcgcaatgttcttagtgacaagaacaactgcagggtgtgtggcaacaagtgcaagcaaggagaaagatgctgtaatggggtttgtaccaatgtgttgtccaatgcacgacactgtggcaagtgcaacaagcagtgctcacctggagattcatgtgggaatggggtttaaggctatgcatgaaactgatgcaagaaagttaatgaaaaag

SEQ ID NO: 41891 - DNA, 2064 bp, Glycine max
  Peptide Sequence Number=SeqID_158669
atgaccctctctgttagagcctcctcaaaacccttcttaaccctcaatgaagcgcgcttcctcttccccttttccttcttcagcttcagcacgcttcagtacaacaacaagtttctgtttcatgccgcggtcgccgaaccgaaattactggtccgggttcttaacacggtccggaaccgccctgtggtcgcgctccggttcttccgctgggccgagaggcaaaccggtttcaagcgatccgaaatttcctactccgtcatcctcgacattctcgcgcggaacggcttgatgcgctccgcctattgcgtcatggagaaggtcgtctctgttaaaatggagaacggcgtcattgatgtcgtttcttcctccgaggtatcaatgccatcggttaagcttattctcgatttgttgctttggatttacgtgaaaaaatcgctgcttgagaagtgcctgttagtgttttataagatggttagtaagggactgttgcctgacgtcaagaattgcaatagggttcttagattgcttagggatagggataataacatcgacgttgcgagggaggtttataatgtgatggtggagtgtggaatttgccctaccgttgttacttataacacaatgttggattccttttgcaagaaagggatggttcaggaagctctgcagcttttgtttcagatgcaggcgatggggtgttcgcccaacgatgtcacgtataatgttttggtgaatggtttgtctcacagtggggagatggagcaggccaaggagctgatccaggatatgttgagattggggctcgaggtttccgtgtacacgtatgaccccttgattcgcggatactgcgagaaagggcagattgaggaagcctcgaggcttggggaggagatgttgagtagaggagctgtgcctactgtggtgacctacaatacgattatgtatggcctttgcaagtgggggagagtgagtgatgctaggaagttgcttgatgttatggtgaataagaatctgatgccggatttggtttcgtataacactctgatttatggttacaccagattgggaaacataggggaggcttttctcttgtttgccgagttaagatacagaagtcttgctcccagtgttgtgacctataatacacttatcgacggtctttgcagattgggggacttggatgttgccatgcggctaaaagatgaaatgatcaaacatgggcctgatcctgatgtatttacttttacgacttttgttagaggattttgcaagatggggaacttgccaatggctaaggaattatttgatgagatgcttaatagaggattgcagccagatcgttttgcgtacataacccgaatagtaggtgagctgaagcttggcgacccatctaaggcttttggtatgcaagaagaaatgctagccagaggctttcctcctgatttgatcacttataatgtcttcattgatggtctccacaagttgggcaatttgaaagaagcaagtgaacttgtgaagaaaatgctctacaatggacttgttccagatcatgtaacatatactagcatcatccatgctcacttgatggctgggcatcttaggaaggctagagcattgttccttgagatgttgagcaaagggatatttccttcagttgtcacttacactgttcttattcattcatatgcagttaggggaaggctgaaacttgctattttgcacttttttgagatgcatgagaagggtgtacatccaaatgtgatcacctacaatgctttaatcaatggactttgcaaggtgagaaagatggatcaggcatacaatttttttgcagaaatgcaagcaaagggcatttctccaaataagtatacttacactattttaataaatgagaactgcaacctgggccattggcaggaagctttgaggttgtataaggatatgctagatagagaaattcagcctgattcatgcacacatcgttctctattgaagcatctaaacaaagactataaattgcatgtagttcggcatcttgagaatgttattgcagctggtgaataa

SEQ ID NO: 41892 - DNA, 4500 bp, Glycine max
  Peptide Sequence Number=SeqID_158670
atggaagcacgtgtgaacgcgttggaaggtgagatctcggtggtgcgatcttccttggtgagtttccaggaagaagtaaaggagaatcacgcgaatctgatcgcgatgttggagaaacatttcggaaaatcgctggatgatgaagggactggaagtgcggtaagcaagaacaaggagacaccagaaaagaagacggaaactccaaaagggtcacacgctgataagatgaatgaatttcatcaatcggcgaagaaggtggagttaccttcgtttgaaggagaagaccccgccggctggatttcgcgagctgaagtttacttccgagtacagaacaccacgccagaagtgaaggtgagcttggcccaactttgtatggacggacccaccatacatttcttcaactccctcatcggagaagatgaagatctgacttgggaatcgttgaaaatagcgttactcgagagatacggtggtcatggcgacggagacgtgtacgaacagctcacagagttgaaacaggagggatcggtagaggactatatcacagaatttgagtatttaatcgctcagattccgcgattaccagagaagcaattccagggttacttcctccatggtttgcaatcggagattaggggaagggttcgcactttggcaacaatgggagaaatgagtagaacgaagctgttacaagtgactcgggcagtagagaaagaggtcaagggtggaaatggatctggatttgggcgtgggcctaaaaatgggccttatcggtccaattctcatggtggaaacaaaggagtatcagactgggtgatggtgaaaaataaggaagggggtgatggagaggctaaggtcttggctgttgaagtagaaggaggggaggaagatgagcaaggagagatgagtatgttggatttacatcacatagctcatgagaaccatcaaaccatgaagtttcaagggataattaagggtgtagaagttctcattttagtggacagtggggcttcccataatttcatttcacaaaagctagttcaccacatggattggccaattgaacagacccaacaaatgaaagtcaagttagggaatggggttcaaatagaagcacaggggaggtgtaaggagctagagatgtacattggcagtcacaaattaaggccaaatcttcaactgtttgaattaggaggaattgatgtggtgttaggcatggaatggttgaaaacattgggagataccattattaattggaaacaacatacactgagtttttgggaggaaggaagatgggttactcttagcaataaggaggggtgcaaaaatccaatgatagcattacaaagtattgtgggtaagcccaggcccaagaaagaaggggatgtgtggagaattgagggggtcgagcctaaggtggtttgtgaatccattaggactgaaagcccacaccgggtgttggaggtggtgttgggcgagtatgccaatgttttccaaacaacttgtgaatctgtgttgtcagaaaaccaacaccgggagttggaggaggtgttaggtgagtatgcacacgttttccaaacgccttcgagcctacccccaagaaggaagaaagagcacgccatcaatctcatagatggacatggagcagtgaatgttcgtccgtatcgttatcctcatcaccacaaaaatgagattgagcgacaagtccaggagatgcttgctgccggtatcattcgccacagcacaagttcattttctagccccgtgatcctggtgaagaaaaaagacaacacatggaggatgtgtattgattacagagcactcaataaggtaacaattcccgataaattccctatccttgttattgaggaattgttagatgagttgcatggagccaaattttttacgaagctagatctcaaatcaggctatcaccaagtgagagtgaaggattctgacattgagaaaacagcgtttagaactcatgaaggtcactatgagtttcttgtcatgccctttgggcttacaaatgccccttcaacttttcaaaaccttatgaatgatgtgttcaggcccctgctcagaaaaagtgtgttagtgttttttgatgacatcctcatatacagtcaagattgggactctcatttgagacacgtacgggaagtgttgggtttattgtctactcatagtttggtagtaaacaagaaaaaatgtagttttgctcagcaaacagtggagtatttaggtcatgtaatctcagaaaatggggttgctgtggatcctagcaaggttattagtgtacttcaatggcctcaaccaaggaatgtcaaagaaggggttagaggatttttgggtctcacggggtactatcgaaagtttatcaaagactatggtaaggttgctaaacctttgacagaattaactaagaaggatggtttcaaatgggatgagaagacacaggcagcttttgatacactaaaacagaagctcacaactgcaccagttctggctcttccagatttttctacaaattttgttattgaatgtgatgcttcaggtacaggtctgggagctatattgatgcaacagaaaagaccagtggcttacttcagcaaagctctaggagttagaaacctggccaagtcagcatacgagaaggaactaatggctgtagtattggcaattcagcattggagaccgtatctcctaggaaggaagtttgtagtgtccactgatcagaggagtttaaaacagctgatgcaacagaaaataatgactgctgagcaacaaaattgggctgctaaactaatggggtacgattttgacattgtgtataagcagggcaagctcaacaagggggctgatgcactttccagagtgtatgaagacagtgaattgagcgccatgagctccatagcaacctggatacaaggagaacagatcaaggcagaggtgcagagagatggtaaattacagaaaatcattgctgaaatccaattagatcctctatcatggccaggatatagttacagacaaggcacacttctttatgaaggcagactagtgatttccaacaaatcacttcttattcctactcttttacaagaatttcattctacgccacagggaggacattcgggtttttacaagacatatagaagaatggctgccaatctatattggataggaatgaagggcatgattcaggaatttgttttacaatgtgacacttgtcagaggcaaaaatatatggcatcttctccagggggtttgctccatccactccctatacctgagcaaatatgggaagatatttcactagatttcattacaggcttacccaagtcaaaacagtttgaagcaatattggtggtagtagacagactgtctaagtatgcacattttattcccttaaaacatccctatacagccaggagtatagcagaaattttttgtaaagaaattgttagattacatggcattccactttcaattgtgagtgatagggaccccatctttgtgagtaacttctggagggaaatgttcaagttacagggaacaaagctgaagatgagcacatcataccatccggaaacggatggccaaacagaagtagtgaatagatgtttggaaacatatctgaggtgctttatttctgatcagccaaggacctgggtaacatggatacattgggctgaatattggtataataccacttaccattcatcgacagacaagacaccatttgaggttgtatatggaaggccaccaccactattgacaagctggacacagggagagactcgggtagcaagtgttcagaaggatctgatggacagagatgaggctttgagacagttaaaaactcaattgctgaaggcacaagagagaatgaagagccaggcagacaagaagagagttgatagaagttttatgtgtggagaatgggtatttgttaagctaagagctcacaggcagcagtctgtagttaccagaatcaatgccaaactagctgccaagtactatgggccttatccaatagttgagagggttgggggagtagcctacaaactaaaattacctgaagggtccagagtgcaccctgtattccatgtctccctattgaagaaggctgtgggtaattatcaagaggataaggaacttcccgatttgttagaagacccagttgaagcatgtgaacctgaggctgtacttgctagcaggaaaattaagcagcagggtgaagaagtgagacaatttttgatccattggaagggtaaaactatggaagaagctacttgggaggaagaattaatgatgagaagtcaattcccaaattttgaccttgaggacaaggtcaattctgaagaaggaagtattgatagagtccaagagaatgaaggatatccacatcagcaattgattcactcaacacagaatggagtcagaccttttctggtttatactaggaggaagggtagaaaggtctttggtggctaa

SEQ ID NO: 41893 - DNA, 366 bp, Glycine max
  Peptide Sequence Number=SeqID_158671
atggatatgcagacctatcttggtaagctcgatcatttgcttgctgattataacaatttgaggcctttcacttctgatgcagagaccttttacctgcaatgtaaccagtacttcatggttctagctcttgctggcctcccacatgaccttgattcggtgggtaaccagattctatcagccccttctgttcctacttatgacatggttagtgaacagttactacgtctctccactctgcatgtttttggtcagtctgaggcatttttaaattgggaacatcagttatccgagaataggaaccgtgagaccattcttggagtagttatctcacggttttcgtatttggtgggatttgtacttttgtag

SEQ ID NO: 41894 - DNA, 270 bp, Glycine max
  Peptide Sequence Number=SeqID_158672
atgatgcagatcacaagaattgaagaggagatgctcaacatcattcttgcaaaggatcagacgtacgatgaagtcagtaggttgtttgctgttagatggaaggaccagctagatcgtcactggcatttggtagacaaacatgacaatatgcatgatgttgtttgcaacaaagatttggtcagcccaaccattgtgcatggatggacaacactaaggactttctatggacttcggggagatcaccatgtcacattaacctattatggttag

SEQ ID NO: 41895 - DNA, 366 bp, Glycine max
  Peptide Sequence Number=SeqID_158673
gatcgtgatggacagtggctgaagaaagacgcacaacctctacaagacgagcgtactccctctcctccacctcaacgagatgattcctcagcccttatgaatgaagttctttcagaattacggggcctccgtacctatgttggcaaacgctttgattcctcagatggtcgctttgaaggaatggatacccgcatcactcaacttaaagaggatgaattaaattgtcatcatcaaaaagggggagattgtagaagcaaagactttgactttgatgttttgattatgccatgtgatcatgcgcttctcaagtttaattcaagacaaaaatccaagaaattcaagatacatcatcaagaagatctctag

SEQ ID NO: 41896 - DNA, 246 bp, Glycine max
  Peptide Sequence Number=SeqID_158674
atggaagtggtgcattgggttggatgtcggaacagcaagaaacaaatgcataacaagattggccattcaataagtggctggagcagtgcaactatgtttcgtggcattgatgtgatttttcgtgtcaaagcagaagcaaataactctagctttcgtgttagaatcgatgtgatttcactgcttcaaatgggtgtcaaaacgcgctgtgacatgcagcaagtacttttcaaaggctatcttccatga

SEQ ID NO: 41897 - DNA, 483 bp, Glycine max
  Peptide Sequence Number=SeqID_158675
atggaagaaggatatgctaccaacaaaccaccattattcaaggtagccaagtacgattgctggaagaaagaatacaccaaggtccacaacttcagaagtgcaaagcaaatgtcagacacactatccataacatatgaagggtcatcacagaccatagttacaacattgagagctttgaagaatattgacaccacgtcccttggagaacttgttggaaccttaaaggtccatgaacaagaacttcaagaagacaaaggaatcaagaagggaaaatcccttgctcctagcaccctaaaagaaaaaccattgtctaaaggtgcatccaaagaaccaagtgctgaaaacttctctaaagaaaaatatgataaggatgatgagttggctttcatctcgagaaagattagaaagatgtggaagaacaagagtgggtccagatggaaaaactcctccaagaagatatttaaagagaaaaaagcttcataa

SEQ ID NO: 41898 - DNA, 312 bp, Glycine max
  Peptide Sequence Number=SeqID_158676
atggacaactacctcaaaggcataattaataggtcagtgttgtttttcaatacaattgcattagcattagtcagtgctttgaaaggacttgacgatactcaacaaagtaaatccaagtctcctgctaggtggattgttgttaaatgtaatagacaaaaaggaagcactgagtgtgggtattacgtcttgcactggatgtcaactataatcttaggaaatttccagaataattgggaaatgaccattggaaccagaaagattgaaggcgcttcgcaaccagtgagcaaagtactatttgaaagtgaaaaatga

SEQ ID NO: 41899 - DNA, 936 bp, Glycine max
  Peptide Sequence Number=SeqID_158677
atggagccagaggacatgtatgtgttatcacacagtgggtctgtcttgtctgctccatctcctaaaccttggccgcacaagcctcctaagtgtagtgattgtgatccacttttcaagaagatcactcacatggaaatgataaaaggaatcaaggggcatggctattatgatgaacttgttgtccccataattgagaatacggcctacgagtatcagctcacggaatcttttgctaaagctattgaagactacccaaaagcaacagcagtgcttgttcgcaaccatggggtatttgtctggggagactcatggatcagtgctaaaacacagtctgagtgttaccattacctctttgatgctgctctcaaacttcatcaaatgggattggattggtcaactccaaatcacggtccaatacaaagtgcaagaaggggtctaagtattgctggggagtcaaatgtgtcagttaaagcaaggaaatctaatggtgacagtgatccattgccacgttgcgttgttcttgacattgaaggaactactactcccatatcatttgtttccgaggttctcttcccatatgcccgtgataatgttgggaggcatctatctctaacatatgatacccccgagaccaaagctgatatcaagttgcttcgttcccaagttcaaagtgaccttgaacaagggattgcaggtgctgtgcctatccctccagatgatgctgggaaacaggaagtcattgctgcacttgttgccaatgtggatgctatgattaaagctgatagaaagatcactgccttaaaagagttgcagggtcatatatggaaaactggctatgagaataatgaattggagggaatagtttatgatgatgtaccagaagctctagaaaagtggcacgccttgggtataaaggttgtttttgctggttcttag

SEQ ID NO: 41900 - DNA, 822 bp, Glycine max
  Peptide Sequence Number=SeqID_158678
atgaccagttctcgagagcgtttggtgaaggcggtgaagcagtttgtggaggttcgctacaaggttttcggcgaccgttatggccaaaacatcatcgacatcctcgactttccgattaaggttgtcttgtctcccttcactctcgccttcgatattgcaggctctgctcctcgcggcttcggcgtcccggaactcatctccaagctctctgccacttccgtcttcgaaatggagattataaaaatgtcattttctcccttcactataccaccctcaatggcggtgaggttgtttcagcttaaccagtgctctcgaaatcgaattcgagtactgggtatgcctgcttatactttgagggagagttttgtcgcctacagtggtcttactgtccgagctcgagcaggaatttctcatgctatagctgctcttgggacttatgacattgcctttgagctggggaggaagaaagcaactgctgaatctgtagcagacgccattgccaataaccgggctgagttggtgcatataccatcatccttggattttcaaaaaccgctaccttcaaaagagtgtccaacttgtgatggaacgggtgtaatgagctgtcctgaatgcaaacacagattgctgcatgttaggatctcagcagatgatgtgagtattgttgattctatgattatggagcccccatggcaagcttgtaatgtcttgaaaaagattgattatccatatgagattatgggtggatttacctatgacgatgatgtgaagcagaaaatatggtggcagtacaaggttgtcacttcatattcctttctgtag

SEQ ID NO: 41901 - DNA, 336 bp, Glycine max
  Peptide Sequence Number=SeqID_158679
atgtgcccttggtgtggactgcaaactgagactacaacacatactcttctgatgtgtgatgaggttcgcagactatggtttgcatcacaatcaatgaaccatatggtgttcaagcaaaagaaaatgatagttgagcagattatgcagcaggcacattgcctcatcttactgcctgttgaagacaatcaaagtgttacaaggaggaatgaaagatggcagaagccattacctagccaaattaaagcaaactttgatgctgctgttagaaagggggttgcaactttggcagctgcaacaaagtttctgccaaatacttatattaagagaagagtatga

SEQ ID NO: 41902 - DNA, 1338 bp, Glycine max
  Peptide Sequence Number=SeqID_158680
atgggacctgctttggtcacgattgacttggatgattatgatgatgtgagagagattccgaaaccgaaaggtcctaattctgaggattataggttagaaagacgatggaagagatttgaacattcaagttcaaataaacgattgaagcaaaatcacagtgacagtggtacaagaactgtgaagagtcatggaaaagtggcaagtttaacagtaaaagagggtcatatgtcacatatgtcagaggatgaagtggatgaagattacaaattctttttgctaacatatgatcctcatattgatgttgtctgtgatggtggtgttgatggttctgatgatgacatcaacattggacacaacagtgaccataatgatcatctttatagggaagaagaaagcttgaataataatcccaagttagataagggttcaaaacaaaggggtgagactgaaaatgaaagaaataaaaggagtggttcagtaggaaaacaaacaagtggctcaatgaaagctaagaagaatttggaggctaaaaaaggacttagtaagaaaatgccacgggaagatgtttctggtgtccccaagaacaatggccagactaatatggagtcagttgttgcagatgaagattaccagatattcctgaattcttgtagggatgattatatacctagtgaattaataggaaagcgatcaagtgttatgcaaaattcacaagttcttgattatgcaccgagtgaggttgatgaagattacttacaatatttgaattctgttctgattgttgatggtgaggtggagtttatgtctgagaggaatacctcaaagacggacaacgtggatggtgacactgacagtaattcctctgaaccagatgttattcttctagaacctgatcaaattcatgaaaacactccatttgtttcttccagaacattcgattcatcttggttcgagactgaaaagaaccccaaaggcaactggcaattatctgcttgcgataattctcagtttaggagaagacttatgaatgatcttcaaaggccatatgaccaagaagaatatgatagacttctgtgtgaagtacgtcagaaaaagcaaaaggaacgtcatagagaaacacgtcatggggtggtcaagtcttatcccacaaggggtttccacaaatcatatctcgacttgtaccctgatctagctaaagcaattgctgaattcaaaaaaccggaaagggttttgtttctcgtgcgtggatttgttttctggttgcaaaatgtgacccacgaaggaatatttcggccttggcttgacaagcattgtctggacattttacgaagaatgtaa

SEQ ID NO: 41903 - DNA, 1791 bp, Glycine max
  Peptide Sequence Number=SeqID_158681
atgagtgatggattttgcggtactcatttgcagatcatggtcactggcagaggtgtgggcagaggagatcgtgatgattccgatgatgctccgcaacgtcgacggactattgcacccgcacggaggcagcgagtcgttgtgactgcggatcacgtcgatgagccagtcatccctgcgccagatgttcaggatgacccgatggaggcaccagctactgtagatgacattcctgcggacacaggcacagaggctgctgaggatgagaatgagggatttccaggtggttcgagcgacccatccgtgttgaccctgtatgcggatcacattgcttgtagcgtatggaggggagaggagcgtcctgaattgaagctatcctctcatgggaggaaggtccacagtttaggcaggcctgtccctaccattgagggacttattgctggtacaggactaagtcctctgatcacgtgttcggtagacactggcaatcgaggacttttgtccgcgtttgtggagcggtggcaccgggagacgtctagtttccatctcctggtgggagaactcaccatcacgctggatgatgtctcctcgcttctccatctgcccgtgattggagacttacacgcctttcagtgcttgcacgtggacgatgcggttcagatgctggtcgacttattgatggtctctacaaagtctgccagggctgagacaacccagtgtcgtggaccgtacgtacacctgcaatgggtacgtgatatatatgagcgtcgatgccaaacaggtcattggacaactgcggcatgcgcatatcttctccatcttctgggttgcactctgtttgccaacaagagtgcaatcaatgtgcatgttgtctacttggaggcccctcatgacctcagtatgacagagaggtatgcctggggagtggctgctttggttgatatgtacgaccagttgaacgatgcatctatgagccacagtcgacaacttggcggttacatcacactgcttgctggatttatgagcactttccctcggtcgcggagtccaccgctgatcaggactacgacgaggcttccctgcgagtgcgcaggtcacgatactggcagaggtgtgggcagaggagatcgtgatgattccaatgatgctccgcaacgtcgacggcctacggcatccgcacgcaggcaacgagtacttgtcactgttgtggacgatgagccagtggtccttgcgacaaaggctgacggagcttcggttgaggctgacgtatatgcggatgagccgatggcaggaggtgatgtacaggacactggagcagacactcttgcagacacaggcgcacatgctgctgaggatgagcttgagggatttccgggtggtccgagggacccatccgtgctgaccgagtatgcggatcacgttgcaggcaacatatggacgggagatatgatgttaacgaattgtgtattcctttatacttcaattcaagagcgtcctgagttgaagttattctctcacggaaggaaggtgcatagtttaggcaggcctgtccttgccattgaggggctagttgctgggacagaactaagtcctttgattgcatgtttgatagacactggcgatcggggacttttgtcatcgtttgttgagcggtggcaccgggagacttgtagtttccatctccctgtgggagaggtgacgatcacactggacgacgtcatgtctcttctgcatctgtccgtggtgggcgacttgcatgcctttcagcctgtgcacgtggatgatgctgtatag

SEQ ID NO: 41904 - DNA, 487 bp, Glycine max
  Peptide Sequence Number=SeqID_158682
gctgacgaaagaacagcttctcactcaggtgagattgaactgggtcactgaactctctcttcccttcgcccctttccttgttgggggggacacctgcttccttagcctgaaagatgggtcgcctacctctattgtattgagttgcccccctcgggcactggaagagtctagagcgactctcttcgtactgctaaggagaaggtgcggagcggaaaggcagaaaggaagtcagaagggaggtcacactggtgccaaaaaggcaaagataacatcctccaccaaagaaactcaagtgaagggacccgaacaagcaagggattcagatgaagcgcaaacgcaacgcgctcaagccaacaagcaaagagcgatagcagctctcccgagagggaatctttctctttctttccttctcccaggcgttattgtattgatggagaggattgagaacgaagtgagaggttatcagacccaagaagcaagggcttga

SEQ ID NO: 41905 - DNA, 1016 bp, Glycine max
  Peptide Sequence Number=SeqID_158683
acacttcttctagagaagaaagtacaaagggtaaagctcgtttacatgttgtcaaacgagacgcttctttaggagaagaaacaaagggtaaatctcgcttacatgttgttagacgagatgcttcttctggagaagaaagtacaaatgataaagctcgtctacatgttattagacgagatgcttcttcaagagaaaaaataaatgataaagctcgtctacatgttattaaacgagatgcttcttttggagaaaaaagtacaaaggataaagctcgtttacatgttgttagaagagatgttccttctagagaagaaagtacaaaggataaaactcgtctacatgttgttagacgaaacacttcttcaagaaaagaaacaaatgataaagctcatttacatgttgttagacgagatggttcttccgaagaagaaacaaagggtaaaactcatctacatgttgttaggcgagacatttcttcaggaaaagaaacaaatgataaagctcgtttacatattgttagacgagatagttcttgcggagagaaaacaaaaacaaagggtgaaacatacattgaaggcaatgcatatggtcagtctcaacaagcagtggaacatggagaagtggatccggaaaatggtggatcatctcgacattgttatggcaagtgcaccgctggatgtgccaacccttttcctaattatgaccctaacctcggagacctatgtgctcggagatcatgttggactgttggtgatcttgtgatagacctatgtgatggtctaagaatctggtgttcaagagagggtttgcaagaagttgaagggatgaaaatagaaggtgctaaatttggagaaggttgcgaagatgcatggaaatttctatggctacttgcaaagaagggtggtagctcaatccacaaccacaaggaagaagtcgacgttaaagatgcattatggaaaattgaatgtgcggttgatatatatagtctcaacgaattttatgagtttcgtgtataa

SEQ ID NO: 41906 - DNA, 169 bp, Glycine max
  Peptide Sequence Number=SeqID_158684
atggaacttgagatacgtgtttgtctcttgttgtttctctttggtatactctctggctctcaagcctacacgttctatgttggtggaaaagatgggtgggttttgtacccttctgagaattacaatcactgggctgaaaggatgaggttccaagttagtgacactcttg

SEQ ID NO: 41907 - DNA, 519 bp, Glycine max
  Peptide Sequence Number=SeqID_158685
atgctgaaaagcaggagtttagatggcacagtaacacacttcacacctctattagatgtatctcatcataaagaaaacacaagacagtaccgatggtggaacagcaaaatcctggatttggaggaggccaaacatcaattacttttttcactacctatgttccttacaaacttgttctattacttaatcgtgttggtttctgtaattttcgctggccaccttggtgatcttcagcttgctggtgctactcttgcaaactcttggttttctgtcactggtttggctgtcatgcttgctggtgctactcttgcaaactcttggttttctgtcactggtttggctgtcatgagccaatccttgtattgctacatcaatctcaagacattgcaagaacaacttccctttacaccaaaaaggttcaggcagacttggacaggattttcatttgagtcattcaattacattttcacagacttgaaactagctttgctctcagcagcaatggtatggaaacattaa

SEQ ID NO: 41908 - DNA, 243 bp, Glycine max
  Peptide Sequence Number=SeqID_158686
atggcttctaataacaaagttgcatcaatactcttcgttgccatgatgctcatcaactccagctacgcagctcgtgtgcatgttgttagacgagacgcttcttcaaaagaagaaacaaaggataaagttcatttacatgttagacgagacacttctttaggagaagaaacaaaaaataaaactcgtttacatgttcttagacgagacacctcttcaggagaagaaagtacggggatcctctag

SEQ ID NO: 41909 - DNA, 1509 bp, Glycine max
  Peptide Sequence Number=SeqID_158687
atggcgaccaaagctgttcctcgtatcatattctggcgatcagcaatcattcaagtgcttcctcatcagatatatgcagataacgtagagcagatgaaagaggagatagagaagatggtggcaagtaacagctcggatgatagcataggaacacctctagtaataaggggatctgataataatggaagagatcaaaacacaagactccaccaagttgagggatggtggaacaaagtgttggacatggaagaggctaagtgccaactcttgttttcactgccaatgattctcaccaacacgttctattacttgataacttcgatttctgtcatgcttgttggtcaccttggcgagcttcaacttgctggctctactctggcaaactcgtggttcaatgtcactggctctgctgtcatggttggtttgagtggggcactggaaacactctgcgggcaaggatttggtgcaaaggaataccaaatgctgggaatttacctacaagcctcatgcatcatatctctaattttttccatcattatatccattatttggttctatacagaacctatcctagtgttgcttcatcaatctcatgacattgcaagaacaactgctctttatatgaagtttcttatcccaggattatttgcatatagcttcttgcaaaatatcttgaggtttctccagacacaatctgtggtaatgccattggttgcactctcagctcttccattgttgattcatattggtattgcatatggcttagttcagtggccaggtctgagtttcacaggtgcaccagttgcaacttctatttcacaatggatatcaatgctattattggccttgtatgtcatgtatgctaagaagttcaagcagacatggcagggattttcaatgcattcattccattatgtatttacaaacatgaaactggccctgccctctgctgcaatggtatgtttaaacacacaattcattgcgtacatggtccctgttggtcttggtgcagctggaagcacaagggtatccaatgaattgggagcaggcaacccagaacaagctaaacatgcaatgaatgtcaccgtgaagctctctttcctctttagtttctgttttgctttggcacttggatttggccataatatctggattcagcttttcagtggtagtgctaaaattaaagaggagtttgcttcaatgatacccttgcttgccatttccatagtactagatgctgtccaaggtgtcatgcaaggggtggccagaggatgtggttggcagcactcaactgtttatattaaccttgcaactttttatcttgttggtttaccaatatcatgtctcctaggatttaagaccaatttgcattataagggtttatggattggtctgatttgtgggctgctatgccaagttgtgactctcttccttttcttaaggcttgccaaatggactaaattggatctctctggggacaaagataaagaccaccctcttgttgtttaa

SEQ ID NO: 41910 - DNA, 168 bp, Glycine max
  Peptide Sequence Number=SeqID_158688
atgttggaagaaaaagaacaaaaggttgtagaaggaagggctgttgaaggtcggaagaagaagctggctgcttgcaacgcaaggtacaggagtggcgcccgccgctcctctctgcaactccaactccgcaaaagcacagctattgactactctagtttgttttgctag

SEQ ID NO: 41911 - DNA, 294 bp, Glycine max
  Peptide Sequence Number=SeqID_158689
atgaaggcagtggctggattaactcatcataacaatgcaaagcctgttgctgattccagtttttccaaggctaaaccagaacattctttggactcacaattcaaactgccaaaagcttcacaactactttgtcacaacttagagggcaatgttggtgcactcacaaattttgaggtccttgatttcttactaactaaaggaacttcaaaggatccaacaagagttattgccaaagtagcacagtctgaatacaaggttagatttgatttttctaataagtgggaatacttgtaa

SEQ ID NO: 41912 - DNA, 966 bp, Glycine max
  Peptide Sequence Number=SeqID_158690
atgatcggaactggaagagcaaaccctcctctccaaatactccgagctccgccgttcaggaatcctcgccaagctcaaaacgcgcgagaagaagttcaagccggtggcggagcacgtgaacgcgctgcaccacctccgcgacccagcctcgttccccttcaagtggtcgtggcgcgacgtctcgataaaggtgcagaacatgcgccaccagacggtaacaatcattgggagaattttcttaaatacaaagaagtcttgggcgatgtgcaattgttggaatccccaaaacctatcaccaccgccaaattagggtttgatgttgattctgatgatgatgatgagggggaggaggaggaggaggaagaagaagaaaaagatgacgacggtggtgatgaagaggaggatgtgttgaaggtgaggaggttgggttcggtggtggagctgagggaggcggtggtgaagcgcgaggagaggcagcgggagagggagttccgccggaagaaggtggaggcggagcgggagaggaagaggagagaggcggagtttcggcgggagaggcggagggagtggttggaggatcgggagatggagctggaggagcggcagttgaggtgggtcaggagggagctggagaagaggcttaggttggagagggagcttgacgtggagcggcggtggcgaaagcgtgtggaggagaagatggaagaggaggagatggaatggaggcagaggatggtggcaatgcaggtcgagcacgagaaacagatgatgcagatgcacgtcgaggcctcccagaatcaaatgcaggttctggggatcatggctagattcctttgccagttcttcgggtccggaaccgatggattgaataatggattggggacattgcctcctcaggttttgcatcatggaggtggattgggtaatgtaaaacccgatgccaattcgccttcccgatttatatag

SEQ ID NO: 41913 - DNA, 153 bp, Glycine max
  Peptide Sequence Number=SeqID_158691
atgtgtattctagaagaagaaaggcttgtaatggagatgggtgagagtgtattgttggaaactgcttgtgggaaaaacaaagatactaagtctcaagctaatcagaaagggactgggtatgcaaaacctaaggaaaccagcaagagtgaataa

SEQ ID NO: 41914 - DNA, 700 bp, Glycine max
  Peptide Sequence Number=SeqID_158692
cacctccaaccaactgagtgccgccggcgaacgtgtcacctttgttgatcaacagccaggcagccaatgtcagctgctgggcaatgttaccggctcgcagagcaactggctgaccggctcaggcggtgaaggcagttcactgcgtggtgcggccaacgacctgcgtaaccgcgcagcggagatgggcggcaacgtgatttatggtgccaccagcccgacgcagaatctgctgtctgcctttgccccgctcgacagcaaaatgtcgggtcagtacagttccagcacggtcgccatcaatggcgacactacggtgatggcgccgactgtagggtgcgcattcatgcgcaccgggcagctggcagggaacgtcactcctgacgcagctgcagatccagcggcgttttgctcggctcaccaccaatttcccgcgccagcttcggcaccatatagcccgacaccatggtcagcagctgccgcaccagcgcccgatgccggcatcaaacagcgcattgctgagctgtgccagagtctgcgcatcgtcattaacgccgcgcagcagcacgctctggttcagcagggtgacgccggcgcgtttaagcctctgcatgcgttcgcgcagcgcctcgtcaatctcctgcgcgtggttgatgtggctgaccagcagcacctgcagacgcgtatccgccagcagctggcatag

SEQ ID NO: 41915 - DNA, 249 bp, Glycine max
  Peptide Sequence Number=SeqID_158693
atggaaagatggagacgagtaacctttttggctaaactcatctccatgaagtataagggcaaaggaaatatcaaagaagacattatggaaatgtttaatcttgcatcaaaactcatgtcacttaagcccgattggtgtttaagagtgcttttgtgtgggggtgacaacaatgatgatgatggtgtgagtagtaatgacggtagagataccagtggtggtttgtgggcgatgaaaaaaagttttcaatag

SEQ ID NO: 41916 - DNA, 450 bp, Glycine max
  Peptide Sequence Number=SeqID_158694
atggtagcatctatcgtgaaaacaacaaaactgaaccaactccccagcatcacaaatctcggtgcctccggcggcattgagctcatccgctggggctacgtggaaaacgccgtgatcatcatcacctcgtcgatcccttgcatccggccgctcgtcatgtcctccgtcaagaaattctccagccacagcttctcccgttcatatgagttgcgcagccccttcaccgggaatcgtcgcacaggtgagaatgataccgctcagtcgcgccgcaaactagcgacgacgaataatgatgtcgaaacgtgtagtattgagcgcatcctgaacccttattcgcacaatacggttatcggtagccatcagacttcgtcgaatcggtcggatcgggggattacgaaacaggtggagatgtcggtttattcgagtgatgatcctgcgaggagtgtttga

SEQ ID NO: 41917 - DNA, 234 bp, Glycine max
  Peptide Sequence Number=SeqID_158695
atggccaagttgacccacaaagaaacatcaaatgtgactaataaccccattttcaacatggctagcctagctcaaccacctcacactctctcactccctctaaagctggcactattaataaacatgcactacatattgaaaccaaagcaagggaaggcaaaggtcaaggaagtcaaagaaaccaaggtggaagaaaaaaaggttgaagagaagattgaagaaaagaaagattga

SEQ ID NO: 41918 - DNA, 993 bp, Glycine max
  Peptide Sequence Number=SeqID_158696
atggatcccgaaacagcgttagaacttgtcaagcacggtgtcactctcctcttactcgatgttcctcagtacacccttgtcgccgtcgatactcagatgttctctgtggggcctgcttttaagggtattaagatgattcctccaggcgttcattttgtgtattatagttcatcaagcagggatgggaaggagttctcatcaattattggattttttattgatgctggcccttcagaggtaattgttcgtaaatgggatcaacaagaggaaaggttaatcaaattatctgaggaagaggaagaaagatatagtcaagctgttaaaaatttggaatttgacagacaacttggaccttacaatctcagccattatgaagattggaaacaattatctaattttatcacaaagagcgtcattgaacggcttgagcccattggaggtgaaattactgttgaatgtgaaaatgagatagttagaaatgctactaaaatgccaatggaggacgcactaggcaagcagctgaaggttggtaattctgcaacatctgttggcaagtctcagaggaaaggatgttattatacctcaattccacatgttgtgaaatgcaaggggattagtgggcaggaacttacttctttgaatctcgacaagacacaattgttagaaactctactggcaaaagattatggaggttctgaagacttgcttcttggagaactgcaatttgcatttgttgcctttttgatggggcaatcacttgaagcatttctccaatggaagtcattagttagccttttgtttggctgcactgaagcaggtctaggttatgttgcatatggatacaagacacttattgattatgctaagatatctagtgtgggattgcctttccgcacacgaactcatctattcacaaagttacaaagcagtggcattagtacttggaatgttgttaatttcatccctgattgttgtagttcttccgacttctga

SEQ ID NO: 41919 - DNA, 102 bp, Glycine max
  Peptide Sequence Number=SeqID_158697
atgtctattagtttggaattggatgtgattttcgatcacaaatgcgacgctcaatcaaacactcttagaatggcagatttcaagggacggatgcatatatag

SEQ ID NO: 41920 - DNA, 1079 bp, Glycine max
  Peptide Sequence Number=SeqID_158698
gtttgagttcaaaggatggtaacaaggaagaagatggcttaagcagcaaggtctcaactccctccgatcctccaactccacggacggagggagagatcttgaagtcttcaaacatgaagagcttcaacttcagtgagctaaaaactgctacaaggaactttcgtccggatagtgtggtgggtgaaggtgggtttggttgtgtttttaaggggtggattgatgaacagacacttgcaccagttagaccagggactggcatggtcattgctgttaagaggcttaaccaagaaggtctgcagggacacagtgaatggttgctgcgtcatcctaatcttgtgaaactgattggttactgcttagaggacgatcaacggcttttggtgtatgagtttttgaccaaaggaagtttggataatcatttatttaggagagcttcttactttcaaccactttcttggaacttccgtatgaaggttgctcttgatgctgctaagggtcttgcatatcttcatagcgatgaagcaaaaaattacaatgcaaaactttctgattttggcttggcaaaggatggaccagctggtgataagagccatgtctctacaagggtaatgggcacatatggctatgctgctcctgaatatatggccacaggtcacttgacaaagaagagtgatgtatacagcttcggggttgttctgcttgaaattatgtccggcaaacgtgcacttgacagcaacaggccaagtggggagcacaatttaattgaatgggccaaaccttacctcagcaacaagcgcaggatcttccaagtcatggatgcgcgcattgaaggccaatacacgttgcgcgaatcaatgaaagtagccaaccttgccattcaatgtctgtctgtggaaccaagatttagaccaaaaatggatgaagtggtgagagcattagaggaacttcaggattcagaagacagagctggaggggtgggaagctctcgagatcaaactgctagaaggagtggccatagctcaagcagcagtgggcctagacaacatagaggtagacaacatgaaacaacaaggaagtga

SEQ ID NO: 41921 - DNA, 3177 bp, Glycine max
  Peptide Sequence Number=SeqID_158699
atggtgctgttcagatgtttctcagtgacacttttgcagtcgtgtttcttggcttgcttgctttgcttgtcactagggcttaataataataataataatcaagccctatcctgtgaccctcatgatttatcagctcttaaggagtttgcaggcaaccttacaagtggctctatcatcacagcatggcccaatgacactttctgctgcaactggcttggagttgtttgtgctaatgtgactggtgatgctggtggaacagttgctagtagagtgaccaagttgatcctaccaaaaatgagtctcaatggtacaatttcaccctctttggcacagctagatcaactcaatgtgctgaatctttcattcaatcaccttaagggtgctttgcctgtggagttctccaagttgaagcagttgaagttccttgatgtgagccataacatgctgtctggacctgttgctggagctctttctggtttgcaatccattgaagtgttgaatatttctagcaatttacttactggagctctcttcccttttggggaattccctcatctccttgctctcaatgtgagtaacaattcattcactggcggattcagttcacaaatttgcagtgcctccaaggatcttcacacccttgatttgtctgtaaatcattttgatggcggtcttgaaggcttggacaactgcacctctctccaacggttgcatttggattccaatgcattcactggccatcttccagattccttgtattcaatgtcagccttggaggaactcacagtttgtgccaacaatttatctggccagttaagcgagcaactaagtaagctctctaacctaaaaactttggtggtttctgggaacaggttttctggggaattcccaaatgtgtttgggaaccttttgcagctagaagaattagaagcacatgccaattcattttttggacccttgccttccaccttggctttatgctctaagcttagggtgcttaatcttagaaataattccctgtcagggcaaattggtcttaatttcactggcttgtctaatcttcaaacacttgaccttgctactaatcatttctttggaccccttccaacttccctgtccaattgccgcaaattgaaagttttaagccttgctaggaatggtttaaatggttctgtccctgaaagctatgccaacctcacttcacttttgtttgtatctttctcaaacaacagcattcagaacttatctgtggcagtgtctgttctgcagcagtgcaaaaatctcaccacccttgtacttactaagaatttccgtggtgaggtaatttcagaaagtgtgacagtagaatttgagagccttatgattttagcacttgggaattgtggtcttaaaggccatattccttcttggttatccaattgcaggaagttggcagttcttgacttgtcttggaaccatttgaatggtagtgttccttcttggattggtcagatggacagcttgttctatttggatttctcaaataattctctcacaggagaaataccaaaaggtctggcagagttgaagggcctcatgtgcgctaactgtaatagagaaaaccttgctgcttttgcattcattcctctctttgttaagagaaacacaagtgtaagtggactgcaatataaccaggcatcaagtttccctccttcaattctcttgagcaataacatattgagtgggaatatatggcctgaaattggtcaattgaaagcactgcatgtcttggatttaagcagaaacaacatcgctggtaccattcctagcacaatttcagagatggagaacttggaatcattagatttgtcttataatgatctttcaggagaaattcctccatcatttaacaacctcacattcttgtcaaagttcagtgtggcacataatcgcttagagggaccaattccaactggagggcagtttttaagcttccctagttcaagttttgagggcaacctggggctttgtagggaaattgattctccttgcaaaattgtcaacaatacaagtcccaacaattcttctggttcttccaaaaaacgtggtagaagcaatgtccttggcataacaatcagtatagggatagggcttgcactgcttcttgcaattattctgctaaaaatgtcaaagagggatgatgataagcctatggataactttgatgaggaactcaatggtaggccacgcaggttatccgaagcacttgcttcctcaaagttggtgctttttcagaattcagattgcaaggatcttacagttgcagatttgttaaaatccacaaacaatttcaaccaggcaaatattattggttgtggtgggtttggtcttgtctacaaggcatatcttccaaatggtgcaaaagcagctgtcaagagactttctggggactgtggtcagatggaacgtgaattccaagctgaagtagaggccctctcaagagctcaacacaagaaccttgtttctctgaaaggttattgtcggcacggcaatgacagattgctaatatactcatacttggagaatggaagcttggattattggctgcatgagtgtgtggatgaaaattcagctctcaaatgggattcaagactcaaggttgcacaaggcgctgctcgcggattagcttacttgcataaggggtgtgaaccattcatagtgcatcgagatgttaaatctagcaacatacttttggatgacaactttgaagctcatttggctgattttggtctctcaaggctacttcaaccgtatgacactcatgtcacaactgatttggtaggaactttaggatacattcctcctgaatatagtcagacactgacggcaaccttcaggggtgatgtctatagtttcggtgttgttcttctagagcttcttactggtagaaggcctgtggaagtcatcaaggggaaaaactgcagaaatctggtgtcttgggtgtatcagatgaaatctgagaataaggagcaggaaattttggatccagtaatttggcacaaggatcatgagaaacagctattggaggtgcttgccattgcgtgtaaatgcctaaaccaagatcctaggcagagaccctctattgaaatagttgtttcatggcttgatagtgtaagatttgatggttctcaacagtga

SEQ ID NO: 41922 - DNA, 717 bp, Glycine max
  Peptide Sequence Number=SeqID_158700
atgtgccgcaatgttcaccagtttgtccgccaatgtcccacttgccagcaagtcaagtataagcccaaacggcccgcgggtctccttcaacccctaccaataccagcttcactatgggaggacctgtctctagatttcataactggtcttccttcctcacagggccacaccaccatccttggtgtcgtggatcgcttctctaaaaggactcatctcgatgttcttccctccaattatactgcacccaaggtcgccacactattccttaacatggtctgcaaactacatggctttcctcgaagcctagttttcgaccgtgatcctatttttatagggcgtttctggtgggagctcttcaccattgtcggcactaaactccgtatgagcacttcataccacccagaaacgaatggccagacaaaagtcctcaatcggaccttggagcaattcttacgttgctttgttcttaattgcccttctaagtggttttcatacttacctttagctgaatggtgctataacacctcaatccactcggctacgagagtcactccttttgatgctacctatggcaaggctcccctttcactcaccacttgtatctcgggctcatcactagttgaaattgttgatcactttgtggaagcaaagcttcatgataaatcaacaatgattcaaaggtgttttgatgataacaatgatgacaacaaaagatga

SEQ ID NO: 41923 - DNA, 978 bp, Glycine max
  Peptide Sequence Number=SeqID_158701
atgacacggttaagggtgttatctatgtcacactacaacaacatcaccgaggttccagattctcttggaaaattaacacaccttaaatatttagatctctctaacactaaaattgaaagattgccagatgcaacgtggaagctctacaatttacaaaccttgttgctctccaaatgctggctacttgttgaattgccagaaaagattggaaatttagtcaatctatgccaccttgacattagtggtaccaaattgaaagatatgccagtcaaagagcaagatggattaaaggtcttagagctgagaaaatttcccctattacaagggaaacattcaatctcaatgctacaaaatgttactgacccctccgaagcttttcaagccaacttaaagaagaaagagaaaattgatgagttggaattaaaatggaactacgataactcagaagactcacaagttgaaaggctcgtacttgagcagttgcatccctcaacaaatttaaagaaactcaacattcaatcctatggtggaaccaactttccaaattggttaggagattcctcttttggcaacatggtgtatttgcgcatcagtgacactgagcattgttggtcactgcctccactaggccaactacttagtctcaagaagctcatcatttcgggactaaaatcagttaggactaatggaactaaaatctatggaagttgttgttctagttccagcttcctttcatttcaaccctttccctcattggagattttgagcttttgcgaaatacaagagtgggaggaatggaacttaattgaaggggcatatgtagcattccgcaagctaaagtgtctttctctatgtgattgtctcaaagtcaaaggaaacttagcaaacaatattcctttaccaatagacccgtcactactaaaagaaaggattcaacatcacccaattaacatcgattgtgatgaaaatcaattttaa

SEQ ID NO: 41924 - DNA, 540 bp, Glycine max
  Peptide Sequence Number=SeqID_158702
atggtggtgtggccctgtgaggaaggaagaccagggttgaaggagacccgcgggccgtttgggcttatacttgacttgctggcaagtgggacattggcggacaaactggtgaacattgcggcacatattggaccagtgaaaattggcctaaaggcagtgcaaggttttggcaaatcccatatggcctccaataggggtgccatcgttgagtatgaagtccgggtgggcaccagagttagaagttacttggtgaatggtatcttgaatagctttattggtgcgcatgtagtcacgaatgacattgaggaacatggggtaaggcatggagagaatgaagcattggccagtggagtactaaggtatgcacgagagagcgtatgcaacaacattagcctttccggacttgtattggatggaataatcataacccaagagcttcgacagataaacttgctgctctggcgtttgtatgacctggttcatgagtttagcggtggtgatggcgtggagttcgcggacataagtggatgcgcattataa

SEQ ID NO: 41925 - DNA, 144 bp, Glycine max
  Peptide Sequence Number=SeqID_158703
atgtctccttccgttaaccaaaaggttttggctcgttgcttcaagtatgcttcttcttgggcaatcagggacgtgttcttcaacattaataaaattggaggagaagttgatgagatgacaagtgaaaggatgtttccggaataa

SEQ ID NO: 41926 - DNA, 399 bp, Glycine max
  Peptide Sequence Number=SeqID_158704
atgagtgcccaatctcgtccaccgctgaagaacctcctgttcatcagcgagaaggcacatgccaacgtccccaagctgacgtcaaacagctccccgtcgttgtggtcaccgttgaaaaatccaattctaatgttggcgctgaagtatgatgctgattcacagaaatttagcgacatcacctctgcccagcgcatgaacgcagcggcgaacacgcctttgacagtgatgcttagctcgttcctaaggaagaatgctgagtcaaaaccgttcagcccaagcaagccgctaagcgcaagaagccacattggaagacagttgtcacgagcaagtgcgctaagcgcggatcctgcacttagtgcatggccacttgatccagttggacatgcgcacttagtatga

SEQ ID NO: 41927 - DNA, 846 bp, Glycine max
  Peptide Sequence Number=SeqID_158705
atgacgactaacagacccataacccaccagatacacctcctccctaactcaaaaccagttaatattcgcccataccgctacactcatttccagaagacaaaaatcgaaagacaggtgaatgaaatgttatccaccggactcatccaactcatccatagcccattttccccaccagtcctcttggtgaagaagaaggacggcagctggcggttctatgtagattatcgtgcccttaactctgccacattgaaggatcgctttcccatgcccacgattgatgagctcatggacgagttgggcaatgcctcatggttctccaagcttgatctccgacaaggtttccaccaaattttaatggcggaacacgacacagctaaaaccattttccgcacacaccttgggtactatgaatacaaagtcatgtcgtttggcctctgcaacaccccctctacgtttcagtcagccatgaaagaactcttgaaaccattcctccatcgttttgtcatagtattcttcgatgatatcctggtttatagcccatgcttcgcagaccaccttcaccatctcgaagaagtctttgactgcttgacacagaaccacttctatctcaaggagtcgaagtgttctttcgctcaacaacggctggagtatttgggtcatatacccactccgtcctccaccaccaccctccatggttttctaggtcttacggggttctgccgcaagttcataagagggtatgccaccatcatagccccattgactaccctactccaaaaagataatttccactggtccgacgatgcacagttggcttttgataacctcaaacaagctatgacttag

SEQ ID NO: 41928 - DNA, 984 bp, Glycine max
  Peptide Sequence Number=SeqID_158706
atggctttgaagattgatatcaataaggcctttgatagggttgattggaattatttgttggttgttatgatcaagatgtggtttcatcagaaatgggtggattcgatgaaactttgccttgggtctacgcaattctcagtaatggttaatgaggattctttgggacctatttctcctaggagagggctaaggcagggtgaccaattgtcaccttacctgttcattatttgcactgaaggtctttcttcccttctaaaaaaatctgagaggagtggtgagttacatggtatcaagcatattgctttgaaagctattctagattcctatggtgaaaattctgatcaagcaataaataacctgaaatcagagatctttttcaattcaaatacaccaccaaatctccatatttcatcttacatgggacagaatgtggaagcggaacaaccattggagtgggaagcatatatctatctaaagcgggatgtgataaaggaaggcgtgagatggaaaattaggagaggtgacaaaatcaacgtatggaatcaactatggctttgctctaatgagaactcctttgttaccacaccaccacctcgtggactagagaatatgatgaaagagattgtttacccaccaaacttaggctacaaacaaaaggagttcaatgtccttcaatgtgccccttttgcaccaacaaccttgataatagctggcatagtagaactgatcttcaaaattgtctattcttggcaacacaatcaggatctcacaagaccacctgagcctatacaagaaaatgcacgcattgctcaatggcaccctccatccccaggctggttgaaatgtaacatagacgcattaattttcagatatcaacaagctttcagcatgggactttgcatctggaacgaatgtggtcactacctcctagctaaagcagcttggtcttttggcactccgaatccaacagaagctgaggcatag

SEQ ID NO: 41929 - DNA, 219 bp, Glycine max
  Peptide Sequence Number=SeqID_158707
atgttgcatgaggtggcagaaggaagtagtgaagatgggggcgatgaagtgaaacaagaagacttggctatgagtaatgatgcagctagagatggtccaataaaagctgtagaagaggcagacatggtgagagatactgccaaggagtccatggatggagcttggattgcagctcaagaagcttcacacaaggttagagacaatgacaacaagggttga

SEQ ID NO: 41930 - DNA, 414 bp, Glycine max
  Peptide Sequence Number=SeqID_158708
atgaaggctcaggcagacaacaaacgtcgtgacgtctcttacagtgtcggcgattgggtatatgtgaagctcataccttatcgccaaacctcactatctgattcccactaccacaagctatccaagcgctattatggtccatttcaaatcaccgagactatcaacgttgtcacttaccgtttagctcttccaccatcctccaagatccacaatgtttttcactattcaatcctcaaaccccatcacaatcccatcattcagaccatgaaccctctcccaccccgtgctaatgacaatcaccccttggttgaaccaatgaacatactcgacacgaagtgggataacactcaggacccttcatcactattgttccttgttcaatggcacgacctcccaccaaaaggcacatcctag

SEQ ID NO: 41931 - DNA, 333 bp, Glycine max
  Peptide Sequence Number=SeqID_158709
atggcaaaacaagtatattatgtaaattatctagaaaggccaaatgattggttggttgtgatcaagaccaaggcacaaagcataaatggaagtttagaaagtagaaaccttgagaaatatgtctcataccaagatgaatcaatcacacaatttccaataacaattatggatgacaatcttgaagaaagtcttgttgatataaggggacaagttgaagaagcatttgttgattccttggatgaggttgactttgaagacaatggagaagttgaaatagaagaagtaatagtactacaagaagtggaagacatggaggaagatgatgatgaataa

SEQ ID NO: 41932 - DNA, 261 bp, Glycine max
  Peptide Sequence Number=SeqID_158710
atgtggaagttggacggagtaatggaagtcatggacttggagaatgaatacttcttagttaggttccaagattggaaaggtttatgccatgtatttgaagttagtccatggtttggtcagcataaagaagtgtggccaatgtttcaactaaagatgaacagcaagttagaaaaaggatgcatgtccttcccatggacaataataaaaacgcataatggtgaattagatataaaaaaagaaaggagaggtaaagctcaataa

SEQ ID NO: 41933 - DNA, 219 bp, Glycine max
  Peptide Sequence Number=SeqID_158711
atggcacaaaaatgtcctcaggaatttaaaaatcctgtgatctgtcctgagtatctagtgtttgaacatcctcctcatctgttaagctcagaagtggcctcaagagatttctcagaagtggctgcaacttcttgtgtttcaactatccttttccatctgatcaggggctctggagtggaagtatcagatgactcatcctccctctactgtggtacctga

SEQ ID NO: 41934 - DNA, 294 bp, Glycine max
  Peptide Sequence Number=SeqID_158712
atggcagttaaccgtcctgtccttcgtgttcacgagaatctaccattagcattaactgttgctcctcaccaattcctccccttcaaattcacctccgttggaattcgctgctcccctttcaacgacaaaaccctcatttccatcaaacctaacacttcccacctcaaccacgacactctcgcttgtcgctttcacgctgcccagtttgctgtttttccaaattctttgctttgtgtgaaaatcaatccttctcaaatgctttattgcaacccagtatttctagagcctggatga

SEQ ID NO: 41935 - DNA, 201 bp, Glycine max
  Peptide Sequence Number=SeqID_158713
atgtcaatacattacctaccaactttgtacatattccatcattgggcacctgatttgcttgagctcctgtttcataaaggatctaaacttctgattggggaacttccttctatacttgatggatcagcaatagtaaaggctcaacctcaagatgactctaaggctacattggctcccaaggtatgtgattgtgagccttga

SEQ ID NO: 41936 - DNA, 339 bp, Glycine max
  Peptide Sequence Number=SeqID_158714
atggagagtcatgagggtggggacaatagcaatggtgagggagggaagaggaagaagaacgaaacattattctcggagataacaaaggacaccgtatcaaaaataaaacggcattgttatcggtcacgcggcggaaatgaaccgaagttgtgtacaatccatgacaacacatcaccaggctatcaatggctgctccccggttgggtagcagaagaacgccacatgatgtcgggcagggtctacaggtactactatgaccgacaagggcgtcaatatagaagccagagcgaggttgtagctgcatgggagaaaatcggggtggttctcattgatgactaa

SEQ ID NO: 41937 - DNA, 1227 bp, Glycine max
  Peptide Sequence Number=SeqID_158715
atggcagacgctgaggatattcaaccccttgtttgcgacaatggaacaggaatggttaaggcaggatttgcaggagatgatgccccacgtgctgtgtttcctagcattgttggtcgtcctcgtcacactggtgtgatggttggtatgggccagaaagatgcatatgttggtgatgaagcacagtctaaacgtggtattctgactctcaagtatccgattgagcatggtattgttagcaactgggatgatatggaaaagatttggcatcataccttctataatgagcttcgtgtggccccagaagaacatccagttctgttgacggaggctcctcttaaccctaaggctaaccgtgagaagatgacccaaattatgtttgagacctttaatgcccctgctatgtatgttgctattcaggctgttctttcactgtatgccagtggccgtacgactggtattgtgttggattctggggatggtgtcagccacacagtgcctatctatgagggttatgccctcccacatgcaatccttcgtcttgatttggctggtcgtgacctcacagatttcttgatgaagattttgactgaacgtggatattcttttaccacctcagcagagcgtgaaattgtgagggatatgaaggaaaagctggcttacatagccctcgactatgagcaagagctagagacatccaagaccagctcttcagtggagaagagctatgagttgcctgatgggcaggttatcactattggcgctgagcgtttcaggtgtccggaggtcttgtaccaaccatccatggtaggaatggaagcatcaggcattcatgaaacaacatacaactccataatgaaatgtgatgttgacatcaggaaagacctgtacggtaacattgtcctttcaggaggtacaaccatgtttcctggcatcgctgatagaatgagcaaggaaatttctgctttagccccaagtagcatgaagatcaaggtggtagcacctcctgagagaaagtacagtgtctggattggaggttctatcttggcatccctgagcaccttccagcagatgtggattgcgaaggcagagtacgacgagtctggaccatcaattgttcatagaaagaagaatttctctgcataccagttctgtacccccatggacatgagcacaagctctctaatcaaagattcaccttggaacccgaaatttggaaccagttcatag

SEQ ID NO: 41938 - DNA, 1608 bp, Glycine max
  Peptide Sequence Number=SeqID_158716
atgggtctcgataccgtcgcgctggaaggtaaagggtttacccgtctggtggaagagggcgcaaccgtcacggcgggccagccgatcctcgaaatggatctggacttcctcaacgccaatgcgcgttcgatgatcagcccggtggtggtcagcaacagcgatgattttgctggtctgaatctgctggcaggcggtaccgtggtagcaggcgttacgccgctcgctttgtggatcatactccgttacttcgtggtacaaatcacccgctattgttttgaggattttgagatgagtgaggctgaagcccgcccaacgaactttattcgtcagatcatcgacgaagatttggcgagcggtaagcacaacagtgtgcatacccgtttcccgcctgagcccaatggttacctgcatattggccatgcaaaatcgatctgcctgaactttggtatcgcacaagattatcaggggcagtgcaacctgcgtttcgacgacaccaatccggtcaaagaggatatggagttcgttgaatcgatcaagaatgatgtgcaatggctgggctttgagtggagcggcaacattcgttactcctctgactactttgaccaactgttcaactacgcggttgagctgatcaacaaaggcctggcctacgttgacgagctgtcgccagagcagatccgtgaataccgcggcacgctaaccgcgccgggcaaaaacagcccgtatcgcgatcgcagcgtggaagagaacctggcgctgttccagaagatgcgtgatggcggcttcgaagagggcaaagcctgtctgcgtgccaaaatcgacatggcatccagctttattgtgatgcgcgatccggtgctgtaccgcattaaatttgccgaacaccaccagactggcaacaagtggtgcatctatccgatgtacgactttacccactgcatctccgatgcgctggaaggcatcacccattccctgtgtacgctggagttccaggacaaccgtcgtctctacgactgggtgctggataacatcactattccggtgcatccgcgtcagtacgagttttcgcgcctgaatctggaatatgcggtgatgtcgaagcgtaagctgacacagctggtgagcgagaagattgttgaaggctgggacgatccgcgcatgctgaccgtatccggtctgcgccgccgtggctatagcgcggcgtcaatccgcgaattctgtcgccgtatcggtgtgaccaagcaggacaacattgttgagatggcgtcgctggagtcgtgcattcgtgacgacctcaacgagaacgcgccgcgcgccatggcggtgctggatccgctgaaagtggtgatcgagaacctgccggccgggcatgaagaaatcatcagcatgccgaaccatccgaacaagccggagatgggcacgcgtgaggtgccgttcagccgtgaggtgtggatcgatcgcgccgacttccgtgaagaggccaacaagcagtacaaacgtctggtgctgggtaaagaagttcgtctgcgcaacgcttatgtcattcgtgccgagcgcgtggcgaaagatgaagccggcaacatcacctgcatctacgctacctgcgat

SEQ ID NO: 41939 - DNA, 825 bp, Glycine max
  Peptide Sequence Number=SeqID_158717
atggcgggcatgtctggatgtagttgccgttggcagtgggcggaggcgaaatccatgggagtgggctgttggttcccttcctcaactaccaaaaggagtttccggcctgtgattgtttctgtttctgctatctccgataataactctcactcttacactagcagcggaagaaagctagaagaagaaggcatcaaagggtcaggaactaccgccagagatcgcaggttgcttagaattcgccaagagaaacgacagcgggaatacgacctccttaacaactaccctgcttgggcaaaagtcctggaaaacgcttgcaaagacgatgctgaactccgtgccgttctcggagatagcattggcaaccccgaactcatgaggaaacgagtcgaagatagggtgagaaagaagggtagagactttcaaaagtctaaaacaggatccgtccttgctttcaaagtcaccttcagagacttcaatccacttgattcatatatctggtttgaattgtttggatcaccatcagatcgggatgttaatctaattggtaatgttattcaatcatggtatgtcatgggtcgtcttggtgcctttaattcttcaaatttgcagtctgtccgcaagccattatgtgatggattattttcatatgctagacatgtttcccaatcttcttgggcctcatgtataaactttatgactgttaatgttaggctgttgcttggaatcaacgcattgtatggctctagtacaatgtcaaatgagcaagaggtattgcatcgcttgctggatgtagtgaaaagtaaacaaaggttcccacttcagtag

SEQ ID NO: 41940 - DNA, 1008 bp, Glycine max
  Peptide Sequence Number=SeqID_158718
atggtgaacccaggctcggcagatagaacagttaaattctgggatcttgaaacctttgagcttattggttcagctggtcctgagacaactggagtgcgttctcttacttttagtcctgatgggaggaccctgctttgtggtttacatgagagtttgaaggttttctcttgggaacctataagatgccatgatatggtggatgtgggttggtctagattgtcagatcttaattttcatgaaggaaaacttcttggctgctcatacaatcaaagctgtgttggagtctgggttgtggacatctcgcgtatagaaccttatgcacttaataatgtgaaccatctaaatggccattcagaaactaaatcttcaagtggaaatatgactgtactgaatgagatcactgctaaggctaggctatctgtttcacaaaatccagatcaattactaaaagaaacaagatctcttggaaggttgtccgtttctcaagattcagaccccttaaaggagggaaaatgtctagcatccacaggaagtgcaccaagtactcctcaaaggatcaatttgaattctggacccaaaacagtacccggtggttcaacaacagtgcttaatacaacagctcagaaaaagagttctttgaaatctcatacaacgtccagtgctccacttatcaataaatcagatattatacccgtaattgtccccagaactagcatgaggtcagagcctgtggctgattctagaaaagaagttggtgtttctggaagaacgatgccattcccctcacagtcaaaggcagcagatgtacgtaaatttccgaacaacagagatgatgtggataagcccctctctcctgtaatcgaatctgcagcttctaagggtagtgaattaagtggttttgcagataaaaataatttccctgcttctgtaagctcaacgcaaggtatttctacatctttgaaaagcttaaattatactaggcttcttgagactggcaaatatgaataa

SEQ ID NO: 41941 - DNA, 846 bp, Glycine max
  Peptide Sequence Number=SeqID_158719
atgtgtttagagttctgtcttgtgccagatgaagctcgaggactgaaagtaaacagagatgtatgctctgtcgaagtacaaaaaggagggagaatgcgctcacttctcaatttagaaaagagggaacgatctcttaattatgagggacctagacaagggatttctcatggaaggatatcatcagttcatgtgctccctttcagtgggtatgtaatttccttattcctcaaagttaaacagagagcacattctatatccactgagaaggctacagtttctgctaccgatgaagattccattgctgatgtgatggaacagcatgacgaatttcttagttcaatgctggctcgttcagctaagttacagatggtcttcagatgttgggaaagaaatgatgttaaggaggtcattggcataatggcaaggatggatgatcatgctgtgattgctgatgttgttagcattataatggaaaaaattgatatcattacacttgagatatgtgctggtcttctgccacttctaactgatcttctacaaagtgaaatggaaagacatctaggaatatccttggaaatgctattgaaactggtcagaatatttggttcagtaatctattcaaccgtatcagctacacaacctgttggtgtcgatatcgaggcagagaacagatgcgcatattcattcatcttttgtttgttaacgaggttcaggctagagcgttgcaacctctgcttcacagagcttgaaaaagtcaaacgttttttgccttctctttcaagaagaggaggatcaattgcaaaatctgcacaagagttgaatctggctttgcaggatgtttcgtga

SEQ ID NO: 41942 - DNA, 369 bp, Glycine max
  Peptide Sequence Number=SeqID_158720
gcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacaggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 41943 - DNA, 621 bp, Glycine max
  Peptide Sequence Number=SeqID_158721
atgactaccaaacgggcttacaagcttcgtatccttcatctcttgtctatctctctctactttgttattatgttagagtctttctttgtgtgtgtgtgtgacttggctggccttgacgagttatgtccagaggaatttgtagcacatgcttctactgtcaattgcctcaagattggacggaaatcatccagggttcttgtcactggaggtgaagatcacaaggtcaatctttgggctattggcaaacctaatgccatactgagcctgtcaggacattcaagtggaatagattctgtaagctttgattcctctgaagtgttggtagctgctggagctgcaagtggtactatcaaactttgggacttagaagaggcaaagattgttcgtactcttactggtcataggtccaattgtacatcagtggacttccatccttttggagagttctttgcatctggttctttagacactaatcttaagatatgggacatcagaaagaagggttgtatccatacttacaaaggccacactcgaggggtaaatgcaattaggtttaccccggatgggcgctgggttgtttcaggtggagaggacaatactgtaaagagtcagatttcataa

SEQ ID NO: 41944 - DNA, 615 bp, Glycine max
  Peptide Sequence Number=SeqID_158722
atgacgactaacacagtggacaagccaactttgattcttaaggcagactactacaaaggcaaagaaaagatgatcgaagatgcaccctcaacgcgctatgttatagcaagactagggattggcaagctttacagaggtattacaaatttggagccctttgttctggtttggaacctgaggagaagccaccatcagatggagttcattacaagacagcgcaacttctcatttactattgagcttccatactccactttcaccttcgttcaccacatacaaaccataattgaagaagtgtattttgatgacgaggtccctattgttgttgttgatatgaccatggaagtttacaacaatcctcctccatcccaagagtatgttagatttcttgagacaactctacttagaacacgggaggcacttgctgaagcttttcatgatcgggttgatgctaaaagagaagccaaaagatggaaggtccttagaaagcaccttttcaagaaatgtgttgatgctctctttgatagttcatttgatgacgaatttggggataagtccttttgtaagcatgaaggggaagaagaggctgccaaacaaaagggggataagaagtaa

SEQ ID NO: 41945 - DNA, 2805 bp, Glycine max
  Peptide Sequence Number=SeqID_158723
atgttgtcacaactggcaaaacacccggatgacggcaaaggaaaattggcaaataaaaaccctaacatcggtaatcggggaattttgaaggtggctcagcccttgcgtcatgctcttgcgcgtgtttgtcagattgatggtagtagtatgagagatatgcaccggaattctactggtagtactaacactaataagatatcatcatcggcaataaggctgccctcacctcaacaatctctaagacgcttgggattgtgttcccagatagctacgggggagcactcttctcctatcgtcttccctgaaaaacgtggcaaagtcaaggcgacttccaggaagaccagtgtcccccccactaccattcgtccagatgatcaggacataaccaagaattttgagcataggattgacattgcaggggctggaggaggaggaggagatgagaagtctgatttgttaggatatgtcgtattctctggaaaactcattttggataagagaaaacttgctacaataaataatgctgctgctgatgctcaacaatcttcttctgatataaccaaccaaaatgctgtagatgccaaactaacaagcaaggccttggcttggggatcccatgtgctgcatctttatgatgttatctcggtttcttataatgctggtctcagacatttcacagtgcactcctacccattgaaagaagcttcatgtgggctttcttgctgtataaaatctcgacgaagtcgcaaggacttccgctttgttgcttctagcatagaagaagcacttcaatgggttggtggattagcagatcaacactgtttcgtgaattgtcttcctcaccctttactgtcttcgaagaagcaagcgtcctcagaattacttcatacagatacccctcctgaattgctctttagatgtaaaactccacctaagatgcttgtgattttaaacccacgatcaggtcggggtcgttcaagtaaagttttccatggcattgtggaacccatatttaagcttgctgggtttagattggaggtagtcaaaacaacatctgctggtcatgctagaaatcttgcatcaagtgtagacatcagcacttgccctgatggaattatctgtgttggtggtgatgggataatcaatgagaacactgaaacagatatatgtatctcttcttctgtactgatatcagatcagtgggactggggtctaccctccttcccactactatgccgaactggtagttggctcagctgtggtcataatgtgtcccatgcccacgtgtgtagcggtgcggtttcgggttgcggctggagcagccgctatcgcagcggagcggcgcgggttgcggagcggtttttcgcgctgctacttcgaaggaagcactggaatttccgatttgaaggtcactcttccagttcctcccacccaagcctcccccttttcctcctcctccgccaccctccgtcctcctccccctcacgcgccgccgtggcggcttcatcccctcctgcctctccaacgacgccgtctccacgcgcaacttcaaccgttcttaatggtctccttagtagagacaatcaaaaggaaggaatatctataccaattggaattataccggctggttctgataactcactggtatggactgttcttggagttagagatccagtttctgcagccatggctattgtaaagggggttacatcttcctcctatattgaagaattgtttccaaattttgctgtaagcccaacagggtttagggggggtcttactgctacagatgtctttgctgttgaatggattcagaccaataaaattcactacggattaactgtctcatattatggttttcttagtgatgtgttggaactttctgaaaaatatcagaagcgctttggcccgctgcggtattttgttgctggattcttcaagttcctgtgcttaccacactacagctatgaagttgaatatcttccagcttcaaagactgagggagaaggaaagctttcaggtgaaaaggaagtagttgacatgtcacatctgtacactgacatcatgagcagatcaaataaggatggaatgcccagagcatctagtctttcaagtattgactcgataatgactcctagtcgtatatctggtggagacctggatacctgtagtagcacccatgctagcactgaaccttctgaattggtgcgtggcttagatccaaagtccaagcgcctatcgtctggaaggggcaatgtaacagcagagccagaagttatccatccgcagctgcctctgtcaacaactcccaactggccaagaaccagatctaagtcaaggaatgataaaggatggactggattgaccacaacacatgatacctctagatggggaaatactgcgacaaatgatagagaggatatatcatcaacactgtctgatccaggtcctatatgggatgctgaaccaaaatgggatgccgaacctaataattgggatgtagaaaatccaattgagttgccgggaccatcagatgatacagaaataggatctgcaaaggaggttgtgccccattttggagataaatgggttgtgtcaaagggacaatttcttggcattctggtttgcaaccacgcatgtagaactgttcagagttctcaggtggttgctcccaaagctgagcacgatgataacactctagatttgctcttggttcatgggagtggaaggctgaggctgttgagatttttcttacttctacaaatgggtcgacatctttcactgccatatgttgaatatgtcaag

SEQ ID NO: 41946 - DNA, 195 bp, Glycine max
  Peptide Sequence Number=SeqID_158724
atggacaaactgctctacgaaaagcctcgcctagacggagatgacaagaaggctctcaacaccttcttgaggacaaccaacctgacctacatgtgtaggatgatccacagtgtgttgtttagcatagtcatgcatatggttggctcaagagactatatcagcaacattaaccatttatgcatctacaagatcatg

SEQ ID NO: 41947 - DNA, 867 bp, Glycine max
  Peptide Sequence Number=SeqID_158725
atggcgcttgatgcgggcgattattccgccagcgcctgctgcagatcggcgatcagatcttccgcatcctcaatccccaccgacaggcgcaccagctgcggccggaatggaggcgtgcgtcatgctgaacggctggctgatcaggctttccacgccgcccaggctttccgccagggtgaacaggcgcgagcgcttgatgacccggcgcgcataggcgtcgtcgcctttcagccgcaccgagatcatgccgccgaagcgcgtcatctggcgcgccgccagcgcgtgctgcggatggctaggcaggccgggatagtagacgttttccacctgcggctggctctccagccactgggcgatgcgcagcgcgctgtcgctgtggcgctgcatgcgcagtgccagggtgcgaatgccgcgcagcgtcaggaagctgctgaacggatcgagaatgccgccgaccgcgttttgcaggaaaccgagctgttccgccagcgccgggttatcccccaccgccgcgacgccggccaccacgtcggagtggccgttgaggtatttggtggcggagtgcaccaccacgtcaaagcccagatccagcgggcgctgcagatacggcgaggcgaaggtattgtccgccacgctgataagcccatgctttttggcgatcgcggcaatggcgctcagatccgccagcttcagcagcgggttggtcggggtttctacccagatcattttggtgtccggctcgatcgcctgctccagcccggcgagatccgccggcgacacgtaagtgacgcgcaggccggcggtgcggctgcgcactttttccagcaggcgataggtgccgccgtacagatcgtctactgcgatcag

SEQ ID NO: 41948 - DNA, 369 bp, Glycine max
  Peptide Sequence Number=SeqID_158726
atgcatatgatgaagaaggtgtgtgggtttgcaatagtggtgatggcagcactttttctggtggagatgagtcccatggcagaggctgtgacttgtagccctgtggagttgagtccctgtttgggggcaatcacgtcctcttcaccaccatcgacaacttgttgccagaaggtgagggaacaaaggccatgcctctgtggttacctcaaaaaccctagtctgaggccatatgtcaactctcctggttccagaagggttgctagctcttgtggggttcccttcccaactttctatggctctaagcatctcgcgactgtagggtcaaccagtcatggtagtttcaaactaaaggaatttaggctaaattaa

SEQ ID NO: 41949 - DNA, 738 bp, Glycine max
  Peptide Sequence Number=SeqID_158727
atgttactttacatgtggcctacaacgttcagggttgaaagcaccttcataaaactagtaaaagttggtttgggttcatcagaccctgactcagggaaaggaaagagcaagatgtcaaagaacataactcatggttatcatttggtgaaaggaaaatcatatcatgacatggaggattacgttgtggctcaatttaagcaaatagataacaatgaattgggtttgtttgcaatattcgacggccatgcgggtcagaacgtacctaattacttgcggtcccatttgtttgataatatcttacatgagcctgacttctggaaagaacctgcagatgctgtgaagagagcatacagtaaaactgattctaatattttagatatgtcgggtgaattaggtagagggggttcaactgcagttacagcaatattagtcaattgtcagaagttaatagtagccaacattggggattctagggccgtcttatgcaagaagggtgtggccaagcaactatcagtggatcatgagccaaccgcagaacatgaggatattaaaaatagaggtggttttgtatcaaactttccaggggatgttcctcgtgttgatggacggctggcagtgtcaagggcatttggtgacaaaagcttgaagaaacacttgagttcagagccatttgtgactgtggagaatataggtgatgatgcagagtttgttatattagccagtgatggattatggaag

SEQ ID NO: 41950 - DNA, 306 bp, Glycine max
  Peptide Sequence Number=SeqID_158728
atgctttgttctcgtgttgttggctcttgtgagcatgctcatcatgagtacaagaactacatacatcttgtgtatacgttggaaaatgtctccaacgtatatagaggattgtttggaaaattgtgcaacgaagcgtattggccatgtggtagcaatgccttccaagttcaagtggagggtacatccacttggtttttcaaagagaacaagggagggtacatcccttgtggatctttggcttgtaaaggattttacaaggttgaaagaaatctcaagaaccacaggttgcttggggactggatgtag

SEQ ID NO: 41951 - DNA, 270 bp, Glycine max
  Peptide Sequence Number=SeqID_158729
atgttcttgtggttcaagttattcatcaggaataacaagttgttcttcttggacgaagtcattagtggaagaactgccagcaatactttggtgaaaggatacaaacgaaggtatggacatgctttgcgtgtacgcataagcatactccagtgttcgaagatttgtacccatgagattgctcataaagtcttctcttctagcactaaagaactgaggattgtacccataatcttcttaatgatgatgaggttgtggcgtgaattcatatga

SEQ ID NO: 41952 - DNA, 714 bp, Glycine max
  Peptide Sequence Number=SeqID_158730
atgcatggggttcacggagttttcttatttcccactacttacttgcaaggacttatgatgccctatacctccaagcacaactattgtcatcacaaattacaattagctttgttgggaaacatatcccttcaaagaaagtccccatcgaatgttggacttcttcatgatccaagctatggctgtattcagaatcttgaaaattggattcttctaaattttgcatttgttgtgggactaagttcttcattaggtaagtcaagctttgttgtaaactcaggctcgtttggtttggttgatgagcaaaagtgtcttgggttgcattggatgtgtgtaaataatgggaccgaggataatattgtggttgatgaggtactggttgagggtttggggtgggaagtacattcctctccagatcccaaaattgaacctttgtttgttcaagttgagttttcagatgttgcaatgctggggcaatttaaaatcgaccatgatttagtgactactttggttgaaaggtggagacctaagttacgcatgtttcatcttcttgttggtgaatgcacaatcactttagaaaatattgctcttcaacaaggtttacgtgttgatggtagaccagggatgcattttaggactgattggtggggtgctgatgctagacaagtcatggaacagagttcacctgatgtatctacccttgttagcagatcttga

SEQ ID NO: 41953 - DNA, 1374 bp, Glycine max
  Peptide Sequence Number=SeqID_158731
atgaggtcaagtggtaaacccaatgctagaactagtcttctaacatggaccaatcgtttgaggcttgaggttgatacaactgcgtgtttatgcagagtagatacaggtctaaaaaccgttgctggagcaaagaacaatgtccctggaacaaagttctgtcttcaacctgacattaaccatccattcacccaactagaaacaaagtcggcacatggtgacagaagccgtaatcaatcccctctacttccaggactccctgatgatctggctattgcttggctaatccaaagtcttggagtcgcagaagagtggatatatgtcattaagagggaccaagatggaaaaatatcatggcatgcctttgatcctgtgtaccatctatggcagcccctgccacctgttcctaaggaatattctggagctcttggttttggctgtgctgttctcaatggctgtcacctgtacctgtttggagggaaggacccactaaagggatccatgagacgtgtcatattttatagtgctaggacaaataaatggcactgtgccccagatatgcttcgtaggcggcacttctttagctcctgtgtcataaacaattgtctgtatgtggctggtggggagaatgagggtgtgcaccggtccttgagatcagctgaagtgtatgatcccaacaagaatagatggtcatttatttcagatatgagcactgcaatggtgcctttcataggagttgtctatgatgggaagtggttcctgaagggactcggttctcatcggcaggttctgagtgaggtctaccagccagagaacgataaccggtaccctatttatgatggaatggtttctggctggaggaaccctagctgtaccctaaatgaaaagctctatgccttagactgcaaggacggctgcaagattcgggtttatgatgaggttgctgattcatggagcaagcatattgacagtaaaatgcattcggggagctcacgggctttggaggatgctgctcttgtccccctgaatgggaaactctgtatcatccgtaataatatgagcatttctctggttgatgtttcaaaacttgaagatttgaaaggatcatctcctgaacagttatgggaaactattgctgggaaaggacagttcaagaccttggtcacaaatcggtggtctagtcttgctgggagaaaccgactcaaaagtcacatagttcactgtcagcttgtcacaggttacagtatctctcatcttgatggtatgtttgtgagaagctgggacaaatcttgccagaacaccatgatgcagtctataattgcttttcatctcaaatccttggcatcatggtcatcacaagaggtgaaacatagatga

SEQ ID NO: 41954 - DNA, 252 bp, Glycine max
  Peptide Sequence Number=SeqID_158732
atggcttaccagctgagtgagattgttgttggagactggttagctcaaaaatcaaacatgttaggagggagaacttttgtggctgagaattgtaataagctcaaagggttgagaataggaagaggattattcaatcggcaatacacatcacttcttgcttcaacactatccctgacccaagttgacgatcaaccgcctccatgctctcataggacatgctttgttcagcgatggagagaagagattgagtga

SEQ ID NO: 41955 - DNA, 240 bp, Glycine max
  Peptide Sequence Number=SeqID_158733
atgtcttcttcctctagtactagtagatggacggttcaggaaaacaaagcgtttgaaagagctctagcagtttatgacaaggacactccaaaccgttggtgcaacattgcaagggctgttggtggaaaaactccagaggaagtgaggaggcactatgatcgtcttgtggaggacattaggcgtattgagtctggccaagttccctttccaatttacaggaacctccaagatggggcatga

SEQ ID NO: 41956 - DNA, 273 bp, Glycine max
  Peptide Sequence Number=SeqID_158734
atgtcgaaggggtgcgtgcgctgtgcgtggccggcagcggcatcgctcagctttccgagtgggatgtgcgggaagagctggcatctggcgaactggtggcgctggagctggaggacgcgcagccgcagatgctgggcgtgtgggcgctgtttcccaccacgcgccacctgccggcgcgcgtcagcgtatttgttgcggcgctcaggcaggcgatgcaacagcaaagccggcccggcgcgtgacgcggacgtacgaaaaaaggcggaggggtga

SEQ ID NO: 41957 - DNA, 420 bp, Glycine max
  Peptide Sequence Number=SeqID_158735
atgccggcaacgcgatctggcgtatcagcgccgcgcagtaggataatcgcaggcaataaaaaaggatttggccaggtcgccaaatcctttttttatgttcgtcacccggctggtgttgagcgcggcggatgcttattgttttctgatgactccaggggcgcggatagtcaaaccccggcaggtttcaggtggtgctggcctgtggctttcacaatgagtgccgctcagcgctcctcacagatgtgcttaggcggtcggcgggtaaagtcagggccccgaaagctgaacagcgcgctcctgtcagaggagaaggaaagtgatggaacttgttcgattactcctggacctggtccgggtgatcctgcaaatcatcgttgcccttttgcaactgaccggtcaggcgcactgaccggaacttga

SEQ ID NO: 41958 - DNA, 860 bp, Glycine max
  Peptide Sequence Number=SeqID_158736
agtggaaccctaaagctacaggtctccttcctccgtccaccatcgcaccaagtcgcagcttcatagcagcaccgcaccgcaccgcaccagaaaatggaacatcaagtcatgttgtagaaggggctgctgatgctgatgctgatgctgagctttctccaccatcacaaaaaggagatgacgctaaagaagtttcaaagaagaaaaagaagaaatctaaaagcaagaaaaagaaagaactcttacaacagactgatccaccatcaatttctgttattaaccttttcccatctggagattttcctgaaggtgaaattcagcagtacaaagacgataacctatggagaactacttcagaggagaagagagaactggagcgcctgcagaaaccattatataattcagttcgtcgagcggcagaagttcatcgtcaggttcgcaaatatattaaaggcattttaaagcccggaatgttgatgactgacatatgtgaaacattggagaacactgttcgtaagctaatatcagaggatggccttcaagcaggcattgcattccccacaggatgctctttaaattgggttgctgctcactggaccccaaattcaggggataagactatacttcagtatgatgatgtgatgaaattggattttggtacccatgttgatggatatatagttgactgtgcttttaccgtggcattcaaccccatgtttgatccactgcttgaagcctctcgtgaagcaaccaatacgggtattaagcataaagctaaatatcagtatcattattataagaatgttgagagaaccataccacaaaagctaggcattgtagttggagagcctaaggctctataa

SEQ ID NO: 41959 - DNA, 683 bp, Glycine max
  Peptide Sequence Number=SeqID_158737
atgggagaagtgtttcaaaatatgagcgaagaagaagaagaagaagaaggaagtgtgatggatggagttatggaagtaaccaagtgggcgcaggagaagaagacagaccctctgatatggtcgatccaggtcagctccgccctgaactcaggcggcgtctccctcccttccgtcgagctggcacagcggctggtctcccacatctgcttcgagaatcacgtgcccatcacgtggaagttcctcgagaaagccatgtccgtcagactcctccctcctctgctcgtcctctccctcctctccgcccgcgtcgtccctcagcgccgcctccacccttccgcctacgctctctacatggacctcctcagccgccacgccttctcccctcacatccacttccccaattacctcaaagtcatggcctccatccatcactccctatctcttcccccctccaaccaccaccctcatcccggcgtcgttctcgttcactttctcttctctatcgtctcgcagcttctccaatcttccttggacgaccaaggatttctccaacacagccccgatccctacaacaacaacgatgccttgcaccggaaaaacactgccatggccattgagattattgcgcgctttcttcaccacaaactcacttccagaatccttgcattggttcaacgaaacat

SEQ ID NO: 41960 - DNA, 423 bp, Glycine max
  Peptide Sequence Number=SeqID_158738
atggaaagtagatgtgagagtgactatgagtctatgaaacaggagagcaacaagtacgtggaagcctatgctgtggggagaaatattcgtatgtctgctaataaagctcgaagagtgattgatcagattcgtggaagtaaatatgatgaaacactaatggtattagaactcatgccttatcgagcctgtgaagccattctcaaaatagtgttttcggctggagcaaatgctagcaataatctgggtttaagcaaaggaagtttagttatcagtaaagcagaggttaatgaagggaaaacaatgaaaagggtaaaacctgtagctcgagggcgtgcccatccaattaaaaagcgcacttgtcatataaccatcacggtaaaaggcttacctagtgagtccgtcgaggaagcaaagcctgcttaa

SEQ ID NO: 41961 - DNA, 1173 bp, Glycine max
  Peptide Sequence Number=SeqID_158739
atggctttttacggaggcgcgaaacgcgtttgtgtatccataaggcactattgttcgaattcagcgtcagagaaggtgaatctgataaagcagctgagagagagaacaagcgcagctatgaaggacgtgaaagcggctctggtggattcgaattgggacatagaggaagctcagaaggaactgaggaaaagaggcaaagttttggcgtccaagaaatcctctcgaactgcctcccaaggcctcctcgctctcgcccaatcccccaccaaactcgctctcatcgagctcaactgcgagaccgacttcgttgcccgaaacgacatctttcagcacctcgctttgcgtttagccaaccaagctttgtctctgtcgctcgattcttcttcttcttcttcttcttcttcctttcatcttggacctcaatcccttcaggacatgccattcaatctcgaccatcctaagttcaacggccaaacaactgttcacaacgcaatcactgagctcgccgccatgatgggggagaatgtcaggcttcgaagaggttacgtcattcctgcatcacccaatggcttcatttctacatatcttcataccagcccccaaccaggtttgggtcgcattgctggaattttgtctcttcaagtggacgatggtcaaactcaactccaagctcttcaacgtgttggatccgaattggctatgcatgtagtcgcagcaaagccattgtttttaactaaggaacttgtaccttcagatgccttagaaaatgagcgcgaaattcttaaatctcaggcagaagcctctggtaagcctaagatggccatagagaaaatggttgaaggacgtctccgcaagtattttgaggatgttgtatttatggaccaaaagtttattatgaatgatactatgaatgtgaagtaccatggtagatctgtgagagattcagaaatctgcaaacagctcccacatcaaatggtaggtggctgtaacttgagaatttggtgtaaggtgtcaattatgatgtcttcacagctgaaacaggcagtgctggataatctatccaaggaggtgggttcatctgtgagggttgttgattttctcagaatggaagttggggaaggaattgcaaggcaagaaacagatacatctgagactgttgctcaggttgcctga

SEQ ID NO: 41962 - DNA, 3088 bp, Glycine max
  Peptide Sequence Number=SeqID_158740
gccagcgcattggggaccttttctacaccagctgcagcagcttgcggcaaactccacagtgttgaggagcttgaagcacgtcactcctgagtcccttttgcctttggatttcaattccactactggaaatgggattaagcttctgtcttctgactggaaaacaacacctacgctggaactcaatgctgtcatggctgactcttgcgcagttcagtctcgtcacgatagttggtctttgctttggcttcctattgatcttatccttgaggatgcaatggatggcaatcacgtcgcagaagctagtgctgttgaagcactcactgggttggttaaggctttgcaagcagttaatggtactgcatggcacagtgcttttttaggcttatggattgcagctctacggctagttcaaagggagagggatccaggagaggggcctgtacctcgccttgatacctgcttgtctatgttattgtgcattacaacccttgtagttgctaaccttattgaagaagaggaagggaaacttattgaagaagctgaacgtagccctgcaaatcaaaggatggacaagcaggctttgggagagcgtcatggggcattggttaccagcttacagctattgggggactatgagaatttactcactcctcctcaatctgttatttggggagccaatcaggctgctgccaaggctaccttgtttgtatctggacatagtggatacttggaacatacgaatgtgaatgacttgcccacaaactgttctggtaacttaaggcatctcattgttgaggcttgtattgcaagacatctgcttgatacctcagcgtatttctggcatggttatgtgagcacacctttcaatcagctgcctcatagtattcctaaccatttacctagctggtcatcattgatgaagggatcaccactaactcctccattggttaatgtcttagttgcaactcctgcttctagcttagcagagattgagaaaatatttgaatttgcaatcaatggctcggatgaagaaaagatatctgctgctaccattctttgtggggcatctttagtacgtggttggaatgtgcaggttccactacttgcagctgtcttaatgccaatatgcgaagcttttggatcatctgttcctaatgtctcatggactgctgtaactggtgaaaaactcacttgtcatgcagtgttctctaatgcatttattctcctgctgagattatggcggtttgatcgtccacctgttgaacatgtgatggggggtgcagcaactccagcattaggatcacaattaggtcctgagtaccttttattggttcggaattgtatgttagcagcctttgggaaatcaccaagagatcgagtaaggagtagaagattttcaaaaatgataagattttctctcgagcctttatttatggattcctttcctaaattgaacatttggtatcggcaacatcaagaatgtattgcatccatctgcaatactcttgcacctggagggccagtttctcagatcgttgaagcactacttaccatgatgtgcaagaaaataaatcgaagtgctcagtcattgacacctacaacttcaggaagcagcaattcatctcttccttcattggatgatgctttgatgaaactcaaagtacctgcatgggacatccttgaagcaactccatttgttcttgatgctgctctcactgcttgtgctcatggaagtctctctccccgtgaattggctacaggtctcaaagatcttgctgattttcttccggcaactttgggtaccattgtaagctacttatcatctgaagtaacacgttgcatatggaagcctgcttttatgaatggaactgattggcctagccctgctgcaaatttatctattgttgagcaacaaatcaagaaaattctagcggccacaggtgttgatgttcctagcctcgctatagatgggaatgctccagctacacttcctttgccattggcggctcttttgagtctcacaataacatataaactggataaatcttgtgagcgctttgttattttggctggcccatctttgattgccctttcttctggttgcccctggccatgcatgcccattgtaggtgctttgtgggctcagaaggtgaagcgctggagtgacttttttgtattctctgcttctgcaactgtattccaccacagcagggatgccgtagttcagcttttaagaagttgcttcgcctccacccttgggcttggttctgcctgcatttataacaatggtggtgttggcaccctccttggtcatggctttggttctcactactctggagggttcactccggttgctcctgggtttctctacttaagagtttacaggtctattagagatgtcatgttcttgacagatgaaattgtatctcttttaatgctttcagttagagatatagcaaatggtgggttgcccaagggtgaagtggagaagctaaagaagactaagtatggaataagatacggacaggtttctcttgctgcatcgatgactcgcgttaagcacgccgctcttcttggggcttcgattctttggatatctggtggttcaggtttggttcaatctttgattacagaaactctgccttcatggtttttatcagcccaagggttagagcaggaagggggagaatctggagttgtggttgctatgctgagaggttatgcacttgcatgttttgcggtacttggtgggacttttgcctggggtatcgactctttgtcaccagcatcaaaacgacgaccaaaggtccttgagattcatttagaatttcttgcaaatgcactagatagaaaaatatctcttcgctgtgattgtgctacttggcgtgcatatgtgtctggggttatgagcttgatggtgagttgcacgccactgtggattcaggaacttgatgtgggtatattgaagagaatgagcagcggattaagacagttgaacgaagaagacttggctctgcgcctattagaaattagagggacaagcgtcatgggtgaggcagctgaaatgatctgccaaactagattataa

SEQ ID NO: 41963 - DNA, 1614 bp, Glycine max
  Peptide Sequence Number=SeqID_158741
atggcattgccggttatgccccggaaaggcatatataatgatttgaacattagatttgaggcgcggcgcaccatcgcatcgatgcctgcaagtgctgctgtagcagattccaagaaaaaagaacaggcccttgcctacaagacccacctgtatgcactgcctggaatacaccaacctttgttgttgttcttgacaaccttcgctacatttgcttcccaagccaaaggcgtctgttgtgatttttctgtctttggaacttttcttgttcaagtcgtcatcatggccttgcagaacattggtgctggaaatagtgatgatgccttctatcggtataagatgcctaaaatgattaccaagatcgagggtagaggaaatggcatcaaaacaaatattgtcaacatggttgacattgccaaggcattggcaaggccaccctcttacacaaccaagtactttggttgtgaacttggggcccagtctaagtttgatgagaaagttgggacttctcatgttaatgggtcacatgacaccccaaaacttgctggtcttcttgagatctttatcaagaaatatgtccagtgttatggttgtggaaaccctgaaactgagatattgattactaagaaccaaatgatccagctgaaatgcgctgcttgtggttttgtgtcagatgtggatatgagagacaagctgactagctttattataaaaaaccctcctgaaacaaagaaaggatccaaagacaagaaggccatgaggagagccgagaaggagagactgaaggaaggtgcagcagctgatgaggaacaaaagaaaatgaagaaagagactaagaagaaaagcttatcttccacttccaaggatgagaccacaaagtcaaactctacaaagaagaaagccagtggctctgatgaagattgtcgatctccagatcacagtcaagttgatgatgagaaagaagaggcacctgatgaagatgatgatggtgaagtacaatggctaacagatacgtcattagaggctgctcggcaacgtatccaagagcagctaagtgccgtaacagctgatatggtcatgctctccacagatgagccagagaagaaggaaacagcatcaagtaagaaaagtgatggttctgaaaatggtaacacgatgcactacaagaaactggttggagaagtgaaagcaatcttgaacaaaggtgttgtggcgagtgaattgcagtcccaaatggaagcaattccatcaccagctcaagaaaagatcagtgctctgattgaggccttatttgagggcattgagaaagggtttgcaaaagaggtggtcaagaagaagcgctactttgatgctgcagtttccatgggggagggatcacatttgctattgcttcgtgcaattgaggctttctgtctaaagtccacttccaatgctttgaaggaaattgccattgttttgaaggcactgtatgatgctgatctgttggaggaagagcacatagtgcagtggtatcaagaagggcttaagggtgacaacaagcactctcagatatggaagaataccaaacctttgattgaatggcttcaaagtgcagaatcagaaacagaggaagaataa

SEQ ID NO: 41964 - DNA, 432 bp, Glycine max
  Peptide Sequence Number=SeqID_158742
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatgggcctattagaagtagaaggcgctctggtgggatcctcacgtacagaaaaagattgcagtcagtttga

SEQ ID NO: 41965 - DNA, 405 bp, Glycine max
  Peptide Sequence Number=SeqID_158743
atggaggccataaaagagcaaatggccacaatgatggaggccatgatgagcgtgaagaagataatggaagccaatgcggttgcaactgccgctaccagcactgttgctaaggtgaacccgatgcccccatcaggcctcaaccaaatgaatcatccaacctcagttatggtaggcaaagatttgggaagtacgggtggcccccattatgtgcaaagtcaaaacaagcacgccttcccgccacatggctttcctcccaactgtacaccacccaatgtagcgtacactcccggtgagaatgtcaataactccactcccatactcattgagagccgacaacccggactgatcatgcacatgtctctcaacccatgggtgagacacatgaaatgccccaccacaatctag

SEQ ID NO: 41966 - DNA, 438 bp, Glycine max
  Peptide Sequence Number=SeqID_158744
atgaagaagtcaatggtcaaaccaaaaaacattctgctaactctgaaggagcacaatgtcaatagttgtacgaccatcaaacaaatatacaatgcaagaagtgcatatcgttcttccataagaggaagtgatactaaaatgcaatatctaataaagtttcttgaacgggatcagtatattcattggcacagattaaaggatgaagacatggtacaaactcccactgctcgattttgttggggtgacacaaactgggatgacattctctgccagttttgcatatctggaagctttcacataaaaaggaatgtgaaagccaaatgtaaatcattaattggtcaaagaaatgcttgggagtatgtcatggatgagtggggaactcttgttgattgtccttcggagcagcagtttgatgagtggctgaagaagtttgaaatg

SEQ ID NO: 41967 - DNA, 513 bp, Glycine max
  Peptide Sequence Number=SeqID_158745
atgtcgttcgacttatgcaatgcaccatcatcttttcaagttactatgaataatatctttgaaccttacctgcgtaggttcatcatcgtctttttcgacgatatattaatttacagtaaaaccttcactgagcatcttgatcacctcgcaaaagcctttggggttttactcgaaggacatttcttcttcaaacttactgagtgcaccttttcccaacaacaaattgagtacttggatcatattgtgtcccggcatgacgttgaacctgttcccaccaaagttgaggcaattcaagagtggcctgttcctcgacgcttcgggcgtaggcatggaggttgttcttactcaacagaaccaccccatcgcattcttcaacaagcctttttgcaccaaactcctccattcatccacttatgtccgagaactagcaacgatcatggtggcagtgaagaagtgacgccagtatctgttgggccatcacttcatcatcttgatcgaccaccagagtcttaa

SEQ ID NO: 41968 - DNA, 395 bp, Glycine max
  Peptide Sequence Number=SeqID_158746
gagaggaagctgggtgtttcggtcttttcctctttgtttatgtggggcgggataccgccagttgagaatgagtttgagtggcaatccgaaaggaagaaccaccaaaaaatgggttttcctttgccggcagtcacttaccttgccaaaaatttatctggccaaggttcaaaaaagtctaaggttgtgtctcaatggggtcttttatcgtgggagcccgatcttgatatatggggaaaaacaaattcgtgtgtcaaggtgttggtttcgggccgaacttccatattattccacaaggcacgtgcaacaatgatgatttggaaacaacgtgcaaaattagtcatggccacagccaggtgggcactcaagcatcccgttcatggcattgtgatactacg

SEQ ID NO: 41969 - DNA, 276 bp, Glycine max
  Peptide Sequence Number=SeqID_158747
atgcagggagagaagaacccctcacatgatcaagaccgagagcgtgagaggagttgggagtgtcgccttacttgggaagccaatgaggcacgaccgcaggaagagaataatccacctgaaacccgacttcggggagttatcaacatgatactcagagggtttgctggtggaggaagctcaaacttggaacacaaacactatgtctacaatcttaggatagtctatgcagttagagtggaaaaactgcccactagaagcatgcccctatcactttga

SEQ ID NO: 41970 - DNA, 186 bp, Glycine max
  Peptide Sequence Number=SeqID_158748
atgcccttgcggggtaggattgcatcagagacactcaaaattgaacaacggaagctctcgagaaattcaaatggtcataagttttcacacggaggtcagattcaggcgcataatatatcaagacactcgaaattgaacaacggaagctctcaagaaatccatatggtcataacttttcacaaggag

SEQ ID NO: 41971 - DNA, 261 bp, Glycine max
  Peptide Sequence Number=SeqID_158749
atggcccgcacaaagaaaactgggcaaatgacgtctgaggcagcaaaggaaattgctgagaagattgaatcgttggaggagcaggcgtcatacagtttctttgttgccattgggcgaccagaacaccgtagtcgtgtgggtgttgttggagttggtgtcacgatcaagaaatactttggactggctccaaggacctcccatatgtcttcctccatgggtcctaaagacctggagcagctgatgcaacaaattagggactag

SEQ ID NO: 41972 - DNA, 963 bp, Glycine max
  Peptide Sequence Number=SeqID_158750
atgggatcgaatcaagtaccctcttttaagaaaagattttatcatgtcaaaatcaaaagcctagaagttgtcgatttgcaagagctagggcagcaaatgggtcagctccaacttcaagctttctacaagacatatggaaagatctgggatttggctatgatagaagtgtccgttgaagccattgcatccctcgttcaatattacaaccagccactaaggtgcttcacatttggggactttcaattagtaccgaccattgaagaatttgaagagatcttgggatgcccactaggaggaagaaagcgatatctcttttctgggttacacccctccatggcaagaatggccaaagtggtcaaagtcttggcgcaagaattggaccgagtaaaacaaaataggaatggggtggtcagaataccaaggaagcacttggaggagaaagcgaaggctttggctgatcaaggtgaatgggctttattaattgatgtcttagtgctattggtgttcagagccatcctctttccaaatatggatgggctagtggatatagtggcgatcgacgccttccttgcttatcaccatagcaaggaaagtccggtagttgttgctttggctgatgcctatgacacatttgactggagatgcgagaagagtggcccaaggattgtttgttacacacccggtctttatgtgtggctggtctctcacctctttcgttatgaaagtagacctgtttgtcccctacaaggtcactgcctgtgtgccgagaaagggaaagcaaattgggagcaacttttggctggtatggtaggggcatccattaattggttcccccgatggaaggaaggaggagccggagttttgtcctcatgtgaggggttctcgagcgtccccttgatgggaatgaggtgcttgtattgtcgcaacctatccttcggtgggagggtgacgcgagagtcacgg

SEQ ID NO: 41973 - DNA, 291 bp, Glycine max
  Peptide Sequence Number=SeqID_158751
atgtccaaatcttttgaatttgggatgaccggctctctcgatgaggatctcttgctttctcataaggatggaccctcgggtactagtaccctggtcttcagaggactacacgtcctcgccaacagagggctgcatgccctcaccttaagaggactgtgtgtcctcaccatcagagggctgcacgccctcacctccagaggactacatgtcctcgccttgagagggctacacgccctcaccttgggtactagttaccctcaccgttcagagggctacatgtcctcgccttga

SEQ ID NO: 41974 - DNA, 801 bp, Glycine max
  Peptide Sequence Number=SeqID_158752
atgaccaatccgagtgccgccgatgaactggcgctgatcgatcgctactggcgcgccgccaattatctgtccgtcgggcaaatctacctgatggccaatccgctgttacgcgaaccactgcagcccgggcatattaagccacgtctgctcggccactggggcacgacgcccggcctgaactttatctatgcgcacctcaaccgcatcatccgccagcgcgaggtggatctgctgtacgtctgcggcccggggcacggcgggccggggatggtggcgaacagctggctcgaaggcagctacagcgaaatctatccgcacgtcagtgaagatgccgccggtatgcagcgcctgtttaagcagttttcgtttcccggaggtattcccagccatgcggcaccagaaacgccgggctcgattaatgaaggcggcgagctgggctattcgctgtcgcatgcgtttggcgcggttttcgatcatccgcagctgatcgtaccctgcgtgattggtgacggcgaagccgaaaccgggccgcttgccgccagctggcacggcatcaaattcctcaatccgcagcgtgatggtgcagtgctacccattctgcatctgaacggctacaaaattgctaacccgacgctgctggggcgcagcagtgatgacgatctgcagcagctgttcagcggttacggtggaggatttctggcgcgcgcaccaggtgccggtggcggcgtgtcgcgaagatgcatcgcatcgtcagctgttagagcagtggttgcgcagctatcagccggaagatctgtttga

SEQ ID NO: 41975 - DNA, 291 bp, Glycine max
  Peptide Sequence Number=SeqID_158753
atgccggaaatcctcatcacgcgcgtctgctttcatcgtatgcagcacctgcgtcacgtcatgtatcctgaatacgctaccttccctgataaagtccgtcaccgcgatgcctatcagcgcatacagatccggtgcaggacggttaacttgtttcacgtcacctccgggacttgtatatccgtacagtgttgcacaggtgataacaactcaacacctttttctgctgtcagtgaaaatggcccaggttattcgtcagacagattgccaggcgttatcacgctgcgcgaatag

SEQ ID NO: 41976 - DNA, 300 bp, Glycine max
  Peptide Sequence Number=SeqID_158754
atggactataaaatgttcgctaaccgactgcagcagtggccgcagttacattttacggcgattgaactgcagcaacgcgagatggcctgcgagatctacgccacggcggctgagcaccagaccatgagccagctgtttatttgtcgcgtcagtgatgaaaaaaatgcgcaggaattaatcaggcagtatcgcagctggctgcataaatttaatctcggtcgcagcaggcgcgataattcccgcccgccgcgcagcgtgtcggtgaatgttccgggcgcaataagcgcagcgctaaaatag

SEQ ID NO: 41977 - DNA, 603 bp, Glycine max
  Peptide Sequence Number=SeqID_158755
atgctttctcataagggtggacctttgggtactagtacccccgtcttccgggggctacacgccctcaacatcagagggttgcacgtcctcaccttcagaggactatacgtcctcacctttagaggactacacgtcctcaccttcagagcgctacacgccctcaccttcagagggttacatgccctcgcctttgtatggctacacgccctcaccttcagaggactacacgtcctcaccgttagaggactacacgtcctaaccttcagaggactatacatcctcaccttcagaggactatacgtcctcaccttcagagggctacacgtcctcgccatcagagaactacacgttctcgcctttagaggacttcacgtcctcaccttcagaggcctacacgccttcgccttccgagggctacacgtcctcaccatcagaggactacacgtcctcgcctttagaggacttcacgtcctcaccttcagagggctacacaccttctccttcgtaggactgcacgccctcgcctttagagggctacgtgtcctcgctttcagtgggctctatatccacaccataagagaatttaaggttcttttcccttaa

SEQ ID NO: 41978 - DNA, 471 bp, Glycine max
  Peptide Sequence Number=SeqID_158756
atgcatgaacgacaatcaatgcatgtggctttgaataaatgtggagaatggagaattgcactaggaaatcacttcgcgtggctccagactccttggtggaggatgcatgaacgacaatcaattcatggggctccgaataaaagtggagaatggacatttgcactaggcaatcacttcgcgtggctccagactcattggtggaagatgcatgaacgacaatcaattcatggggctccgaataaaagtggagaatggagaattgcactaggcaatcacttcgtgtggctcgagactcattggtggaggatgcatgaacgacaatcaattcatggggctccgaataaaagtggagaatggagaattgcactaggcaatcacttcgcgtggcgtaagactcattggtggaggatgcataaacgacaatcaattcatggggctccgaataaaagcggagaatggagaatgcactag

SEQ ID NO: 41979 - DNA, 336 bp, Glycine max
  Peptide Sequence Number=SeqID_158757
atggtggaggccatgatgagcatgaagaagataatggaagccaaagcggttacagttgctgctaccagcattgttgctaaggtgaacccgatgcccccatctggccttaaccaaatgaatcatccaacctcagatatggtaggcaaagatttgggaagtagggacgacccccatgatgtgcaaattcaaaacaagcacgccttcccgccatatggcctgcctcccaactgtacaccacccaatgtggcgtacactcccagtgagaatgtcaataactccactcctatacccattgagagccaacaaccccaaactgatcatgcacatgtctcttaa

SEQ ID NO: 41980 - DNA, 147 bp, Glycine max
  Peptide Sequence Number=SeqID_158758
atggcaaggttgagagtgggagtgaacacagcagaaaaaaccattactgggtttgtgatcagtggcagaggttacttgaaattgttgcaaggcaaaagaagagcttcaacggttcaagttgcggttgatgtccccacttcaacgtag

SEQ ID NO: 41981 - DNA, 285 bp, Glycine max
  Peptide Sequence Number=SeqID_158759
atggtgaacatgccaagctatgccacttgggggtgttacaaagaaggtaagaaagagaagaaggtaaggagaaggagtaggaaggaaggaagagaaaaaagacaaaacaatctaaggtggttctggtggctcctgtcataccctaatttcgtccggggattattatttgatgatatacaaccttggattggccgctttgagacacttggcgtccttggttgcacaataaatgatgtcccgagacgtctccgaaatcaaaaggaagcaagcttgcacgatccgtga

SEQ ID NO: 41982 - DNA, 111 bp, Glycine max
  Peptide Sequence Number=SeqID_158760
atggcaaaagtgaagatgattggatggagagtaaggaaccaatggttttattccatctatgagaagtgggcaaagaggttcaaagaacctaggggaattagcgagtgctga

SEQ ID NO: 41983 - DNA, 348 bp, Glycine max
  Peptide Sequence Number=SeqID_158761
atgggggcgcttcagaaggtccgcaaggcatgggagatgatgcaaaaaaaggacaaggaacttagaggtagtagcaacgggcccatcggcggctaccatgggtggttgaaagcctacacacaagatctggattggctcccgaatttgagaaccactaagggggtggaggttgaagctccagaagaggacgaagaggtccaagaggaacttgtctcagcggttatgcgagaccgagaccaacatgttagccatcatcagcaagtaccaagaagaattaaatctagccacggcccacgagcacaaagtggtggacgaatatgcccgagtgtacgcggaaaaggaggctag

SEQ ID NO: 41984 - DNA, 552 bp, Glycine max
  Peptide Sequence Number=SeqID_158762
atgcaggatgtagaaattattccgcacaacgaggatgcacatgtgccaaagccggctaatgtggacgcagatgatccgttgcgtggcctgataaagtacagttttgatatttatgagaagccagttgaaatcaactttgatgggagctgctttggaattgcagatgcacctacatcgatattcataacatattcagatgttagtgaaataatagcaggagacaaaactctgaacatatcagtacaacaattatggttaatgtatatgcatgagtggagtcaaaccttgggtcaaggttccatgtatgcattccttgagtcacagtcattggtggtttcaaaggatagacgcagcgagtgccaacaatatcttgaaagatggcttaaggaatctgaccgagaggtgtacgttggaccttacttccatcaggcacattggcagctcgtacttttgtgtcccaggcaacatgttgttgtttggttgtgttcgttgcgtaggaaacttgatatgcatatcaaagccgcaattaataagttatctcataacatataa

SEQ ID NO: 41985 - DNA, 660 bp, Glycine max
  Peptide Sequence Number=SeqID_158763
atgcaacaggctttaatctgcgatgccgttcgtacgccctttggccgttacggcggcgcattatccgcgctgcgcgccgacgatttggccgctctgcccctgaaggcgctgcttgccagactgccacagctggatccccaggccattgatgacgttattctggggtgcgccaaccaggccggtgaagacaaccgcaacgtggcgcgaatggcgctgctgctggccggattgccgcactccgtgccgggcaccaccctcaatcgcctgtgcggttcgggattggacgcggtagggatggcggcgcgcgccattaaatgcggcgaagcggaggtcatcatcgcgggcggcgtggaaagcatgtcgcgcgcgccctttgtcaccggcaaagcggacagcgccttcagccgatcgctgaaaatggaagatacgacgatgggatggcgctttatcaacccgcaaatgcgcgctcagttcggtgtcgaaaccatgcctgaaaccgccgaaaatgtggctcgcgaattcgccgtcagccgcgccgatcaagacgcctttgcattgcgcagccaacaacgcaccgcccgcgctcaggagctgggcctgtttgatgaggaactgatcgccgtcagcattccgcaacgcaaaggcgaaccgctcagcatg

SEQ ID NO: 41986 - DNA, 288 bp, Glycine max
  Peptide Sequence Number=SeqID_158764
atgcggcttggtggcatagtgtgtgcggagtgggtgggtggaagtgagtgtcagtgtagcggtggggcaagggacttgcagagaacatgtggagggagtggtagagagggggttgcatgcatgaatctagtgtcgatagcggcaagtgatgttcaaactgtggaagtgttgcgcgcgaccaatgggaaggtgaaagggggggcaacagggaaagggaaggtgaaagagggttgggggtgcagggagggtgggggcacaaagaagggaaaaggagaggatttatgctaa

SEQ ID NO: 41987 - DNA, 273 bp, Glycine max
  Peptide Sequence Number=SeqID_158765
atggtgacgaaaatgaaaagaacgacaagtgaaaggaaaaattaccagaaaagcccagggatcgaaactcttcttcatcgtaatcgctttcttcttagaagtttccattattctcaagaagcgatgcgagaaacgcttcgagaaccgcagagagcagcactgtcgagtcgaaatgggagaacatggcgcgtgaaagtggaggaaggtgaagaagggaatgtaaaacgacaaagtattggtttgcgtttgggacttgtttcggttttaagttaa

SEQ ID NO: 41988 - DNA, 1557 bp, Glycine max
  Peptide Sequence Number=SeqID_158766
atgtgggtggatttgactcttgaagttaaatctggatgtgtagacacaggtgatgatgaatggttcaacacaagtcacccgttccaccagatgtctgctagagagttaaaatctaggttttctcacggcgaggagatattgacatcaggggttgattcgccagagcttccttcttcggtctcgagatctagaggcaaacactacaacaacaagaagtgggaaggtattgatctgaatagtttgttagataaacagaagggtttaagtaggagaggtttccaacaaggttccagctttggccaggaagtgaaacccaaaccaaattcaaatgttaacaagccaaaaggtgggaagctggggttggcttttgaacggaagtccagaggaaaaactgactctatggtcaattgcagcaatccaccgagtagttcaagttctaaccacaagtgtgaaggaagcactgcaaggagcacaattacatctgaaaacactcagaagtatagggaggtatctagcaaaccatttgatcagaaaagaagttcatcaattaggagggttagtcttgggaaaagttgtgttacgagaaaagtctcaagcattctgccacagaaggaatgtttggaggtgtctagtcaaccgtgtgatcagaaaagtagaagttcatcggttattagtgttaggagaagttatgtttcaggaaaagcttcgaaagtggagattggtggtgatagcactgcaaggagcatgattacatctgagaacactcggaagtatagggaggtatctagcaaaccatgtgctcagcaaagttcatcagttgggagggttagtcttgggaaaagttgtgttacaagaaaagtctcaagcattcagccacagaagaagtgtttagaggtgtctagtcaaccatgtgatcagaaaagtagaagttcatcagttattagtgttagaagaagttatgttttgggggaagcttcaaaagtggagagtggtggtgatagcatgcgatcaaggggtcgtaaatcatcttctgggaagtctagtattggttcatgttcaaaccctggttatgaagttaagtttgtgtcaaggcagcagagagagaaaatcaccattgataaaggtgaggtcactatgaatcttgcagttaagaaccgttgcaagcccagtgaaagatcaaagacatctaccatttcagttgaggaagcaaaatctggtaacagaaagagaaatagcatcaattttgcaaagccagcataccatcgaacagcaaagtcattggtccaatattcctctgcaagttcaaaggctttgttacaacacacagtcaataaagaaaacacttgtattggtggtgctaaggagaaactaagaactaccaaggttaagagtttgacagccaagggaaaagagaatgtttcaaggaatgtggcggtaaatcagaaatgcatttcaagaggtgcttctgcagggggccttgttagaagtcatagaactacagaacacaatcatccacagaagggtgacaaagcaggatcaactgctttgacaattgtg

SEQ ID NO: 41989 - DNA, 294 bp, Glycine max
  Peptide Sequence Number=SeqID_158767
atgaaagaaggtaaatccgttaaactcaaccatcaacaaccgcaccagaacggtcacctcacgccttcaaaattcgccaaattgtttgatcccgaagcttcctgggacaaggatcaattgggagacgtattgcattggattagacaagtgcttggccttgcgtgtggattcctttggggttccatacctttggttggaggcatatggtttatcatgaaagaatggaaaatgaccatgcagatctatgagaggggtttatgggtggaaaagaaatgtagagggactaaactttaa

SEQ ID NO: 41990 - DNA, 576 bp, Glycine max
  Peptide Sequence Number=SeqID_158768
atgttcagggctccctgccttgtgctccattttttttgtttttttttctctagaatattgagtgatgtggtcgtagggcaggaagatctgtctatggtttttgcattagcaagcacatgggccatgttccttgcatttggcagtttagcctgtgttggtcccgtatcatacactgttggcatggcttatcaaaatgcattcgattcaggcttatcacttggtagccaaacacctggactagggtttctggccgtggtgaacagccttattttcgttgggctgggttttgtgatcggctaccctgttgcttcagcttcagctaaggtgcttcaaggcctttggaggaatgacttggtggcactaaaaggtgcatgtccaaattgtggagaagaggtatttgcatttgtgagaatggacaggaatattgagtcacctcacagagcagattgtcatgtgtgtgaatgcatattagaatttcgcacaaaagttgagcaatcagtctcaagatttggtagacagtgggtttatgggcgtatttatcttgtttcattaagaggcagatcccgacgtaaataa

SEQ ID NO: 41991 - DNA, 171 bp, Glycine max
  Peptide Sequence Number=SeqID_158769
atggcttcaataaccgatgtagaataccttatttgtagtagtgcacgcaaccttagatctaaagcttctcatcaccatcagaactcaacatttctaatctatgttggtgttgggtcgtactctgactatggagtgggtagtgtgatggaaaaaagaaaaacaggtgattga

SEQ ID NO: 41992 - DNA, 246 bp, Glycine max
  Peptide Sequence Number=SeqID_158770
atgcagggttactttatggttactcgcacctttcatcaaccagggtcaaacgagcccgttgacacaaggagactaacatcgtcttatgcaccttttgtcgtcctgacccgtgaatcaattgacatgcggggttacccaatggttacctgcaccattcgtcaaccaggggcaaacgagaccattgaggcgcggagactgacatcgtcttctgcaccttttgtcgtcctgacccgtgaagtcaggtga

SEQ ID NO: 41993 - DNA, 480 bp, Glycine max
  Peptide Sequence Number=SeqID_158771
atgactcctgccgcagatagcgatccaggtccagcgctgcggccgatgccccacccacaatcgctcccaacagtacagccagcacaatcctgcgcatccttcccccatggaaaaccggacaccctgtccggatgcacgattctaggcacgacgtgggttcggggggcgtgcgccgggtcagtggaccccgcgcaccgccaacgtgagggccaggatgctgaggatcacggcaatggtgccgtcgagcacgcgccaggtactgggcttggtgaacagcggcgccagcaggcgtgcacccaggccctgcgcggtcaaccacaggcagctggcggtgaccacgccagcggcgaaggccatgcgggcgttgccgaagttctcggcgatcgaaccgatcaccatcatgtccagccagaagtgcgggttgatcagcgagaaaccgaccgcggccatcagcaccccgcggcggctgccgtcgtcact

SEQ ID NO: 41994 - DNA, 738 bp, Glycine max
  Peptide Sequence Number=SeqID_158772
atgtggatgctaatatttcgggattttaagacatccaacatcttgctggatgagaatttcaatgcaaagctttctgattttgggctggctaggcaaggaccctcagaagggtctggctatgtttcaacagcagttgtcggcaccataggttatgttgcgccggagtatgttctgactggtaagctaactgctaagagtgatgtgtggagctttggtgtagttctttatgagcttatcactgggaggagagttgtagagagaaacctaccaagaaatgagcaaaagcttttggattgggtaagaccttatgtttctgatcctagaaagttccatcatatattagacccccggcttaagggacaatactgcatcaaatcagctcataaacttgcaatcctagcaaacaagtgcctcatgaagcagccgaaatcccgtccaaaaatgagcgaggtggttgagtctcttggaagcattattaatgacacagttcctcatgatgaacacatcccccaagctgctgtagcagcaactggagaagaaaaagaagaaaagttatctgtagaggacactcaacctgaacctgcagctaaacaagggaacaattacctgaagaaggtttttgaattgaaagacatggtcagcttaagaaacaagtccgttggaaggttggattggaaaagttgggcacctgggctattttcactctgtgaaatcgacattgtcaggcacacaggttaa

SEQ ID NO: 41995 - DNA, 453 bp, Glycine max
  Peptide Sequence Number=SeqID_158773
atgtcacgctttcatccgtcgtcatcatgttggaccagcctcaacgaggaactggagcagcttcttgcgaatgtgcccaaattaacaattgaagagcacgaagaattgaggaaaatggcaaacatgatgcagaatgtcgcaggtctacctgagacttattttcagactgttcacgctagggaccagattttcagtgaagttagtaaggtatatggtgtcaggtggaaggacgtacttgacggttctgtaaccttcaaggcttatctcgctgagcagaaagttacctctaacagttggacgttccaagcagcatgcattattttcttaaagacaaagattgaactcatttgcacttggagaacgttgcagaatgacggcttgtgttcaatcattggaggaagacacttaaaatttgagctagatgaaaacatttatgcaaaactttgtctttga

SEQ ID NO: 41996 - DNA, 390 bp, Glycine max
  Peptide Sequence Number=SeqID_158774
atggacaagagcatgctagcggatttggattcgctccctgaggctgataagcaaagaatgactgtcatgatcgatcagctccaaatccgtgacaggttgatccaggttgtaagaatcaggcttatactcccacaaggatgggagtttgagtcctgccgcgaatgtgaggatcttgttggtgagtcatttgtaaattccttttttctgagaatgtataattcactggttgagagatgctttaatgattgtgttgacacatttaagcataaatccctgcaaaagcaagaggaaacctgtgttcgaagatgtgcagagaaatttctcaagcattctatgcgggttggcatgaggtttgccgagctcaaccaaggagctgctacacaagattaa

SEQ ID NO: 41997 - DNA, 381 bp, Glycine max
  Peptide Sequence Number=SeqID_158775
atggctttttcacaaaaaaaaccatggagcagagaagcatggcaaggaggaagcatggtaggcaagaagaacaatacacacaacaatacacaaaacacaaaacaagcaacaccaatgcaaaccaaaacacaaaacaatacacaatacacgatatctaacggcaaggaagaacaagcaccagaggaggaagaagattcactaaccttgaagatgggagaagaagaggccgcaacaacgaggaagaatttgcaagagaagaggaggaagtgcggaaatgaagcgaaaagaggccacagattctcaaaaatgaagcgagaagaggaagaagattctcggaagaacaagctttctcttggaggaagaagaatcgaaaatgaatag

SEQ ID NO: 41998 - DNA, 102 bp, Glycine max
  Peptide Sequence Number=SeqID_158776
atgtctcaatgtggcacttttagtccaattgaggcttttgacattaagttgtatattttggctgaaagtaacacattgaggtcacaagaaaatgaatggtga

SEQ ID NO: 41999 - DNA, 2163 bp, Glycine max
  Peptide Sequence Number=SeqID_158777
atgggaaacggcatagggaagctaacggtgtgcttcaccggaaacggtggagggggtcgtcggaagcaggatatatcctttttaataacggagccgttagacgagggcttgggtcactctttctgttacgttcgacccgacccgacccggatttcgtcgtcgaaggtgcactcggaggaaacgacgacgttcagaacaatctcgggcgcgtcggtgagtgcgaacacgtcaacgccgttatcgacggcgtttgtggatttgtactcgtacagttgcatcgacagagccgcggcgtttgagagttcaacttccttcgcggcgttgcctcttcagccgattccgaggaacctcgtgaactcgggcccgttctcggggaacctgaacggtggtgggtttccgggctcgggcccgctggaaagagggttcatgtcgggcccaatcgagcgcgggttcatgtcggggcccatcgaccgcggacttttttcgggcccgatggagagggaggggaacggaatcggaaacggatcggatcaatttcagagaagcttctctcacggagggttgggattagggttaggtatgagagtgagaacgaggaagggtaggtggattcgcgttttgcagagggcaatttcgaagactctgtctcgggggcagagttcgattgtagctccgatcaagggcgtggtgatgaaggagccggagtggatggtgatggcggcggcggagaagcataatgagaatctgagcgtgaatctgagcagtgaggggagtttggaggatgatgattcgatggagagtcagaatcttcaatgggcgcaggggaaagcaggggaagatcgcgttcatgttgtggtgtctgaggaacacggttgggttttcgtggggatctatgatggtttcagtggacctgatgcacctgattaccttctctccaatctctacaccgcggtgcataaggagcttaaagggttgttgtgggatgatcggtctgcacccgaaaattcgatgccgaaagaggacatgttgcgagatgttacaactgatgttgcagattttacggttgctgatgaagatgatgcttgttctcactgtgttgagcaagataataatgataataatagtaagagtggtaataagagaggtaggaattcgaggaacaagttccagggtgctgcaaagaaatgggaggagaatcaacggaggtggaagtgtgagtgggatagggaaagattagagcttgatcggagattgaaggagcaattaaatttaagtcgatctgggtcaggtggagcagcgagttctattaatcattcggatgttttggaagctctatctcgggctttgaggaagactgaggagtcttatcttgatgtcgcggataagatgttgatggagaatcctgaattggctttgatgggttcttgtgttcttgtgatgttgatgaagggggaggatgtttatgtgatgaatgtgggggatagtcgcgccgtgctggctcagaaggttgagcctgattactggcttgggaagatcaggcaggacttggagaggatcaatgaggagacaatgaatgaccttgaatcttgggatgttgatacctccaacttggttccgagtttgagcgcgattcagcttaccaaggatcatagtactagtgttgaggaagaaattcagaaaattaaaaaagatcacccggatgatccttttgctgttgtaaatgaccgtgttaagggttctctcaaggttacccgagcatttggtgccggatttctcaaacagccaaagtggaacaacgcacttttggagatgtttagaatagactacgtaggaaactctccttacataagctgcctaccatatctaaaacatcacagattaggtccaaaggacaaatttttgatactatgctccgatgggctctaccagtacttgtcaaatgaagaggcagtggctgaagttgagcttttcatcacattgcaacctgagggagacccggctcaacatttggttgaagaagtgttgtttcgtgctgcaaagaaagctggtttggactttcacgagttgctcgaaattccacagggtgatcggcgacgttaccatgatgatgtttccatcattgttatttctttggagggaaggatatggagatcatgtgtataa

SEQ ID NO: 42000 - DNA, 978 bp, Glycine max
  Peptide Sequence Number=SeqID_158778
atgagcacacccttgttccatgaattcaaaaggcaagcttctttcttcttcaaggagaaaatcaagactgctagattagcactaacagatgtcacccctgcagaactgatgacagaagaggcaacaagtggaaatccatgggccccagatgccagaactctcagatcaatttcaagggatgcttttgagctagatgattattggaggattgtggagattctgcataaaaggtttcttaaatttgaaaagaagaattggagggtctcttacaattccctgatcgtgcttgagcacctgttgactcatggaccagagagtgttgctgaggaatttaagagtgacaaagatgtcattagccagatgaaaggttttcagtatattgatgacactgggtttaattggggcctaactgtgagaaagaaatctgagaggataacgaaactgctggaagaagggactcttctcaaggaagagagaaaaaatgctagaaggttatctagagggattgaaggttttggaagtttttctcatttgtcaactcagggacaaggcgttctacgtgagagatcgttgccatccacgcttaggagatatgattcagacttgaacaaccgtgaagatctggaaaaccagtcctcttgtttaaacaatggtgtggatgtggacacagtagctgttaaatttccaagccatcaaggtggaaccttcaagtcattgggtagtgtggaagccaagggatatcaggatgatgatcttggcaacaacaatcaaatgcttcagaaatctgaaacaagttctaaagaaaacatggagcctagcaaggaggagttccatctatggaacttgaatggggagtccaaaccaattttggattggggtgaagaggactccaagcttggaatcatcagaacagaagatgatcacccctttagttcaacagaaatgcatgtcactgcctccttgctttctgcttgctag

SEQ ID NO: 42001 - DNA, 670 bp, Glycine max
  Peptide Sequence Number=SeqID_158779
gcgaataccatatgtagttgctctgaaacacagacatggcgcatgtgcaacattgctgaatctttcatctgctgagtctcttgtatggccatcatctttgaagataatcagtgagcttaatccaaacgccaaagagttattagagcgggccctgatggatgcaaacagggaaagagagaagaacatattgaaagggagtgattactctcttccatctccatcacattctgatggggtagatgacaatatctccgagataattcaggttagtgagacggaattatgctgcatctgctttgagcaagtgtgtacaattgaagtccaagactgtggtcaccagatgtgtgcacaatgcacactagccctgtgttgtcacaacaagcccaacccttctacttctcgtgttatcccaccagtttgtccattctgccgaagcagcatagcaagattagtagttgtaaaaaacgaaagccctgatgacattaatcaagatggtgttgatatcacttgttccaagcctagcaagtcaaggaaattgcgaaacttgaacgaggacggtagcagcagcatcaagggattatcaaatgtgaactcatttggaaaaatgggtggtcgcagctctggaaaaattgctgctgaaaatgagtgggaagatgataaacaacagtga

SEQ ID NO: 42002 - DNA, 207 bp, Glycine max
  Peptide Sequence Number=SeqID_158780
atggccgtggttgttgctaattggttgccatgtgattatgtccgctggtggttcatggtggcgacgccgattggatggcgggctggtggtgtggcggtagataagggtggtggcgctggtttgtggtgtttggtggtgcggcgcatagagaaagagaaaacggtgggtgttggaaggtttttggaagagagaagagatcagagatag

SEQ ID NO: 42003 - DNA, 369 bp, Glycine max
  Peptide Sequence Number=SeqID_158781
atgtggagagatcctggggctcccgctgattctttctatgaaactcgtcctgagtgcaccgatgttcccaagtctcgatttaggatcaaggctggcaaaacattaagtgcaagaaaatggaatgctgcattttctccagaagggtatctagatataggcaagactctaagtcgaattcatcgtgggggaatccatccatcaattagaggagaagtttgggaatttctacttggttgctatgatcccaagagtacatttcaagaaagagatgagataagacaacgtcgtaggggagttagcaccacctccactgcaccaaactccccttcaactcctccgtcgacattgtcgaagatcaccgatctctga

SEQ ID NO: 42004 - DNA, 336 bp, Glycine max
  Peptide Sequence Number=SeqID_158782
atggttttttatgaaaagaaagataacttatcaaaactttgggatattctcagtgtttatgctcgaatagattcagatgttggttatggtcaaggaatgagtgacctatgctctcctatgataatacttcttaatgatgaagctgatgcattttggtgctttgagcgtttgatgcgtagactgcgaggaaattttagatgcactgataactctgttggtgttgaggctcaattaagtactttggctacaatcactcaagtaatagacccaaaacttcatcaacatatagcacagaacatattggtggaggcgactatctgtttgcttttcgaatga

SEQ ID NO: 42005 - DNA, 924 bp, Glycine max
  Peptide Sequence Number=SeqID_158783
atggttttctcctctattccagtctttgtagatcctcccaattggcagcagcaaccaaaccatcctcaagcaagtaataatggtggtgataactcccagcttcttccacctttgccaccacatcaacctcatgtgggaggttctgttggttcaatcaggccaggttccatggcagatcgagctaggctagctaagataccaccaccagaagcagctctcaagtgtccacgttgcgattccaccaacactaaattttgctacttcaacaactatagcctctctcaaccacgccatttctgtaagacttgtaggcgctattggacaagtgggggtgctctaagaaacgttcctgtgggtggagggtgccgtaggaacaagaagaacaaaaggagtcgctctaagtctcctgcctcatcggagaaacaaacactttctggttccacgagtgcaacaccctctggtggaaccactcatgaactagttggtcagttgccacagccaccgaaccttcccttcatggcatctcttcagaaccttaaccgttatgctgttggaaacatgggtctcgggttgcgtgagattcacggacagaacgagaacatggggtttcagattggtaattcttcagctgctggtggaggaatggatcagtggcgcatacaacaggttcctttcttgaatggttttgaatcaacttctgctggttcgtacccttttcaaaatgaagggattgaaacaccttctggttttggtggagacatagcaacgaattctagggtttctcagatgccatcggttaaaatggaagaaagtggagctttgaatttgtcaagatcaacactcaatgtttcagaaaataaccaatactattcatggactgatatgtcaggtcttgcttcttcttccgctactcatctcttgtaa

SEQ ID NO: 42006 - DNA, 207 bp, Glycine max
  Peptide Sequence Number=SeqID_158784
atgcaacgggtcgaaaagggtggtggtggtggtggtggtgcatgtgacgcgaggaagatgcgtgctcagatagataacgcaaacaccaagttgatgatattggacgtatgcgccataaatgtccctgctgcctcctactaccatatacggtcaactaaaatatatagacctgatagcaggggtgaggtgagtgagtgctcatgctaa

SEQ ID NO: 42007 - DNA, 984 bp, Glycine max
  Peptide Sequence Number=SeqID_158785
atgttttcagagatgttctgcaccaaaaacaatacgcatgttaatcctctctatcaactctcaaccattttgtttctccctacctatctactactctataaaaagagtgagtgcttcacaagccatgggaataatagtaagagcatagtagtaattactagtaataataaaatcaaatactccagtggcattggcattgataataggattgtgatggagagtgggaataataatgatgaggagttggatatggagatggagatgggagggagtaatgtaaatggaaatgggggggttgcagggagtagttcgcggtggaaccctacaaaagagcaaataagcatgctagagaatttgtataagcagggaataaagactcccagtgctgaggagatacagcagataactgctaggcttagggcgtatggtcacatcgaaggaaagaatgtcttctactggtttcagaaccacaaagctaggcagagacagaagcagaagcaagaaaccttcgcttacttcaatcgctttcttcatacgcctcaaccattcttttctcctccaatttgcccaaatgccatgtgtgccccatattacatacctcaggcacagggtgaaattgggttttatcacccacatccaaaggtgcttgtacccgtaggttttaggaggagcccctctgagaaagttgtgcccacaggcatgcatcaaatgcaacagagaatctcggattgctgtaactctcactacagtaaccaagaaacgttggatcttttccctctgcacccaactggcattttggaagggaaaacgacaacaacaacagaccaggtgccttctctggcttcagtttctgctgatagttccactgatacaccttctgctgcggcttctcctgatcatatcaatgaagatcatgatcatgcttccccactcaaccaacccttctttgatttttttactacttctggacaaggttcttattaa

SEQ ID NO: 42008 - DNA, 1311 bp, Glycine max
  Peptide Sequence Number=SeqID_158786
atggggataattcgtaaaatattcattccctcatctctaatccgttatgagaagctgaaccttcctctgcacaatctccttcaaaaagcttctcatccatggcgaaaacgctcatttcgtctccatcgttcatcggcacgccgctcccctcgctccctcgccaccacctcccccaccgcaccagccgaaggccttctctacacgctcgccgatgccgcagttgcggcggaccctgcggttgcagcggacactgcggcttccaccaccgatgctgccgtacagaagagcggaggttggttcggcttcatctccgaagctatggagttcgttctcaaggtgttgaaggatggtctttctgccgtgcatgtcccttatgcatatggatttgctatcatattgctcactgttatagttaaggcagcgacgcttcccctgacaaagcaacaggttgaatctacattggctatgcaaaatcttcaaccaaaaattaaggccattcaagatagatatgctggcaatcaagtgagggatgttgttggttgtttaccaactttggctacaattccagtctggattggtctctaccaagctttatcaaatgtggcaaatgagggactgctaaccgaaggttttctttggatcccctctttgggtggtcctactaccattgctgctagacaaagtggagctggaatctcttggctttttccatttgtggacggacatccacctttgggttggcaagatactgcagcatatcttgttttacctattcttcttgtcgtttctcaatacgtttcaatggaaatcatgaaaccacctcagacagatccttctcaaaagaatcaacttcttattttaaagtttcttccactcatgattggctacttctcattatctgtcccatctggactaacaatttactggtttataaacaatgtcctgagcacagctcaacaagtatggttgcgaaaattgggaggtgcaaagcctgttgtgaatgaaaatgctggtgggattattactgcaggacgtgctaaaagatcagattcgcagctagcaaggaatggtgaaaggtttaagcagttaaaggaagaggaaaagaagaaaaaggtaagcaaggcactgccagtggaagaagttcagtcactggcttctgtttctgcttctgatgatggctcagatacagaaagtgacaataagggacaggaagatgcagaagaagcatacgcttctaaagttggcgaagaggttcaaaattattctagggaaagaagaagcaagcgttcgaagcggaagcgtgctgtataa

SEQ ID NO: 42009 - DNA, 198 bp, Glycine max
  Peptide Sequence Number=SeqID_158787
atgacctctatagcccagtctaacacttatagacttaggaagaactgttggaaccccgaggatctaacagtttctattcgaggggctaggagggcgagggcgagggcaaggccagctgagcttccttctacttctatagctcctactccagcatccacttcagcaggcccttttgtcccagttcagacagatttttag

SEQ ID NO: 42010 - DNA, 324 bp, Glycine max
  Peptide Sequence Number=SeqID_158788
atggacaagtgtcttttgaagttgcaaaccaaatttcgagaagatctaatggttaacgaaggctgggcagcgtttttaccgaggcagcttcatgcttcctccagaagcttcattaagaggcttctagcacactccagatatcttctcaaagatcccaacggtcagatcatggacatgtgtcttgcaaagttgcaaaccaaatttcgagaagatccaacggttaacgaaggctgcgcagcatttttaccgagtcagcttcatgtagctttctctagaagcttcattaagaggcttcctccagaagcttcctcgtggcttctttga

SEQ ID NO: 42011 - DNA, 300 bp, Glycine max
  Peptide Sequence Number=SeqID_158789
atgttatgcctacaagagaataaggcagaagccctaacaaaagaagtttgttttagaatatggggtgactatgaggtacagtggttggataacccgactgtgggttatatgggggggtctatatgtggagaaaaagtcagaactttggaggaaaagagagggttgactaaaatacctataggaggtgtagatatggattatttcaattcttttattgatgacatggaggtggaggatgtccccttggttggcctcaaatacacatggtttagaggaaataatagtctagcaaatagctga

SEQ ID NO: 42012 - DNA, 267 bp, Glycine max
  Peptide Sequence Number=SeqID_158790
atggagaaggctatgaataagctagaaaaatggaaggataggaatctctcctttggtgaaccagggctatggtgtaacacctcgatcgaatcacaacaaaatgagaaggatctagaggctgtgcacgtacgggactatacaactaaggatgacttaaaggaattaattggtactaccaataccaacaagatgcatctacctttcagtaacccatcacttaagaacttcatagttaagcgtgcttggcttggagtagttgtgggatga

SEQ ID NO: 42013 - DNA, 144 bp, Glycine max
  Peptide Sequence Number=SeqID_158791
atgtataattttaaggtggactttgaaaagaccttcagaggagttaaacctatgaaggaattgagacaaaaaaacccacttgctcttttttctcttccttattgtggcgtattggctggatggcttgaagagacaagcggttga

SEQ ID NO: 42014 - DNA, 555 bp, Glycine max
  Peptide Sequence Number=SeqID_158792
atgggaagaatcaaaagaattctcagactgtgtcgttttgaattctttgacaagggagaagggagacacaaaagaattcaggcggttagtcctttgttcttttggaaaagggagaagagagacacaaaaagaattcaggcggtatacctgaaagaccagaccattgcctaccctcctggtctgcacatctcaagagccactgatatcaagatggttgttaataaaatgtactctaaaaaagcatccacttctagttatgatggaagtgacaatgctaagcaccacgatgccattcaagtgttgtgtcctattaggaattaccactttggtgatgtttgcttttgctttacaaaggatgctgaaagctacccattcattcaatgttttcttaaacttctcattattcaatatgaaggcaaatataatttgaagaagatgaccgaagatcagatgatagctcatgtgactcagcttcacgaagctcaacaaagcaagaaggatgaagaagaagttattgctactgctgctgagaaagataatgccgcctttgtctag

SEQ ID NO: 42015 - DNA, 151 bp, Glycine max
  Peptide Sequence Number=SeqID_158793
tggggtagtggccagagaaggagaagaagagggaaaacttggcaaaggagaagatggggtgggcgataagcagagcgtagagatcaagggtcttccactttgggtcggagaagtaccaaagtttggagtggaagtgagaggggttgtgaag

SEQ ID NO: 42016 - DNA, 395 bp, Glycine max
  Peptide Sequence Number=SeqID_158794
atggcagaatcattgaagaagcacaaaggatcttcctccaccactgttgttgttggccaccactgtcacggaccttctggagcacccacaacaccaattcctcctttcctttcatctcctcgatcatctaccttgttttctttagatggtcaacgccaaaggtctttttctattggtgttggagcgattacctcctttggttatcgtaaggatgatgatggtcgggttgattcctcttcacttctgaaagacgtcctcactaaaatccgtggtcttcaaactttcatgggtgaccgatttgatgctatggatactcacctggatgccatggatgctcgatttgatgggatggatacgaggatcactcaccttgaggaagatatgagcttcattag

SEQ ID NO: 42017 - DNA, 616 bp, Glycine max
  Peptide Sequence Number=SeqID_158795
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagaacgtgtcttcttcttcctccgagagaacgattgttcttcttcctccgagagaatggtccctctccacttcgtggcttcatttccgccctgcctcctcttctcctgcggcctctccactatcggttgcggcctcttcttcgctgcctcctcttcatttcctcgctgatgcggcatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42018 - DNA, 558 bp, Glycine max
  Peptide Sequence Number=SeqID_158796
atgtatgggggacctgacccttcaatctacagatacaacaagactaaagcattagcagggaattggttctgcaattatggagctcacaactatgctatgggtgaagaaagggttgccattggaagtgagagtgtgagagaaagaaaaggttatgaagtagcaaggaaggatacgaaggaaggtagaattgcccttggtcttgaagtctccaagtccaaagcaagaaatgagaatagaatggttgccttaggagagcaagaggagcctggccactctgagaggaagagagggaatgagttgagtgagagaaagactaaaaactgtcttcgaaagcatgtgttttcccactctcatgttgatgtggcatgttttaattgggctagcttagacaaccctaaatctcaatttttcttctatgttccctcattcttccattctcatttccatcatagagagagagggagagagaagaaacatcgtaagagctgtaaagctcactccactactccgtcgagcatgcactgcatcccaacaatgcctacgacgtgccatgggtag

SEQ ID NO: 42019 - DNA, 705 bp, Glycine max
  Peptide Sequence Number=SeqID_158797
atggctggtggcggtgctgttttcaccgctgaccggcagatggctgttgccggccacgctaaagcagcaccgcgccggaaacgggcgcctcagccagtgctatcgccgcctgctgagcagcgtgctgcgccaccgcatgctgacgctggcgatggcgatgctggcgctggcgagtttttcccggcatccgatcggcctgagctgctggtgagcctcgcgctgccggccagtgcgtcgcagcaggccaccctgcgtcaggtgcagcgccttgagcagattgtctccgccagccgggatgttgaccactattcgtcttacgtcggcaccggtgcgatacgcttctacctgcccatggatgtgctgctggacgatgaaaacagcgctcagctggtggtcgtggccaaaagcctggccgcccgtgaacgactgcagcgctcgctggatgcggtgcttgcccgggatttcagcgacatcaccacgcgcgtcgcgccgctcgagctcggtccgccggtaggctggccgattcgttatcgcatcagcgggccggattatcgccaggtgcagcagctggcagagcggctggccgccgcgctcggcagctcagcgctgacgcgtgacgtcaatcaaaccgccggtgagcccgaacgcgtaatcactttgcaggtgaatcagacgggcagcgcgcgcagccggcctctcttctga

SEQ ID NO: 42020 - DNA, 783 bp, Glycine max
  Peptide Sequence Number=SeqID_158798
gaaatagctccaaagaagcttctatctaagagggcaaggaaagacaccactgaagaagggtctagtgcggcctcacaagcggatatggaatttgacaaacatcggttccaaagtgagaaacaccaatgccgctttgaagcaatcaagagttggtctttcctcaaggagagacgggtcaagttgagagggggagagtacgttgagttccaagaggaaatttccaggaggcagtggactcaacttgcggggcccatggctaaatatgatccagaaatagtcatggagttctacgccaatgcatggcccacagaggagggagtcagggataagcgctcctgggtgtggggccaatggatcccctttgatgaagataccattaatcagttcttggggcttctgttggtcttagaagaggggcaacgctgcaaattcagtcagaggaggagccaggcctcggggtttgatgaggaggccatcagtcagcagctatgtgttccaggggatcacacctcccagacacctaatggacccagaaaagtccaacagagcactggggtttctggccttgatcatgggcctctgccagttctatggggatttggcaaagcagtaaggtcaggcacaacagtagcaagaggaggaccagtagcaaccagctgcagatgcaccgccgccacctctacagtagccaccatctctagagtccatctctgctcacctgcgaaggatagagctccagatgcacggacatatgcagcatgtgaccgaccagcaagcggctaa

SEQ ID NO: 42021 - DNA, 582 bp, Glycine max
  Peptide Sequence Number=SeqID_158799
atgacactgctgcttagcaatgtcttgcctagcgatcacaactccgatctccctctgcctaagtgccagttggtgtatgtcatcctgacacggatgaccgtccacgtggcccaggtgattgctgacgccatttatttgtttgcaagtatggcgcctaccaggcaccctctggacccagataagtccaacagggccctggggtttccggcgctgatcacgggcctctgtcagtcctacggagttcccgtcacccccagtaaatactgcacgcctaggcaagcacagggtgatgcacatcaggccgcagacgcaccgccaccacctcggcaggccgatccagctaggtcactgggcgtggagcgttatctacagcatttggttcgccagcaggcagccaaccaccatggcaggtgcagatacatgagtgtctctaccggttcagcctcagtcagcaggggcagggttttgccccttttgcatgccctactccggagcagtttggggctgaggtcgcatggcctggagactggcccgatgcccaggcagggagcggataagagccacgtgtggatgaggatatga

SEQ ID NO: 42022 - DNA, 800 bp, Glycine max
  Peptide Sequence Number=SeqID_158800
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggtcgaccagaacctgcacttggtggcctggaaccgccgttacctggaactgttcaactaccctgacgggctgatcagcgtgggccggccgattgccgacatcatccgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42023 - DNA, 351 bp, Glycine max
  Peptide Sequence Number=SeqID_158801
atgagattcaattgtcctgtgtttaaaagaagaatagaaaaatccgacaagatgaatttcaaagagaagaaagaaaagaaaggatatatcacttgggaagataatgtcataaattattcaagtgattcaaagaagaaaatcataagtctgggtatcatgatgaaagactatgaaaatggagaagagcaaagtcgatacattgatagcaatttctccaaacacatggcatgcatcaaattggaagttggaagtggaagttactggaagttggaagttggaaatgaaagttattggaagttgaaagttgaaaatggaggttggaagttggaaggagaagttactaaaagttga

SEQ ID NO: 42024 - DNA, 405 bp, Glycine max
  Peptide Sequence Number=SeqID_158802
atggaaatttaccaacagcaaactcctcggtcatattgtagcagttctatactcatgcagcacaagattgttgaattcttgttcatgaaggcatccaaggaaaatgctacttcattcccctcgaagaagaggaacatgaagaagggtgggaattacaatcatacattttccacttactatagaatatatgcaaaaaacctgccaggtaaaacaatattctcctttgctggaaacttcctcgctgacttagagtggaagcagcccattatggaggaaaaacataaggagagaagcttcgagataatcattgttattgttgccgtgaaagtagcggaagttggatttgcggcaggaggaatcataggaaatgaggaaggatttgcggcagtgataccagagcggtga

SEQ ID NO: 42025 - DNA, 862 bp, Glycine max
  Peptide Sequence Number=SeqID_158803
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccatgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcggcgaaggatgtcccatgagaggagtgccatcagacgaaagcatcacgcctttcatcgcacgaggtttcagtgaccacaacgcgagggacagagagcttaggggaagcagtaatgagatcatcggcggctatcataagtggctaagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 42026 - DNA, 1365 bp, Glycine max
  Peptide Sequence Number=SeqID_158804
atggattcgttcaatcagagtcatcaaactaccagcttcaggtacaatccaaactcgaacacaatgaatcatgcagatgatgacgctgagttctcagggattcttgatatctatgttcatcatgctaggaacattcacaacatatgcatgtatgataatcaagatgtgtatgctaagttctctctaacatacaaccctgatgagactctctccaccagtatcataaatggtggtggaaaaaacccaatattcaatgaaaacttgaggatgaagataacccagatggatgccgttctcaagtgtgagatttggatgttcagcaggtcaagaaatcacttggaagaccagcatttgggatttgctttggtccaaatttcacaagttgttggcaaaggaaaggtgacagaagattatagcctttcctccactgatcttttccattgtcctcctggaactgtcaaattgacactgtctttggacacatcattttcaatcaattccactgtgaatcccatatcacaatcagctactaattcatccatatcttcagaagttgttttgcttgatccaaaaatttcacaagatatgtcagacccagttgagtattctagaattgaatttcctgatgttagtgtgacgaaggagaaccagaaaatggtttctgagtacttcaatttggaatcttatggttcttctgcttcaaggcctaattcagtgggattgctaccatttcttcaccttggtgcttctcctcgaggtgatgattatgaaatgactgtgactgcaccagatgagaatcatgaatccacttctccatatgagagcattcagaaatctgtgttcccaagttctactactacgagcttaagtgatgaaagaaacacaggtgattcagttgaggaaaagaacaacttaagggataacacatcaaattctttcaatgtttcaatcacagttgaaggttgtcagaactctggtgctagtccagataccccaacttccaagaaagaaactggagccagagatgaaaaggaatcaaagttcacatcaaggaaggaaaaggagatcaatagtgatagaaatacagaagctacaagatttggtcaagttttttctgctccactagggaacatcaacatggaggctgagcaatcagctatgcagcagcaaatagttgacatgtacacgcgaagcatgcaacaattcaccgagtctttggcaaaaatgaaactcccaatggaccttgacaaacccgagagtgaaggtcaaggtgatgtggttcaaaatcataacagcaacaagttagaaactgataagaaaaaggatggatcacgtgtgttttacggtagccgagctttcttctag

SEQ ID NO: 42027 - DNA, 333 bp, Glycine max
  Peptide Sequence Number=SeqID_158805
atgcttcagctgatttctgctaataagttacgctcagacttttataattcacaatgtccccaggcacttgaagccattaaggcagaaataacctctgctggatgtgatgcatcaaacttgttgaaagacacagcaaatttcacgggcgaacaaagtgcaattcctagtcttgattctagaaatggtacggatatcatagagaaggtaaaagctagagtggagaagctgtgccctggtgttgtctcttgcgctgacattctagctgttgctgcgagagattctgttgttgccgtgagtattgaaataactgtttggattgtagctgctggttaa

SEQ ID NO: 42028 - DNA, 657 bp, Glycine max
  Peptide Sequence Number=SeqID_158806
atggctgaatccacccgttccaagtcctttgatcgacttgaggaggcaattgccaaactcgccactagccatcttcacgtttcacaaaagcttgataaccttatcaaccgcgtcaccgccctcgaatccaacccttattccccttcgtcttcctccactaacccttctcaccacacccaaacaccttctccccacaggctcaaactcgatgtacccaggtttgatgggtcagacccctctggctgggtattcaaaatctcacgattttttgaataccacggggtccctgactcagagcggctcacggcgattgaagcctgttttgccctttctccttataaggacccaacaggacaactcttcaagttggttcagaaaggtacggttcgagaatacctgtctcagttcgagtccttggccaatcgcatcaccggtttgtcgccgtcttcacttctgagctgcttcatatcagggctcgaacctgatatcaggcgtgagcttccacagcagaccttccttcactccctcaccttcaacctcgcctcccctttcagtggtttctcctccctccccatttcccttacttccttccccgcccaaaccctctcccttaccaatccgacgtctcagcctggaggagcttgccaaccaccgtga

SEQ ID NO: 42029 - DNA, 459 bp, Glycine max
  Peptide Sequence Number=SeqID_158807
atgttcttcctcttcttcctcacttcacattcttcctctttttcctcgcttactcttctttgcatcttcttcctccctattcatcgaacctcgtcatcttcatcttcctcttgctcgaaccccatcatcttcatcgtcctcttcctcaaaccctatcatccttccttgatggaaagtagtgggtattcgcataacactggttctgggctcaatagacattgtgttcattgtgaatgcaacttatatgctccgttggccactgcttggacggacaataatgccggcgtaaggttttttggttgtgggaactataaggacttatggaggcaggtgtgcaatttctttgaatggtatgatccatcattaaatcctcatgtgaagaaaattattattgggttgatgaggaacctagaagagttcaagaatattgagaatgaactcaggacaaagcatatttag

SEQ ID NO: 42030 - DNA, 564 bp, Glycine max
  Peptide Sequence Number=SeqID_158808
atggctagctgcaagaacatggacaactcatgcaacattttaaaaattgaattcaacctccaacgaccacaacaatggctaactcttgaattaatcaaatttgaaggagcaacttgcaaggaaggtagagccaaatccgaaatacaagtccctaggtttagagggaaagaactcagaaggaagatgaagcttgggaggcttcaggaaagaaaaaaataccacaaagtgtttgttcttagtggaaaacctatagttgtaggtactggacgtagcccaagttcaggagtcgccgaacatgtggtcaaggtcggcagcgtagccaataaggaagacggcgatggtgatggtgagggagctagcggcgatgaagaagtggcggtaggcaaaacaggaggtgcaacgatcgttgtggtatcccatgatgatttggatgagcatgccagagattgggccgcagagccagatgaaggtggccctaatggacttgtggttatgtcttatatgaataggaggaatgttgctgacatcatatttgttattgcaatgcaagcatttcttgaatga

SEQ ID NO: 42031 - DNA, 546 bp, Glycine max
  Peptide Sequence Number=SeqID_158809
atgaagatgatggggttcgagcaagaggaagatgaagatgacgaggaagaagaggaagaacataaggacggagaggaagagcgcggcgacacccttggagttagggctctagggttgagcatgccgcctcagaatctgacttggctggacgatgacacgtggctccacaatgttacggatatgcgggtgttgggcttgaggttggatatgatctttcttgaagacaaaaagattagggttaatacacctaggtttaaaggagcaattcacgttttggccaatgatcatactcatcgccattgggtggatcgtgagttcaaagcgtcaaaggttaaggcacatacaatagcgatgatcatcaaaagggatgcgaagattcaggatcctcttatggtctttttgcataggtggataaggggggtgtcacaaactagtgattcttttcttttgcagcataaactccagacgaagggttggaatccacactttatagataatgagcatttggtttcggagaagttgtatgtggttcctttgtacacttag

SEQ ID NO: 42032 - DNA, 936 bp, Glycine max
  Peptide Sequence Number=SeqID_158810
atgcccaagagcctggtatctgatcgggatccactatttctgagtcacttctggcagaaattgtttaaattaagtggaactaagctctgcatgagctccgcttatcacccccagtttgatggtcagaccgaggccatgaatagagttgtggagcagtatttaagggctttcgtacatcagaaaccttcttcttggggtcattatctgatatgggctgagtggtcttataatactttgacccactcagccacgggcgcgtcgaaggtggaagcggtggaggaatggctcactcaacgtgatcgaatgcttaccagccttgtgaagaaactttctaaagcacaacaacacatgaaggagattgcgaaccaacaatgtcgcgatgtgagttacaaggagggagatcaggtcttagtcaaattgagacctcgtcgacagacatctgtttcagggggtgttcactcgaaacttgcaaaaaggttctatgggccattttcaatcatcaagaagataggaaaggttgcttatcaacttcaattacccacaggatcacaaatacatccggtcttccattgttccctgttgaagccctatcacccctcaactgaagtcaaccccgccacattacccattttatcgaaagataatcaaccttgcatcaccccattagtaatattagatactaaatgggtatcttcacctgcgggacaaaacttgatggttcttgtgcagtggacaggtttgcttcctgaagactcttcgtgggaatcttgggaaattctcaagcgtgattacaaccttgaggacaaggttgttttggaagcctgcaaggatgttatgaacaatgaatcagcagaagcaggggacgcagagtatggaacagggacaaagaggaaaagccagaaaccacgatacctgagggattacgtggcaaaatga

SEQ ID NO: 42033 - DNA, 354 bp, Glycine max
  Peptide Sequence Number=SeqID_158811
atggctagttttactaagttagcatgcatggttctggcgtgcatggtcgtgatggttgcacacaacactgtccaaggcatcaggtgtggccaggttcagggtaacctagcaccgtgcctagggtttctccagaacggtggagctgtttccagaggatgctgcaacggggtcaggagtattgtgaacaatgccaggaccactggtgatcgccgtgctgtttgcaactgcttgaagatagctgctggtgctgttcggaagctcaacccttacaatgctcaggctctccccgggaaatgtggggtcaacataccctacaagatcagcacctccaccaactgtaacagcatcaagtga

SEQ ID NO: 42034 - DNA, 114 bp, Glycine max
  Peptide Sequence Number=SeqID_158812
atggctagcacttgtttgtggtgtgtgaacaggctcaacaatgttgatcataactcgtgcaagggagacccttcatcaatggagaagtgcctaagtccaccgggcctcctgtga

SEQ ID NO: 42035 - DNA, 1461 bp, Glycine max
  Peptide Sequence Number=SeqID_158813
atggtattttctatcaaggtgcatcacagagggcatgtggtccattctatttggaattatgttggtggagatgtcacgtcgttggctgacatagatgttgacaaatggtcatattttgagtttgtggggattttgaaggaagatgtgaaactaaaagaatgtgaggcactaaaagtgtatgtggaggtgtttaatggtggtgggaatgaagttgttgttgctgggaatgaagggaatgaagatgcacacggtgggaatgaacgtgcttctaaatctgatgaaggtgatagtggttctgaatttgaggaagaaagggatgttattgaggatagtgaggaagagagagcaattagtgttgatgatgggattgagaataacgatgaactactagggtatgagactgaagaacttgatagcgtaggatctgaatcagatgatggcgacaaacacaagttgggaggagcatgcaccacttacaggattaagacatgtagacccaaacataaatgtggaaaggcctttaaaaacaaaaatgctacgcccaaatgggtgtccaaggttactatagagagtttgaggattagaaatgatgtgaaactgacacagattatggatgatgcatatggcgaggagctaaaggttgtatgtaaaggaagcaaattggccttcaagaaatcatgtagaccaataataggtcttgatgggtgtcatttaaagagtaagtatgggggtcaaattgcagttgggagagatcccaatgatcaatatcttccactagcatttgttgtggttgagaatgaaacaggatttggggaagtggcttttggagttgctaagattggtgaacactttaagagcaataggagctggcacacatttgagagacctaatgatgtggtggctaaagctacatttaaggaggtgtgggaagacaaaatgttgcaactaaaggagatcaaacaagatgcttatgaatggctaatgaaaaccgttgacacaaatgcctggtatgctggtgtaaaaccagagtcatttgtccatgagtattatagtatgaagtttgatgacatttgttattcaaatgagatctctactatgaacgaccaaagaatgtggaaggattcaaggaatcctgctagtgttttaccccctgagtataaaagaggtgcgggtaggcaaaaaaaacttagaagaagggaaccaaatgaggagtgtcccatacctcctcctgtggtcaaggaaccacctgcttcaaataatggggcaactactgatgcaagtacaattgctgataggaaccaagctaatgggaaccaaaatgctactgttgccaaccaaggtccctttggttcaatcccaggaccaaaaacccggaagcaaatgagaccacctattgagaatgtatttcttaggaaaatgtgtaagttgtttgcaaagacatctgcttctacagccccatga

SEQ ID NO: 42036 - DNA, 649 bp, Glycine max
  Peptide Sequence Number=SeqID_158814
atggcgaaaagaacaagcacagaggcaaatgaaaaccctaaagctacatcaaaagcattaaagaatgcttacctaaccgtgttgtgttcaatctcactttcaccaaaccgtgttgtcttcaaactcccttcaaccaagaaccctagaaaaagcatgaactacaccatcaacgtccaaagcagaaagctctcaccatctacacccatggatcaggaagtctacccttccacgacaactcgcgagtctgctatgagtccacaggtttacgaaaacccaaaacggtgttgtgctgcctctgattccaatgagaatgcatgcaacggcgctgctgaggaggttgcgatacgcataattgaggctggcaagcaggaaagcgattcgtcgccgtcctcgttgaggggtcggggtggggagctgggcggtgaggaggcggtggttgggaggagtgagattttgtcgtatcgttggcgaatggcagaggagagggtgtcgttggtgtctttggatgatggcgctagggattcttcttcttcttcatcgtcctctacttaccagaggtatgatattcagcaggttgcgaagtggattgagcatattctatcgttttctctcttgttgctgattgttttcatctgccagcatttgcaag

SEQ ID NO: 42037 - DNA, 543 bp, Glycine max
  Peptide Sequence Number=SeqID_158815
atgaccccacacgcacgaccccgcacccagcagcgacgaccaagcacacgacactcggacggcaacggcggcggcggcaacggcgctacagtctgcaacggacgcattcaagattacatgtttgaggagagtgtgtgcctgctacttcgggcctcatggttcacacctttatctgttgaagaacatgtggttcatgaagatgcatatgaagacctagaagattattatcagtacgaggatgatgatgatgatgatgatatggatgaagtttactatggtggttcgtccagtcttcgggttattggcaaccgtagatggggagataatggttatgtcagggctggtcgtcaagaagctcggccagtccatcgtccaaactttcaggattcaggagcaagttcttcttcgcatgagccgaagaagaaagaggctgggaaaattatcacaggcagaagggcaaagagggcacagaaaagggaagctgctgacaaggcggcggaagcaaagcatcagcagcatttagtaaggttgggtaggaagtga

SEQ ID NO: 42038 - DNA, 276 bp, Glycine max
  Peptide Sequence Number=SeqID_158816
atgtcaaagaattgggtgttgaaaaagcataacaagactttctgtgattggtttaaagatacaatctttgtagatgagaatgcttcagaaacattaagaaagctagcagatgggcctaaaagaaatgttataacctggcaaggatacgacataaacaggtattcattttacacaaaagcacaagatgacaaaagtacaatgcagaacaatggggtcaccctaagggttgaatctcaacattttgcaacaacatcagtgtgcgcaccgatgatatag

SEQ ID NO: 42039 - DNA, 288 bp, Glycine max
  Peptide Sequence Number=SeqID_158817
atgtgttttgttaggcgagcaagcagaaggtggagattggaaaggttgatggctaggcggtggcgtttgctcggtggtgttggcataggagtgaaaaggaaaagggttggaatgttcatatgggtaagagaaaagaaagggttggttgatgagggaaaggaaccctattttttcataatagccctggagttgttcgaagttgtcaagttgaatttggagagctctcacctggtcgatgatggcattgaggtggaggtctttcatgggagtaagctaatgaaaacatag

SEQ ID NO: 42040 - DNA, 246 bp, Glycine max
  Peptide Sequence Number=SeqID_158818
atgttggagaaattctggaagttagcttggagatttgagtccattgcccgtcaaaaatcttgggggttgcatttgaatggaagttgggtggatgatcctttagtggttaaaatagaggcaatgaggttctttcttgagagatttaaagaaattgaggatattgacattggtttggatggagacaggtttaacagcatagatgagggagacaatggcatgcttatagaaacttttcagaagaagtga

SEQ ID NO: 42041 - DNA, 1319 bp, Glycine max
  Peptide Sequence Number=SeqID_158819
atggagtatgtcatacatttcttgatggggctcaatgaatcctatagttcaattcgagacttcctagcatctcaaggcaccttacatcaattctcatgtgttgaaagacctcaacaaaattctgttattgaaaggaaacataagcatttacttaatgttgctagagcattatttttccagtcaaaggtgcctattactttttggggagaatgtgtggttactactgctttccttatcaacagattgccttcaccattgctgaaacaaaatactcaatatcaagttctttatggttctgcacttgattattccattttgagatcttttgattgccttgcctttgcagctactttgaattctgagaggaacaaattctctccaagagcagttccttttgtgtttgttggttatccacaaggcatcaagggatacagtgaattagctattcccttacctattcctgaatctatatcctcaaccattcaacctagagccatcgacaccaatatttctgaacccaatagttctcctgacacaaataatctgcctgttcagttatctgattctacagtgaaattcaaacctgatggcattgtggatcgccacaaagctagattggtagctaagggctacacacaacaggctagcattgatttttctgatactttctctccaattgctaaatttacatcagttagagttcttttggttgttgtagctgctaaaaactggtcaaccttacaacttgatgtggataattctttccttaatggcaatctatttgaggaagtttatatggaacttccaaaagggtacaattcagttgataaaaatcttgtttgcatactcaacaaatccatttatggccttagacaagcttctagacaatggtgcttccttggttccttgaaatattttctgggtctgggaattgcaaaatccagcaagggcattgtcccgactccgcgaaaatatgctctttctctgttagaagatactggcttccttggctgcaaaccatcttctcttccaatggatccaaatttaaagcttagcatgctcaatggtgaattactacttgatcccttaatgtacaggcgtttacttggtagcctaatgtatctaactatttcaaggccagatattacatttgatgttaacaagctaagccagtacatgcagaatccaaggaaacctcatctatatgttatgcatcatcttctccaatacatcaaaggtactctaggtcaaggtcttcattttccaacaagtaattccttcaatttgtctgcctatgcagatgctgattggggaggatg

SEQ ID NO: 42042 - DNA, 618 bp, Glycine max
  Peptide Sequence Number=SeqID_158820
atggatcttcttaaaggaggagaaggcaatgtagatgagaattttgttgaggtctttcaacacatgagaattgatgtaaggtgccttgagatgctaggaagtctctttgagattgaaaaaggttcttggctcaattattttgagctgccaaactacgtggctggtagaagtattttggatggggttgtggcggaaaacgagttggtagatcttgttaaaaggggtaaaaggagttgctttatttttaacattgattttgtgaaagcttacaactcagtcaattgggagttccttgattatatgatgacacatcttagttgttttgaggagctgcagaggaagtgggtaaaggttgttgtgtgctctagtaggatgttggtcttagttaatgagagtccgatgaaggaatttgtggcagaaaagggattgaaacaaggtgatcctttagttccttttctcttttttattgtggctaaaggtgtccatggtttggtgagtaggtcagtgaagttagggacctttaggttacttaaagttgatgatgaggtgtctttctctatcttgcaatatgtcgatgattcgattttgtttggggagactagttgggacaacttatag

SEQ ID NO: 42043 - DNA, 393 bp, Glycine max
  Peptide Sequence Number=SeqID_158821
atggattctaggcggcgtggtaaaaacgcatctatgcaacgcaagttgcaacaacttcgatcggtgaacaaagcctcaattattgtggatgccaccagatacatagaggagctgaagcaaaaagtggatggattgaactcagagctaggaaccgcggaatcatcaatctcccaagacgaactacccatggtcactgtagaaaccctagaaaggggattcctcattaatgtgttttcagaaaggaattgtcccggtatgcttggggcaatactcgatgcatttgaagaactgggacttgatgtgcttgatgctagggtttcttgcgaagacactttccagcttgaagcagtcggaggagaagtaagagaatacactaggatatacaatgtctaa

SEQ ID NO: 42044 - DNA, 1518 bp, Glycine max
  Peptide Sequence Number=SeqID_158822
atgatgcttcagctagcagaacgctcgattactagaccatatagtgtagttgaagacgtccttgttaaggttcgccaatttactttttcggtagaccttgtgatcatggatatagaagaagactctgatattccccttattctaggccgaccattcatgcttactacaaaatgtgttgtggacatagggaatggcaacttggagatgagcgtgaaggatcaaaaagtcacattcaacctggtcgaagcaataaagcatcccagtgatagtaagacaagcttcaaggtgaaggagattccctcaggggagcatgcctttgaagatttaaagaaagacagcctaacagagaagctcaaggtggagttaaaagctctacctactcatctgaagtatgtgtttctggatgaaaatgaagccaagccaaccgtgataagcaatgacctatcatcagatgaagaagcacgattgatagaggttctcagaaagcacaatgaagctattaggtggcatatctctgatctcaagggaatcagtccaccctactacatgcataagattatgatggaaaaagaatgcagaccagtgagacagccacaaaggaggctcaatccatccatgaaagaggaggtgcaaaaagaagttcttaagttacttgaggctggacttatctaccctatttttgacaatgcttgggtgagtccagtccaagtggtgcccaagaaagaaggaatgatcgtgatccgcaatgaaaagaatgatctcattccaactcgaactgtcactggctggaggatgtgcatagactattgcaagcttaacgatgccacaagaaaggatcactttctttgccattcatggatcagatgttggagcgtagaccccaaggagcaagagaagacagtgtttacatgcctttttggagtctttgcttacagaagaatgacattcaaattatgtaatacaccagccacttttcagtggtgcatgctagctatcttcgccaacatgttggagaagtgcatcaacgtttttatggacgacttctctgtctttggtccttcctttgactgttgcctgaccaatctggagcttgtgctaagacgctatgttgaagcaattctggtactaaattggaagaactgtcgcttcatggtccaggaaggaatagtgttgggccataagatctcagctcgagggatagaggtggacaaagcaaaaatttatgtctttgaaaagctacctctgccaatcaatgtgaaaggcattaggagtttccttggatatgcaggattctatcggcgattcataaaggacttctccaaaattgctagacccttgaacaaattgctgaataaagatgtagtgtttaagcttgatgaggaatgcttgacaacctttcataccctaaagaatagtctagtatctgctccaataataggggcacctgactggagtaaagaatttaagctcatgtgtgatgctagtgactatgcagttggtgcagttcttggacaatga

SEQ ID NO: 42045 - DNA, 414 bp, Glycine max
  Peptide Sequence Number=SeqID_158823
atggagctcaaatcaccaacttcaatggcgatttccaccaaccaaattgccagtcaaactggcgggtgggtttgtggctttcactgtttgtcgtcatctatcggtgcacgtcgttggtgggatcaactatcatttaagattgtggtagtgatccttcatccccacaaaggttcttcgataaagacctacaagctcacgtcaatggtctacaaagttgtatgtgaggtgcaaaatcttgggagtctaagtgtgtctgggaagcttgagaatggaaaaagagtaaagtgttggtgctattgcatgtttagagggggctggcttggaaggacaaaattgctcactagtgagggagttggagaagacagggtagaagctatcggtttagaggagttgttgtcgggacgacatcgttga

SEQ ID NO: 42046 - DNA, 528 bp, Glycine max
  Peptide Sequence Number=SeqID_158824
atgaaaattgtggcaccaaatggtgtgaccttgttgttgttggtggagtgccaaggatcagatttccaaaggtggctattccatcactctgcgtccacctggtggacatcctcactgattcaccaaagccaccctccaaagaatgttctaacaacaacaacaacaacaacaacaacgccttatcccactaggtggggtcggctacatggatcaacttccgccataatgttctatcaaatttataagcactccagaagttctagagaggcattgaaaagtgttgaagaaactgttataagacttgaaaagttacttcaagagttgcatgtatcaagctctagttttggaaaagagcatttgaaagcagcttgttctgacttggagaaaatacaaaaactttggaaagaagctaaattcctggaagcatcttttagagcaaaagctgattctctgcaagaggtacagcttctaaccctcaccaacctccttgatcaattctttggaaccattttttataaaaaaatttga

SEQ ID NO: 42047 - DNA, 279 bp, Glycine max
  Peptide Sequence Number=SeqID_158825
atgtatcatatccttttggctaattgcagtgtaacatgcatccttcattgggctacataccgtgagaaagttacctgccctcagtgtaaacatccatttgagttcctcaatgtccatcgctcacttgatggcagacctcacgtatttaatgcctatgaaaagagagagagactagattctaatgacaaggtcgtgaaattcaacattggaggattcattcagaatttttctgtgatcagctacatcaatcaattaatggccattagtttctatcagtaa

SEQ ID NO: 42048 - DNA, 447 bp, Glycine max
  Peptide Sequence Number=SeqID_158826
atggatgatcagatagtaaggaaagattacattacaaggatatttggttgcgtggctcccaacaatggtggtttagccttaagggctgatgtggatagaagaataagaggaatggataaagaaagagaaggagagaatgctatagaaggagggtttcccctattagagatactcaggcttaggatgtattcattagagagctctgagtctctcttgagcttgaccgctaagcgaggaggtgcgctgagcctggcttgtgcgctaagcaagttgccccatcttcaactttttcttcaagtttttgcatcaattttcctccaaagcacttgtaatttacttcttttcaatcctactgatggccttgaggaagcaccaaacaggatccagccaaccacaaggggggattccacttgggattcctctcgctttgcttctgagacagcctag

SEQ ID NO: 42049 - DNA, 147 bp, Glycine max
  Peptide Sequence Number=SeqID_158827
atggggtacgaagcagagtatatgaagtgccatatagagtttgctgacagaagattgagaagcctgaacagacaaggtcacattgtctctgtacgcaagctcgtgagagagagaatttcagaaactgagaaacatctagctaggtag

SEQ ID NO: 42050 - DNA, 1086 bp, Glycine max
  Peptide Sequence Number=SeqID_158828
ggctctatggaagattttgtagaaggacttcaccacaattgcccaaacctggagtgtgctttcttatttcaaccttgctcctacctcccacacctccgacctcaacatggacagggcttgcctgatatatgggctcatgatgaagatggacatggatgtgggcgacatgatttctctgcagattacccaaatagcccagcaaaggcaggtttgaaccagagccactcaagatgctccaccaccaccaccagtcattcctcctttttccacctcatcttctgccgaccagtcttcttcttctcagccagagcagctcttccccatgctacaaagcctccaccatggctagtatctcttggcccaaagccttcatcgactatctctctaacagccaatgatgacaccagaagcattcctatctcaggggatgatacttctggtgtcggcgatgatgatgatgcagacaccggagttgatgatgattatgttgtggatatcaatgctgcacagggagcctgggacctttggtcaggcgcgcttagcgcgagaataccgccatacttgctaagtgcaaccatcgtgcttagcgcaaaggctttctatgataacgagaggctaaaccctcacttgttgggaactcagcagccaactgttcttgatggtagtattaggaagcgttattctctaagagaattaggaaaagatccggttgcgattcagttgaatggttgtgatggtgacaccgatgacaacaattctaattggttggatctttgtggcttagggactcacgatggcattgcaaatacggagaaccacaatctaaaccattgccctatagttgttgcaaatcttgacaacactaatctgaacatcctcttcgtggtagagggactcacagtacgtttccaacggaggaagtcgttgtcagtggtggttgggttagatgtgagcaatggcgtcaccatcagtggtggatggaaaagtgacgttggcgatgcagaggaggtcgttgacaacgatggagaggtgggtagcttgaggggaagaagaaaagatggatcaggaggagatggagaacaatga

SEQ ID NO: 42051 - DNA, 585 bp, Glycine max
  Peptide Sequence Number=SeqID_158829
atgggttgcaaatatcaatatccaaaatttctagttctcctacaaggaagaatttcatactttgcagcggaaaatataattaacacgaaaggcacgttatcaaaacataatgagatcaacaaccttgactacaagattgacttgactacaagtgagaagctctacttgatgactttgattatgatcattatgccactgctaagaagttacaaccttccaaataagggacgaaatctattgtgcataagcaaaacatttatgcatgatttatgggggtggtggtgcatggtgcgccattgccatggtcaccatctattgttatgggataaggaagaagatagggaggggggagaaaaagggaggagagagggcgatgaagtgcatatagatggaggtgccaactttgcacgcgagttgctagagagtgagcaccccattatacgaggggccacagtcagggctcacggcggagcagccttggaggtggtgttgcgactgacaggtatgatgaagtgtttgtcatcgacgatgggagtagagaacgtagggaagaagaagagagagaagatgagaattaaagggtaa

SEQ ID NO: 42052 - DNA, 432 bp, Glycine max
  Peptide Sequence Number=SeqID_158830
atggcggcaccccctctccccctctctcctagtcagcctgtcccgctgctacgaatggcggcacctcctatcccgccattgtcactagcggttcaagcttcccaccggaccaacaatcttcttaatggatgcgagaaagagcctggtatggataaggtgaaatggggaagaaactccagaggggtctctaccaaaggggaagcgttgtcgagaaggatcgtgaattcgtcagcgcagaggaaggctctcggagaaactctccatcttcatatttgcgacgtgaaattgctactcttctggctcgcactctcctccctcaccggaaatggagagtatgcgttgtttttgaagaagaggaaggcgtcggataagagggttgtggaggagaatggaggtgaggatgatggggagaaagttgttgataatggctga

SEQ ID NO: 42053 - DNA, 1134 bp, Glycine max
  Peptide Sequence Number=SeqID_158831
atgggcaaagttgtcaattcaaacaccgagtcttcactttcagaatcatcgtcagcggttgcagattgtgctgttcgcaaagacaatcaggttatggttgatgggccattggcagatacacctgatgacaacgaaggatttataatgtttggcagtattcgtacatcgctgaatagaaagaatgagaagaagcattcagtaccttggttccctggttgcacaccatttgttgataaacactctgaattcacgtctagttctaatcatttaaaatcaacaccaacaactactactacgaaattttcaaattctatgttgacaacctccaatgataaatcgcctcaaggtagtaattcctggaagaacaaatctgcatctgtcaatagaacttataatagcgccagcaattcaaactttgataatgaattgcctcaaggtagtaatttttggaagaagaaacctgcatctgtgaataggccttataatagccccaacaattcaaactatgatgcagttggtaacaagttggatgcttcagttggttcgccaatgtccaagccatttgacatctgcttttctggaagaagaaatcctgctttaataggagctacattgccgggagacaatgaaaaaagctgcattgaaatgcaggaggaaaagataaaaggggggatattgaggcctggaatggttctcttgaaaaattatataactcttgatgaacaggtggaaatagtgaaagtttgtcgagaacttggtcttggtcctggaggattctatcaaccgggttatgcaaatggagcgaaacttcgattgaagatgatgtgtcttggtatggactggaatcctcagtcttataaatatggaaagaaacgggtgattgatggtagcaagccaccgagtattccctatcacttcagtcaactggttataagagcaatccaagaagcacattctataattaaaaaggaaaatagagtattcaaagtggaggacgaacttccttcaatgactcctgatatatgcattgtcaatttttatacaaacaatggaaagcttggtctccatcaggtcagctcctttacttcctacactaccatggtttgcattttcaatgcgagaaagaactcataa

SEQ ID NO: 42054 - DNA, 267 bp, Glycine max
  Peptide Sequence Number=SeqID_158832
atgctctccacctcctccagcatcaccctccttgcctgcaccttatgcggcttgcggaagaatgcgagctccgcctggtccatgcgccagccacgaggcggcagtcatgtggcggcacgaggtgaaaagggaaaaaaggaaaaccacttcacgatcgattatgattttaacgtcgtcgccgccgccgcgaacgggtcaaagctcaccgttctgaagtcccagtcgagccacaagatcgaggcccgctatgagctgggccgcgagtga

SEQ ID NO: 42055 - DNA, 960 bp, Glycine max
  Peptide Sequence Number=SeqID_158833
atggctttccataagtatttctcttttgtcctctatgtctttgtgtttgcagcttttccaacaacagcattttcaaaattgtcacatgattactatgactacacgtgccctaacgctttaagcaccattagaagcgttgtggaggctgcggtgcaaaaagagcgccgtatgggcgcatccttgctacgcttgcacttccatgattgttttgttaatggttgtgatggttcaattctactagacccttcatccaccattgacagtgaaaagaatgcactccctaattttcaatctgctagaggatttgaagtggtggatgagatcaaggaggctgtggacgaagcatgtggaaaaccagttgtttcttgcgctgacatattggctgttgccgctcgtgactctgtcgttgcgttaggagggccatcatggaaggtgagacttggtagaagagactccaccacagcaagccgtgaagcagcaaatgcaaacattccagcaccatttttcagcctttcggaactgatcaacaacttcaagagccacggcctaaacgagagggaccttgttgctctttcaggaggccacacaattggaaatgcacgttgtgctacctttagagaccatatctacaatgactccaacatcaacccccattttgcaaaagagcttaaacacatttgccctagagaaggaggtgactccaaccttgctcctttggaccgctcagcagcgcgatttgattcggcctacttctctgatttggttcacaagaaagggcttcttcactccgatcaggaactgttcaatggtggttctactgatgcattggttaaaatatatagccacaataccaagggtttccacaaggacttcgcaaaatctatgattaagatgggaaacataaagcctcttaccgggaatcgaggtgaaattcgtttgaattgcaggagagtgaactaa

SEQ ID NO: 42056 - DNA, 168 bp, Glycine max
  Peptide Sequence Number=SeqID_158834
atgacgttagtctctgcatgctatcgtgctttgagtcttacggatagcgaaagagtgtttatacggataaccacttggtctttaccggaagatgctgacatctccggaaagggtgcagatgaccacattggtctccgcgtgtcaatcgggcttggggtccccgaatga

SEQ ID NO: 42057 - DNA, 430 bp, Glycine max
  Peptide Sequence Number=SeqID_158835
tccattccactgccattcatcttccaagaagcaaaggaatccatttgatgaagaagatcctaggcctacaagctccaatggagcttacatcagcgagctagaccgcagcgagttcgggataacctacctcttggcgggtctcagacccttgagagaaaggactagggcttgggatgacgagagtcaaaatctgactgaaggagaactcacttatttgcatgttattgatatgtcacttctctcaggggctatttacaagaaaagaggagagcaacttaggtccattttcacaatggaacataacaggaacttacaaaggtctaacatgttgctaattgctaagcttacctttgtgcctatgctttatgtgtttttaatatgctatcattgtacagagcataacaaaggcaaaggggcagcatccatgtga

SEQ ID NO: 42058 - DNA, 330 bp, Glycine max
  Peptide Sequence Number=SeqID_158836
atgtcgtcaataggtatatggatgagtggagtcaaagcttgggtcatggttccatctatgcattccttgagccacagtccttgcacatttcaaaggataaacgtggcaagtgccaacaatatattgaaagatggcttaaggaatcccaacgagagtgcaatgaacaaattaaagacgagttcgtctggtgatactaagccagctgcacctaagtggattgaagctaagtggtttggtgatgacacaccattggacaatgacaccatcacaacaattcggaagaaatgggcaagttattttttaaagaatacaaacattggccgggtgtaa

SEQ ID NO: 42059 - DNA, 420 bp, Glycine max
  Peptide Sequence Number=SeqID_158837
atgaggagccagaaaactgctacttctcgacccacttttgaagttcaaaacttaaaccctagttgtctctctctctttcttctgcatcttcaaccttggcaagggaagccacagctggtgagcaacatcaatgcctgcactgccgtcgccgacgtcgtccgcaccaccctcgaccctcgcggcatggacaagctcatccacgacgacaagggaaccgtcaccatctccaacgacggcgccaccatcatgaagctcctcgacatcgtccaccccgctgcaaaaatcctcgccgacatcgccaagtctcaggactccgaggtaactttaacttcccttcgatctcatgcaatgccactgctttcaggatcttttcattttcgcttcattcagatgctttacactgtggaattggaattttaa

SEQ ID NO: 42060 - DNA, 492 bp, Glycine max
  Peptide Sequence Number=SeqID_158838
atgaaggtgatacttgagtatcaggaagtccttgagatcgtggagaaaaggtattcactgcttgcagaagatgctacaaaagaacagaaggtggcatataatgagaataagaagaacgactgcaaggccctatgtttgatttaccagagtgtggacaatgcccattttgaaaagatcattggagcaaaaacctcatcggaggcatggaagatcttggagaaaggaaatgaaggtgtggaacagttgaagaaggtgtgtcttcaaacgatgcacagacaattcgaattgatgcagattgaggaaaatgaaagagtagctgagttctttaatcatgtctttactctgaccaatgcaatgaagtcctgtggtgagaaggtcactgatctcaccatcgtagagaaagtcctacataccttgaaccccaaatttgaccacattgtggtggtcatagaagaatcaagaaatctggagagattagcattggaggactag

SEQ ID NO: 42061 - DNA, 153 bp, Glycine max
  Peptide Sequence Number=SeqID_158839
atgagggccaatatagtgaaaaaaggtccagagaaagaagacattggaatcaatgtgatactaaaccccgaaaagagcaatgttttaaatcatggccataattggggtggcttttttgttatgatccatgatatgatgaaaaattatggataa

SEQ ID NO: 42062 - DNA, 219 bp, Glycine max
  Peptide Sequence Number=SeqID_158840
atgagagaatggcagtggtcgaatgtcgatgatggttatgtagttggtggtggtgttagtgtcgatgataatgatagtgatgatgatgtaatgtcgatagtgatgatgatggcgacagtcgtgttagtagctatgacaatggataagatgacggtggtgatattagtgcttacattgggaaaggattattgccaatatggggagatgacacttttttaa

SEQ ID NO: 42063 - DNA, 778 bp, Glycine max
  Peptide Sequence Number=SeqID_158841
atgcctcgtatgaatgaagttgatgacgtcgatgatggacatgcaaatcgtatagatcatgatgaaggtttatggatcatggccacacctccaaggtctcctccacagtccgatggccagtcagaggtcacttccaagaaaagtagacaaacgacacgacttagaagcttgacacacagatttgtggatcagcctagaccgatggttaatgtcgatcccgctactaggagaggatccagacctcaaaaggaaaagttccacggctatctaggggtagttgctcaagaaaaggctaaatttgatatcccagaagccccaaaggtgaagagaaagggcaacaaatgcaggatgtcgttacaaaatatggcatcaatcctgaagcctggcaagaatttgcagcaactcgatagacacctaactaggagctttatatcccgtggtcgtgacgacatactgaacactgccattgggcgacctgaccatgggggtcgtgttcgtgcagtggggtcaggtgttactattactcagtattatggaaggacatcatgtacattcaataactcgtccacatccatcagtcatcaacaattacatgaagttcttgcaagacttagggaagacatgagtagtcagattagggaagaattgaggagatccctgggctcacccccaattgagtcggacatacaacaattaggtgctcgtgtcagcacaaagggaagtaatgttgaaaccaatgtgcacccttcaggggaagatgatgttgatgccataccaa

SEQ ID NO: 42064 - DNA, 330 bp, Glycine max
  Peptide Sequence Number=SeqID_158842
atgaagagcaagttcctttttgttttcctattcttgggaattcttaactgtgaagcacaacatttcaatgctatcccatacgactatttacaactagccttaaggtggcctaattcctattgcttgacacatgaaggtggttgcagggaaatagtaccacaatatgtcactattagctaccttcatcccatgagaagaggaggcgcggatctgcaaaattgcccctcaccatttaatatgccaaatagcactgttagtatatctcctgcattcccatacatttattttgttttgtttgcaagtttccttcacggaaattttccttattag

SEQ ID NO: 42065 - DNA, 264 bp, Glycine max
  Peptide Sequence Number=SeqID_158843
atgcttgtccaggatccttcaaagggaaatgatgtggatgaaattttcaatcaagctaggcaacttggggctctgttgaaaggcctcttgatcagcttcaggagcctccaaggtcaactaactttactggaactggcagcaaaggattcaagacccaacattacccacagaacctggagaaacatacaacacaacagggacattgtgaatagcacttgtacacttgtagaagtggcaccgttaaataactttatagttccttaa

SEQ ID NO: 42066 - DNA, 330 bp, Glycine max
  Peptide Sequence Number=SeqID_158844
atggaagatgtgctagtgaaggtggataaattcatattcttggttgactttgtaatcatggatatggaagaacatgttgaagttccttttattcttggaagactattcatgatgacaactctagcattgattgatgtaaacaatggcaagctcaaaatacgagtgcaagataaggagctcaactttaatataaaggttcagagatgggagaagtatttgggagagcaatctcggagtattgaaactccaaaaaggataaacttggacaaacaaaaattcaagaagaatgaagattcatgtttggcccaaccaaaatccattgttgagtga

SEQ ID NO: 42067 - DNA, 608 bp, Glycine max
  Peptide Sequence Number=SeqID_158845
gtgtcgtaactggagcagttacaactcctcttgatgtagtaataaagaccagattgatggttcagggatcacaaaaccattacaaaggcatttctgattgtgtgagaacaatagttaaagaagaaggaagtcatgctctttttaaaggtattgggtctgagacttccgtttatccagaactggctaacttttttacatttgcattgtcaatgctttattattttggctttatgtgcaagatttacaaacataactacttcatactaggatcctgttgtagagaaagcgcatgttactacattggtgcctacctcaccaacaatgtagaaaattcaagttacaacatcagtgccttagccaccactgatgtagaaaatccaggttactacatcggtgcctacctagccaatgatgtaaaaaatccaagttacaacatcggtgcctcagctaccaccgttgtagaaaatccaggttactacatcggtgcctatctagccaaagatgtagaaaatctaggttacaacatcggtgcctcagctaccaccgttgtagaaactaaggtttctacgtcgaacaaatgggtagcaccgtattcaaaaacaatgtaa

SEQ ID NO: 42068 - DNA, 762 bp, Glycine max
  Peptide Sequence Number=SeqID_158846
atgaataccaaattatacttggaagctttagagattgaagagggctctcctaggaatcaagggtctgaaaccctaagttcaagggccaacacttatgattcgaagattaaaaatgttccaaaactgacaagaagaaaaagcacgagaatcaaggaggacctcattccatccctaaattctctagttcttcatgcatctcttgacactgagtttggctacttcaaatcttcttggaaaaacttcaccctcgtggagattcaggctgcaactgatgactttagccatggaggctatgcagaggtttacatgggcaaattggaggatggaaactttgtttccattaaacggttgacaagagggtgccgagaagaaatgattgcagatttcttgtctgagcttggcattatagtgcacgtggaccaccccaacatagctagattgattggatatggtgttgaaggagaaatgtttcttgttcttcatttgtctccacatggacctagagagaaactgaattggagtatcagatataagattgctatggggattgctaagggccttcactatatctgcatgaggggtgaggttagtgaggaggttgctaagtacaaggctatctcatacccaacacttatcgctgcaccacacatgtttgtcaatgcctacaagaatgttcttgctgttgtggttgagatagattattctttccctgagacaaacaaggtcaaggagtatatcaagctattggctttgacattttga

SEQ ID NO: 42069 - DNA, 147 bp, Glycine max
  Peptide Sequence Number=SeqID_158847
atgtttgtattcaacagtactttgaaaggacttgacgatattccacaaagtaaattcaaggctgttgctaggtggattgctgttaaatatttcaatgatactagactattggaaccagagagattgaaggcgtttcgcatccagtag

SEQ ID NO: 42070 - DNA, 246 bp, Glycine max
  Peptide Sequence Number=SeqID_158848
atgttagggtggatgtttctaaggtgggctgtcgaacatcacacgtcaactttgagagttgcctttgttaagaggataagaggggggacctgcagaacaaaggactctaatgctcaagtttttgatgaagccaagtataagcaaacaagattgcttcaagaaacattcagggttaagcaaatagagattgcttcaagattaattcaaggtcaagcaaacaagatcaagaaaaagataaggccttag

SEQ ID NO: 42071 - DNA, 198 bp, Glycine max
  Peptide Sequence Number=SeqID_158849
atggaggagaagaaaaagaaacaactcgaggaaactgctaaatctggaagcactgacactatcattgaccctccatctcccatcagacgacacgtgaagtggaagatgacccgcaccaagaaaactgggcaaatgacttctgaggcagctaaagaaattgctgaccagattgattccttggaggagcaggcctcataa

SEQ ID NO: 42072 - DNA, 1700 bp, Glycine max
  Peptide Sequence Number=SeqID_158850
taacccctgatggaccgagaggtcatttccattggaggcacctctcgcctccatgggaaggtgcgaccttccgctgcttccccgaccagggatcaaggaaaaatggtggggacgttagggcatccccccatgtgcgttgcaatcttagtgttgggtcgccatcgtctctacttgttgttgctggctatgagtgggtgcaggatgatgttccgaagtataagtcctccctcacctctatggcgagtgttgttgatttgcaacgccaggtgaaactggcgaatcttgaggactcctgcaaaatggtcgtacaagcttgcaggagtgatgacttccctttcttgaggcacttgaatgtggccccttcccaacttcactcgaatagttgggccatggtgaaggcctttgaaattttgtgcctcttcttcaacatccagcctggtgtgccggtcttcctatttttcttccaaatgaagctgattggcaagattggttgggtctccttgaacaatgtatccaagaagttgtttgagttcgactcaaacatctttcaccacttcaaggatcagtttttcaaggtcctggctactgatgatctattgacccttgtggagagggtcaataaagctattctggaacagttgtcggcctcactggacatgcgggccattctatctcttccttcagtgaataatcctctcgctgccttggacagtaaaatgcctaaccttgtcggacctaaagatggaaccgtgccaccgttcattgtcactcctgctactgtagaaaagggtcaacctgctggtgaggttggtcttgttgttgttgttgttgaggttactcctactgctggagttgatatcccagctacttcagccaatgctgttacggcgtctacatccaccattgccacacccttgctgagtgccagtgtaacgaccactaatgctcctatgatttcgtctcctccttctccggcgtctactgtgttggtggtggtgtcaccttcctcgtcttctagtccccatgtttctttggaccacctgtacacttccagtgatgcagattcactgtggggtgccaattacaaactgaagcagaagacctcggttgactttgtgtcagcctttgatagaaacctcattcgatcaagaggggagaatggacaacgacaccaagaggctttgggcaaggtgtcatccttggagacagaggttgccaaatggagggctactgcttgcacgatttggagacaggagcgccctaaggtagctattgccaccatcaccttcgttgaggctgtaaggtcgaaccaccaattgtcttccaaggaagagaaaaagaacttggccggcaaggtggaaggcatcgcggtgaagagggatgagcttgccaaggcgagcaaggagagggaggccaacaaggagcttgaagaggagcttacaatgtacaagaaggaggccatggagcagcatgaaaaagggtttcaaaaggccatcaggaaggtcgagttcttcaccaaggatcttgacttgggtctttttgatcctttcaaggacgcaaaggaaggtgttcttcttaaagaagaagaaattgttgtgaaggaggaggctactgatgacaagcaaggtgaaatctttgatggcacaggaagcaagaccttattgatgtggaggcaagactttggtggtcttgtgaaataa

SEQ ID NO: 42073 - DNA, 555 bp, Glycine max
  Peptide Sequence Number=SeqID_158851
atgagcgtggacgaagggcctctaatccgagccttgactatctaccaagcgagcttggatgaagaatttgatatagatcagcatgatgacacctctgacaaaggcccaaagcccatcgaagagctagtcaagctacaactcggagccaaacccgggcagtgtacgcaactcagtagggacctcaccagtcatgaatacaagcatgtggacctattcacttggcaaccatctgaaatgccaggaatccatcccaacattatctaccatgagctttccatttgtccccaggccaaacctgtatcacaaaagaaaaggaagataagagaagaacgacacaaagctatcagagaagaagcagacaaacttctcaatgctaacttcattagagaagtcaaatattccacctggctcatcaatgtcatcatggtcaaaaaggccaacgtaaaatggcatgcaaatgatgaagagatacaccagaggcaaagacaaagcatgagaaacacaggaaataaagaagaaagtggaaagtggagcccgagcgctccaaagttgtga

SEQ ID NO: 42074 - DNA, 554 bp, Glycine max
  Peptide Sequence Number=SeqID_158852
ctgtgaactatcaaggtgtttgtcagtttccactcttggtgaacatgtgtcggatttgggatgaggactttcgagatagggtggcctattataggagtatgggcccaatgaagaataaaaagaatggacctcaaaatcaaggaaaaccatacccgacccctcctaagcaacatggtaatcgccctaacaatcagaggactgctgctacaaggtttactggtggtagtggccacaagaagatgcatactatattggaaaacttcaagggtatcaaccccattaaccaggatgaccccatggttgtctccataatcatcgcaaacttcatggtgtccaaggtcctcatcaacgatggcagctccattgacatcctatattggaaaactttccagaagctcaaagtctcacttgacattgtccaccctcacgccagtccactctttggctttgcaaatacatcttattctactttgatcgacagaaatatagttaacgagcttggagccatagtctctgagctgcatctgaaaaggaaattccccaccctgatctag

SEQ ID NO: 42075 - DNA, 352 bp, Glycine max
  Peptide Sequence Number=SeqID_158853
agtatcgtctcgggtagctcaaggcaaaaatagcaaagacgagttaaatgaggttcagaatccacacaacattaaatacaatggaacaattcaaggggatggtactaattgtgctcgaattgtcccaaactctgctgtgaagttcttcagttacgagcaagcttccaagttcagaatccacacaacattaaatacaatggaacaattcaagagacttccaaattgtgccattacacatcttaatgcttgcagccaacacatgacgatccttagaaaatttggacctccactacagtggaatgttgtggtccttgacattggaattggccacagatatgttgtacaaccatga

SEQ ID NO: 42076 - DNA, 420 bp, Glycine max
  Peptide Sequence Number=SeqID_158854
atggcaatggtggcggaatcaccggaatctgacagtgacaacaactcctcaaaaaccaacaatcctcaaaccctcaatgaaacggcgccgtttcttgactacgctcttgcgcaggcccagctttaccacaaggccttcaacgacgccgtcgattcgacaatcgatactgcaaaatcccgtttctcccaaatccgctcaacttcttccgcccactttcaccagaccttggattctttggatgatctcaaatctcagtacactgcttatgagggtcttttgtttggaaagatcaaagagggtgtagttgttgcagcttcgcatccggtgattacatgtggggctactgcttccctggggcttctgtcttggttagagcttttgcagatcattggttttagagtgagattctatgccttttaa

SEQ ID NO: 42077 - DNA, 339 bp, Glycine max
  Peptide Sequence Number=SeqID_158855
atgaaaactggtgttaagatccttcacgcaagtggtatttcgggttcaatcgcttacaattggtctcgacccaacatgaaaactggtgttaagatcattcacgcaagttcctgttactcgcaaaggattagggtgtctgtggctcaatggtacctatctttttacaagtgtaggtatgatgtttacctactacggtaccggagtgaacattctatcttgagtagtcatgatcctcctattattttggctaaagtagatgccaatgaggagaagaccaaagaccttgcatcacaatatgatgttaagggattgcccacaattaacattctgagaaattag

SEQ ID NO: 42078 - DNA, 2937 bp, Glycine max
  Peptide Sequence Number=SeqID_158856
atggagagagagagagagagtagagagagaaacaacgggtgggagagagttaggacaagaagagagaggagagtgagcgccaggttacgaacgacagagggttcacgcctgaccatcagagggagcacaacaggacagcattatagctacatgcaagcaaattggacagaccataaggacgttacttctttctatttcaccagattccctgaagatgcaactgcagaagaattgtggtatcacttcaagcagaccggagacgttcaaaagaagctggacagtatgctgtttggaggaatgaagatgtttgttaatgtccccaaatatgggagagcaaagaatgaagagatacaaacagcagaagggggaagagtagagggggtcactcgaaatacccaaaggacagaacagagaaaagcaccagccaaaatcggttacactcgttacaattcgacatccgaagttaaccttgacatacagttgatggaccagcaatggcttaaggaggcatgggtgggcagactgaaaaatctagcaggctttgatagcatagaagacgagaacgagatatggtgggatagcgggcacaacatatcattaaagtacattggcgatgatatggttttgatcaagagaaatggaatccaaaattacgttgggaggcatacccatcagtcaactcagctggtggcattctttgcgtttggaatgagatcctttaaggtggagagcagattagttggagctggtttcataatgttgtcagggaagacacctgcagaaagaatgggatcttctcagagggggcaggtagatggaagtattacggaattcaataattggattgaggagctggaggtagaaaaagcgccttgggtgggaaagagatttacatggttcagaccgaatggtgcaactaaaagcaagctggatagattcttggtttccccagaatggcttgctaaatggcctggaattttagactgctggctatccgataaatctttcaagaaaatgatagctgacagttggtcgtctactcctcaaagtgggtggggaggttttgtgttaaaagagaaaatcaaagcactcaaacagaagataaaggtgtggaacaaagaacaatacggggacacttttagcaagttcaagaagataaaggaagagctaaataaattagaagaggtaacagctgacaagcagttggaagatagcgagcgagcactcgaaaagcagctccagcaggagttatgggaggcagctcagacacataagtcattattgagacagaaggctaaatccaggtggattaaggaaggagattgcaattcgagatatttccatctgctgataaattccaagcaaagatccaattgtttgaatggagtagcagttgatggtgtgtggaaggatgagccggcagtagtaaaagaggaagttaggaggttcttttcacaaagattccaggaaaaggattttgacggaccaacgttagacggaatcagtttcaagaccattaattctcagcaaaatgacatgctagtggagagatttcaggaggaggagatcaaaagggtgttctatgtcaatggagtcttcccgaggggcttgaatgcatctttcatagccttaatcccgaaagtaatggaccctcaagtgctgaatgactacaggcctatctcactgataggatgtacctacaagattcttgctaaggtgttgactaacagaatgaagaaggtagttgaagacgctaaaagatgccaaaaaccgtgcatcgtttttaaggtggactacgagaaggccccttcatctgagttcttaccgcagaaagggctcggacagggagacccattatcacctcttttattcaatattgctgctgaaggattgagtgggataatgtcaaaggctattgacagagggttctacaggggatacttagttggcacaaataaggttgaaattagcctgctccaatatgtagatgacacaatatttttgggagagacaaccatggagaacgtaagaaccatcaaagcaatattgcgtgcttttgagcttgcatcagggctcaagattaatattgctaaaagtagttgtggggccttcggcgtggttcttaggcaggtggttgacaagttagtcaaactacagaggaattttttatggggagtcgtgtatgatcaaacaagattgcctggattcaatgggagacgatatggtgagacttgggcaagagttctagaatcaaagtatggaggttggaggagtctacttggagagcagagggctagtactgaatccttatggtggagggatctgaagctagtatatcaacatcctcatcaaggacagcagatgaatagagcaactttgtggaaggtcgggcgcggggacaagtttaaattttgggaggataaatggacaggtggagatagccaattaccagagaagtatcgaagattgtacaccatatcggatcagcaacaccaatccatccagcaattaggagctttcaatgaagaagggtgggagtggcctttccagtggaggagactgttgtttgacagcgagatagagatggcagtcgcattcctacaagaagttgaagggttcagaatcagcccggattcacaagatcagtgggtgtgggcggcagaaccaaatggaagttattcggctaggagtgcatatagagtaattagagaaggaatatcaggagagggtcagggggaagggtacaaggaattatggaagctaagggcaccatcgaaagtggctatgtttgcttggagagagtgcaagccacttattcttccactgcagcaaaattatccacttatggtgggaatcggcgtcttgggtgaatttggtgggggttttcccacatcatccgagacagcacttcctccaacattttcatggagttcatga

SEQ ID NO: 42079 - DNA, 438 bp, Glycine max
  Peptide Sequence Number=SeqID_158857
atgaaggttgatttgagacagaagcaaagccaggaggaatataggaagcagaaggtgagtgagaggaaggcaattgtgaaagtgaaggcacaaccaaaggttttaagaaaatggaagtcaagatctttgttgaaaagagtgacaaagggaatagcaaagtttagagatgcagtaggcagtctattaatcaggaaatatccaagtatatctagaaaaagcatcaatgaaggatacatagtatttgaagccagaatagcctgtgagattttcccatgcaacaagaaacacaaaagtctgaaaactaacttcagtacaagcctagcattccatagactaacagtgctaggaggtgaatttatagaactagaagctacaacagaacttttattaacagtaggagatgtgattgaagcaaaagtcgaagttgacaacagctga

SEQ ID NO: 42080 - DNA, 150 bp, Glycine max
  Peptide Sequence Number=SeqID_158858
atggcggcgccatggcggtcgttgcggaattgcggtgttgggctgacccgacccaaccctacccgaatttcttctgcaaaaggagactcggagcgtgagcacgaacagaacagcagtctccaatgcgaccagcaacagtctccagcgtga

SEQ ID NO: 42081 - DNA, 357 bp, Glycine max
  Peptide Sequence Number=SeqID_158859
atgtctgccattttccgttacgccatctgccatatttttatggttgatttttggctttccgccatgaaccgccatccgtcattaacaacattggttaaaaggatcttgagatatctcaagggtaccttgtctcgtggtttacttcttcagcttgcttccatgatgaaacctttggctctttatgctttttgtgatgctgattgggcattagatgtagatgataggtgttctacttcaggggctgccatctttcttggctccaacttgatatcctggtggtctcacaagcagaaagtcacagctaggtccagtattgaagctgaatatcgtagcttggctcaaacctctattgaataa

SEQ ID NO: 42082 - DNA, 336 bp, Glycine max
  Peptide Sequence Number=SeqID_158860
atgacgtttccacatgctatcaaacacgatcgtccctgcctagcagagaaaaatcttaaagtaaaacctgcaaaaattttcaaaaataatcataatcggatgaccaacatcaccccaatgaaggacaaaatggaaatcaaaggtgaccgaaggacaaaatgtcaaggtgatccccacaccggacgaggatgttccgacaaaggattttgccgagggaagagagggctgcggcaagaaagaggtatcactcgaggaggccggcaagaaagaggtatcactcgaggatcttcaagaaagaggtatcactcgaccaatttaaatgttaatatgttttaa

SEQ ID NO: 42083 - DNA, 540 bp, Glycine max
  Peptide Sequence Number=SeqID_158861
atgaagctctcaactcttctttcttggtttcttcgagattttgatacggtagtttgggatagggaacccaactatggggatatagaagctaaggcaaaacaacagcaggagaagcttgaatttgacgaacagttcaacaatcttcatgcgcatcttgaacctcctctgtttgatattacttcacaacctccacaagttatggaagataccttgccaccattggcacttccaaacactctggagtctttgctcaaatccttcaacgattctattctctacaacgtgaaactgatgatgcaacaaaggctgcctcctaacttggttccactccatcaatcaattgtccaacaccagtatgcacccatacctcaaccacctctaccaccaccaaccactgttgtgaaacctcaccctggggttcccgtaccaatggttcctacatcagaggctgccatacctaatgatcctatgcctgagcctccacctacgccaccaaaatcaccacctcctatccctcaacctctgtccactgaaggttga

SEQ ID NO: 42084 - DNA, 453 bp, Glycine max
  Peptide Sequence Number=SeqID_158862
atgataagcacaggttgcgttggggttgtaccattgcgggaaaggagattgaatcggggcgaattccgcaagtttcttcaccagaaaattcctccctggattggcacttgtgctaggattggagttgtcaacagggcgaggtattgggggagccgagttttgagcgggggccctttgtggttgagcgggtgccctttgctagacaggcgccagaatggaagggtttccgacgcgggccgaaaagctcagcttatgttgggcatattgataagtgttgtgagcggtttgttggggtttcgtccaagtaggagccaaagtaatagcgtgggcatcttcttctttcttctttgcctcacttgccccgaatctcctattgcccatattggcaggagcaacacaatcgaacttccccctcttcaagcctacttcgatcctctcgttcgcaaatactaa

SEQ ID NO: 42085 - DNA, 570 bp, Glycine max
  Peptide Sequence Number=SeqID_158863
atggcgccctttacatgtgcatgcgacaaatacaataaggaagttgtgcttaggtataggcttgaggtgatgatcaaccagggaaatgaaagcacaaaattcctgctttgggaccgtgaatgcagtgaattaattggccaatcagctgatgcagttaataagcttaaaattgaagatggtgatgttgatttgaatgtttcaccccaagcacttgataagctgctgggtcatgaacttgctttcaagataaaggtgcaacccaagttcaggaattttgttgttttgaagtgttcagctgactcgagcttgataaatgctgtaatggatatgctagctaatgctgaggtaatgttcaatgcaaattatttgacattaactattgtgaaaaacatcttcaaaaatggatatcccggtttctggttccaatcttctgctcaacatgaatctcaatccctctctgtgacagcagatcatgatcccctacttagactccccttgacgcctacaaagcggcaggcatttcaggattgtgatgatgaaccagggacctctcaaatttcacctgcataa

SEQ ID NO: 42086 - DNA, 501 bp, Glycine max
  Peptide Sequence Number=SeqID_158864
atggaggccatgatgagcatgaagaagataatggaagccaatgcggttatagttgccgctactagcgttgtcgctaaggtgaacccgatgctcccatctagcctcaagcaaatgaatcatccaacctcaaatatggtacgcaaagatttgggaagtacggatgaccccatgatgtgcaaattcaaaacaagcacgccttcctgccatatggcttgcctcccaaactatacaccacccaatgtggcgcacattcccaatgaggatgtcaataactccactcccatactcattaagagccaacaacctcaatctgatcctgcacatgtctctcgacccatggaggagacacatgaaattccccaccacgatctagccgacttcgagccttgcctcggatatgccgctgaagggcaagcagttggtggtataccccttgaaaacacttcggaaggccctcagtatcacccccaaccacaaccctcatgttccacagcggtttaa

SEQ ID NO: 42087 - DNA, 294 bp, Glycine max
  Peptide Sequence Number=SeqID_158865
atggctaagtttgacccagatatagtcctagaattttatgctaatgtttggcccacagaaaagggagtgcgggacatgcgatcatgggtgaggggtcagtggattcccttcgatgcagatgccctcagccaattcctgggtgacccgctggtgttagaagaaggccaggagtgcgagtttagtcagagaaggaatagggccgacggggaggcgggtgcggatcatgtgcaccaatatgaccaccttgacaccgatgtggatgacgttgctactcagcaatgtcctgcccagtga

SEQ ID NO: 42088 - DNA, 267 bp, Glycine max
  Peptide Sequence Number=SeqID_158866
gaatcactaaacagcgtgtatcgccaaggcagagtatcagagtctattggacccttggaaattaagatagttgagaatggcacatttgacaagctcatggactttgctcttagccagggtgcgtccattaaccaatacaagactcctcgatgtgtgacatatgcgcccattctggaccttctaaactccaacgttgtgtccagttactttagcccaaaatgccctaattgggttcctggtcacaaggactggtgctctcttcattga

SEQ ID NO: 42089 - DNA, 177 bp, Glycine max
  Peptide Sequence Number=SeqID_158867
atgacagtcagactcagggataacagtaactgcgacattctaataactgtttgggaggactatgccattcagctacatgatgttattgacaaaaaccttctgcttcaggaaccattgattgttatgttgaccctaggtaaaatcaaggatgctacaggtgtgtctggtgttggttag

SEQ ID NO: 42090 - DNA, 237 bp, Glycine max
  Peptide Sequence Number=SeqID_158868
atgtatgttgttgtggtaaaacaggggcaggatcaccttgggctaccttctggagtgaagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 42091 - DNA, 132 bp, Glycine max
  Peptide Sequence Number=SeqID_158869
atgagaaatggccaccctccattgtctcagggcactggcacacccatgcaaaaaaatcctaaacatgggctttgttttgacgtgttagttgacggaaccggggaacgggactatttttttcgggttctttga

SEQ ID NO: 42092 - DNA, 417 bp, Glycine max
  Peptide Sequence Number=SeqID_158870
atggagtcggaagccccagaaatggattgcctagcgctgttggtctatcctctcctctcaaatcttatccggagccctaggaatggagtggattgccttgcgctgtttgtctatcctccaccctcaaatcttatccggagacccatgaaatgcttatcattcatgcatcctccaccatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggccattaaatgattatcattttccgatcgcccttcccaacagttgcgcagcatga

SEQ ID NO: 42093 - DNA, 348 bp, Glycine max
  Peptide Sequence Number=SeqID_158871
atgagtctagaagaagctcaccaccataggaggccatggataagagcttggaggaagaagaagatgaatgaagggagagggagagaagagcatgaaattttgtgctctaaaagagctctgaaatctaaaataagcggactcatacttagcccatgggccccgaaatctatcctaaggctcatgagaatcctaaggtcttctcttgcatctctggccccaatcttcttggagccttctatccaatgcccttgcagagtaggattgcatcattccctcccccttgaaaaggatttaaccttaaatcctgaggttcttgaaactctgggcttttttcctcaacacctgtaa

SEQ ID NO: 42094 - DNA, 351 bp, Glycine max
  Peptide Sequence Number=SeqID_158872
atggggtcggaccaagcgccctcctttgaaaagaggttctatcatgtcaaagtcaagaaactagaactagccagcatgcgagaactaggacagcgaatggatcaagttcgacgtcaagctttcagcaagatccatcgcatccctcgctcaatactacgaccagtcgctcagatgcttcactttcagggatttttagttggcatcgaccatagaagagttcgaaggaatctttggatgcccgctaggagaaaggaagccataccttttttccgggttctatccttctatggcaagaatagcaaaagtggtcacaatctcagaacaagagctagatcgattgaagcaaaatag

SEQ ID NO: 42095 - DNA, 517 bp, Glycine max
  Peptide Sequence Number=SeqID_158873
ggctgttcatgtgtcctccattttcgagtctggagctgtgttccatgattgcctaagagaggaccctcaaggcaatcctccattctcgtccttttccggagccacacgaatgttattgcttagggttgttcatgtgtcctccacttttgaggctgctcatgtgtcctccactttcgagtttggagctgagtttcatgattgcctaagtgcggaccctcaaggcaatcctccatactccacctttgttcggagcaccatgaatatcgaagaaaaagaaggagtagagacgagagtcgtcatcacggaaaggcaaggcggacgaaatcagtgtcctatctttgctttcctcttatctccgatgagaggcccacttgggccctccagaagattcctccagaaggctgttgcttctggaggaagcaaccctgctcgcctgggcgagctgggcggcaagcttctcccctattttgctataaataggggaagaagtgaagaagaaaagggttcagccccttag

SEQ ID NO: 42096 - DNA, 386 bp, Glycine max
  Peptide Sequence Number=SeqID_158874
gggctcctacggaccctaagagaataaaggtcattcctgattggcccactccaccaacaccactcattgagttggtgaggaaccatgctctctcatgggaagatgtcaatgaaaagggtgttgagggaaggagcccagagtatgaagaacctcgggatttgagggtattggatagaagactccaagaggattgggctagagctgctaaagaaggccctgaggttctcatgaatctaagggcagattttttgagcccatgggccaaggaggtgagcttagttattagaggggtgtgtgtagctaagctcttgcttttcaaggaagttttctcaaagaagcttctcaaggaagttttctcaaaaaagcttctcaaggaagctacctag

SEQ ID NO: 42097 - DNA, 728 bp, Glycine max
  Peptide Sequence Number=SeqID_158875
acccatgaattcattgcctagcgctgttcatgtgtcctccaccatcgagtctggagccccgcgaattcattgcctagcgctgttcgccaattctccattctccacttttattcggagacccatgaattcattgtctagcgctgttcatgtgtcctccaccatcgagtctggagccccgcgaattcattgcctagcgctgttcgccaattctccattctccacttttattcggagacccatgaattcattgcctagcgtttttcatgtgtcctccaccatcgagtctggagccccgcgaattcattgcctagcgctacccatgaattcattgcctagcgctgttcatgtgtcctccacaatcgagtctggagccccgcgaattcattgcctagcgctgttcgccaattctccattctccacttttattcggagacccatgaattcattgcctagcgctgttcatgtgtcctccaccatcgagtctggagccccgcgaattcattgcctagcgctgttcgccaattctccattctccacttttattcggagacccatgaattcattgcctagcgtttttcatgtgtcctccaccatcgagtctggagccccgcgaattcattgcctagcgctgttcgccaattctccattctccacttttattcaaagactcatgaattcattgcctagcgctgttcatgtgtcctccgttatcaagcgcggaacctccg

SEQ ID NO: 42098 - DNA, 283 bp, Glycine max
  Peptide Sequence Number=SeqID_158876
atgtccataaataaggtggcgaccttgtatgcaaaatggcgtgggggtaaagcaccaaaatgggcccctttagagaaacggtcgaccaccaccaaaattgaagtaaagccatgggactggggaagtcccatgatgaagtccattgaaatgtccacccaaattccatttggtatagatagaggaggtcccgtcaaatggaatattccgggtgggcatttggatgaagcccaaccttgttccataagtccagaaaaacaggggactgctaaagtgacctttgtag

SEQ ID NO: 42099 - DNA, 338 bp, Glycine max
  Peptide Sequence Number=SeqID_158877
aggaaacactgggtccaacaaagataggagaaaatcactcaaagtgtatcaatctcacacagtgcgtggcgagaaagtcactagcacacaggattttgtcggcaatcaaagggagaggaccactttaggtcgtggtttcctttttcttgtttacttggtgacaattctgtactgttcagatattgtctggtccaaagacctttctggatgtttcttctgttttcttccactctttgatttagggcaaggattgacattctcaccctgggtcaaggtttatgataagttgggattttggctcaaggcttgtagaacggctggtcatgatatatgtcagg

SEQ ID NO: 42100 - DNA, 413 bp, Glycine max
  Peptide Sequence Number=SeqID_158878
ttcgtagaccacgtctttttccgggttttccgacgttttcctcaaataaacgttggtggcgactctgcgcgtattcctttcttggaagatgcacccgcgagtcacgcgtcgtcctctcgtcgaagggtgagggcgtgtagccctctcaaggggtggacgtatagtcctctgaagatgagggtgtgtaaccctctgaaggcgaggacatgtagtcctctgaaggtgagggcatgtagccctacaaaggcaagggcatgttgccctcagaaggtgagggcatgcagccctctgaagtacccaagggtggcgagggcgtgcatccctctgaaggtgaggacgtgcagtcctctgaaggagagggtgctagtacccaagggtccacctgatgcaatcctatcccacaagggcattgg

SEQ ID NO: 42101 - DNA, 483 bp, Glycine max
  Peptide Sequence Number=SeqID_158879
atggcggcgcagctaatccatgatcgagtggagatggagtgcctagagggagcttgggagacccttgaaggcaacacgaggtgtcaatttcggggcacgattcgatttacgactacttcattggtgcatccagatgaactcgtgcgcacgcttcagcgtactgtggagtggatactacccacgcctacaccataccgtctagtggagccagtccaagtgatcgaggtgacgtcatccgaggaagaccctgaggaggatcccgaggagctacctccagagcctgttgtggatgctcttgaatttctagagggtgatgaggacccactccctgaggtggatctcccgaggacgtcatgtcggcatccgaggcagactctacggaggatagtggccctggagagatggcgatcagtggaggctcttcatcatagtagacagctcattggactagttttatatacttttgagggtgggtgtatctag

SEQ ID NO: 42102 - DNA, 282 bp, Glycine max
  Peptide Sequence Number=SeqID_158880
atgccgcaacacaatgcatctcataaccactacatgaaagtaaaaggggtatctttaggcttttcatccctggtaatcgattacacagccttggtaatcgattaccagaggccaaactcgaatcacacagcttcaggacatgaaaacctgaaaaaggcactgtgtaatcgattacacagactggtaatcgattaccagaggcctccacaatcttccaattccctttttaagcctggtaatcgattacaccccttggtaatcgattaccagaagctctcctag

SEQ ID NO: 42103 - DNA, 360 bp, Glycine max
  Peptide Sequence Number=SeqID_158881
atgaggattcccttttttacaggccaaggttcaaaaaggtctaaggttgtgtttcgatggggtctttcatcgtgggaacccaatcttgatatctggggcaaaacaaatttgggtgacgaggtgtcggtctcgggccgaacttccacattattccataaggcacgcgtgacaaggatgatttggaaacaacatgcaaaattagtcatggctacagtcaggtgggcactcaagcatcctgtttatggcattgtgatactacggtcgagaatttatacagacagacccaacgtttccaagttatgttctttcatcagttcaatgaattcatccatccttatctcggttcattccggaaaataa

SEQ ID NO: 42104 - DNA, 225 bp, Glycine max
  Peptide Sequence Number=SeqID_158882
gatggaaggactttatgtacatcaacaccaaaatatggaacaggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 42105 - DNA, 722 bp, Glycine max
  Peptide Sequence Number=SeqID_158883
ttatccagaactacgtaggtctgagttcctcattggaggatacgtaggagcaaaagcctcgcttttgtcgaccgcgccgctttttgttaccatgacccaagagctggtagcccgcggagacaccttacggttatccgcacctcgtcattcagtgaccccaagtgtgattgatgagcagaggccaatgtggtcatctgcgccttttccggagatgtcagcattttccgatggagacttttcaagtctcacaagttatccagaactacgtaggtcatgtgacgtgcaccctttgtatcatccagaggcggcgggcccgatgacaagcagagaccaagtttggtcattctgcacccttgtatcatccagaggcgacgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgtggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcctgatgacaagcagagaccaa

SEQ ID NO: 42106 - DNA, 252 bp, Glycine max
  Peptide Sequence Number=SeqID_158884
atggtgaatgtgacaacagcagcgatcatgttggttgtgatgatggtcttggaggcaatcatggtggtggtggcagtggttggcgatcatgatagtggttgcagtggcggccatgacaattgtgacagaaacgatcatgatagtggtattagtcatggtgatgatagatttgagatatttaaggatgttataaattatatctttaatatatttgattttctgttgagagttgtcattttcattctgacataa

SEQ ID NO: 42107 - DNA, 231 bp, Glycine max
  Peptide Sequence Number=SeqID_158885
atgacaagtaaacttcaaatgctcataacttttgctacgattgtctgtttgagacccactatatatcacaacgctcagaattcagaggagaatccagataaggggatttggatagaacctgtatcaagagctgaagctctgataccagatgatgtgaacctgactaggagcggatcacttgatacaagctacggagatttggatgacgccacttccagtgaaggaagataa

SEQ ID NO: 42108 - DNA, 222 bp, Glycine max
  Peptide Sequence Number=SeqID_158886
atggttcgtgattcagttccgcatactggcaccgttgggatttgcgagataatatttacagagagagaaaaagaattgcaccaagacagtacaagtggaggctttaatcccttctctgtctctctgacatttgggaattctatcagagcagttagaggaaaaaattggaggaatctcagggaaccgctagagatgctgctatcgctgtctgaagacacgtga

SEQ ID NO: 42109 - DNA, 324 bp, Glycine max
  Peptide Sequence Number=SeqID_158887
atggggggcattttcagcatttggctttggtttagtaggctatggttctggttgggaaacaacataggaaattggggtccgggaaactgtatcattgttatgtttgtaggatggttcagtaatgtctcacggaaggtggttggttggtgtggcaaagaagacagcgccatcaattgcaaggcaatcaagttgctgtctgaagaattgaaatatgttatttttagaattattactaattgttggttgctgcttggtgtgtctcctcctcttaatctgtacaatgatagcttctccaatagtgctttaatagagacaagactatag

SEQ ID NO: 42110 - DNA, 213 bp, Glycine max
  Peptide Sequence Number=SeqID_158888
atgttaaaccctcctggtatctgtgaatcacttaaaattagtgagaaaaattgtttccgtgaagaaaatccaagcagaggcgcttccgtaacgcttccgagatgtttccgtgggcgatttcgcgaaggttttccaccattcttcatcgttcttcggtcttcaaccggtaagttcccgaaatcaaacttttcaattcattctctgtacccttag

SEQ ID NO: 42111 - DNA, 267 bp, Glycine max
  Peptide Sequence Number=SeqID_158889
atggaagtggaatggagaaggaagagagagaggagacgccacttcaaggagaagatgagtctagaagaagctcaccaccataggaggccatggataagagcttggaggaagaaggatatgaatgaagggagagggagggaagagcacgaaattttgtgctctaagagagctttgaaatctaaattatggttcagcccactaatccaagatcaattcgaagattctccactaagtgtgcttaggtggcatgaggcatgtaaagcatga

SEQ ID NO: 42112 - DNA, 240 bp, Glycine max
  Peptide Sequence Number=SeqID_158890
atggacttgaaagaaaattgtacttatgtcatgcacaattttaaagtgctaaaaaacaatggtcagtacagagtgtgtgatcatcaatttaaattggtgtttattggggttactattgtggctgaccagtttaaacctggactattggttgatgttattggtgttgtggaggaggttgtctttcgacaagtttcaggaaaaggtagaagggtagtcttcaaactagaggacttgaggtaa

SEQ ID NO: 42113 - DNA, 321 bp, Glycine max
  Peptide Sequence Number=SeqID_158891
atggagggtacatcccttgtggatctttgcttcacgtgccccccaaatggtcgaacttgcatgacctcaattgttaacaccagaaaacaaaagacattgtctttctggattaccatagacaacttgcttgctagcaggaaactaacaaaaaaggagagacagagagagggggagagaggagataaaggagagatgagagggcaagagctttacgcaactaagataaattgtaggattgacaaggctattcctgttacagaattgcaagtggctaattgctctggggtactgttgggaatttgtagttgcttttggggataa

SEQ ID NO: 42114 - DNA, 387 bp, Glycine max
  Peptide Sequence Number=SeqID_158892
atgtacgccattggcatatccaatttcaatgttgaggttattgatgaagcatcgatggcttttgttttggttgtggctcctattactgatgcaaactggcaatcccttgtccttgaatccgaatctgctgttttggttgaattctgggcgccatggtgtggtccctgccgaatgattcaccctataattgatgaacttgcaaagcaatatgctgggaagctcaagtgttacaaactcaacactgatgagagcccttcaaccgctactcggtatggaattcgaagcatcccaactgttatgatcttcaagagtggtgagaagaaagatacagttattggtgctgtgcccaagtcaacattgaccacgagcatagaaaaattcgtatga

SEQ ID NO: 42115 - DNA, 627 bp, Glycine max
  Peptide Sequence Number=SeqID_158893
atgtctaaagcagtaagcgagtgtgtgacccgtgccacgaaactgaacggccatggagaggagtgggtgtgtgacccgcactgtggagcaatcaagggaggagttaaagatggtggcgtagatgatggtggaggcggtggcttcggaggtggtggtggacgggatcttgcggtaacgacgggtgttggttcggagcggcagaggccacaactggatggactggaagtggcggttgatgtcggcatggtgcaaggcggaggagctggcggtgtcggtggtggttgcattgaagaaggaaacggtggcaacggcggtagcggtagtgatggtggtggtggttgcgctgaaggagggaacaatgacggcggcggcggcggtggtggtggttgtgctgaaggaggaaacagtggcggcagcggtagcagtagtgatggtggtggtggttacgctgaaggagggaacagtggcggcggcagcggtggtggctgcaccggagaaggtgacggggagcgttggcgggagatcagggtgaaatgcatggagatcagaatccactgcggtgaggttggccatggctgcctcgagccggtccaagctggcgtcgagagggtcggcatctgccattga

SEQ ID NO: 42116 - DNA, 777 bp, Glycine max
  Peptide Sequence Number=SeqID_158894
atgccaccgtaccactttctacgccagttcccaaacaaccgtcgtagagtccctgtcaatgcatcgaatcccctatacatccactcaaacgagagcccatccaccatccttgttttgccaccgctcttagacgataattatcattgttggtctcgggcgataaagatgagcatgttgacaaagaacaagctaggattcattgatgtcatgattgtagaaccacctaagaatcatgcagttttacctttatgggaacaagacgtgtggaaggagcttcgtgagcacttttcccatgttgatctgtttagaatctcagaaattcaagaggaaatcttcagccagaggcaaggtgataactctatctcgaaattttacactgcactaaaaaccctatgggatgaattagatgttttgaatcctcttcctgtttgtacatgcaatcctaagtgttcacgtggtgcaatcaagaaaattgaagaagagaaaaacaagaatcaagtggttagattcttgcgaggcctgaatgatcaatattcaggtgttagatcacaactaatgctcttagataatcttcccaatgtgaaccgagtttttgcactgattgctcaacaagaacggcagtttgccaatgagaatgcttccgtgccaaaggctcttcttgtggctggtgatgatacattagactccaagagaaatcaagggagtggtaatggttggaataacaaatacacttccaagaaatgttcctattcaagaattctaaaaacactgctctaa

SEQ ID NO: 42117 - DNA, 261 bp, Glycine max
  Peptide Sequence Number=SeqID_158895
atggactttttggatgcagtttcaatggcttcgatttgggaggaatcaagtgcggccgattactcagggaaagtgatgagggaggaggttctagaaagggccgttgtccgaggcggcagaggaagaggaaaagtcaccgtcggagatcatgtagtcgacgcggacgacgatgtattcgacctgcggaacgagggagtggaagcggtgcttgctcttttgagagtgagggagtggaagcgacgcttgctctttggagagtga

SEQ ID NO: 42118 - DNA, 1239 bp, Glycine max
  Peptide Sequence Number=SeqID_158896
atggagccttttgattacactcctccacaaagtgagttagaagctgaaacacgacaaaatcctctttctaacaatcacacagcagatgaagtggtcacaccacacaatcttatactagtacgacagtgttcaactacgagaattagaaagccttcttcatatctacaggattatcactgcaaccttgctgctgccactgctatgccacatcaatctttaggcaaaggtaatctctatcctctttctcaagtgctttcctatgatcgcttgacactttcatatcagtctttttttatgaatatcaccaccacacctaaacccattagatattttgaggtcatcaaacacgaatgttggagggtagccatggatcaagaactagaggtgttggcaaggaacaatacatgggtcctagttgataaaccacctgataaaaacataattagttgcaaaagaagaaatctatatggctttaccgcaaggtctatcgactttcaagcctatcaggaaatgacatttctgaaatcaataaagttcattttgggtttagaaattgcacggtcctccaaaggcatagtccttaaccaacgaaaatatgccttggaacttttatcagactctagtattctctgttgtaaggcagcaacaacacctatggatacctctatcaagcttggagctgttattggcaaaccactttctgatattagctcctatagaagattgataggaagactcctttatcttaccactacaaggctagatataacttttgcactgaatcaacttagtcaattcctatctgctcagattgtcatcaagcagctgctcacagagtacttcgctatatcaaaggctcacttgcatgtggccttttctacccagcatcaaacgctcacaagctcacagcctacaatgactctaacttggccagttgcattgattttagaaaatccattactggatattgtttatacattggtcttttatcttaccactacaaggctagatataacttgtgcactgaatcaacttagtcaattcctatctgctcagattgtcatcaagcagtttctcacagagtacttcgctatatcaaaggctcacttgcatgtggccttttctatccagcatcaaacgctcacaaactcacagcctacagtgactctgaattggccggttgcattgattctagaaaatccattattggatattgtttatacattggttcttctttaa

SEQ ID NO: 42119 - DNA, 372 bp, Glycine max
  Peptide Sequence Number=SeqID_158897
atggtcgcaggggagaatgttgctaagcagcaatgtcatccaaatcttcatgagagtggtcatgctggtgcacatgatccacacccatctccctgctacgctcagggcaaagtccagccccagaacgcacaacaactggttgatagcctcctcatcgaagccagaggcctaactccccctctggctaaactcacaatgttggccttcctccaagaccagtggatgccccagaaactgattgatggcatcctcattgaaggcaatccactggcccctcacccaggagcatttgtctctaactccctcctctgtaggccaagcgttggcataaaaatccatgactatctctgggtcgtacttagtcgtgggtga

SEQ ID NO: 42120 - DNA, 225 bp, Glycine max
  Peptide Sequence Number=SeqID_158898
gtgccggtgttgcccaattggattcagaaacgctcatcatcgtcatcaatactggtgcaggagttggatctaagatcagatatggataaatggttttgtttcagtggaggaaagaagaaaggtggaggaaagaaggaagaggatactgtgggaagattaaatagtgagatgaagaagtgggaagtgaaagaaattctggtgggagttgggaaagtaaacgaataa

SEQ ID NO: 42121 - DNA, 840 bp, Glycine max
  Peptide Sequence Number=SeqID_158899
atgacaagcctgtggtgcgtgacaatcggcatgacggacaacgccaccgactacgacagcgttgagttctggtcgaaccccgagcggaccggcggctggctcaccaagcagggcgagtacatcaagacttggcaccatcgttggtttgtcctcaagcaaggcaagctcttctggttcaaggactccaccgtcacgagtgcatctcgtccacgcgatgtggtccccgtcgtcacgtacctcaccgtcaaaggcgccaaagacatcctcaacaagcctaatgccttcgagctctccacgcgctccaacaccatgtacttcatcgccaactccaagaaggagaaggaggattggatcaactctatggcaggagcagaagggttcgttgagatttattttgttttccataaaagaagctcattttcatccttttctattagtgcccaggtggagtctaatgatggttcaactatagtagccacacatggtgaatctgtgacagaggctctgaaaactaaggagcgggaggtgggaatgttccaaaatgaggttgcagctagccaaggtataagaataaggagaagaccaccatctagaccccctttgcattatgtaggaccctttcaattcaagttgcagaatgagggaaatacgccccggaacattttggaagagattgtgtggaacaaagacacagaagtctcgcatgcagccaacgaacgaactggactaccagggttaattgctgaagtgaagaaagtgtcaccaagtagagaggtgggaggattctctgtcatgaagatgcatcagttgttgggaggttttgatgggatgagtgtttaa

SEQ ID NO: 42122 - DNA, 4110 bp, Glycine max
  Peptide Sequence Number=SeqID_158900
atggcaaggctcagcaattatcttattttggtggctttctttgttgctaccacaatagctacaatctcagccaccgagaatgaaacattgtctcaatgtggaaaatatatgggagcacactgtggaaagcaagtggctgacaaattgaggggtagtcatattgatactgcaatttccagtgattgttgttataagcttttgcagacgggttatccttgtcacaccaagtacaccttgtatgttcttctaaacaggccagagcttaaacattcaaattggactgaactttttgcaaaaagtgatcaaatataccacgagtgtgatgagcttacctcaccaggaagcatcgaatttgtggctaagtgcacagaaaatttaggcaatgaatgtggagaacaagtatacaacaagctgatccatgacgggagaatcactaagccctgctgtcaagagcttgtgaaaaatggtctacaatgccatactgctatggtgaagtctttgattcgcatccccgagatgaggaatgccaatgcaactgaacttatgaagaagaacagcttgatattcaatcactgtcttcacggatcgattgagggtcttctttgggctgagaaaatgaagcaaaggggaaagttggctattgagagaatgggtgatgccggaaacacaggaagcactagcatcaatggtgcagagaggagaagggaccaagagaagagtggttgctgccctcaaagccagcacaggcccaatccttctcccactccatcttctcagccaccaccgtcacctgcatccattcataagatgaaattagatgttccccgcttcgatggtatggacccatctggttggatctttaagatcaaccagttctttgaatatcatgataccccagcctatgagaggttaactatagcttcgttttatatggaaggcaaagccctggcctggttccaatggatgaccaaccccactgatgctctatttaaactcacacagaagggcacagtcagtgcttacctgtcagaatttgaggagcttgccaatcatgtcatcagcctccctactccctttctccttcaatgcttcatttccggcctctcgccggacattcggagggaggaagacaagattttggacactcgtccctcacatcgcccacgaccaccctttctctctacccaaccctcgttccgcaaccctccaccttcacccaaacctcccaccccttccatcgcccatccaccatcagttccccttcttgccctaccccctcgccctccgccacccgccatgaagcgcttaacgtcgaaagagattgcctcacggcgtgagcgtggcctctgcttcacgtgtgatgagaaataccatcgaggtcatcgctgtgtctctagggtatttatcttcctcgcagaaggagatgacccccctgatgctgatatagaaccccatgacccacaacccgagccacccgacccaatttcgccccacaccccatctgttttaaatgacccagtccaggcccaaataagtctcaactctttagcgggtcacgtgactcccgagacactgcgtttagtaggcgttatcaccgaccgacaagtggtcctcctcgtcgacgacgggagtacacataattttatccaagaggaactcgttactcagcttggcctcccttgtcagtctacccctcctctccgtgtcatggtgggaaatggccaaaacctggagtgcagttgtgtttgcattgagatcacggtggaaattcagtcggtccaattcctagtggacctgcatgttcttccgatatttggggccaacatcgtgctagggggggggacaatgatgctcatctccgattgctttcctcaccatagtttcgtcgcatatacagacgccaagaccctgcttctcaaatttgaggctttgtttcaaccacaacactcactgccaccagcgagaagcacagaccatcatattcatttacttccacaaacaacactggttaatgttcacccttactggtacccccattttcaaaaacagaaaatcgaactccaggatggtacttggaggttctgtgttgattacagagctttgaatgcagcgactgttaaggacaaattccccattccaacaattgacgagcttcttgacgaattgggggcctcaagtggaatatttgggacacgtcgtctcgcggtgaggggtggagcctgtggcctcgaaggtttctatcgaagatttatccgtggttatggaaccatcgctgctcctctggtcaaggcaacaacaattgatcccttccaatggtccccatcagctcagaccgccttcgaatgccttaaggaagcattgtccaccgcgccggtactagccttaccggactttagcaagcctttcaccctcgagacggacgcatcaggagtgggcatgggtgttgtcctgtcccaacaaggacttcccattgctttctttagcaagccatttacttccaagcttttgcgatcattgacgtatgtgcgagaactatgtgcgatcaccacggcggtgcgtaagtggcgccagtatttgattggccaccatttcacgatcctcactgaccaccgtagcctcaaggagttgctaggtcaagtgattcaaaccccagaacaacatatgtacatggctagattaatgagttatgattacgatattcaatatcgttccggtgccagcaatcaagcagctgatgctttatctcgattaccagatcaacaaccttcaatggcaatgttactttcagtcccttgcctatcctttctcaaggagctgtgtgctcaattggacgcgaatgaagaatatggtcaactccgccgaaatattctgctgacccctcacaattactcagatttttcagaattccatgccacgcctactggtggtcacgcaggggtcaccaagacaacagctcgcttgactgaaaacttctattggcctcggctaagagatgatgttgctcgatttgtggctaactgcagggattgccaagtcacgaaatatgaagctaagaaaaccgcggggctgctatgtcctttgcccatcccatattggtcatgggatgatttatcgttggactttattgtcgggctgtcagcgtataaagggcataccgtgatacttgtagtggtggaccgtttttcgaaagacatttacttagggatgttgcccacggcacacacggctaatatggtagcatctcttttcatgaacaatgtggtcaaacttcacggcttccctcgcagcctcagtgatggtcagactgagatgctaaaccgcgtcatcgagcaatacttgcgcgcctttgtgcatagccggcagggcacatggggcaaatatcttccttgggtggaatggtctcataattccgcatggtctacaagcactggttccaccctatatgaaatcacgtatggccgaaaaccgtttacgttcccggagtatctcgccgaaacttctaagattgatgcagtggatgcgctgttggtagatagaaagatgacatttcaagcaatacgcaagaaacttgctaaggcccaggaatcaatgaagaaatatgcagatgccaagcgtagggatgtggtctatcaacccaatgattgggtccaggtcaaacttcgaccatatcgtcagtccactgccaaaagctctgcaacacaaggaaccaaaatacactcagtcttccattgttcgttgctcaaaccattcacgagaccaccaacccagccagagtgccctgctctacctcgccaatttgtggatggtcaacctgtgatcacaccccttgctattctcagttgccacgaaattccagggtcaacaccagtggcttggaaagtgctcgtccaatgccatggtctatcacctgacgaaacatcatgggagaattggagccaattatgtcaagattatcaccttcaggacaaggtgaattttcgaggggccgaggatgttatgagcaaacctaggatgccagaaacacaggaagcaccagcatcaatggtgcagagaggagaagggaccaagagaagagtggtaaagcctgtatacctggctgactatgtgtaa

SEQ ID NO: 42123 - DNA, 316 bp, Glycine max
  Peptide Sequence Number=SeqID_158901
atggcggaaaccttaagccccaatcccaaaaaggtgttgcatttcgtctttttgttgaaggctagtggcggtggtgaggatctagaaggaagacctcgtggaaggatccaaaaggctgcatcatcaagagcacaaccagagaaaatgcaattccaacaaaacgtcaagaatcccatcagcgtcgtctccgtctacgtgcgagctagggcaaaagtttcatcctcaaccagagtcaatcatcgacggggttttggtggatctggtaatgggatgagtagatttgtaggatgtggaagtgttccaggagttggaagag

SEQ ID NO: 42124 - DNA, 210 bp, Glycine max
  Peptide Sequence Number=SeqID_158902
atgcccttgcgaggtaggattgtatcaacaagtacaagagcagatgaaggtcgatatggaggccatgaaggagtagatgacaatgatgagcataaacaagatgatgcaggacttgctttcttagatggaacactgatactcacaaacatggatggtgaagagttgccttcatctgtgaattctaatgttgacaagcgatactatgcatga

SEQ ID NO: 42125 - DNA, 909 bp, Glycine max
  Peptide Sequence Number=SeqID_158903
caccttcagaggactacacgtcctacgccttcagagtggttgcatgccctcaccttcagaggactacacgtcctcgcctttagatggcatcacgctctcacctttagaggactacaggttctcgccttcagagggttgcacgccctcacctttaacggactacacgtcctcgccttcagaggactacacgtcctcgcctttagagggctacacggcctcactttcagaggactacacgtcctaaccttgatagggctagacgccctcgccttcacagggctgcacgccgtcaccttcagaggactacacgtcctcgccttcagagggctgcacgtcctcgccttcaaagggccgctcgccctccccatcagagggctggatgccctcactttccgtggattacacatcctcgccttcagaggactacacatgctcgccttcagaggaccacacgtcctcgcctttagaggactacacgtcctcgccttcagaggactacacgtcctcccttcaaaggactacatgtcctcacgtttagagggctacacctccttgcctttagaagggctacacgccctcgccttcagaggactacacgtccttgccatcagaggggtgcacgccctcaccttcataggactacatgtcctttccttcagagggctacacgtccttagcttcagagggttggacgccctaaccttcaaaagactacacgtcctcgccttcagagggttgcatgccctcaccatcagaggactacacgtccttgcctacagaggactacacgtcctcaccttccgagggctacacgccctcgccttcagaggactacacgtcctcgcctttagagggcatcacactctcaccttcagaggactacacgtcttcgccttcagaggcctgcac

SEQ ID NO: 42126 - DNA, 340 bp, Glycine max
  Peptide Sequence Number=SeqID_158904
aaacttgtggaactcctcaaaggaaaatcaactattggagcaaagtgggtgttcagaaacaaggttgacgaaaccagtaaagttatgagaaacaaggctagactggtggccaaaggttactcacaacaggaaggccttggatcttcttcatcaatggagtcctttgcttctagaagatcaatggtagctgaatggagaaggaagaaggatgattggagacgccacttcaaggagaagatgagtcaagaacaagctcaccaccattggaatggaaactggtctgactctaaagtccttgatagtacagggctaagttgtcgtactatcacgaggaataggg

SEQ ID NO: 42127 - DNA, 510 bp, Glycine max
  Peptide Sequence Number=SeqID_158905
atgtcaagcaatgcaagagatgagcttggatttgtgtttatcattttccaaaatgcaggaagagcagtaagcataagatcatttattacctccttgagaggcgaggttcaaatgatgaagatactaccacctaaggtcaagaaaagagttgaactaggattattatactcaatgccacccattagctggtctaatatctcatactatgaaaataaggtcattcctctattgctgaaacacaaggtcatacagctaaatagaacagatgctagactagcaaataatggactacctggtgagattcagaagctacgatgccgagtaaacttcaatgctctgaggtttactactcagatagaagaacttggcagaatgatggtcaaggttttgagggaaaagtggcctttccttgcacttcatcttagatatgagatggacatgttggccttctctggctgtgctcatgattgttacagcaaagaggaggaggaacttacaagaatgaggtaa

SEQ ID NO: 42128 - DNA, 282 bp, Glycine max
  Peptide Sequence Number=SeqID_158906
atgatgatccaccaccgaggcacagacttagccaacggggcgcaagccaaagttggcaaaatcctggcaacaaaactgatcacggggggggaggagggggccaaaccaatccgaaacttagcacggggccataacccagcaccgccgaccctagccaagccaacaacgggcaaaaaccacgaagttgaccggggggcaaaatttcaaccaacggcttgccaagacctagccacgggccaaaaccgaccaccgggcacatggaaaaacttaagcaatggctaa

SEQ ID NO: 42129 - DNA, 579 bp, Glycine max
  Peptide Sequence Number=SeqID_158907
atgacggaagggtgtggtgaaagggttttgccttgcaaaccttcccgtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattgggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 42130 - DNA, 496 bp, Glycine max
  Peptide Sequence Number=SeqID_158908
caacagcggcatgagtgacaaccgccacaagaacaagaacccccctagcatatcagagcaaagtctccctcctatcactttcacggatagggacttcaacggtatcaaccctgtcaaacaggatgaccctatggttgtctctattatcattgcaaacttcatggtgtctaaggtcttcatcgaccagggcaattccactgacatcctgaagacacttaatgagcttggagccatagtctccatgccccatttgaaaatgaaattccctaccctaatcggggagattgtaaccgtcaaggtagaccaaaagcaagcacgaaaatattatgtagagagcctaaaggtagcaccatatcctccccccagggagcttgccaagcctcaccccatagcgactgaaggtactcaagtcatgagcgtggacgaagggcctccaatccaagccctgtccgtctaccaagcaaacttggatgatgaatttgatgtagatccatga

SEQ ID NO: 42131 - DNA, 2748 bp, Glycine max
  Peptide Sequence Number=SeqID_158909
atggaatctctagcattgtcatttctcctcattacattgtttcttttcaccataatctcccttaacagtttttcatcttatgcttctcaactcacttacacagatcactgtgcttccatggttccaaactcaaaccccaatgagtccaagttcaaagacttcccacatggtagattccaagttggttactaccttggtggtgacaaaattgttggtgctgacaccttccagaaactgagacagaaacaagttacccttcgaatcaagagtgtgtatgaaactgatgtctttggcatacacaaagttggagctaccttgttagtaacaactgccagttcctattaccgtgtgggaaacttcacacgtggcaaaagattaaagaaccgcaagcgttttccaagttcaataatgtttagtcttgatgggttttggtcagaatattcaggcaagatttgcatggttggaacaggaagtggctataacatgcaacttttggaggttgttctcaagctttacaatgtcgtcaattcgagtaatactatttctaccttggctattggaagcttggagagcttgagttctaagaatgaggtgagttattttgaacccatttctctgtttatttttcctagagtggattatgaatatagtttggatactatagaagcaaaaactgagttctctaatgaaggtgaagtagtactgggtttatccattaatccggttagtttttgtgcaaacatttttccaatgattaatggtaaatatgatttgcaataccaaagtgaatgcaattctgcaaagtattgcagtcctgttaatggtaaatatgatttccaattgccttatattgtgtctttgaaagaattggtttgtttagatgttaagcaaagggtgagagtattgattggatttcgcaatagtggtgatagatggtctttcaatcctaatactacattagttggagaagggtggtgggatgaggaaaagaaccaattgtctatagttggttgccatttcttgggaatggaaaaatcaatgactagtgtttatgtgggtgattgctcaacaagaatgatcttgaggtttccaaagatttggtcaatcaaagatgcaagtagcattgtgggccaaatttggagcaacaaaactgtaggggattcaggttatttcaagagaatggttttaagaaaatttgaggaccaaagagttcaaatttctggcacaaagtatgagtatagccagcttgacaaagtgagaaaggtgtccccaagacacgaacagttgaagaacaagggaataaggtaccctgatgtttattcttctgacatgagatttgacatctcagttagaatctctaagaggagagttgcatggggttattctgttccattggttgttaatgatcagatccaacagttgaacttagaagaaacctttcattctaattccagcaacacactcccatccatttctccaaactctagcagcactggcttgtacaatgttagctacaaaatcaacatcaagctactacctaatgtcaagttaggtgaagagaagtctatgttaaacacaacaacaaatgtaactgagccagtgaatgtttcagctgagggaatttatgatgctgaagctggaatcttatgtatggtaggttgcagaaaccttggctcaaagaaccaaattccatcatcaaattctctggattgtgaggttatagtcaagtttcagttccccccgcttgatgcaaagaacaatggaggttacattaaaggaagtattgaaagcgtgcgcaaaaattcagaccctctttacttcaaacagttggatgtgatttcagctgcattttacacagcagaagcatcacaaatatcgaagaaagtagatatggaggtcataatgattctgctttgcaccacactagcatgtgtttttgtgggtttgcaactctaccatgtgaaaagaaatcctgacatgcttcccttaatctcctttgtcatgtcattgattttgactttgggaaatatggtacctcttgttctgaattttgaatccctttttgcacaaaatcatgacaagaaaagaattttgcttggaagtgaatggcttgaagtgaatgaaattgctgtaaggctaattgtaatggtggctttcttgttgcaattccgtctcttgcagctaacttggtcagcaagaaaggtttatacaaaacaaaaggacctttggattgctgagaagaaggttttgtatgtgattttaaccctatatgcagcaggtttcttgattgcattgcttgtacaccaaagcaataccttgcagggtgatgtggtgtattcatctagcctttcacaacaacactcactttgggaggacttgaaatctttttcaggtttggtgctagatggctttctcttgcctcaaattttgcttaatttgttcatgaattccaaagggaatgctctttcttgttcattttactttggaatcagtttggtcagactaattcctcatgcatatgatctctttgaggctcttgtatatgttgatggttcatccttatatgaggatgagattgcagactattactccactgcttgggatataatcattcctttggtaagcctgatgtttgctgcaattatccatttgcaacaacagtttggcggttgcagcattctttcttggagaatcaataccaagggtgtagaagaatataaaaaagtgcctgtggtaactgaagcatag

SEQ ID NO: 42132 - DNA, 294 bp, Glycine max
  Peptide Sequence Number=SeqID_158910
atgaagattttaaatgacagtctaacgacggtgctgaaggttacgaggctttgcccatggaagagttgggataggctactaaagaataaagcgaaggtggaaaaacacattaatgttgcgatttttatctcaagaacttcatgggttcagaaggtggaaaaacacattaaagttgcgatttatctcaaaaacttcatgggttcagcgaaggtggaagaagacactgaagctgccattttttactccaaaaagcttccatttttatctgatttttatgtcaaaagacaaggttga

SEQ ID NO: 42133 - DNA, 150 bp, Glycine max
  Peptide Sequence Number=SeqID_158911
atggccttgggaaccatggcagctttccccggtgagctgatgcttcatcctaaaggaagtaaagataaagacactaatttcattctagcgatcttgctattcgatcgggtgactggtgaaaaccaaggaagtgaaaccgagaaaacataa

SEQ ID NO: 42134 - DNA, 423 bp, Glycine max
  Peptide Sequence Number=SeqID_158912
atggtagctctagtgttgattagcctattaattatcattaaaattaatgaagccaagctatggatggaacacagacgaaggaaaagtacgcacactgcaaaggaagattcaaatttgaagaaaaataaaagagttatgggaagagtagagggcaaaggggtcgacctggatcatgggcttgcccaggatttgaacgagaggctttccctcaaagcgcgaggaagcgaatcgggcgggtatgatgcccacgacccggctccgaaacttgctgaatcggcaatcgccactccggccacaatgccatggattatccacgccttcgcggtgttcgaggaaccaaacgacgacgtagaagaagaagatgacgatgacgatgatggtgaggaacaaattgccatgacccaaacaagaggaataagctaa

SEQ ID NO: 42135 - DNA, 216 bp, Glycine max
  Peptide Sequence Number=SeqID_158913
atggcaacactcttcgactctctcgccgtcgtgcgtctccccaccgccgcccgccggacctccgttatgctcccgcactgcgctggcctcaggctcagacccgccgccgcttcgcgcctagttgcgtcccccgctcgcaggatcgcttctcgcgcagcgcgcgtcgcctgcgaggctcaggacaccgccgtggaagtgccgattaaatacatgtga

SEQ ID NO: 42136 - DNA, 223 bp, Glycine max
  Peptide Sequence Number=SeqID_158914
atggcagaatcgtcgaagaagctaaagggaacgtcctccaccaccgctgctgctagccatcaccgccacagaccatctgaagcacccacagcaccaattcccccttcattattacccagtcaaggtgcaccttttgagggcaccattgttgatgactggaagtttaactattcaagtcatgatgctcgccatatggtctgtaatgaccaggctgatatgactg

SEQ ID NO: 42137 - DNA, 885 bp, Glycine max
  Peptide Sequence Number=SeqID_158915
atgacgcgcgatctggcactgagcagcctgctgccgtggctggtggccatgccgctgatgctgctgttgctgctggcactggtgtggtttgagctgcgtccgctgaaacgcctgactgcatcgctgcagcaacgcgcgccggatgatgccaccccgctgacgccgcaacgcctgccgctggaggtgaagccgctggtggcggcgctgaatggcctgtttgcccgcatggcacagctggtgcagcgtgagcgacggtttacctccgatgcggcgcacgagctgcgcagcccgctggcagcgctgcgcgtgcagagtgaggtgattcagctggccggcgatgacgaggcgatgcgtaaccatgcgctgcagcagctcgacagcggcatcctgcgcgccacgcggctggtcgatcaactgctgacgctgtcgcgcgtcgaagcagacgatctgcgcagcgaatttcagccggtccccctcgcgccgttgctgcaccagctggtcactgaacaccaggcacaggcggcagcgcagcacaccaggctgacgctgacggctgacgcggaaccggtgatgatcggtcatccactgctgctgggtttactgctgcgcaatctgctggataacgcgctgcgctacacgccgtccggcagtgagattcagctgcggcttagcgcgcgcagactggaggtggtggataacggaccgggcgtcagcgccgatcaactgacgcggctgggcgaacgcttctggcgaccgccggggcaggcgcaaaccggcagcgggcttggcttgtcgattgtgaaaaatgtggctcagctgcacggcatccggctaaccttcagcgcggtgcagccgcaggggctgcgcgtcaccctcagctggtga

SEQ ID NO: 42138 - DNA, 294 bp, Glycine max
  Peptide Sequence Number=SeqID_158916
atgaagaaccgcgaaggcttcttccggaagaaggtgttccggaaaattttcggaagaacggttcttccagaagtaacgaaaggtcatccggaagaacacttcttccggaaatcttccggaacaccttcttccggaaactttccggaagaagtagttcttccggaaaattttcggaagaagggtactttcggatgccctttgaatattccggaagaactttccggaagagccacttcttccggaaagtttccggaagaactacttcttccgaaagtttgtttgttttttttttaa

SEQ ID NO: 42139 - DNA, 447 bp, Glycine max
  Peptide Sequence Number=SeqID_158917
atggagcgagttatgatgggtcaccttggtgactgtgccaaaggtgctaaggatagtgagcttgatgtgaccttggcaagcaacgccaagaatgaactccttgatgttcatacccgagtccacattgatgatgacgatcctcacaaatggctcactaggttgggccacaaggaaggaaatggtcttttgcttgttcttggagcctggtggcctgccatgtcacttcttaggaggtggggttgggagaaggagattctcttggggctggtttgtaccaacaagtggtggtgtatggtgggggcattaagaggaggagtcagtgtggtgtcccaaaatgatgttgaacttgaggtaaaggaggagttttgggtgtgggaaaatgcaaaggaattgtttgttattgtgacccagaggtgtatggaattagagaaggacaaagatatgtaa

SEQ ID NO: 42140 - DNA, 123 bp, Glycine max
  Peptide Sequence Number=SeqID_158918
atgaataacttctacgtcaaaagtcaagaacacgatggcttaaggaagaggataacacaagaccatcaaacctatctcagaaaaatgacgatctcagaatcgttcaccgttggatcatcgtaa

SEQ ID NO: 42141 - DNA, 285 bp, Glycine max
  Peptide Sequence Number=SeqID_158919
atggcaatgagcccaaacacaaacacacaccgcaacgttatgcgaaaaatacactggactcaagcctacatgcaatatgataccattttttcagtgaaaaacctcgtcgggcgcctaggagtacatgacaggacatgcctcacaatggggagaccaatcaaggtcacactgttttgcaagaatactccaaccatgtgggatcggcacaggcttaaaggaacactcaaatcgggtgacccccaaggcctatattccgaagagtctgtcagggcctctccctcctga

SEQ ID NO: 42142 - DNA, 940 bp, Glycine max
  Peptide Sequence Number=SeqID_158920
tcagagggttgtacgccctttctcttcataaggctacacgccctcaccttcagaggactacacgtcctcaccttcagaaggctacacgctcttgccttcagaggactacacatcctcgccatcaaaggactacacgttctcgccttccgagggctgcacgccctcgcctccagagggctgcatgtcctcaccttcagaggactacacgtcctcaccttcaaagggctacatgccctcaccttcagagggctgcacaccctttccttcagaggactacacgtcctcgcctacatagggctacacgccctcaccttcagagggctacacgccctcgccttcagaaggctgcacatcctcaggttcagaggactacacgtcctcgacttcagagggctacacaccctcaccttcagaggactacacgtcttcgccttcagaggactacacgtccttaccttcaaaggactacacgtccttacctttagaggactacacgtcctcgctttcagaggactacacgtcctcaccttcagagggctacatgccctcaccttcagaggactagacttcctccccttcagaaggctacatgtcctcaccttcatagggctacacgccctcaccttcagaggactacatgtccacgccttcagagggctacacgccctcgccttcaaagggctacacgccctcgccattataggactacacgtcctcaccttcagagggctacacgtcctcgccttcagaggactacacgtcctcgcctttagagggctacacaccctcgcctttagaggactacacgccctcaccttcagagggctacacgccctcgccttcaaagggctgcatgccctcgccttcagagggcgacacgccctcgacttcagagggttgcacgccctcgcctttagagggctatgcgtcctcactttca

SEQ ID NO: 42143 - DNA, 172 bp, Glycine max
  Peptide Sequence Number=SeqID_158921
tgattcaaagaagcctttgtatatggggtgcaagaattccttgacgctattgttggtagtgttaagtctggttaatgtcaaggctagatatgggaagatactgtgtccgatgggtatggagtatcagaagattcatgcttgcccgaatgattgcatactgtacaagcattaa

SEQ ID NO: 42144 - DNA, 273 bp, Glycine max
  Peptide Sequence Number=SeqID_158922
ggaaaccctaaaagagagaaaaagaacaattacctgagaaatttgatccttgtgacatcgaacatcagagacccacccttcgtactgcattcaaaggcgatcttcaacaaacctgtggcggctcacgaaggagtgaagctagttatgctagttgcgcaccatttgaaccattgtgaaggagtgaatgtcgtgaagatgttgtaccatctgctggctcgcgaaggagtgaagttgtgttccgaagaaagacgtcgttggagggttctgcttagg

SEQ ID NO: 42145 - DNA, 1083 bp, Glycine max
  Peptide Sequence Number=SeqID_158923
atggaagcagattatggaaaggattgcaccaaatctgagaatagagaaaatctttcagttccccctggttttacgtccctgacatctttcattttgaaaagggatggaaatgttaagaaaagtgataaatctacagcctttcaaattgcatccgaacaagagccaatattcatggagactattcctgagatgaatgacattagtgcttatagacaggttcttatgcatcggccgtggataatcgcagaccagagcaatcaccacaaacttgaggaatctcacataaagcatcttcctatggttaagttgggaatcttgcattttttttggtgtgaattaggcaatatctcgctactgacattggtagaatacacacacccaaacacatatatgtgtgatccccctttaaatgatggtcgtccaaaagggatcatacatggatgtccaaactgcagtaattgtgtgaaggtaacagcaaggtggcatcctgaggatgctataagagaagttttggaagaagctcctactttccacccaacagaagaggaattcaaagacacacttaaatatattgcaagcatacgttccagagcagaaccttatggaatgtgccgtattgtccctcctacttgctggaaaccaccatgctctcttgagaaaaagaacatatgggaaaagtctgaatttgttgctcagattcagcgaattgatggacaccaacttcagcatgcacaagaaattatggctagtgctagtggaaatacaaaaaccaagagaaaaagagatgtaaaagtagctttagactctcagcttggtaatagaaacaccagcactccaaataaccagaatgttcaaaaatgtgactgtgagtctgaacctggtcctaaattcagtctcaaaacattaaagaaatatgcagacatatttaagagtcagtactttgattacaaggataagaagaagattataggttccaatataaaattagctatacatcagcagtgggaaccatctgtggagaatattgaaggtgaatatggacggattgttcaaaatccaactgaagaaatcaaggtatattga

SEQ ID NO: 42146 - DNA, 294 bp, Glycine max
  Peptide Sequence Number=SeqID_158924
atggctccgagaaagctttccacaaagagatctaggagggacgccgcggctgaagggaccagtgctgctcccgagtttgacagccatcgtttcaggagtgctgagcaccagcagcgtttcgaggccatcaaaggatggtcgttccaccgagagagacgcattcagcttagggacgatgagtacgcagattttcaggaagagatagctcgccggcgttggacgtcgctggtcactcccatggctaatgattattatattattattttacctctttttggtttccaacatggttag

SEQ ID NO: 42147 - DNA, 1704 bp, Glycine max
  Peptide Sequence Number=SeqID_158925
atggctaatgaacgtgatctgttctcggcggagattgtgaaccgtggaattgaatcgtcaggaccaaacgctgggtcgttgacgttttcggtgagggtgagaaggcgcttaccggattttcttcaatcggtgaaccttaagtacgtgaaattgggttaccattatctgataaaccatggcatatacttgttcaccataccggttcttctcgtggtgtttagtgctgaggttggaagcctcagcaaagaggacctatggaagaagctttgggaagacgcgcgttacgaccttgctacggttcttgcttcctttggggtcttcgttttcaccttgtctgtctacttcatgtcgaggccacgtcccatttacctcattgattttgcatgttataaacccgatgatgaactcaaggtgtcaagggagcagttgatggaggtagcaagaaaatcaggcaagttcgacgaagcgagtctggagttccagaagaggatgctgatgtcctccggaatcggcgacgagacctacatcccgaaggccgtcgtggcctccacggagaacacggcgacaatgaaagaggggcgcggcgaggcctccatggtgatgttcggagccctggacgagctgttcgagaaaagccgcgtccgaccaaaggacgtgggcgtcctagtagtgaactgcagcatcttcaacccgacaccatcactctcagcgatgatcataaaccactacaagatgagagggaacattctgagctacaacctcggcggaatggggtgcagcgcggggatcattggtgtggacttggccaaggatattctccaggcgaaccctaataactacgcggtggtggtgagcacggagatggtggggtacaactggtaccaggggaaggacaggtctatgcttatcccgaatagcttcttccgcatggggtgttctgctgttctgctttccaaccgtcgaagggactatagccgcgcaaagtaccgtcttgaacacattgttcgcacgcataagggtgccgatgaccgcagcttcagggttgacattttagttccatcttccaaccgctacttaatgactcagcagacaaaccagatccctccatcaaacataacagaaatggaacttgccaagtgtgtttaccaagaggaagatgagcaaaaactcaagggactaaagatcagcaaagacttgattgagattggtggtgatgctctaaaaaccaacatcaccacactaggacccttggtgctacccttttctgagcagcttctcttctttgccacccttgtgtggaggcacttatttggcagcaaaaatggtgggaattcaccctcaatgaagaagccttacattcctgactacaaactagcttttgagcacttttgtgtgcatgctgcaagcaagaccattcttgatgagcttcaaaggaacttggaactgagtgacaagaacatcgaagcgtctagaatgacgctgcatcgctttggcaacacctctagcagcagcatttggtatgagttggcttacatggaagcaaaagagagtgttagaagaggagaccgtgtttggcaactcgcatttggctctggcttcaagtgcaacagtgtggtttggcgcgccatgcgccgagtcaccaagccttctaggaacccttggcttgattgcatcaacagatatcctgcacctctcaacaactga

SEQ ID NO: 42148 - DNA, 1122 bp, Glycine max
  Peptide Sequence Number=SeqID_158926
atggaattagataggctcagtaagcttgaagaacctcctctctctggtgcttgcatccgtggtctagtgaaacaactaaccacctctagaacaaaagacttcatgaacccaaaataccaaaattgtgttgtgaacggtggcgtttcccatggtcaaaattcaacaaaacatggcaaagtcgcagatactcgtcaggcacaacagtcctcacaaccccaacaacaaaaaaaacaagttagaaggagactccacaccagtaggccttatcaggaaaggcttttgaatatggcagaggctcggagggagattgtcaccgccttgaaatttcacagagcagcaatgaaagaagcaagtgaacagaagcagcaacaagcccaagaacagcagcaaaggccatcagtatctctccagccatcccagttcccaagttttgaccaagatggaaaatttaagtctaggagaaatcccagaatttacccagcatgcacaaccaaattttcaagttacatggacatggatgatttatcccaacctcctcctttggttccaaattcttacacctggcctgctgcttccccaattactccaccaccccttatggctgaaaaccccaatttcgtgcttccaaatcagactttaggattgaatctcaatttacaagatttcaacaacttagatgctacccttcacctcaataactcatcatcatcatcctcttactcatctgcaacctcatcttctcctccacaggaacttccttccgttggaatatcacagggagaggggttttcttcattggtggatactattgaatccaatgctgcaacccaggtcactggaggcttacacacagccatggacgatgagggtatggcagagatgagatcattaggagagcaatatcaaatggaatggaatgacaccatgaatttggtcaaatcagcttgttggttcaagtacttgaaaaacatggaacatagggcacatgaagccaacactgtagatgttgcatacaataattttgaccagcttctggagtttccagcttggttgaatgcgaacgagagctgcttagagcagtgctcggtggattattttcaagagtcttccttgccttggtaa

SEQ ID NO: 42149 - DNA, 1254 bp, Glycine max
  Peptide Sequence Number=SeqID_158927
atgcacgtcctcacctttagagggctacgcaccctcaccttcagaggactacacatcctaaccttcaaaggggtacacgctcttaccatcagaggactacacgtccttcccttcagagtgttgcacgccctcaccttcacagtgttgtacgctctcaccttcagaggactgcacgtcctaaccttcaaagcgctacgcgcccgcaacttcagaggactacacgtcctcaccttgatagggctacacgctgttaccttcaaaagactacacgccctcgacttcagagggttgcactccttcaccatcatcggactgcacgtcgtcaccttcagagggttacgcgccttcacctttagaggcctacacgtcctcacctttataaggctacacgttctcaccttcagaggactacacgtcctcgccttcagagggttgcaccctctcaccttcataggattgcatgtcctcacctttagagggctacgggccctcaccttcaaaggactacacgtcgtcaccttgaaagggctacccgctcttaccttcagaggactacacgtcctcaccttcagtgggctgcgtgccctcaccatcagaagactacacatgctcaccttcagaatgctacacgctcttaccttcaaaggattacacttcctcaccttcagagggctgcacgcccttaccttcagaggactacacgtcctcaccttcagagcgctacgcgctctaacctttagaggactacacgtcctcaccttgagagggctacacgctcttaccttcaaaggactacacgtcctcgccttcagagggatgcacgccctcgccttcagaggactgcacgtcctcaccttcagagcgctacgcgccctaaccatcagaggactacacttcctcaccttcagagggctaaacgctcttacctttggtggactacacgtcctcaccttcagtgggctacacgcccttacctttagaggagtacacgtcctcgcctttagagggttgcacgccctcaccttcagaggactgcacgtcttcaccttcagagggctacgcacgcccacctttagaggactacacatcctcaccttcatagggctacacgctcttaacttcagaggactacacgtcctcgccttcagagatttgcacgccttcaccttgagaggactgcacgtcctcaccttcagagggctacgcgccctcaccttcagaggactacacattcttgccttacgaggactgcat

SEQ ID NO: 42150 - DNA, 572 bp, Glycine max
  Peptide Sequence Number=SeqID_158928
tcggtgacatagacctgctctacaaactaattcagatgcaaccatatgtgttggagcacacagatttcatgccatttgttgatactcctttgcatgttgcagccgcagctgggcatgcaagtttcgccactgagatcatgagactcaagccttcatctgtatggaagctgaatcaatgtggccttagccccatgcaccttgccttgcagaacaagcattacagaatggtgtgtcgctttgtgaacatcaacaaggaccttgttagagtcaaagggagggaaggtctcactcctttgcatattgctactcaaactgggagaactgatcttgtggctaagttcttgtcggcttgccctggttccattgaagatgtgaccgtccgaagtgagactgcgttacacattgctgtgaaatatgatcagtttaaggccttggaggtcttggttggatggcttcagagaaattgccaaagacttgctgaggaccgggaaaaaagggttttaaattggcaagatgaagcaggcaacaccgctctccatctttcagttctcaaaggcttcccacaggcatga

SEQ ID NO: 42151 - DNA, 609 bp, Glycine max
  Peptide Sequence Number=SeqID_158929
atgaggacagtgctttcgcgcttgatccattccacgccttccatttccaggatcaatgcagtgtcaatccgcgggagagatctcttctttccaaatgtctgctttaaagttgaagaagcagttaatgtgcctccacccccaacggaaaaggttgttctgtttggaggcgattggtttgttggatcacacttttttagagaagccctagaacgtggcatgtctgctgggagtcctagcaggtctggtaggtcatccctgcatgattcctgggctaggaattttgcttggtatcaagggaatctcttttcaactgcttcattgagaaaacatctgaatggggccactgctgttttacaagatgttgctttagattttaaagaacttgtttggatacagaattttatatgtaaatatttgttcccttgtgatgatatgcctgtggtgctaacttgtgtttcttttataagatctcatttatgggtggttttggctccaacatcaaagctattagagcagcttcagatcaagtgtaagagcttgcaggagcagcaacaagtctgtttttcccctgatagatttctagccacccctatgcagatacagtcatga

SEQ ID NO: 42152 - DNA, 447 bp, Glycine max
  Peptide Sequence Number=SeqID_158930
atggagaatgattctatagaggacatggacattgaagcccttccttcaatgtggcctcaagatattggaaccgaggttgggaagcagtttaatatagaaaaggctggaagggaccaagacatgttagaggaggttacaatcatagaggagccaactatagttgatttcaagcgtctcatggagcttacagattttacagaaaagggctcttctcagttggcatatctaatgaagcaatgggagtacaaacaggccagtgtcgtgcgtcttctcagagaagaacttgacaacctaagcaagcaaaggcaggatgctgagctcaggaagttggagatattggaagagcatcgattcgaggaagaacaatatgggggagataagcgtccagtttctatattggatgaagtttatgatgggtatatggcaagatataccttggcaggaaaa

SEQ ID NO: 42153 - DNA, 163 bp, Glycine max
  Peptide Sequence Number=SeqID_158931
ctgaggaagaattcgggtatgaccatccaatgggcggtctcacaataccatgcaaggaggatgagttcctaaccgtcacctctcacttgaatgacctggatttctattttctactgaagttgaaacctgtttccttaatgagaattaatgcagcacaggacac

SEQ ID NO: 42154 - DNA, 600 bp, Glycine max
  Peptide Sequence Number=SeqID_158932
atgaggacagtgctttcgcgcttgatccattccacgccttccattttcaggatcaatgccacggtagtgtcaatcagcgggagaaatctctgcacagattctaacaaagttcatgaaccctttaaagttgaagaagcagagactgtaaatgtgcctccacccccaacggaaaagttggttgtgtttggaggcaatttttttgttggaatcaacattcttatggaagcccaaaatcgtggcatgtgtgctgggagtcctaccagggatgatggtaggtcatccctgcatgattcctgggctaggaattttgcttggtatcaagggaatctcttttcaactgctacattgagaaaacatctgaatggggccactgctgttatctcatttatgagtggttttggctccaacatcaatgctattagagcagcttcagatcaagttctactgcttggagtagccagggcattgcccatactaatctttctttttgagcttataacaactgcaactgagccttattccaccaagtgggatttgttgaatagatcaaatgataagactaggcttaacaaaaatttggaaaaaaaattgttcaattga

SEQ ID NO: 42155 - DNA, 159 bp, Glycine max
  Peptide Sequence Number=SeqID_158933
atggaaggcgtggaatggatcaagcgcgaaagcactgtcctcattttctctgttgagctttggaattttctttacgagacgaagcttccgcgtgacatgagccttcgcattcgcccagaatacaggaacaaacttggaatgggcaccaggcgcaaccac

SEQ ID NO: 42156 - DNA, 561 bp, Glycine max
  Peptide Sequence Number=SeqID_158934
atgggtggttttggctccaacatcaaagctattagagcagcttcagatcaagatttcatgccatttgttgatactcctttgcatgttgcagccgctgctgagcatgcaagtttcgccactgagatcatgagactcaaaccttcatctgtatggaagctgaatcaatgtggccttagccccatgcaccttgccttgcagaacaagcattacagaatggtgtgtcgctttgtggacatcaacaaggaccttgttagagtcaaagggagggaaggtctcactcctttgcatattgctactcaaactgggagaactgatcttgtggctaagttcttgtcggcttgccctggttccattgaagatgtgaccgtccgaagtgagactgcgttgcacattgctgtgaaatatgatcagtttaaggccttggaggtcttggttggatggcttcagagaaattgccaaagacttgctgaggaccgggaaaaaagggttttaaattggcaagatgaagtaggcaacaccgctctccatctttcagttctcaaaggcttcccacagtcatga

SEQ ID NO: 42157 - DNA, 126 bp, Glycine max
  Peptide Sequence Number=SeqID_158935
atgagccttcgcattcgcccagaatacaggaacaaacttggaatgggcaccaggcgcaaccaaaagacacgagttcgatccgtatacagatcgtcgatccatagcaaaaatattgggtgctcttag

SEQ ID NO: 42158 - DNA, 1929 bp, Glycine max
  Peptide Sequence Number=SeqID_158936
atgtctcatgagataagatctccattgtctggggttgttagcatggctgaaattctttctaacacaaaactcgattgggagcaaagacaactcctggatgtcatgctatcttctggagatttggttcttcaaattataaatgacatacttgatctttccaaggtcgagtcaggagtgatgaaattggaagctacaaaattccggccaagagaggtagtcaagcatgtactccagaccgctgtggtttcattgcagaaaatattaaccttagaaggacatgtagcagatgatgtacctattgaggtcattggtgatgttttaaggatgcggcaaattctcacaaatttaattagcaatgccatcaagtttacccatgaaggcagagttggaataaacctttacgttgtgccaaagcctaattttgcaaaagcagaagacatccaaatgatgactccaaaccaatcaactatgtcagtgaatggtgtaaaagaagaacaacatctctcaaaacctcaaagtggcaatgatggaaatcttcttgatggttgtcaaaaacatgacgaccatcccagtcaaaaccatgcattcaatgacgaatgtggatctccggccaaaagtgaatgctcaatgaatggagacactgaggagcaaccttattcagctgaaacaacggtgtggatacgttgtgatgtatatgacacaggcataggaataccagaagatgctataccaaccttatttaaaaggtacatgcaagtcagtgcagaccacactcgaaagtatggtggcacagggctaggactagcaatatgcaaacaactggttgagttgatggggggtcaactaacagtttctagcaaagaacactatggttctactttcactttcattcttccatacaaggtttcaatcgcttgtgatcattctgatgatccggatgagctttctgatttggagaataatgatgtcgcatctgatgatacaatagagagtttcttccaattccaaccacgcactttgggctctcttttctcttctaatggatctagcaggacacagaagttattaacacacaaaattggctacaccagctcacataaacttggtggattttctgagagtttatattcattcccctccaatgatatcatgtcaaaagggacatgttcagttgatgatgcatcttctgtggttgatgctccggagacgtctgaatcggctagttcatctggtcacagcctagaaacaaagaacaaaagtttggttagaagagataaacagcatcaagataaggctcgtgcttggtcctttaatggttatgcagattcctctgaagttactgtgtcaaacggagaaatggctggagcaacaaagtcaagtgaaccccaacaaacatgtcagggtcaagggaaggcaaacacaactactcaatgtgttacaagcagcagcacatcagaagtaaccaaatccacaataaagcctaagatccttcttgttgaagataacaagattaatgtcatggtgacacagtccatgatgaagcaattaggccatagcatagatgttgtgaacaatggagtggaagcagtacgtgcagttcagcgccacacttatgacctgattctgatggatgtctgcatgccagttatggatggtcttcaagcaacaaaactgattcggacttttgaggaaacaggcaattgtgatgctgcaagaagtgctggaattgaggaaagtctaccagatcaagattatgaatgttatgtaccatttacaaagcgggtccccattgttgcgatgacagcaaatgctttgtcagagagtgctgaagagtgttttgcaaatggtatggactcatttgtgtcaaaacctgtgactttccaaaaacttaaagaatgtattgaacaataccttgtaaatttcagctag

SEQ ID NO: 42159 - DNA, 240 bp, Glycine max
  Peptide Sequence Number=SeqID_158937
atgccgatctccccctacggaagtatcaattggggtcgcgcccacaagacacccagtggacccggagaagtccaacagggccctagggtttccagctcgggttacgggcctctatcagtcctacagggtgcccgtcccccccagcaagggatcgcgcctgcaagacacccagtggacccagagaagttcaatagggtcttggggtttctagctgtgattacgggcctttgtcagttctaa

SEQ ID NO: 42160 - DNA, 938 bp, Glycine max
  Peptide Sequence Number=SeqID_158938
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtcaaccaactttctatgccaattccacattgctaagaatgtcagagcaaattgcaagatgcatgtgaacaacatggaagattggggcaaggtgctcgatgcttggaatgggttggtgcaatctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42161 - DNA, 339 bp, Glycine max
  Peptide Sequence Number=SeqID_158939
atgggtaattttggggtaaactctcatctcaatcaagtctataacattgaattagacttgctcaaactgattttaagctcccaaaacccaacacccccagatttcaagagagaagaagttcacccttacctgaaattgaaggtcccacgaggtagaggtaggctcctagactccgaaaatagcttttccttgcaatttggtgtggaaatgaagaggaatttggagcttcaaaagagacaacaatggtggataagaagaggaagaaaagcaacatggagggagaaagaagggctgctggaagtttctggagaaggagagagaagatttggctttttataa

SEQ ID NO: 42162 - DNA, 322 bp, Glycine max
  Peptide Sequence Number=SeqID_158940
atggcggaaccatcaaagaagcagaaaggaacttcgagtcggagtcaacggcattccggggcacaggaaaccccaattccttcctccatttcctctggatcattgttctcatcagaggaacagccatttgaaaactccaatcttattccattcatgtctctgaaattacctgtttattctgaactagtcaaagccttttattctaatctagaaatccatgaaggtaccctaatgtctgaggtttatgggactaagatggtcattgaccagtccctattctatgatttaacccaattgccaagcgaaggtgtaccatttgaag

SEQ ID NO: 42163 - DNA, 354 bp, Glycine max
  Peptide Sequence Number=SeqID_158941
atggatagttgggtagtatcaggactgaggagaaattctactggtgaccctatgctaaaagttgcttctgcacttcatgataattgtagagctgttcttgttggaaaacgcacatatggcaagggtctaatccaatctgtatttgagcttgatgatggatctggtgtggttatcactgttgggaagtatgtaacaccaaatcacaaggacataaacggcaatggaatagagcctgacttccagaaacttccagctgctcgctggaagctgctttgtatatctcaagaatttcaagttaatatagatatatgcctgaatggtttgcctagccttcttggctacaatggcatttaa

SEQ ID NO: 42164 - DNA, 375 bp, Glycine max
  Peptide Sequence Number=SeqID_158942
atgaaccacttcttccggaaagttcccggaagaggtttttccgggagtcttccggaagaagtgttcttccggaagacgtttggttacttccggaagaacccttcttccggaaactttccggaaaatgttcttccggaacttccggaagaacccctaacgggtcttccggaagtctccgccgtcagcctcctttccccattttttccggcgtcctctcctctcgtcttctaccctaaggttactatcctaagcaaaggggagttagggagactaacctcgttcgcggagaagaagaagacgaggttcgcgcttgccttgccggagaagaagaagcagttcgcggagaagggagaagaagcttcgcggaaggaatga

SEQ ID NO: 42165 - DNA, 192 bp, Glycine max
  Peptide Sequence Number=SeqID_158943
atgggtgcaaactgcaaagtggagaactttcttttactcagtgataccccatatgcatttggtaaagagatcgtagatctatgtttgggttgtatccggaaactcgcagacaactacactggtctccagggcttccttgtcctcaacgctgtcggtggtggcattggttccgaactcgcgtcgattaggtga

SEQ ID NO: 42166 - DNA, 753 bp, Glycine max
  Peptide Sequence Number=SeqID_158944
atgaaacgagcgctaaacctttcaagccgctcaatagtacatgagtggtcgactgtgggtttggggggcataccaggctattcaacctatgtcggcaatgccgccaaagcggcacgttttcttaagatgggcggctatgtgggtattgcgttttcttttgccggggcgacgaatgatgttatgaaggcttgtacggttggacgtttcgaaatttggactctaaaccgctgcggaaagaaatattacacgcttttggaagagtttcaaaaaagacatgaaaatattgagaacagggccggcagcgccagcccgggagggaaaagatcagttcagcagcgcgaggatttcgtcagtggtgccggtttcgccgaggcgcgggaagatgcgctcaatgctgttgtggtgagtttcggcgttcaggcagcacattgcatcagtcgccagcgtgacgccacgctgctgctgcaactgctgatgcaggtcgttattgtggtagttaacgcgtgcaccaggggacgcgagagtgaatgtggcaaaactgcctttaaagaatatagtaaattcgccagcggtacatttgctggtattactggagggacgctgggtgcatctgctggtatcggtatctgttttgctgtaggcatagccactgcaggagccggaggggttgcttgcgccgctgtaggttcattagtaggtgggactgctgccagctcagcaagtgattatcttatggatctatggttgaaatag

SEQ ID NO: 42167 - DNA, 265 bp, Glycine max
  Peptide Sequence Number=SeqID_158945
atgttaactatacggtgtcggcttcgcgcttcaccacgcacggctatcgcgaccacagcgccgcgcagaagaacctcggcaatgcccagactgggcgtgcgcattgacgatgtcagcaccctgacactgctgttcaacagcgttcacgtcgaggcgcaggatccgggcggcctgacgccggatcagtggcatgataatccgcgccaggtggccagcaacgtcacgctgtacaacgcgcgcaaaaccgttgatcagacccaggcgg

SEQ ID NO: 42168 - DNA, 2382 bp, Glycine max
  Peptide Sequence Number=SeqID_158946
atgagtcagcaacctgtagtggcggtactgggattaggcgcgatgggacacgcatttgccgccaatctgttgaagaaaggctttaccgtgcgcggctggaaccgcacccgtgccaaaggtgaagatctggtggccgcaggcctgacgctgagcgacagcgccgcgcaggctgtggaaggcgcagacgtggtgattgccatgctggcggacggcgctaccacgcgcaccacgctaaaccaggtgcagaacgcactgcagcagggggctaccgtggcgcagatgggcaccatcggtgttgaagcgaccgacgcgctgatcgccgagctggcggccgcacggccggatgtggtgtttattgatgcgccggtctccggtactaaagcgccggctgagaacgcgcagattctggtgatggccagcggcgaccggcagcgcgcccaggcggcggagcaggtgtttgccgcgattggtaaagggacgcagtggctgggggccgccggtgccagctcgcgcatgaagctggtggtgaatagctggctgattggcctgatgcagagtcttgccgaaagcacccggctggcagagcagttgggtttcactaccgacgatctctggcaggtgctggaaggcggtccgctggcagccccgtacgccaaaatgaaactcggcatgattgccagcggcgactttacgccgcagatgcatctggtctgggcgctgaaggatgcgcggctggcgctggacgccgctggcgacgcctcactgccggcgctggaaaacatcgtcgatgtctggcagcaggcggtcgatgccggttacggcgagcaggatctggcggcgcgtccgctggtgccgtatgcgcacgattacgcgcacggcgatgcggagccgtggcactatcaccactgcgcgcagctgatccataccctgagcggcgtggtgaaagtggaaacacaacacggcagctggattgtgccgcccagccgcggcgtgtggctgccggccggcacgcgtcatgcgctgcacatcgttggcagcgtggcggcgcgcacgctgtttgtcgatccgctggcgcgcgccgatctgcccgccagctgtcaggtggtgcagatatcgccgctgctgcgggagctgattgtcagcgcgctcacgctgccggagcattacgcgtctggcagtcgcgccgagcgcatttacgagctgattctcgatgaaattcgcgtgatggacgtgctgccgtttggcctgccactgccacacagcgaccggctgctggcgctgtgccagcagattcagcaggcgccgggcgagagctggacgctggcgcgcgcggcagcgcagctgtgtgtggcggaacgcacgctggcgcgccatttcagtcgcgaaaccggtttgcagtttagcgactggctgcggcgtgcccggctgagcgtggcgctgacccggctggcgcagggcgatacggtgctggccgtggcgctcgatctcggttatgacagcccgagcgccttcagcgccatgtttcgccgtgtgctgggcgttacgccagcgaactactttccggcggcagaaaagcgcccgccgcctgatatagcacaccgaacggctgtcgctgcgtttgcccagcgtgtgttcatggtaatcctcaatgattacggccagatcgcgcgctttaatccgcgtctcgccctgatcatcgctatagctttccgcctgcagcaggcgacaccgtggctgttgcaggccgtactgctgacagaacagctgccacagcgcgtggtgcgtcatctcctggccgtgagcatcggtctgctgctgcacgcagcggctgaaatcctgctgcaggccgcgcggcagttgcaggccgtgattttgttccagcagccaggcggcaccgcctttaccggactggctgttcacgcggatcaccgcttcatagctgcagccgatgtccagcggatcgagcggcaggtagggcatttgccataccacttcattacgcgcgctgcgttcggcaaagcctttgcgaatggcatcctgatgcgagccggagaaggcggtaaacaccagttcgccggcgtaaggatggcgcggatggaccggcagctggttacagcgcgtcaccacttccagcacctcgcgcatatcgctaaagtccagctcaggcgtcacgccctgggtatagagattcagcgccagcgtcaccagatcgacgttgccggtgcgctcgccgttaccaaacagacagccttcaacgcgatcggccccggccagcagcgccagctcggcgcaggcggtgccggtgccgcgatcgttatgcggatggacactgatggccacctgcgagcgctggctgaagtggcgacagaaatactcgatctg

SEQ ID NO: 42169 - DNA, 978 bp, Glycine max
  Peptide Sequence Number=SeqID_158947
atgtcctcctcaagtgtctgccaagggttgcaatcttgtctcgaaccccgcgtgatggagccacgtgtactcaggctcaaactcgcactacaacaaggttccaattttcctcaaccctctccctctcccactaccaacacattttcactttcacccctctctgactccgaagaaaacccacctaccaactgccaatgtgacaaaaatgacacaaaatccggcgagcctagtggctggagtttccttcaaactctctcacaggacaaaacagaggaccaagtctatgtccaccccacagttaaacgttcctcctcaattctcagtgaaaaaagcttagaaatgtgcaccgaaagcctcggcagcgagaccggtagcaatgccagtgaaaatggtgatgacatgtccttgttttcctttgacaccaacactcgttccaccgaacatactactactactactgctactcatgcaaattatgagtctaaaagagtgaaccgcacttgcaacttgccaccaccactgaccacaatcactgattttggcggtgttcatgttcgacctcatcgcgaaggtggaaggctagtattggaagctgtagcttctccttcccctcgtccatattttcacatagagcgcggcgatggaaggcttaggctgtgtttgcttgagagcttttcggcctcggatagtgatgatgaagtttgtgatgctgaggaaggtgttgatgaacaacaggaagaagaaaatgaaagtgagaagaacagaggagaagaagaagaaaaggagtgtggtgaagaggatattgctactggggcagaggaggaggaggaggaagagtgtgttgagaacgtggaggatgggatgggagtgaaaaagttggcgagaccaagcaggtgcaaggaaagtgggaaaagagatatttttggtgatgccttggctaatttgagcttccctcgttttctctctgtctccgaatag

SEQ ID NO: 42170 - DNA, 453 bp, Glycine max
  Peptide Sequence Number=SeqID_158948
atgctatatttaaagcaggaaccaaaagctctcacatcattctcagatgaacattcatggaagaaatccagagatttgcttgagaaggttggtagacaaggagatctaactggttatagagttccttgtctccttattgccgcaaaggatgatttaactccatatccaagggcagtacaagattcagttaaggttactgaggaattgggaatagaggcacctattcatgtaagtatgaaattaggcgattcaagtaacgtgtaccataagattgtcaatgctgcagagcaccctcatttaagcattccagaaactgagattgggaggaaaagaaagcaataccatcggcttcttcagcactctcttgtttttgcctcagttgggactgctatggcatttgttggtttggcagcatgtcgtgcatatgcagttaaaaagaattcctctggttag

SEQ ID NO: 42171 - DNA, 891 bp, Glycine max
  Peptide Sequence Number=SeqID_158949
atgggtattttttctcgtttcgccgatatcgtgaacgctaacatcaactcgctgctggagcgtgccgaagatccgcagaaactggccgaaattcagcaggccgaatggcaggaaaaagctgagctggcgctgagtaaagagaaagaagatttagcccgttcggcgctgattgagaaacagaagctgaccgacctgatcgccgcgctgcagcaggaagccagccacgttgaagagacgctggaccgcatgaaaggcgagattggcgagctggagaaaaaactcagcgaaacccgcgcccgccagcaggccctgacgctgcgtcatcaggcggcttcatcgtcacgcgatgtgcgtcgtcagctcgacagcggcaagctggatgaggcgatggcacgcttcgagtcgtttgaacgtcgcatcgatcacatggaagcagaagcggaaagccagcgcttcggtaaaagcaaaacgctggaccagcagtttgccgacctgaaagccgatgacgaaatcagccagcaactggctgcgctgaaagccaaaatgaaccgcagcgagagagtcaatgagcgcactatttctggccataccgttaacgatcttcgtgctgtttgtggcaccgatctggttatggctgcactacagcaacaaacgcaacggcggggcgctttcgtccgcgatcctcgatgccgaacacccgaactggaggcagccatgatgaacggacgcaaactgtggcgtattccgcagcagggcaaagtgcgcggcgtgtgtgccgggctggccgacaccggtgaccgcactatttttatccttggctacgtgctggatgaaaaaccgctggacgcaccctctgagcgcacaccaacggcgcgcgaactgctgggatga

SEQ ID NO: 42172 - DNA, 522 bp, Glycine max
  Peptide Sequence Number=SeqID_158950
atggttgtgaattgcagtccatgggatgatgctctatataaggatgctgctgagagaactaacatgggttacatatctcttaatggattcctggcgcagtgggtccttatgacattacttgatccaccatgtagcctggctaatttgatttacattggatatagtggtaatccagctgctgctcttcgtgttacccgtagaagagcagtagatcgcaagaagcaagcaacagaaaagaatgtgttccaatgctatgtttttggttctaaaaatgctgggaagtctgctctgttggattcattattgggaaggcctttctcaaacaattatactccaacaactgttgagaggtttgcagcaaattccattgaattaatagggggaaccagaaaaactcttgtgttgcgggagataccagagagtgaagtatcgaatgttttgtcaaataagggttatttggcagcatgtgatgtagctgtttttgtctatgacagcatatttatgggtagtcaatataaataa

SEQ ID NO: 42173 - DNA, 1854 bp, Glycine max
  Peptide Sequence Number=SeqID_158951
ctggcgatgcacgatgcgccgctgctgattgtcggcgacaccggcaccggtaaagatatgctggcgcgcgcctgccacctgcgcagcgcgcgcggtaaaaaaccgttcctggcactcaactgcggctcgatcccggatgacgttgctgagagcgagctgtttggtcacgcggcgggcgcgtatcccaacgcgctggaagggaagaagggcttctttgagcaggcgaacggcggctcggtgctgctggatgaaatcggcgagatgtcgccgcgcatgcagactaaactgctgcgcttcctgaacgatggcaccttccgccgcgtcggcgaggatcatgaagtgcacgtggatgtgcgcgtgatctgcgccacgcaaaagaacctgattgagctggtgcagcgcggcgagttccgcgaagacctgttctatcgtctgaacgtgctgacgctgaatctgccgccgctgcgcgagcgtccgctggatattctgccgctcaccgaaatgtttgtggcgcgcttcgccgatgagcaggggctgccgcgcccacgtttgtcaccgcagctgacgccgttcctgacgcgctataactggccgggcaacgtgcgccagttgaaaaatgcgctgtaccgcgcgctcacgcagctggaaggttatgaactgcgtccgcaggatatcgtgctgccggagcaggcgctggatgtgtcgctgggcgaagaggcaatggaagggtcgctggatgaaattaccagccgtttcgagcgttcagtgctgactcgtctctatctgtcgtatcccagcacgcgtaaactggcgaaacgtcttggggtgtcacacaccgcgatcgccaacaagctgcgcgaatatggcctcgcaatagccttacttcagcgctgccagtgccgcttcatagttcggctcttcggtgatttcattcaccagctcgctgtacagcaccttatcgttctcatccagcaccaccaccgcgcgggcagtcaggcctttcagcgggccatcggcaatcgcgacgccgtaattttcaataaattctgcaccgcgcagtgtagacagcgtcactacgttattgacgttctcggcgccgcagaagcgcgattgcgcaaacggcagatcggcagagatgcacagcaccacggtgttgtcagcttcgccagaacgctcgttgaatttgcgcaccgacgcggcgcacacgccggtatcaatgcttgggaaaatgttcagaactttgcgtttgcctgcatactgagaaagggacacatcactgagatctttcgctaccaggttgaacgcctaattcaacgtggagctgcaccagcacgttatgacgtcatggatttgaggagtcagtatgagaacagtgaaaagttatccggaagcctggccgctgcactcgccgatggcctcaaagggattggcgaggccacgccctatgcgcgctatggcgaaagtgaggcttcggtgctgcagcagattgcttcacagcttggtgcgttacaaaacggcatgacgcgggcagcgctgcaacaggcgttgccggccggtgccgcgcgtaacgcgattgattgcgcgctgtgggatctggagcgccagcagcagcgcaccagcctggcggcgctgtgtgaggcggtgccggcacaggagatcgtcacggcgcataccgtcagcatcgatacgccagaagcgatggccagcagcgcgctggcgctgtggcagcacggcgcgcgcctgctgaaaattaagctggataaccatctgatcatcgaacggctggtggcgatccgcagtgcggtgccggacgccacactgatcgtcgatgccaatgaatcctggcatgcataa

SEQ ID NO: 42174 - DNA, 207 bp, Glycine max
  Peptide Sequence Number=SeqID_158952
atggagagcagcgaaaatttacagcttcatccaaatggttctgttctccaatgtagagtgattgggatcggagatgaaggggttgaggaaggggaagaggaaaagcgacatgatgaattggctagaatcgagcagattgatgggttgtctcgtgacgaggttgctgctttgttgggagatgaatcagctagcaaggaagacaaggtg

SEQ ID NO: 42175 - DNA, 744 bp, Glycine max
  Peptide Sequence Number=SeqID_158953
atggcgaatcactcaagcagcttcggcggtcgcagtggagttcgagtggtggtcgccggcgaccgctccaccggaaaatcgagcctgatagccgccatagcgacggagtcattcgccgaggccgttccgccggtccttccgcccaccctcctggcccctgatttgtaccccgacaccgttcctctcaccgtcgttgacacaccttccagcttggagaagcagagaaagcgtaatgaggaattgaaagcagctgacgttgtggtgttaacctatgcttgcaatgacaccgcgtcgttttcgcggttgagttcttactggttcccggagctgcagaagttggaggtgaaggtgcctgtaattgtggttggttgcaagctggatcttagggatgaaagccagcaagtgagcttggagtgtgtcatgacacagctcctgcaacagttcaaggaaattgtcacctgcattgaatgctctgctgctacgcaataccaggttagatgcttcaatgcaccattgcaatcctctgaaatagcaggagtcaaaagggttgtacagcagaaagtacctgaaggattcaactcacatggtcttacttttcctggatttatttatgtccacaatatgttcctcaaaaaagggcgtccagagacattatgggctgttctaagaaactttggatatgataataatttgaaactcatggatgatttccttcctgttccatctaagcatgctttcgatcag

SEQ ID NO: 42176 - DNA, 786 bp, Glycine max
  Peptide Sequence Number=SeqID_158954
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatgccccaatcgcagcctccaaggtgtcgatgcccgacagcacatgcaccacgcccttgccgatctccagcgtcttggccagctgcgcgcgcagttctttttcgttggccgccgtgaccttgacgctggccacgggcagctcgatggtgtgttccttgaagcggtccaggcgcgggaagcccgtggtcggcaggaaggcgccgtccacgcgcaggtgcgtatagcccttggggcgggcccagtcggccagctcggtgtacaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42177 - DNA, 693 bp, Glycine max
  Peptide Sequence Number=SeqID_158955
gatgaattagaagaacaaagcacacaaggtacgtttgtgccgcatggccggaacgacatattgaacactgcgcttggccgtgaagagcatcctggtcgtgtccttgctgctggacatggtgtcaccattagtagttactttggacagcgttcaagtgcctctaatagttctgctgctacgataaccccggatcagttggttcaaatcataggtaatctcaagcaagagtggacaaaagaggtagaagatgcaagcaaacaaaaaatggacatgctgcaaaaggagttggatgcaatcaagactgagttgtcccaaatgcaaactcaacagtcagcccctgtacaaccggctaaccctaatgtgttgattgcacgtgttagcaccaaagaaagttgtgcagaagctgttgcaaatgttgttgctggggacccatctgcggttgaggagaataccatgggattgtatgttgtttgtggcgacagtaaacaattggtggccttaggaaaggtgtatcaagttggcggcatgatacacaatgttccttacgcagatgaagtcgtgagggtttctgtggttactgtttatgatggtgatgcaagggtcccaattcccacacctgagattgaatacgttagggaggccatgaacacattcattggctggccaactaatcttgtcaaacctttctccgct

SEQ ID NO: 42178 - DNA, 309 bp, Glycine max
  Peptide Sequence Number=SeqID_158956
atgaaactgtgctcaagtctgtttggaagagtagctctccgaataaagtcttggatttttcatggaaacttttacatgacggtttggcaactaaagaaaaccatgattatgaagggccaagacatttatagttaccaagatgaggttactacttcaccttcctctagtgaaagtgaagcaaaaggggaagaatctagtgaagaaattgactcccaagaagaaagggaccttttaatggtcagaaggcttctaggtggtcaatcttgtgacttgtttcttttgaacgactcgaaagtcattttcaattaa

SEQ ID NO: 42179 - DNA, 256 bp, Glycine max
  Peptide Sequence Number=SeqID_158957
atgaaagccgcaactttactgctggccggagcagcgctgttactctctgcctgcagcagcaacagcgataatgaaccgccgcaacaggccaccgccgcgcacgtgcagccgcacgtcgtgatgtcgtccatggcagaagccaactgcaacagcgcaggcggcacgctggcgttctcgcgtcagttagacggttcacgcatcgggatgtgtcagctggctaacggtcgtcgctgcgacgaacaggcgctgatcggcg

SEQ ID NO: 42180 - DNA, 657 bp, Glycine max
  Peptide Sequence Number=SeqID_158958
atgttagccgacatgctcatccgcatcgcgttagccggaatactgggcggactgattggcctggagcgccagatgcgcgctaaagaagccggcctgcgcacccacattctggtcggtattggcagcgccatgttcatgctggtgtcaaaatatggctttgccgatatgctgactaacgaacatgtggcgctggatcccagccgtattgcggcgcaggtggtcagcggcatgggcttccttggcgctggcaccatcatcattcaaaagcagattgtgaaaggcctgacaaccgccgccggcctgtgggtgaccgccgcgattggcctggtgatcggtagcggtatgtacgaaatcggtatttacggtacggtgctggcgctgatggtgctggaaacgttccgccgtatcagccactggctgattggccgccatcacactcttatcgtccatctcaaagccaaaagcgtaccgctggtgttgctggtactgcagcgcgaaaatttgcgctatggccacatcgctgtggtcaatcgtaacgaagagagcggcctgtgcgagctgagcgttgaggtgacgttgtcacgcagatttcctatgcatagcatttatgacaaagtgatggaaatcaaaggcgtgcagtcgctggaaatggtttga

SEQ ID NO: 42181 - DNA, 586 bp, Glycine max
  Peptide Sequence Number=SeqID_158959
gcctgcattaactgtgtccgcgcacgctgcgggtcgctgcgctggcctttatgggtgccggctgaccgcagtcagcaggaaaagtctgtggcgtatggtacggattacagcgccaaattccagcacgatttatgggtttgccggtgatgcgctctgtgcgccgcgcgatcgcgcgatgaaaaatgttgtgttaagcatgctggcgaagatttcacaaattgatgccaccaccaagcagttgaccgcgcgcgttgaggctcagtcgctgctgatcggtgcgctggtactggccgtcagtaagaaaggcggcgtcactgaagttattgaaagcgccaacaaagccatcaacatggtgattgagtcagccgaggctgacgatatgctgaagtcggacgccgctattctgctgagcgagtttcaggatctgttgacgatttcgcgtgcggttgacagcgccgatgatgtcatcaatcagcaggcgctggaaggtattaccggcgtgccggctggtggggcaatgctatctggaactggcgcagcgcggtgccgctaccgaaaaagaggtgctggccagcgagttgcgtaa

SEQ ID NO: 42182 - DNA, 515 bp, Glycine max
  Peptide Sequence Number=SeqID_158960
atgaaagttgcggtttacagcaccaagcattacgaccagaaatacctcgagcacgttaacgaaagctacggatttgagctgcagttttttgacttcctgctgagcgaaaccacggcgaaaaacgccgctggctgtgatgcggtctgtatcttcgttaacgatgacgggagcaaagcggtgctggcggagctggcggcgctgggcgtgaaatatatcgcgctgcgctgtgctggtttcaacaacgtcgacctcgacgccgcagccgcgctgggactgcaggtggtgcgcgtgcccgcctactcgccggaagcggtagcggaacacgcggtaggtctgatgatgacgctcaaccgccgcattcaccgcgcttaccagcgcacgcgcgatgccaacttctcgctggacggcctgaccggtttcaacatgcataacaaaaccgctggcgtggtcggcaccggcaagattggtgtggcgacgatgcgcatcctgaaaggttttggcatgcgtctgctggc

SEQ ID NO: 42183 - DNA, 456 bp, Glycine max
  Peptide Sequence Number=SeqID_158961
atgacgcggggcctccgtcgactacttgctgcgctactggcgctgatactgctgctgctgggattgctgctgacgctgacgcactggctgccgcggctggcaggtatctggctgccggaaaatacccgcgtcgagctacacggcgcgccgcactggcagcagggccggctggtgtttcctgatgtgcgctatctggccggtgactgcctgctggcgcagcgattgtctgcaggcgctgccgcacagtgccacgcgcgatgcgccgcgcagcctcgcagagtggcagcagatgctgcccggcgcggatatccatctgcaacagctcagtattttgccatggcagcaatatgccggccgcttcgatctgaccttagacaaggaccttcagcagctgcgttatcagggcgacaacctgcgcgtcgccgcgcgcctgcaggggcagcagctgcacattga

SEQ ID NO: 42184 - DNA, 198 bp, Glycine max
  Peptide Sequence Number=SeqID_158962
atgcaagctgttttcttagtttcggggcaaggatcatgtggtactggcgtgttcttaccccaaaaagcaggcacaaaatcaaccagcaagccagcatgcgctcctgtcctccttccagcccgagtagttcaagctctaaatcttaaagtgcaccaattaggcctgcagatttcaccttctcaaggtctcgtatcctag

SEQ ID NO: 42185 - DNA, 900 bp, Glycine max
  Peptide Sequence Number=SeqID_158963
atggaagcaacgcgattctcccctaatcacttctatccacactgcttccttaccaaacccaacgcactcagagaaagaagatacgtaaaatgcatcaacggagttggaactagggtttaccttttcacaaaccccgcattcaacaacgcaccgaaccggtctttgtttccgaagctgaaccggactctctctgttagcttctccgaccggctccgagatgattatgtgcgcgtcgatgctccgaggagcaaggaagttgttccggcgacacgcggcggcgatggaggggaggcgattcttgcgtcgtctccgagtgctgacaactcgggaaccctgcaactgaaaccattgatgttcaggaacaggtttctgaactttgcgcgattgggttctgtgattaacggcgccgcggaatcgtttttcaagagcgagattcggaggaggctgttcgtaacggctgtgttaattgtgattagtcgcgttggctattttattcctcttccggggtttgacagaaggttgataccggaagactacttgagctttgtcgcaggatcatctgttgatgaacttggtgacttcactgctgagctcaagctatctattttccagcttgggatcagtcctcagataatcaatcgcgtccattattgtgcagccttttatgaactgcatttatacaagatattcatgtgcagatggtggatgtcatttggctttgcaattttggaagctttaatagtggcttgttactcacttccatattcaatttatgctgccacttatagggtcaagcatgtaatggtgacatctgttttattggtttgtggtgcaatgactattacatggatatgtgataccatatcagaatctggatttggtatttttcttgccacataa

SEQ ID NO: 42186 - DNA, 1482 bp, Glycine max
  Peptide Sequence Number=SeqID_158964
atgattgtcactgcacagcatgaccacactgttcaaggaaccaccactcgtccttttcacggcttccctatttgttttgacgaaataccaaggttgcccggaacagcatatgccaggaggcagcatttatggctcagtggtgcaaacgaagtagacagcaaaactttttcaagagctattcttgccaagacagtggtgtgtattcctgtgttggagggcgtcgttgagttgggcacaaccgataagatcgaagaagacctaaatttcatccaacacataaagagcttcttcatagatcagcagcctcctcctcccacggcaaagcctgcactgtcagagcactccacctccaatctcacttcttcataccctcttgttattgttcctgtcactgctgccgccaccgccaataatgttctcatccaaaacgacatgaacattgttgataaaggagaagctattatattgaataataataataataataccgaagcagaattattagcagaccctaacagtaacagtttcataccgagcgagctaatggagctggaccaccagttggaggaattcggggtcggatcacctggagatggctccaatcacttggattccttccccaaagaggagtcaatggcactgtgtgctgcagggttggagctccttcaacttcaacgaccaccagctccagcacatcctcccacagaaaatctagcacaaggcgacacagacacccactactctcaaacagtgtccagcatccttaaaaagaactccagcaggtggtggccggattcaccctccgtcaaccaccccactgactccttccaatcagctttcaacaaatggaaatccgacactgacaaccaccaccactatttccacgagacggtggccgatggcacctcgcaggggctcctcaagtacattttgttcaacgtcccttacttgcacgccaaccggctcaagggcacgggagcttcgtcatacgagactaatcacgtgatggcggagcgccgcagaagggagaagttgaatgagaggtttctcattctacgttcgatggtacctttcatgatgaggatggacaaggagtccattctggaagataccatccactacatcaaacagttaagagagaagattgagagtctcgaagcgcgtgagcgcctccgggggaagaggagagtgagggaggtggaggtttcgatcatagagagcgaggcgctgttggaggtggagtgtgtgcatagggaaaggttgttgctggatgtgatgacaatgttgagggagttaggggtggaagtgatgatggtgcagtcttgggttaaggatgatggagtgtttgtggcggagatgagggccaaggtgaaggaaaatggtaacgggaaaaaggctagtgttgttgaagtgaaaaatgcccttaaccagattataccacatcatgagccatacacactttgttccaatgatcacttttaa

SEQ ID NO: 42187 - DNA, 159 bp, Glycine max
  Peptide Sequence Number=SeqID_158965
atggcttcacctcagttcccaactccatctcctgaggttaatgacaaattcagggaaaaggacatacgagggtatttgctggtgcatgtaaaggatgaatcctacgacgtcgtagatggtgtgaaagatggcggagccgcccaaggtatcggattgtga

SEQ ID NO: 42188 - DNA, 336 bp, Glycine max
  Peptide Sequence Number=SeqID_158966
atgagggatatcaaggtggggaccaagagattggataagttgatgaattcacttttgaatatgcaaaccgcgtttaagaccatgatcagcgaggttcccatcgtagacggtgtcgttttggcgctcggagctagcccacttcgacctcagcatatttatgtcttgaatttttcctctgcaaggttaatgatgattttgcgaggagtaaagcggccgacacttttcgagaaaggtcctatcaaattgtttgtgttaatcaaggccccttcttctttcaatcagcctatgcattttcctcctaaacgtgactttaggtataacagaaagggaatgtaa

SEQ ID NO: 42189 - DNA, 366 bp, Glycine max
  Peptide Sequence Number=SeqID_158967
atggctacgccgccaaatagcaggcttcacaccatgttgcgggcatcagtgcaatcagttcagtggacttacagcctcttctggcaactttgtccacaacaagggatattgacttggggtgatggatactacaacggagcaattaagacacggaagacagtgcaagcaatggaggtaagcactgaggaagcgtctctgcaaagaagcgagcaactaagggagttatatgaatctttgtctgctgaggagacaataaacacgcaaacacgaaggccatgtgctgctttgtcgcctgaggatctaactgaatccgaatggttctatttgttgtgtgtctctttctcctttcatcttggtatcgggtaa

SEQ ID NO: 42190 - DNA, 192 bp, Glycine max
  Peptide Sequence Number=SeqID_158968
atggaggaacgtcgtaagagaaaaggggctgcgcagggatttctggaaaatgtgatatttatagagcaggacgcgtggaggaggcagcctactggtaatcgattacatgaatactgtaatcgattacaggccatctgttctagtgtaatcgattacagtattcatgtaatcgattaccagaacataaaatag

SEQ ID NO: 42191 - DNA, 796 bp, Glycine max
  Peptide Sequence Number=SeqID_158969
gttaccatcagaccacagagagattgaggctgctctttgcataccagggatggggtttattttaaatgttgagggccatccgaggaggattctcaagaaggatctgactaccttggcccaggtgtggagtgttctctcgtactccaacctgacccctacatctcatacatcagaccttattgtggacagagtcagacttgggtttcctactttgcttaccaccttatgccgagcccgaggggttgtctctaacaacctcacatttgagcgcctgagcccggctattaacttggcatacatcaggaagaactgttggaacattgatgatctaacagttgctttcccgggggctaggagggcgagggtgaggccagttgatattccatctacttttgcaactccatcacctactccaacatctacttttgcagctccttcagtcccagctcatatggtatcttctccagaatccatcctatcagtggatcagttcttagagaaggtagcttggcttggggcccatccttctcttgatagggaaggtggaggtcccacagcccaggtagcccaacaggtacaggatgcttcatttgagaccaccattccagagccattcactcttcatcatgaggtaggtgaagaacaggtgagaccaaagattgatgttacttctgagagatcacttgagggcacatcagagcctcctactcccaccacaccagtcctggcactgaacacctctcctccagctactccagtacttcacttgacagatgaggaggatgctcagacttag

SEQ ID NO: 42192 - DNA, 243 bp, Glycine max
  Peptide Sequence Number=SeqID_158970
atgggtgaagtagaggagatacaagagaagatgaaggccgacatggaggccattaaagagaaaatggccacaatgatggaggccatgatgagcgtgaagaagataatggaagccaatacggttgtaattgccactaccagcgttgttgctaaggtgaaccctacgtccccatccggcatcaatgaatcatccaacctcagatatggtaggcagagatttgggaagtatagacggcccccatga

SEQ ID NO: 42193 - DNA, 159 bp, Glycine max
  Peptide Sequence Number=SeqID_158971
atgggagatcggttggcggatatgattcgtgaccttggacaaaagtcttttcaacaagcccatgtccctgtgtatgaaggattgcagagtgactcaaagaagcctttgtatcaagggtgcaagaattccttgacgctgttgtcaacgatcttaagtctg

SEQ ID NO: 42194 - DNA, 441 bp, Glycine max
  Peptide Sequence Number=SeqID_158972
atgggcattaatccaacaaaatatgcaacaattgcgatttgtttgttttgcctatggagtgttgctgagtgtatccccaacaccagcatcatcaatgttctctgcaacaatggggtgtacacttctggggacccttttgctattagtctaagctatgtttttggggacttagagaaggaaacaccagcacagaagaattatgactaccacaacatttcaccctatcctaatgcctatgcctatgggcatgctacttgtaaccttaatctgacatcctctgattgcaaaacatgtcttggtgctgctaaagcggccttgtttagcacatgccagacaccacggatcggggctcgttcggtgctctatgattgtgcaatcagtgcacgtttggaactaacttctacatctaaagttgcacatttccaacaaaaatcagtgtaa

SEQ ID NO: 42195 - DNA, 1359 bp, Glycine max
  Peptide Sequence Number=SeqID_158973
atggaatcaactcacgtactagccattacaaatgaagaagagaatattgctcgttcaaaagagaataaaacattccaatttcatcttccccccatcatttcccatcttgggaaaaatgaggtccactgtgtctccattacttccaatcctagacacaagcagatgcaaagtggtggccatgatatgaggaagataatccactgcatcaaagtgggaatctccttggttttggtttcactcctgtacctcttgaatcctctctttaagcaagttggagaaaatgcaatgtgggctatcatgactgttgtagtcatgtttgaattctctgcaggagccacaattggaaagggcttcaatcgtggactaggaactattataggaggtggactaggttgcttagcagcagtttttgcccaaagcattgggattggcaggcttggcaactcaattattattggtgcttcagtatttatatttggatcagttgctacatatcttcgactggttccaagcataaagaaaagatacgattatggggtgatgatattcatgctcacattcaatctagttgtggtttctggcgtacgtggggatgtgaaagtgtgggacttagccagggagcgtctcttgaatatactaatgggcttcattgtgtgcgtttgtgtgactttgtttgtcttccctttgtgggctagcgatgaacttcatgattccacggtctcaagattcctggaccttgccaacacaattcaagtttgttttggggaatgtaccaaaatcgttagtggaaaggaaaaccaacctcgtgctagcttcaacgtttgcaagtcagtgttgaactccaagtcaaaggacgaatcattggcaaattttgcaaaatgggaaccctggcatggaaaattcggattttcctacccttggggaaggtacttaaagattggtgaagttcttcgagaactggctgcatttattcttgcagcgggacgttgccttgaagcatcaaaagagcccatggcctctttgagacggtcaaaatgggtccatttagaaacatgcgaagcagttgagtcaaaggttgtgtttattctacgagaacttggagaaagcatgaagcaaatgaggaaatgtgatgcaaagggcaacatttcgggccagttgaaaaatgcaagagaagatttaagcttgataatttccacatctaaaatggtggaacttgaggattgccaagtgctagcaattgctagcttcgtgttcttgctcatggaagtgatagggaaggtagaggaattggtgaaagaggtggaggagctcgaagacattgctggttttcgcaccaccacaacttcattgtcttcgtag

SEQ ID NO: 42196 - DNA, 1431 bp, Glycine max
  Peptide Sequence Number=SeqID_158974
atgagcaagagcgtaacagcaacaaaggactcaggcgacaacaccgcgacccacttgaattttttcgagaaatttaaacgctttaaccctctcgagtcttccttgggagtactagccttcttcttcgtcgcttctctcttcattgccagcttcttctacttggattacaaaggcttccgctccaggggcactgccactgtccttcacttggatttctcatcaccatcttcttctgccccagttcagtttctgagccaagacggtgataaatgtgatgtctttgatgggaaatgggtttgggatgagacttaccccctttaccattccgcaaattgttccttcccggatcaaggttttcgctgctcccagaatggcaggcctgacactttctacaccaaatggaggtggcaacccaaagattgcaacttgcccagtgcctgtaattatctgctgttgacttacatcttggaaaggaaatataatgtgggagtgtactcttgtaacagatttgatgcaaggaagatgttggaaaagctgcgggacaagcgactagtttttgttggagattcgattggtaggaaccaatgggaatcactcatttgtatgctctcttcggcaattgcaaataaggctagggtctacgaggttaatgggagccaaattacaaggcacatgggcttcttggcatttaagtttgaagatttcaactgtaccattgaatactacagatcacgatttcttgtagtgcagggacgacctccttttggagcacctgatggggtaagaatgactttgagagtggatcatatggactggatttctaataagtggagagatgcagatgtgctggttctcaatgctggacattggtggaactttcagaagactgtcagaatgggttgttacttccaaataggggaggaagtgaagatgaatatgacaatagaagacgcattcagaaaatcaatagagactgtagttgattggattgccaataaagtagacatgaacaaaacttatgtcctttttcgaacttattcccctgtccatttcaggggtggtaactggaatactggtggtggttgtcacttggaaacattacctgatttaggctccttgccaccagtatctgacatccatttcagaaatgtcgttgatatcttgtcagaacgcatgaataaatcagaagttttgaatctggacttgcttaatgtcacgcaaatgtcaatacatagaagagatggccatccatctatttactatcttggaccaggcaggacatcctctatgtggcggcaagactgtagtcattggtgcctacctggcgttcctgattcatggaacgaaattctttatgcacttcttctcaagcgggaggattttttcgaacggagacagcatacaacaaaagtttctcaagttccactataa

SEQ ID NO: 42197 - DNA, 198 bp, Glycine max
  Peptide Sequence Number=SeqID_158975
atggaattcacatatgatggctcacctgaacaaatggcacacaccgagatgaaaaacctcgtcgggcgcctaggagtacatgacaggacatgcctcacaatgggcttacaggagcactcaaaccgaatgacccccaaggcctacactccgaagagtccgtcagggcctctccctcctgattcagtgcgcctcaagtga

SEQ ID NO: 42198 - DNA, 1259 bp, Glycine max
  Peptide Sequence Number=SeqID_158976
gattatcgccatgtcagttgcaccagttgacagtattccctcattaagcagtgatctcttctatgatatatttcgtcgacttgatggtgcaacattggctagtgcagcatgtacttgtgcagcattgtgttccatctcaaaagaagagaatttatgggagaatgtatgttcatctatgtggccttcaaccaatagagaggatgtcaaaagtttaatatcttctattggtggattcagaaaattctatgcagattgtttcccgcttattgtaaacaaggaggttgtagagtatcaactgaacaactatctcgagtacccggacaattggactgaagctgaatattatggggacatgaatgaatctgaaagcatctctccatcagattttgtttctatagtagatattaggttcaaggggaaaccaatctgttccaaagttctctggggaattccaaatgcaaatggctatgatggttggttctataactgccctttccggattgatattctcacttatgcagatagagatgatatcaatgatggagcggttcatctttctgtaactgatggtctgccaccaattacatccttggagagggaaaggaaagatgggaagctgtggcaggtgctccatgaagggctccagcttagttggattatagtaaacaagaaaataaaacaggctgcaaatcttgctagttggagccctcttggtggtcaaagacactggccaacagataaggattttgttatccgctttggatcagttctacctgccagggacattcttccttgtcaggtagcggagtgtattcttattatgaagtttagagtggttcacactgaagaagatggggttcaaacaactcttaaattaacagagctgagcatgcagttggaagacatggaaggtgctcatgttaatggaagaaacagtttgcatatacttaaggaagcacttagcagccgaaggagcaaaaattatggtgaagtacttgagtcttgtcatatgtatttgaaagtacagaatgagttgaaagaggagaagatgagaaacgaaactgggtggactagcccaaagccgaaggaatggaattatgctcgaatttgggttcttgttgcttctgctggtcatcacacagacaacgatgatagtggtcgtgtcaacaacgacgatggtagagataccaatggtggttgcactgacagtggcgatagaggtgatggtgatagtagtagttatgtcggtggtggtggtg

SEQ ID NO: 42199 - DNA, 342 bp, Glycine max
  Peptide Sequence Number=SeqID_158977
atggtgataaatgaagctggggtggaatgccatcgtaggaggctaaatgggagcacgcaatcttgcataaatacagagaagaagagaagagtgaagagacgaaggatggggaaggcaaaagaagcggcggtggtggcgggagccctagcattcgcgtggctcgctatagagctcgctctcaaacccttccttaccaaggcacgtgcttccatcgacaagtccgacccggcacgtgaccccgacgacgatgctcttcctaaaaccaccgccgacgacgttcccgaagcctccgctgacgacgtgcctgtcgctgctgataccaaaaccaccgacgacgcctga

SEQ ID NO: 42200 - DNA, 578 bp, Glycine max
  Peptide Sequence Number=SeqID_158978
tcttgtgtgtgacctcaaaaccctgccgtcagtcaccgtcttctctgccgccatgaagctcgtcaggtttctgatgaagctgaacaacgaaaccgtatcaatcgagctcaagaacggcacagttgttcacggcaccattacagactccgcgaaaatcataatcgcgggcgccttatgtgtcacggaatctcattgcgtcacggctgttgtgtcgccagtttctggcaaggtcacgtctgcagtctgcacggaacttcagttcagagttgttttgggcttgcggacaaggtttttggctttgttaaaactcacgtcgcggatcttgtgtctcctttcagaaattgcagagcggcgaagtttctcagccgtgatagagcagagtcgaggtgttgatatcagtatgaatacacatttgaaaacagttaaactaactctgaaagggaaaaacccagttactttggatcatctcagtgtgagaggcaacaacattcgatattatatccttcctgacagcttgaatcttgagactttactggttgaagaggctcctaagatcaagcctaagaagccaactgctg

SEQ ID NO: 42201 - DNA, 741 bp, Glycine max
  Peptide Sequence Number=SeqID_158979
atgaacgcctgtaagcttctagttggatttgaaactacctctgacttgtgggtcatttccttgctgccattctatgaaaggtggaaattgctggagaaagaagtaattgaacctcgtaatatggaacgtgagggcctctcaaagagtataaatccttattatagatatgacttggaaccatttagtgtgaggaggaagggtttttggttactatctaccgtgtcaaagctccttcataaattcattccacaactatcgcattcatcagatggtcttgtattccagggttgggatgatccatatgtccctcgcacacatgaaggtcttctgaagtggaaataccctgagatgaactctgttgatttcctctgtgaggttgtacaagtgggagctggtgatcgtcccttgctttttctatttgaacgaggaaggaagaagttaatggaagagaatgttatttttaaagatgcatcggacatttcttcctattcagggaagatcattgaatgctactgggattctgcggagcatcattgggtctgcatgcggatcagaatagacaaagccactccaaatgatatcaatacctatagaaaggtaatgcgaagcataaaggataacatcacagaagatgtattattgaatgagatcaatcagatcattcgcctacccttgtatgcagacagaatacagagggatatcaaggctcaccagcatatgatctctttgcggcgcaagtga

SEQ ID NO: 42202 - DNA, 927 bp, Glycine max
  Peptide Sequence Number=SeqID_158980
atgtcaagagtgatgtgtagaccaacgcagccactgaaaaacgttcctactaatacatccagtggccaaaaccagataataaggccaaaagagaaggtggtgttggtgatgggagcaaccggaagcggcaaaacgaggttgtcgatcgacctagccacatgtttcccatcagaaatcataaactccgacaaaatgcaagtctattcgggcctcgacgttgtcacaaacaaagcaacaaaagaagaacaacgtgggatccctcaccacctgctagggacacagaaccccaacaaggagttcactgcctctgacttctgcgacatggcgtcacacgccattgaatccatcacaaaccgcgagaaggttccaataattgttggaggctctaactcatacatggaggcccttgtggacaagttcgggacacgttacgaatggtgttgtctctgggtggatgtttccacgcccgtgcttcattcctacgttgcgcagcgcgtggatcaaatgattggtggcggaatggtgaacgagctgagaccctttttcagtcccaacggggattactcgaaggggataagaaaggccattggggtgccggagttccacgagtattttcggagagaagcgttttcaagcaccgaaatgaggatgaggttgctgcaggacgcggtgagggaggtgaagaggaacacgtgccacttggcatgcaagcagcttgggaggattcagtggctgaggagtgttaagggatggaagattcaccgtgtttgtgccactcccgtgttccagaaacgtggccaggaagcgaatgatgcgtggaagaacgttgtggcacagccgtgtgcctccatagtttcccagtttctctatagtgccaatgctgtttctgggagagtgccagcttctttgcagcaaaatagtcattaa

SEQ ID NO: 42203 - DNA, 1344 bp, Glycine max
  Peptide Sequence Number=SeqID_158981
atggttcaaccattgacgacattgatgaagaaaaagggattctatgggagaggagcaagagtgtctttgccctgcttggcttttttccctgtgctagcattgccggatttcactcagctttatcggtgcaacacctgcggcactacctattgggtcgtagttttaaggtctatacagaccatagcagcttgcgtcatttgctccaacagcggcttacaaccactgatcaacagtgttggttggagagttaggggcatttccataagcccaatatgggtggacttccccaccatttgcaccgaggaccagcaagatccagaacttagaaaattgtccgcccaagttcaagctaatccagctttggtgccacaatatgttcaacgtgatgggatcatcttcttcaaagggcgcatgatgttgcccaagacttctgctatgattccagtactcttagcagactttcattctactgtgagaaacaaatatcaagctttgtctcctatattgcaacccattccgattttggaagtggtttggggcgatatatctttagacttcatctctggtttacctcgctctcaggggtttgatgtgatacttgtgattgtggaccgcttatcaaaatatgcccatttcctttctttgaagcacccatatacagctcacacagtggctgaggtgttcattcgtgaggtggccaagctgcatggatttcccaaatccatcatcagcaatcgcaatcctctgtttttgagtaaattttgtagtgaattgttttgtctccaaggaacaacgttgaggatgagcactatatctatcaccctcaaacagatggtcaaacagaggttgttaatagatgtttggagacctatttgcattgtttcgcttctgaaaaaccaacgaaatggaatctttggctctcttgggcggagtattggtacaatacttccttccactcagccacgggatagactcccgaggttgtttatggacgagacacaatttctgctaggagagacacaagttgattcagtagcttcggtgttggttgacagagatgaggctatccaccaactgaaatttcatctgcatcgcgcccaacaatccatgaagaaggcggcagataagcattgtcacgctgtgtcatttgcggaaggggattgggtgtttgttaagctgtgccctcataggcagcatactgtggcctgtcgcattaatcctaaattatcaacctgctattttgggccttttaaaatattatcacgagtaggggaggtggcctacaagctgaagcttccggaatctgcaagagttcaccctgtctttcatttgtcacagctctag

SEQ ID NO: 42204 - DNA, 1344 bp, Glycine max
  Peptide Sequence Number=SeqID_158982
atggagatgattgtgtatgtcaaatgtctcacttgttcagcatgggtaggttggttagactgcccaccacatgggcaagaaataggatgtataatcccttcaaaggttccacttggtgattccttcaatgattacatttcaagtcaaaaatatactcccaagcaagcaattcatcaacaaagagtcttaggtagagaacttggtttagtgattgatctgacaaatactactcgctactatcgtgtatcagattggacaaaagaagggattggtcatgtcaagataagatgcacaggaagagatgctgtacctgatgatgaatccgtaaaaaaattttgtgataaggttctggatttttgctcccaaagaacaaacacaaagaaatatatacttgtacattgcacacatgggcataatcgtacaggttatatgattgttcactttcttgtgcgcacggaatctatttctgttactgaggcgataaataaatttgcttgcgcacgccacccaggaatttacaagcaggactacattgatgccctgtacatgttttatcatgaaaagaagcctgaagatcttgtttgtcctcaaactcctgaatggaagagaatttctgatcccgattttcgtggcacagctgttccagctgtggacaattgtgcacacattcctgaacagtgttgccactgggttgaataccttacttcttggcatgtaatttacttccaacaagtttgtgtgagcatgagtctgccagggactattgtgaggaatgaagtattaacaagtgatgatgctttgggagatccaattcctccaaaccagctgcgttcaatgcaagaactttgttatcaactgctcaagttgggcacagggggaagaggatgctggcagtttcctggatcacaccctgtttctctgaacaggacaacatcccagcgtctcgatgccattgaggtcgatctcgcagccatcaaacttattcttcagtcccatgagtccttcatttcagccaatcttccaagctcgattcctttgtctcctttgtcaatgcgcgagtctcacttttccaactcagcaggatcgttccatcattcctctgcaactagcggtgcttcctctaacgatgttgctctgtactcgaagtgtgtcgatcttcctccctttgttggtgacaaccctgtggggtggttagccaaggccgagacctacttttccgttcagaacaccccgtcagaaacatgcatctccctcgctcagatttgtatggaggggaagacatggcattggttcaagttcctttccaactttgatccaaacctccattgggactccttcaagtag

SEQ ID NO: 42205 - DNA, 294 bp, Glycine max
  Peptide Sequence Number=SeqID_158983
atgaaaagcaattacatcaactgttcattagaaatccctaactatggttttttagccagccatacaaggaaccctactacaaatgagacaggaagtacaaagcaattgttgcttacacaggaagaggatccctcatccttttcatggcacctcataatcgctcaaacactctctaatctctcaaaatttccttgtcacgctaagtgctctaaagatgcgcttagcggtggatgcgtgctaatcccacaaggtctacttagcccgacggctccttttagcacttcacgattttag

SEQ ID NO: 42206 - DNA, 261 bp, Glycine max
  Peptide Sequence Number=SeqID_158984
atggaggattgggagaattttctccaccaaatccttgaggaggatttcgaggattccactcctattaaagtgttcctcttgatctcgcttagcgagctcgtctcactaagctggagtccagcctttgcgcttagcgcgacaattagggctcgcttagtgggccaaaactcactcagcgcaactccctctcgggttggaattgcgcttagcgcgcccctgctcgctcagggcaatcccctctcgggttggaattgcgcttag

SEQ ID NO: 42207 - DNA, 699 bp, Glycine max
  Peptide Sequence Number=SeqID_158985
atgacactaaagaaccaaagtacagatcctcgtatctattctcaaggaaaatattctgtgtcttactcttccacggaaagtatagttagtgtgctactatggctgaaaggaagaggagatgagtacagaaacattctgggtttggtaacaagcattgatctgtcaagtaacaagttatttggggaaataccaagagaaatcacatatctaaatggattgaattttttaaacatgtcccacaaccaattgattggtcatattccacaaggtataggtaatatgagatcattacagtccattgatttttcgaggaatcaactttttggtgaaatccctccaagcattgcaaatttgagctttctgagcatgctagacttgtcttacaatcatttgaagggaaatattccaacaggaactcaattgcaaacctatgatgcctccagcttcatcggcaacaatctatgtggtccaccactgcccataaactgcagctccaatgggaaaacccatagttatgaaggaagtgatgggcatggagtgaattggttttttgtcagtatgacaattggatttattgtgggattctggatagtgattgctcctttgctgatttgtagatcatggcgagggagagtagctgaacgtaaagaggggaaggataggaggtgtgggggaatggaactaaggataaccaagtaa

SEQ ID NO: 42208 - DNA, 1458 bp, Glycine max
  Peptide Sequence Number=SeqID_158986
atgttgttgcatgagctgaaccttggtatgagggagttccaaccagggaacttcgtgtacgatgctgaggatattccatttgggacgctgtggtggttcttttatgctggaatctcttgtttgctcgttctattcgctgggatcatgtctggtctcacccttggattaatgtctctgggtctcgttgatcttgagattctccaacagagtggctcctccactgagaagaaacaagctgctgctattttgccggttgtacagaaacagcatcagcttcttgtgaccttgcttctttgtaacgcctgtgccatggaggcacttccaatttaccttgacaagatttttcatccctttgtagcagtagtgttatctgtgacttttgttctagcttttggagaggttatcccacaagctatatgcacaagatatggactctatgttggtgctaattttgtggggcttgtgcgtgtcctgatgatcatctgttatccaattgcttaccctattggaaaggttctggatgttttacttggacacgatcatgcactgtttaggcgagcacagctgaaagcccttgtttcaatccatagccaagaggctggtaaaggaggtgaactcactcatgatgaggcaacaattatcagtggagcactagatctcacagagaagactgcagaggaggctatgacaccaattgaatctacattttccttggatgttgcttccaaattggactggatgttgttggctactagtaccaatggctatgtttggattgatgaaaagggatgggaagcaattgggaaaattcttgcacgaggtcatagtcgtgttcctgtatacagtggaaaccccaaaaatataattggcctcttactagtaaaaaaccttcttactgtaagagctgaaacagagactccagttagtgctgtttccatccggagaattcctagggttccagcagatatgcctctatatgatatcctcaatgagtttcaaaaaggaagcagtcatatggcagctgtagttaaggttataagagagagaaacaaccctcagtcacccaatgacactgagaaatccaaggataaggaagtcatcaaacataattctcaactaactatcccattgctatccaggttttatgaaaaatcagaaaatgttgtcaatattgacaaacccaagcttgctgcagaccaacagtttcaaaaggatggccctgcaacaaatggtgtttaccactctcttgacaatgctgaagatggggaggaagttattggcatcattacgctggaggacgtgtttgaagaactcctgcaggaagaaattgtggacgagactgatgtgtatatagatgtacatagaagaatacgtgtggctgctgtggcagctgctacatctgtggcacgagttccttctggccgaaagttaacaggtcacaagcctatagggaattaa

SEQ ID NO: 42209 - DNA, 174 bp, Glycine max
  Peptide Sequence Number=SeqID_158987
atggaagatggagtgaagggaatttgtggtggattggaaattgtggcccgtgggtgcagaaataggacatgtcccactgtccacctaagatatctaagtgacacctatgagtttgtctccttatcgccaaacccagttgagaaggacttctcatccacttctactaaaaagtaa

SEQ ID NO: 42210 - DNA, 192 bp, Glycine max
  Peptide Sequence Number=SeqID_158988
atggctctcaatcattgcccatattttcgacgagctaaaatatgttctaagtatgcattggatgtcgtctcgaggttcggagcgtattacagagcaagagtctggccaggacctgctcgaatcgaaaagagaggagagtctttaagaaggaattcccaggttcaaaggagtatttacgaagtacaaagctaa

SEQ ID NO: 42211 - DNA, 240 bp, Glycine max
  Peptide Sequence Number=SeqID_158989
atgccaaatggaaagcatgttggcattgtggtacgtgtcaatggacctgatacagcacctgtctacaaattccttaaagcaaataaaacaggatttctgggtagtaggataaagtggaatttcactaagtttttggttgacaaggaagggcatgtcctcgctcgttatggtccaaccacctcaccgttgtccattgaagtacaatctctctctatttctctccatggagtgcatatgtga

SEQ ID NO: 42212 - DNA, 414 bp, Glycine max
  Peptide Sequence Number=SeqID_158990
atgataactctagacctgttccacaggattggataccactacaaagctgctgataaatctttgcttcaaggcaagcatgatccttcattgtttatattacatcaaggacctcattgcatttttatccttgtttatgttgatgataccattgtcactggtgattctctatgcctcattcaggatttcattgacaagctgcattctgaatttgctcaacaatttggctccattaattactttcttggtattcaagtccagcctctccctgatgatctaccgttggtgccctgtactatgttattattacaatttacaaggcctgaaatcagctatgctggaaacaagacctctcagtttatgtctcagtctttggaggaacactggaagtctggaaggcagtcaagttcgttttaa
